US009441224B1

(12) United States Patent
Kim et al.

(10) Patent No.: US 9,441,224 B1
(45) Date of Patent: Sep. 13, 2016

(54) LONG NONCODING RNAS AND CELL REPROGRAMMING AND DIFFERENTIATION

(71) Applicant: CALIFORNIA INSTITUTE OF TECHNOLOGY, Pasadena, CA (US)

(72) Inventors: Daniel H. Kim, Los Angeles, CA (US); Barbara J. Wold, San Marino, CA (US)

(73) Assignee: CALIFORNIA INSTITUTE OF TECHNOLOGY, Pasadena, CA (US)

( * ) Notice: Subject to any disclaimer, the term of this patent is extended or adjusted under 35 U.S.C. 154(b) by 0 days.

(21) Appl. No.: 14/120,786

(22) Filed: Jun. 27, 2014

Related U.S. Application Data

(60) Provisional application No. 61/840,306, filed on Jun. 27, 2013.

(51) Int. Cl.
| | | |
|---|---|---|
| C12N 15/11 | (2006.01) | |
| C12N 15/113 | (2010.01) | |
| A61K 31/713 | (2006.01) | |

(52) U.S. Cl.
CPC ............ *C12N 15/113* (2013.01); *A61K 31/713* (2013.01); *C12N 2310/14* (2013.01); *C12N 2310/18* (2013.01)

(58) Field of Classification Search
None
See application file for complete search history.

(56) References Cited

U.S. PATENT DOCUMENTS

2014/0142160 A1* 5/2014 Lee ...................... C12N 15/113
514/44 A

OTHER PUBLICATIONS

Ameres, Stefan L. et al.; "Target RNA-directed trimming and tailing of small silencing RNAs"; Science; Jun. 18, 2010; 328(5985); pp. 1534-1539.
Anders, Simon et al.; "Differential expression analysis for sequence count data"; Genome Biology 2010; 11:R106; 12pp.
Aravin, Alexei A. et al.; "A piRNA pathway primed by individual transposons is linked to de novo DNA methylation in mice"; Mol Cell.; Sep. 26, 2008; 31(6); pp. 785-799.
Aravin, Alexei A. et al.; "Developmentally Regulated piRNA Clusters Implicate MILI in Transposon Control"; Science; May 4, 2007; 316(5825); pp. 744-747.
Boyle, Elizabeth I. et al.; "GO::TermFinder—open source software for accessing Gene Ontology information and finding significantly enriched Gene Ontology terms associated with a list of genes"; Bioinformatics; Dec. 12, 2004; 20(18); pp. 3710-3715.
Buganim, Yosef et al.; "Single-cell gene expression analyses of cellular reprogramming reveal a stochastic early and hierarchic late phase"; Cell; Sep. 14, 2012; 150(6); pp. 1209-1222.
Carey, Bryce W. et al.; "A single-gene transgenic mouse strain for reprogramming adult somatic cells"; Nat Methods; Jan. 2010; 7(1); pp. 56-59.
Chang, Gang et al; "High-throughput sequencing reveals the disruption of methylation of imprinted gene in induced pluripotent stem cells"; Cell Research; 2014; 24; pp. 293-306.
De Hoon, M.J.L. et al.; "Open source clustering software"; Bioinformatics; vol. 20; No. 9; 2004; pp. 1453-1454.
Eppig, Janan T. et al.; "The Mouse Genome Database (MGD): comprehensive resource for genetics and genomics of the laboratory mouse"; Nucleic Acids Research; 2012; vol. 40; pp. D881-D886.
Guttman, Mitchell et al.; "lincRNAs act in the circuitry controlling pluripotency and differentiation"; Nature; 477(7364); pp. 295-300 (29pp.).
Hanna, Jacob et al.; "Direct cell reprogramming is a stochastic process amenable to acceleration"; Nature; Dec. 3, 2009; 462(7273); pp. 595-601.
Hayashi, Katsuhiko et al.; "Dynamic equilibrium and heterogeneity of mouse pluripotent stem cells with distinct functional and epigenetic states"; Cell Stem Cell; Oct. 9, 2008; 3(4); 21pp.
Hayashi, Katsuhiko et al.; "Resetting the epigenome beyond pluripotency in the germline"; Cell Stem Cell; 4; Jun. 5, 2009; pp. 493-498.
Johnson, David S. et al.; "Genome-Wide Mapping of in Vivo Protein-DNA Interactions"; Science; vol. 316; Jun. 8, 2007; pp. 1497-1502.
Kelley, David et al.; "Transposable elements reveal a stem cell-specific class of long noncoding RNAs"; Genome Biol.; 2012; 13(11); R107; 22pp.
Langmead, Ben et al.; "Ultrafast and memory-efficient alignment of short DNA sequences to the human genome"; Genome Biology; Mar. 4, 2009; 10:R25; 10pp.
Leitch, Harry G. et al.; "The mammalian germline as a pluripotency cycle"; Development 140; 2013; pp. 2495-2501.
Li, Xin Zhiguo et al.; "An ancient transcription factor initiates the burst of piRNA production during early meiosis in mouse testes"; Molecular Cell; Apr. 11, 2013; 50(1); pp. 67-81.
Luteijn, Maartje J. et al.; "PIWI-interacting RNAs: from generation to transgenerational epigenetics"; Nature Reviews; Genetics; vol. 14; Aug. 2013; pp. 523-534.
Magnusdottir, Erna et al.; "A tripartite transcription factor network regulates primordial germ cell specification in mice"; Nat Cell Biol.; Aug. 2013; 15(8); pp. 905-915.
Marchetto, Maria C.N. et al.; "Differential LINE-1 regulation in pluripotent stem cells of humans and other great apes"; Nature; Nov. 28, 2013; 503(7477); pp. 525-529.
Marson, Alexander et al.; "Connecting microRNA genes to the core transcriptional regulatory circuitry of embryonic stem cells"; Cell; Aug. 8, 2008; 134(3); pp. 521-533.
Mortazavi, Ali et al.; "Mapping and quantifying mammalian transcriptomes by RNA-Seq"; Nature Methods; vol. 5; No. 7; Jul. 2008; pp. 621-628.

(Continued)

*Primary Examiner* — Kate Poliakova-Georgantas
(74) *Attorney, Agent, or Firm* — Lewis Roca Rothgerber Christie LLC

(57) ABSTRACT

Long noncoding RNAs (lncRNAs) are identified that enhance pluripotency reprogramming of somatic cells as well as differentiation of pluripotent cells. Induced pluripotent stem (iPS) cell generation from somatic cells leads to the upregulation and downregulation of identified lncRNAs. The modulation of these lncRNAs are capable of enhancing pluripotency of somatic cells as well as enhancing differentiation of a pluripotent cell.

8 Claims, 55 Drawing Sheets

(56) References Cited

OTHER PUBLICATIONS

Ohinata, Yasuhide et al.; "Blimp1 is a critical determinant of the germ cell lineage in mice"; Nature; vol. 436; Jul. 14, 2005; pp. 207-213.

Raj, Arjun et al.; "Imaging individual mRNA molecules using multiple singly labeled probes"; Nat Methods; Oct. 2008; 5(10); pp. 877-879.

Ramskold, Daniel et al.; "Full-length mRNA-Seq from single-cell levels of RNA and individual circulating tumor cells"; Nat Biotechnol.; Aug. 2012; 30(8); pp. 777-782.

Roberts, Adam et al.; "Streaming fragment assignment for real-time analysis of sequencing experiments"; Nat Methods; Jan. 2013; 10(1); 14pp.

Saitou, Mitinori et al.; "A molecular programme for the specification of germ cell fate in mice"; Nature; vol. 418; Jul. 18, 2002; pp. 293-300.

Saldanha, Alok J.; "Java Treeview—extensible visualization of microarray data"; Bioinformatics; vol. 20; No. 17; 2004; pp. 3246-3248.

Silva, Jose et al.; "Promotion of reprogramming to ground state pluripotency by signal inhibition"; PLoS Biology; Oct. 2008; vol. 6; Issue 10; e253; pp. 2237-2247.

Tam, Oliver H. et al.; "Pseudogene-derived small interfering RNAs regulate gene expression in mouse oocytes"; Nature; May 22, 2008; 453(7194); pp. 534-538.

Trapnell, Cole et al.; "TopHat: discovering splice junctions with RNA-Seq"; Bioinformatics; vol. 25; No. 9; 2009; pp. 1105-1111.

Trapnell, Cole et al.; "Transcript assembly and abundance estimation from RNA-Seq reveals thousands of new transcripts and switching among isoforms"; Nat Biotechnol.; May 2010; 28(5); pp. 511-515.

Zhao, Jing et al.; "Genome-wide identification of polycomb-associated RNAs by RIP-seq"; Mol Cell; Dec. 22, 2010; 40(6); pp. 939-953.

\* cited by examiner

FIG.4B

| # | Name | # | Name | # | Name |
|---|---|---|---|---|---|
| 1 | Dut | 48 | 1500009L16Rik | 95 | Ipo11 |
| 2 | Gm17386 | 49 | Abhd4 | 96 | Gm5921 |
| 3 | Dppa3 (Stella) | 50 | P2rx4 | 97 | Tmsb15b2 |
| 4 | Unc13d | 51 | Tmsb15b1 | 98 | 0610037L13Rik |
| 5 | Gm17312 | 52 | Fbxo6 | 99 | Fabp5 |
| 6 | Gm10491 | 53 | Ppm1e | 100 | Yif1a |
| 7 | Tmem55b | 54 | Rabac1 | | |
| 8 | Calcoco2 | 55 | Gm10291 | | |
| 9 | Prps1 | 56 | Mfsd10 | | |
| 10 | Ufm1 | 57 | Gltp | | |
| 11 | Lsm3 | 58 | Nrbp1 | | |
| 12 | Gm17635 | 59 | Rpl21-ps6 | | |
| 13 | Lztr1 | 60 | Abhd5 | | |
| 14 | Gm17404 | 61 | Timeless | | |
| 15 | Gm10139 | 62 | Raly | | |
| 16 | Gm9396 | 63 | Plekha3 | | |
| 17 | Hspa14 | 64 | Glrx | | |
| 18 | Snx22 | 65 | Mrps10 | | |
| 19 | Spic | 66 | Psmd14 | | |
| 20 | Zfp125 | 67 | C730034F03Rik | | |
| 21 | Gm10772 | 68 | Gltscr2 | | |
| 22 | Gm3272 | 69 | Ubac1 | | |
| 23 | H2afx | 70 | Gm2606 | | |
| 24 | Gm2574 | 71 | 4930402H24Rik | | |
| 25 | Gm5138 | 72 | 1500010J02Rik | | |
| 26 | Chpt1 | 73 | Glb1 | | |
| 27 | Gm10982 | 74 | Gm8225 | | |
| 28 | Gm10358 | 75 | Qk | | |
| 29 | Gm16512 | 76 | Madd | | |
| 30 | Fbxo15 | 77 | Nudt2 | | |
| 31 | Gm17449 | 78 | Mfge8 | | |
| 32 | Gm10481 | 79 | Ube2c | | |
| 33 | Gm11092 | 80 | Gm11032 | | |
| 34 | D330041H03Rik | 81 | Nfyc | | |
| 35 | Sgpl1 | 82 | Eya3 | | |
| 36 | Rtcd1 | 83 | Uck2 | | |
| 37 | Pbld1 | 84 | Cinp | | |
| 38 | C130073F10Rik | 85 | Mettl3 | | |
| 39 | Snf8 | 86 | Prdm9 | | |
| 40 | 5730507C01Rik | 87 | Gm17555 | | |
| 41 | Gm17353 | 88 | 8030474K03Rik | | |
| 42 | Cd59b | 89 | Dom3z | | |
| 43 | 5430437P03Rik | 90 | Aspscr1 | | |
| 44 | Rpl29 | 91 | Add1 | | |
| 45 | Cib1 | 92 | Wfdc2 | | |
| 46 | Tmem70 | 93 | Flot1 | | |
| 47 | Supt16h | 94 | Cxcr2 | | |

FIG. 7B

| GO term | Cluster freq. | Genome freq. | P-value corrected | FDR | False positive | Annotated genes |
|---|---|---|---|---|---|---|
| developmental process | 95 of 356 genes, 26.7% | 3888 of 32859 genes, 11.8% | 1.63e-11 | 0.00% | 0.00 | G6pdx, Unc5b, Angp, Myo7a, Casp6, Nedd4, Ext1, Hsd11b1, Aspa, Prdm1, Selenbp1, Maf, Gm13305, Asl, Tnfsf4, Lcsk1, Cd1d1, Gja1, Mfn2, Bpgm, Elna, Tdf1, Pgp3rl, Spin1, Twist2, Agba3, Dclk1, Nfic, Pik1a, Stat1, Epha7, Ant, Gna12, Luzp1, Pesin, Luf, DOH48114, Cdc42ep5, Olfm1, Dand5, Elat, Serpinf1, Lefat1, Fam82c2, Adigap24, Il1ral, Zeb1, Tmem204, Keap1, Tgfbr3, Bmp1, Col1a1, Endo3b, Snpc2, Zfp422, Tec2, Shroom2, Jara, AI597479, Casp1, Clcf1, Mgat1, Tnc, Plag1, Mcst1, Jam3, Man2, Mfn214, Clmn1, Usp1, Hoxb9, Angpt2, Mmp2, Prkra, Fam3c, Cub, Mfge8, Zfp37, Tgfb1l1, Lpar1, Snai2, Abhd5, Sdf4, Col8a1, Trim16, Thbs2, Ahi1, Inpp5b, Gapd1, Cebpg, Nr4a2, Acvr1, Rgph9, Fuz, Olfm3 |

FIG. 7B Cont.

| GO term | Cluster freq. | Genome freq. | P-value corrected | FDR | False positive | Annotated genes |
|---|---|---|---|---|---|---|
| metabolic process | 172 of 372 genes 46.2% | 9274 of 32859 genes, 28.2% | 1.40e-10 | 0.00% | 0.00 | Arhgef1, Mettl8, Zfp14, Kitl, Zfp186, Rad11, H1f0, Palm, Ephl, Ehd1l, Actr1a, Pck, Tgfb2, Dync1, Pde8a, Tspo, Trex, Adssl1, Med16, Nme1, Ss3ga6, Bgh, Ctc, PacT1, Klk1b21, Ugt1a6a, Tecpr1, Junb, Rgnef, Gsta1, Irf1, Anxa3, Ampd4, Crym, Ogt2, Epas1, 1810031K17Rik, Gsrm4, Mettl13, Hmgn5, Lrtlp1, Mapkap1, 2810002N01Rik, Net1, Prm2, Tcf7l2, Tmm12, Pla2g16, Edem3, Tmem188, Crebl, Hsd3b7, Clst, Abat, Fosg1, Sprk, Prs, Egd5, Ubn4, Pkig, Oaz3-ps, Lrlm1, 2010106G01Rik, Gstnl, Ya1, Men1, Ogfod2, Mysl1, Nt5c3, Pckrir, 4932438A13Rik, Clns, Mocos, Dpagt1, Pcyt1a, Hdhd2, Atp11b3, Cct1, Add1, Lange, Ncoa3, Ghr, Srebf1, Mboat2, Cnnt, Akat1, At12, Klf6, 5830428H23Rik, Mgl, Slc27a1, Pcdh, Ascc2, Mara, Gtf2i, Nr3c1, Bach, Klk1b24, Cryz, Nhn, Gsti3, Fabp5, Adam17, Dix3l2, Tufnip5, Cd55, Rare, Timagl1, Nmmat2, Amfr, Nudc2, Cogalnact2, Cast, Mtmh1, Bmlc7, Hcstd1, Itng5k, BC026590, Adam15, Cpeh1, Cd34, Lck, Cast, Lig3, Mef2a, Pik1p1, H2-Ke6, Tuk64, Col5a1, Sacs5, Rrase1, Mrl1, Hoxb13, Psc23, Hes, Mnd4, Rab27a, Rnre, Mcpee, Shikhp1, Mast2, Pape1, Rdh10, Klk15, Aldh1a1, Mice, Myh10, Mos81, Cd109, Ptprv, P2rx4, Acads, Ikbkg, Hk1, Aca5, Eif4g3, Ophn1, Nudt6, Pla2e2, Hadhb, Cn43D, Rpt4, Abcn5, Bse, Mgll, Egsr, Bcs5, Sh3rf1, Caga4, Ecc2, Scbp2, Ilrap |

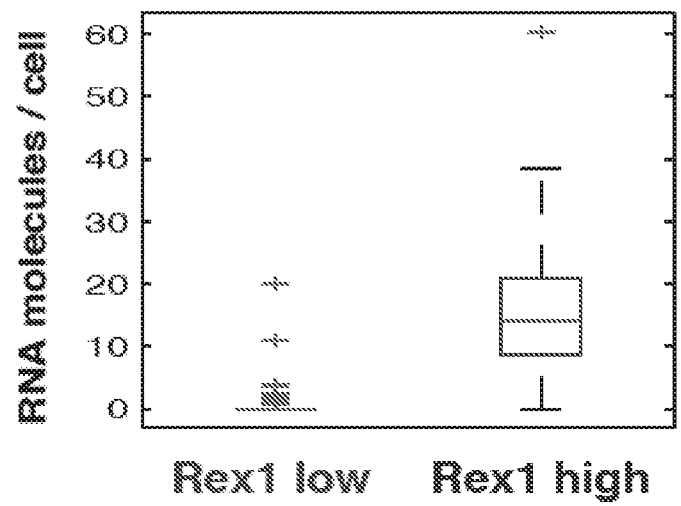
FIG. 10C  Blimp1
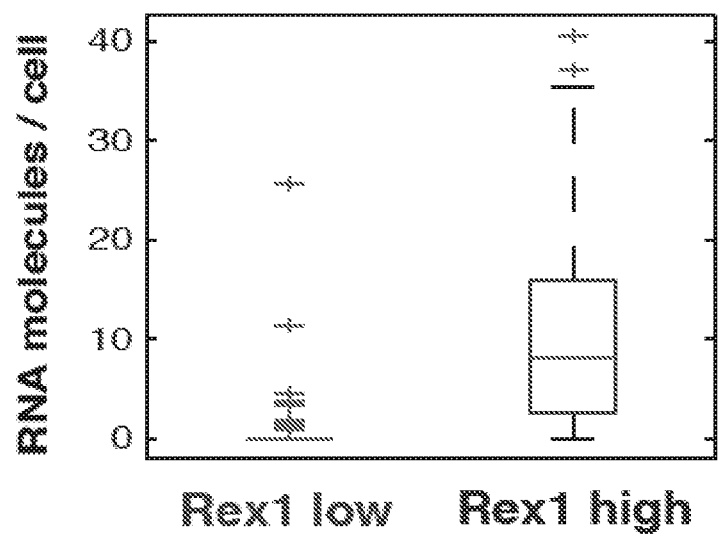
FIG. 10D  Prdm14

(Wk6)

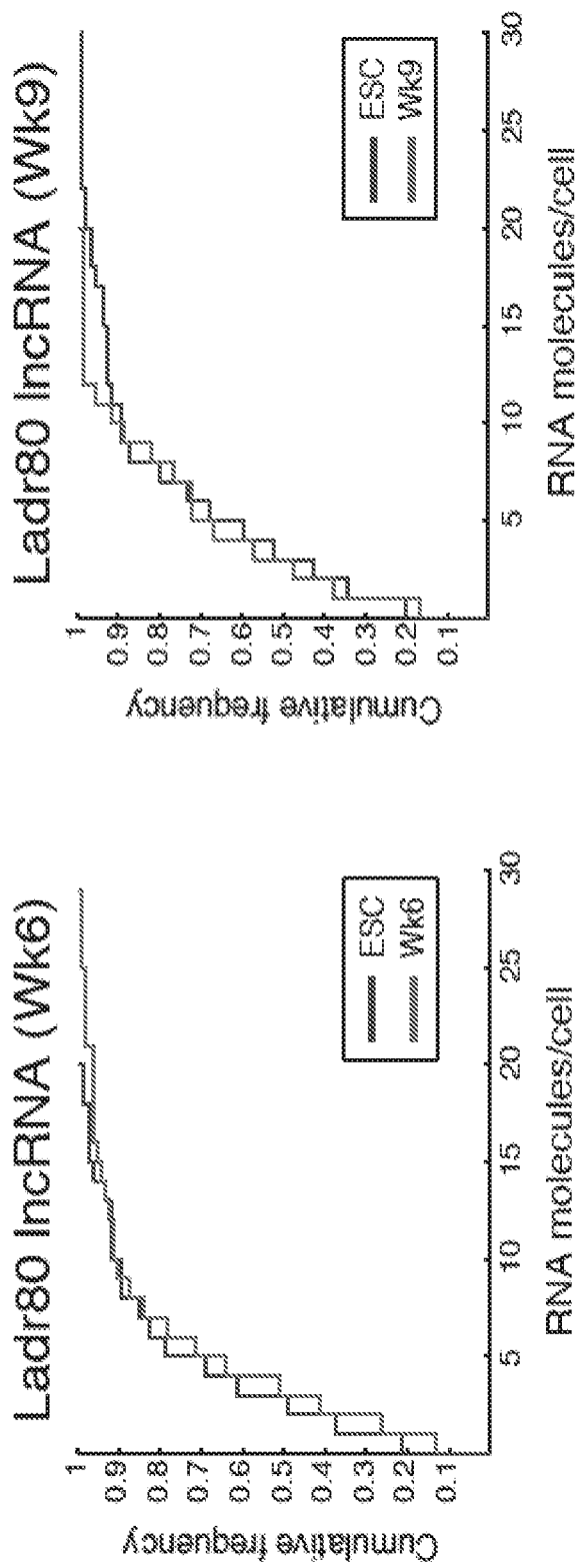

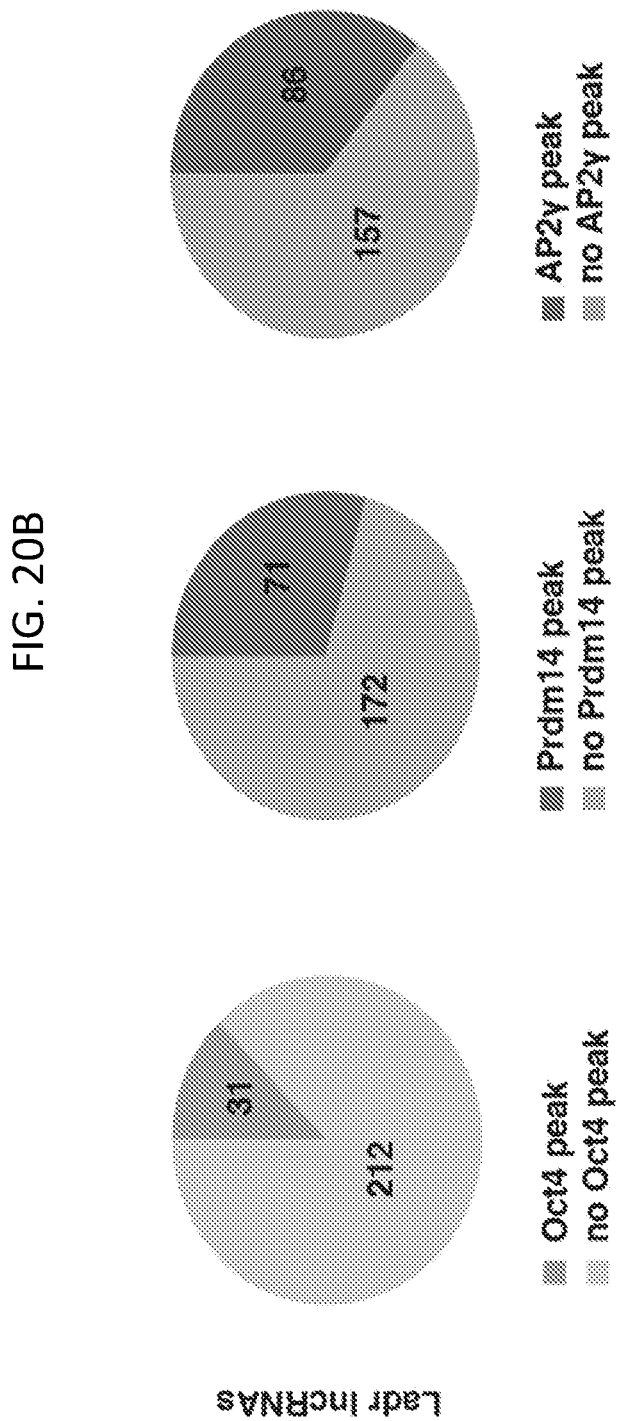

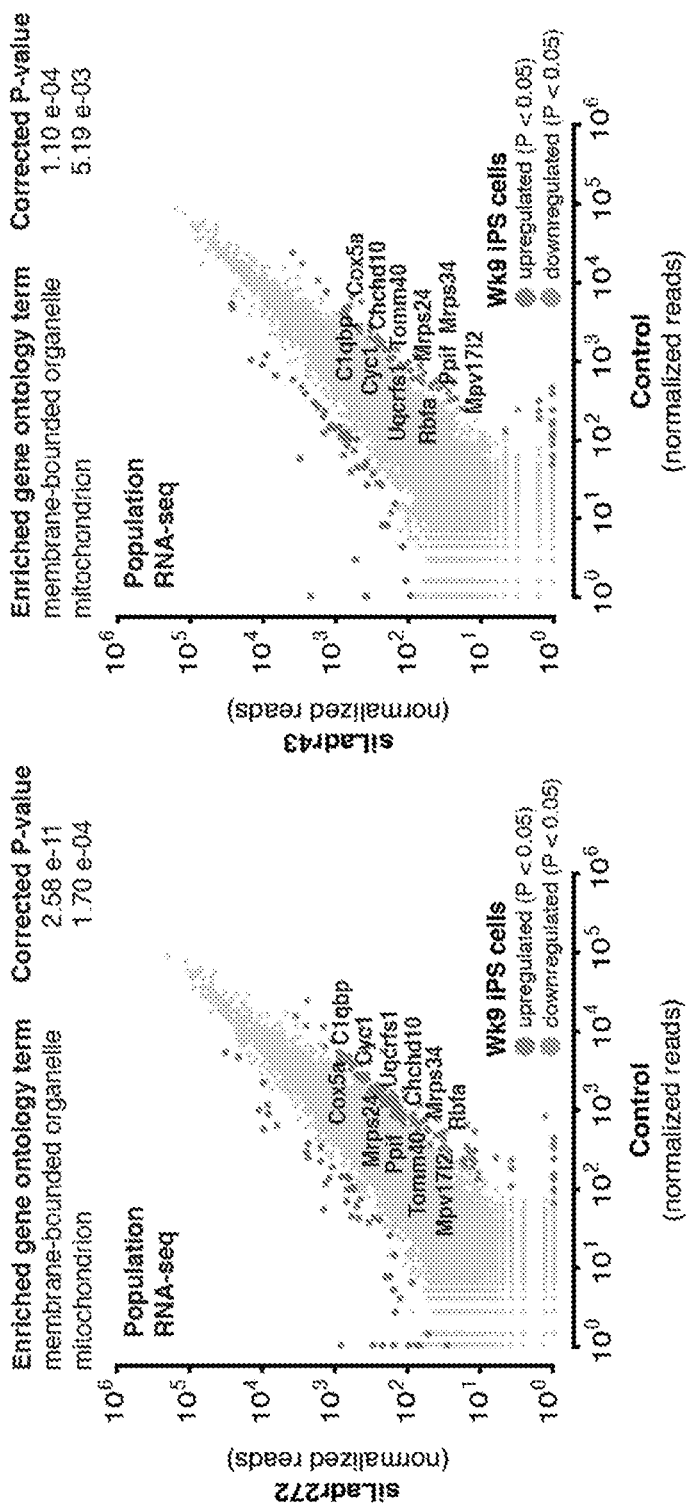

LONG NONCODING RNAS AND CELL REPROGRAMMING AND DIFFERENTIATION

CROSS-REFERENCE TO RELATED APPLICATION(S)

The present application claims priority to and the benefit of U.S. Provisional Application Ser. No. 61/840,306 filed on Jun. 27, 2013, the entire contents of which are incorporated herein by reference.

STATEMENT REGARDING FEDERALLY SPONSORED RESEARCH OR DEVELOPMENT

This invention was made with government support under HG006998 awarded by the National Institutes of Health. The government has certain rights in the invention."

SEQUENCE LISTING

The instant application contains a Sequence Listing which has been submitted electronically in ASCII format and is hereby incorporated by reference in its entirety. Said ASCII copy, created on Nov. 17, 2014, is named 75207-C766_SL.txt and is 19,013,879 bytes in size.

BACKGROUND

The most well-known type of pluripotent stem cell is the embryonic stem (ES) cell. However, the generation of embryonic stem cells can only be derived from embryos, and it has so far not been feasible to create patient-matched embryonic stem cell lines. Induced pluripotent stem (iPS) cells are a type of pluripotent stem cell that can be generated directly from somatic (differentiated) cells. Since iPS cells can be derived directly from adult tissues, they not only bypass the need for embryos, but can be made in a patient-matched manner, which means that each individual could have their own pluripotent stem cell line. iPS cells may be generated through the ectopic expression of Oct 4, Sox2, Lkf4, and c-Myc (OSKM) transcription factors in somatic cells (Takahashi and Yamanaka, 2006), leading to global epigenetic changes during reprogramming (Papp and Plath, 2013). Chromatin regulatory proteins mediate epigenetic remodeling during iPS cell formation, and loss-of-function studies have shown that Polycomb proteins are potent regulators of cell fate reprogramming (Onder et al., 2012). However, iPS cells may retain epigenetic signatures of their somatic cell of origin (Kim et al., 2010; Polo et al., 2010) that can persist through extended passaging (Kim et al., 2011), and the molecular mechanisms responsible for epigenetic memory are unclear.

In ES cells, long noncoding RNAs (lncRNAs) associate with chromatin regulators such as Polycomb proteins (Guttman et al., 2011; Zhao et al., 2010; Zhao et al., 2008) and are required to repress lineage-specific genes in the pluripotent state (Guttman et al., 2011). LncRNAs have been shown to target chromatin regulatory complexes throughout the genome in various developmental settings (Lee and Bartolomei, 2013; Rinn and Chang, 2012), but relatively little is known about lncRNAs in the context of cellular reprogramming.

SUMMARY

Some embodiments of the present invention are directed to a method of enhancing reprogramming of a somatic cell to a pluripotent cell in a human or mouse, the method including upregulation of at least one long noncoding RNA (lncRNA) selected from SEQ ID NOs. 1-347 and 368-408 and isoforms, fragments, and homologs thereof in the somatic cell.

In some embodiments, the method of enhancing reprogramming of a somatic cell also includes downregulating at least one lncRNA selected from SEQ ID NOs. 348-367 and 415-424 and SEQ ID NOs. 408-414 and isoforms, fragments, and homologs thereof.

Some embodiments of the present invention are directed to a method of enhancing differentiation of a pluripotent cell in a human or mouse, the method including downregulation of at least one long noncoding RNA (lncRNA) selected from SEQ ID NOs. 1-347 and 368-407 and isoforms, fragments and homologs thereof in the pluripotent cell.

In some embodiments, the method of enhancing differentiation of a pluripotent cell also includes upregulating at least one lncRNA selected from SEQ ID NOs. 348-367 and 415-424 and SEQ ID NOs. 408-414 and isoforms, fragments, and homologs thereof.

Some embodiments of the present invention include a composition for enhancing pluripotency reprogramming in a human or mouse somatic cell, the composition includes an inhibiting nucleic acid directed against a long noncoding RNA (lncRNA) selected from SEQ ID NOs. 358-367 and SEQ ID NOs. 408-414 and isoforms, fragments, and homologs thereof.

Some embodiments of the present invention include a composition for enhancing pluripotency reprogramming in a human or mouse somatic cell, the composition includes a vector, synthetic nucleic acid or in vitro transcribed nucleic acid encoding a long noncoding RNA (lncRNA) selected from SEQ ID NOs. 1-347 and 368-407 and isoforms, fragments, and homologs thereof.

BRIEF DESCRIPTION OF THE DRAWINGS

These and other features and advantages of the present invention will be better understood by reference to the following detailed description when considered in conjunction with the accompanying drawings.

FIG. 4B lists 100 induced proteins as described herein.

FIG. 7B is a table summarizing the tail tip fibroblast (TTFs) analysis of FIG. 7A, as described herein, in which GO (gene ontology) the annotated genes as well as the Cluster frequency, Genome frequency, Corrected P-value, FDR, and False positive values are shown as indicated.

FIGS. 10A-10D show a histogram (FIG. 10A) and box plots (FIGS. 10B, 10C, 10D) of RNA molecules per cell for each indicated gene, as determined by 4-color smFISH showing that cells expressing higher levels of Rex1, also expressed Stella, Prdm14, and Blimp1, while cells with low Rex1 expression generally did not express these genes, as described herein.

FIGS. 14B and 14C are graphs of cumulative frequency of Ladr80 lncRNAs at week 6 (Wk6) (FIG. 14B) and week 9 (Wk9) (FIG. 14C) compared with ESC (embryonic stem cells), as described herein.

FIG. 20B shows graphs indicating the fraction of Oct4, Prdm14, or Ap2γ binding sites within lncRNA promoters out of the total number of Ladr lncRNAs, as described herein.

FIG. 22A is a graph showing differential expression analysis of upregulated or downregulated genes, as indicated, in week 9 (Wk 9) iPS cells in the presence (siLadr272) or absence (control) of Ladr272 siRNA, as described herein.

FIG. 22B is a graph showing differential expression analysis of upregulated or downregulated genes, as indicated, in week 9 (Wk 9) iPS cells in the presence (siLadr43) or absence (control) of Ladr43 siRNA, as described herein.

DETAILED DESCRIPTION

Figure 1:
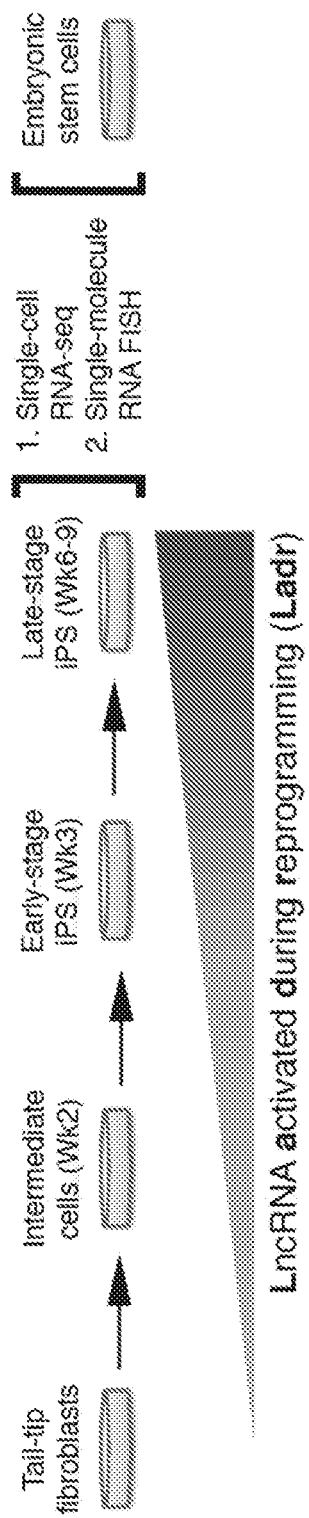
FIG. 1 is a schematic showing induction of pluripotency in somatic cells, according to embodiments of the invention.

Some embodiments of the present invention include at least one long noncoding RNA (lncRNA) that regulates the induction of pluripotency in somatic cells. As disclosed herein, the lncRNAs in Tables 1 and 2 increase effective pluripotency of iPS cells. Some embodiments of the present invention include methods for improved induction of pluripotency in somatic cells. These methods for inducing pluripotency in somatic cells include the presence of (activation of) and/or absence (repression of) at least one of the long lncRNAs disclosed in Tables 1 and/or 2. Induction of pluripotency in tail-tip fibroblasts from an OSKM mouse to produce iPS cells for comparative expression analysis with embryonic stem (ES) cells is shown schematically in FIG. 1.

As used herein, "reprogramming" in the context of a somatic cell refers to the erasure and remodeling of the differentiated somatic cell to a pluripotent embryonic state, Conversely, "reprogramming" in the context of a pluripotent cell is also referred to as differentiation, and refers to the remodeling of the pluripotent cell to a more specialized differentiated cell.

As used herein, "induction of pluripotency" and "pluripotency reprogramming" refers to the induction of pluripotency by induction of Oct4, Sox2, Klf4, c-Myc (OSKM) transcription factors and/or the "dual inhibition" of Mek and Gsk3 also known as "2i."

In some embodiments, methods for improved induction of pluripotency in somatic cells includes the presence of the lncRNAs disclosed herein to be activated during reprogramming of the somatic cells. These lncRNAs activated during reprogramming are also referred to herein as Ladrs. Induction of pluripotency activated mouse Ladrs 1-314 (SEQ ID NOs. 1-314) are listed in Table 1 and the orthologous human lncRNA (SEQ ID NOs. 315-347) identified by Liftover analysis, are listed in Table 2.

TABLE 1

| SEQ ID NO: | lncRNA | Gene name | chr | left | right | Str* | ID |
|---|---|---|---|---|---|---|---|
| 1 | Ladr 1 | Gm17586 | chr11 | 120495082 | 120496439 | + | ENSMUSG00000090998 |
| 2 | Ladr 2 | 4930444M15Rik | chr14 | 76914365 | 76920662 | − | ENSMUSG00000085974 |
| 3 | Ladr 3 | 1810019D21Rik | chr8 | 108659300 | 108662425 | + | ENSMUSG00000086390 |
| 4 | Ladr 4 | B230208H11Rik | chr10 | 12636446 | 12642898 | − | ENSMUSG00000085233 |
| 5 | Ladr 5 | Gm15728 | chr5 | 117839148 | 117843507 | + | ENSMUSG00000086075 |
| 6 | Ladr 6 | Gm2529 | chr8 | 87189027 | 87193305 | + | ENSMUSG00000073822 |
| 7 | Ladr 7 | 2700086A05Rik | chr6 | 52125216 | 52165075 | + | ENSMUSG00000085696 |
| 8 | Ladr 8 | C430039J16Rik | chr13 | 98053137 | 98055889 | + | ENSMUSG00000091451 |
| 9 | Ladr 9 | Gm17291 | chr10 | 62755034 | 62758541 | − | ENSMUSG00000050249 |
| 10 | Ladr 10 | A330048O09Rik | chr13 | 48367785 | 48369253 | − | ENSMUSG00000087671 |
| 11 | Ladr 11 | Gm17698 | chr1 | 165231921 | 165233751 | − | ENSMUSG00000090335 |
| 12 | Ladr 12 | 4930481B07Rik | chr3 | 94819547 | 94824060 | + | ENSMUSG00000085956 |
| 13 | Ladr 13 | A730011C13Rik | chr3 | 94798332 | 94801272 | − | ENSMUSG00000084846 |
| 14 | Ladr 14 | 4930526L06Rik | chr19 | 11271307 | 11374376 | + | ENSMUSG00000085490 |
| 15 | Ladr 15 | Gm15787 | chr5 | 110583419 | 110605523 | − | ENSMUSG00000086247 |
| 16 | Ladr 16 | 2310043M15Rik | chr16 | 93792395 | 93795133 | − | ENSMUSG00000091302 |
| 17 | Ladr 17 | 4930566F21Rik | chr5 | 31789002 | 31797552 | − | ENSMUSG00000086967 |
| 18 | Ladr 18 | Meg3 | chr12 | 110779211 | 110809936 | + | ENSMUSG00000021268 |
| 19 | Ladr 19 | 3110056K07Rik | chr12 | 72092602 | 72116819 | − | ENSMUSG00000085622 |
| 20 | Ladr 20 | Gm15441 | chr3 | 96359688 | 95370724 | − | ENSMUSG00000074398 |
| 21 | Ladr 21 | Rian | chr12 | 110842155 | 110899919 | + | ENSMUSG00000091793 |
| 22 | Ladr 22 | 9830144P21Rik | chr2 | 129031694 | 129056315 | − | ENSMUSG00000087528 |
| 23 | Ladr 23 | 4930513N10Rik | chr8 | 98330730 | 98345628 | + | ENSMUSG00000074136 |
| 24 | Ladr 24 | 4930404I05Rik | chr16 | 91011494 | 91016988 | + | ENSMUSG00000087354 |
| 25 | Ladr 25 | GM17250 | chr2 | 71586132 | 71588219 | − | ENSMUSG00000090953 |
| 26 | Ladr 26 | Gm16641 | chr11 | 50050511 | 50102341 | + | ENSMUSG00000085364 |
| 27 | Ladr 27 | 2310010G23Rik | chrX | 34354766 | 34357180 | − | ENSMUSG00000090647 |
| 28 | Ladr 28 | 2810442I21Rik | chr11 | 16835157 | 16851285 | − | ENSMUSG00000087060 |
| 29 | Ladr 29 | 9230114K14Rik | chr5 | 52581920 | 52589223 | + | ENSMUSG00000087676 |
| 30 | Ladr 30 | Vax2os1 | chr6 | 83642800 | 83662195 | − | ENSMUSG00000085794 |
| 31 | Ladr 31 | 1700007L15Rik | chr16 | 33379941 | 33380813 | − | ENSMUSG00000090918 |

TABLE 1-continued

| SEQ ID NO: | lncRNA | Gene name | chr | left | right | Str* | ID |
|---|---|---|---|---|---|---|---|
| 32 | Ladr 32 | 4632427E13Rik | chr7 | 99886168 | 99889978 | − | ENSMUSG00000074024 |
| 33 | Ladr 33 | Gm17491 | chr8 | 23590763 | 23593802 | + | ENSMUSG00000078859 |
| 34 | Ladr 34 | 4930461G14Rik | chr9 | 58302980 | 58317430 | + | ENSMUSG00000086516 |
| 35 | Ladr 35 | Gm16957 | chr17 | 17526907 | 17532267 | − | ENSMUSG00000087696 |
| 36 | Ladr 36 | 2410003L11Rik | chr11 | 97459825 | 97484207 | + | ENSMUSG00000085806 |
| 37 | Ladr 37 | 4930500J02Rik | chr2 | 104399320 | 104411586 | + | ENSMUSG00000086454 |
| 38 | Ladr 38 | Gm17335 | chr11 | 22500338 | 22510882 | − | ENSMUSG00000090797 |
| 39 | Ladr 39 | Gm13110 | chr4 | 154019863 | 154029427 | − | ENSMUSG00000086810 |
| 40 | Ladr 40 | 9530027I09Rik | chrX | 45629969 | 45638603 | − | ENSMUSG00000085283 |
| 41 | Ladr 41 | 2500002B13Rik | chr8 | 59966851 | 59987674 | + | ENSMUSG00000086276 |
| 42 | Ladr 42 | 4933404O12Rik | chr5 | 137395016 | 137412982 | + | ENSMUSG00000085062 |
| 43 | Ladr 43 | Gm2694 | chr8 | 89996711 | 90049453 | + | ENSMUSG00000087391 |
| 44 | Ladr 44 | A230072C01Rik | chrX | 20538810 | 20563863 | + | ENSMUSG00000086877 |
| 45 | Ladr 45 | C330046G13Rik | chr10 | 84010162 | 84016083 | − | ENSMUSG00000085671 |
| 46 | Ladr 46 | Gm17300 | chr4 | 131907687 | 131909297 | + | ENSMUSG00000091021 |
| 47 | Ladr 47 | Xist | chrX | 100655714 | 100678556 | − | ENSMUSG00000086503 |
| 48 | Ladr 48 | 4930558J18Rik | chr1 | 57416066 | 57434348 | − | ENSMUSG00000084958 |
| 49 | Ladr 49 | Gm10143 | chr19 | 10272858 | 10276874 | + | ENSMUSG00000064032 |
| 50 | Ladr 50 | 1110002J07Rik | chr10 | 66375237 | 66383006 | − | ENSMUSG00000087275 |
| 51 | Ladr 51 | 1700086O06Rik | chr18 | 38398059 | 38410219 | − | ENSMUSG00000086988 |
| 52 | Ladr 52 | 6720401G13Rik | chrX | 47908921 | 47988498 | − | ENSMUSG00000085396 |
| 53 | Ladr 53 | Gm17418 | chr1 | 93885628 | 93889205 | + | ENSMUSG00000079420 |
| 54 | Ladr 54 | Gm16986 | chr13 | 66604096 | 66620459 | − | ENSMUSG00000086120 |
| 55 | Ladr 55 | Gm17656 | chr13 | 66450332 | 66466708 | + | ENSMUSG00000090969 |
| 56 | Ladr 56 | B230206L02Rik | chr11 | 93994799 | 94017090 | + | ENSMUSG00000086003 |
| 57 | Ladr 57 | Abhd1 | chr5 | 31252439 | 31257464 | + | ENSMUSG00000006638 |
| 58 | Ladr 58 | 5930412G12Rik | chr5 | 129084981 | 129106568 | − | ENSMUSG00000072591 |
| 59 | Ladr 59 | E130018N17Rik | chr2 | 167978103 | 167980013 | − | ENSMUSG00000087648 |
| 60 | Ladr 60 | Gm14022 | chr2 | 128886682 | 128891422 | − | ENSMUSG00000087151 |
| 61 | Ladr 61 | Gm2788 | chr7 | 56133328 | 56141978 | + | ENSMUSG00000085995 |
| 62 | Ladr 62 | Gm16880 | chr1 | 138592788 | 138622305 | + | ENSMUSG00000085011 |
| 63 | Ladr 63 | Gm4419 | chr12 | 21423772 | 21425664 | + | ENSMUSG00000090621 |
| 64 | Ladr 64 | 9330185C12Rik | chr1 | 115787962 | 115860711 | − | ENSMUSG00000086520 |
| 65 | Ladr 65 | Gm17659 | chr9 | 89989016 | 89990740 | + | ENSMUSG00000091035 |
| 66 | Ladr 66 | Gm17710 | chr7 | 95427297 | 95432039 | − | ENSMUSG00000091953 |
| 67 | Ladr 67 | Gm10785 | chr16 | 91689156 | 91715887 | + | ENSMUSG00000085169 |
| 68 | Ladr 68 | Gm17561 | chr17 | 32506250 | 32515390 | + | ENSMUSG00000091872 |
| 69 | Ladr 69 | 4930509G22Rik | chr16 | 11178269 | 11192385 | + | ENSMUSG00000085780 |
| 70 | Ladr 70 | C430002E04Rik | chr3 | 41292726 | 41297114 | − | ENSMUSG00000091878 |
| 71 | Ladr 71 | Gm17605 | chr8 | 4088149 | 4089166 | − | ENSMUSG00000091309 |
| 72 | Ladr 72 | Gm17362 | chr8 | 23755333 | 23756758 | + | ENSMUSG00000074911 |
| 73 | Ladr 73 | Gm17525 | chr4 | 128986325 | 128995687 | + | ENSMUSG00000091673 |
| 74 | Ladr 74 | Mirg | chr12 | 110973191 | 110987665 | + | ENSMUSG00000091158 |
| 75 | Ladr 75 | 1010001B22Rik | chr5 | 110424530 | 110425417 | − | ENSMUSG00000091434 |
| 76 | Ladr 76 | Gm17597 | chr15 | 81631221 | 81633043 | − | ENSMUSG00000091934 |
| 77 | Ladr 77 | Gm16283 | chr18 | 49915448 | 49916843 | + | ENSMUSG00000087020 |
| 78 | Ladr 78 | 4933407K13Rik | chrX | 72952271 | 73010038 | − | ENSMUSG00000087396 |
| 79 | Ladr 79 | Gm17279 | chr8 | 19888055 | 20016359 | + | ENSMUSG00000091588 |
| 80 | Ladr 80 | Gm16096 | chr9 | 40588825 | 40592264 | − | ENSMUSG00000087135 |
| 81 | Ladr 81 | Gm17440 | chr7 | 30983649 | 30985908 | + | ENSMUSG00000092079 |
| 82 | Ladr 82 | Gm17594 | chrX | 78316033 | 78318441 | − | ENSMUSG00000078930 |
| 83 | Ladr 83 | Gm13657 | chr2 | 75615245 | 75620363 | + | ENSMUSG00000086813 |
| 84 | Ladr 84 | C330018A13Rik | chr5 | 116573623 | 116579119 | + | ENSMUSG00000086655 |
| 85 | Ladr 85 | Gm17637 | chrX | 20937991 | 20941748 | − | ENSMUSG00000091801 |
| 86 | Ladr 86 | Gm16827 | chr18 | 31940880 | 31948699 | − | ENSMUSG00000086768 |
| 87 | Ladr 87 | Atp10d | chr5 | 72594568 | 72690014 | + | ENSMUSG00000046808 |
| 88 | Ladr 88 | 5730457N03Rik | chr6 | 52258383 | 52264826 | − | ENSMUSG00000086126 |
| 89 | Ladr 89 | Gm11714 | chr11 | 107289590 | 107297000 | + | ENSMUSG00000087113 |
| 90 | Ladr 90 | Gm16159 | chr8 | 26659133 | 26666555 | − | ENSMUSG00000086134 |
| 91 | Ladr 91 | Gm12898 | chr4 | 118895779 | 118897420 | + | ENSMUSG00000085626 |
| 92 | Ladr 92 | Gm16973 | chr14 | 57315117 | 57320105 | − | ENSMUSG00000086985 |
| 93 | Ladr 93 | 6030442K20Rik | chr1 | 134363010 | 134373622 | − | ENSMUSG00000090678 |
| 94 | Ladr 94 | Gm13830 | chr5 | 115751129 | 115769217 | + | ENSMUSG00000086368 |
| 95 | Ladr 95 | C330013F16Rik | chrX | 135774765 | 135892277 | − | ENSMUSG00000086807 |
| 96 | Ladr 96 | 4930467K11Rik | chr10 | 57198187 | 57206159 | − | ENSMUSG00000085621 |
| 97 | Ladr 97 | 2010300F17Rik | chr11 | 96574296 | 96608750 | | ENSMUSG00000091444 |
| 98 | Ladr 98 | Gm2464 | chr3 | 13471906 | 13474596 | − | ENSMUSG00000078587 |
| 99 | Ladr 99 | 9530080011Rik | chr4 | 95626406 | 95634346 | − | ENSMUSG00000044125 |
| 100 | Ladr 100 | 5C046401 | chr2 | 165683184 | 165684534 | + | ENSMUSG00000085274 |
| 101 | Ladr 101 | Gm17481 | chr15 | 78693386 | 78697319 | − | ENSMUSG00000086640 |
| 102 | Ladr 102 | Gm14817 | chrX | 71040554 | 71042955 | − | ENSMUSG00000085669 |
| 103 | Ladr 103 | Gn717501 | chr3 | 145313276 | 145315057 | − | ENSMUSG00000090771 |
| 104 | Ladr 104 | Gm17502 | chr7 | 6296993 | 6300606 | + | ENSMUSG00000091822 |
| 105 | Ladr 105 | 1700023H05Rik | chr13 | 81023485 | 81024785 | − | ENSMUSG00000089827 |
| 106 | Ladr 106 | 4930480K23Rik | chr14 | 70132591 | 70166920 | + | ENSMUSG00000085243 |
| 107 | Ladr 107 | 1110020A21Rik | chr17 | 85354307 | 85357050 | − | ENSMUSG00000087023 |
| 108 | Ladr 108 | Gm16723 | chr6 | 87858837 | 87864453 | − | ENSMUSG00000085703 |

TABLE 1-continued

| SEQ ID NO: | lncRNA | Gene name | chr | left | right | Str* | ID |
|---|---|---|---|---|---|---|---|
| 109 | Ladr 109 | Gm16972 | chr4 | 43058906 | 43066125 | + | ENSMUSG00000086983 |
| 110 | Ladr 110 | GM807 | chr13 | 99870661 | 99877535 | + | ENSMUSG00000074744 |
| 111 | Ladr 111 | D030068K23Rik | chr8 | 111599122 | 111797711 | + | ENSMUSG00000085859 |
| 112 | Ladr 112 | Gm8378 | chr12 | 92913252 | 92924553 | − | ENSMUSG00000090722 |
| 113 | Ladr 113 | Gm12059 | chr11 | 22967998 | 22975574 | + | ENSMUSG00000085665 |
| 114 | Ladr 114 | Gm17716 | chr14 | 26175287 | 26198121 | − | ENSMUSG00000091164 |
| 115 | Ladr 115 | Gm16244 | chr19 | 42853522 | 42855944 | − | ENSMUSG00000090235 |
| 116 | Ladr 116 | 3110045C21Rik | chr1 | 171899540 | 171902526 | + | ENSMUSG00000085494 |
| 117 | Ladr 117 | Gm16845 | chr9 | 21875476 | 21890566 | + | ENSMUSG00000087161 |
| 118 | Ladr 118 | Gm10658 | chr9 | 56904437 | 56919773 | − | ENSMUSG00000074284 |
| 119 | Ladr 119 | A930011O12Rik | chr14 | 65206952 | 65212796 | + | ENSMUSG00000091456 |
| 120 | Ladr 120 | C030010L15Rik | chr16 | 98215766 | 98218584 | − | ENSMUSG00000091751 |
| 121 | Ladr 121 | 4833407H14Rik | chr19 | 53535121 | 53537213 | + | ENSMUSG00000090800 |
| 122 | Ladr 122 | Nespas | chr2 | 174106738 | 174120937 | − | ENSMUSG00000086537 |
| 123 | Ladr 123 | Gm10492 | chr17 | 95234246 | 95235982 | + | ENSMUSG00000073366 |
| 124 | Ladr 124 | Gm17713 | chr1 | 135506988 | 135510999 | + | ENSMUSG00000092104 |
| 125 | Ladr 125 | A930029G22Rik | chr17 | 69766000 | 69788644 | − | ENSMUSG00000085144 |
| 126 | Ladr 126 | Gm16046 | chr17 | 13812667 | 13820523 | − | ENSMUSG00000085705 |
| 127 | Ladr 127 | GM15522 | chr5 | 34993367 | 34995126 | + | ENSMUSG00000085166 |
| 128 | Ladr 128 | Gm11818 | chr4 | 12833984 | 12908632 | + | ENSMUSG00000055963 |
| 129 | Ladr 129 | 1700016P03Rik | chr11 | 74986062 | 74991135 | + | ENSMUSG00000085609 |
| 130 | Ladr 130 | Hoxa11as | chr6 | 52195051 | 52199794 | + | ENSMUSG00000086427 |
| 131 | Ladr 131 | Gm17477 | chr9 | 79966702 | 79969744 | − | ENSMUSG00000084917 |
| 132 | Ladr 132 | C030037DO9Rik | chr11 | 88579959 | 88590207 | + | ENSMUSG00000087574 |
| 133 | Ladr 133 | A330040F15Rik | chr19 | 12660358 | 12671056 | − | ENSMUSG00000086213 |
| 134 | Ladr 134 | Mir155 | chr16 | 84713268 | 84715487 | + | ENSMUSG00000091875 |
| 135 | Ladr 135 | Gm4890 | chr8 | 81819022 | 81831584 | + | ENSMUSG00000085259 |
| 136 | Ladr 136 | 1700028E1ORik | chr5 | 152171284 | 152216658 | + | ENSMUSG00000087548 |
| 137 | Ladr 137 | Gm10575 | chr7 | 148647380 | 148653670 | − | ENSMUSG00000073787 |
| 138 | Ladr 138 | Gm15545 | chr7 | 52242270 | 52249967 | + | ENSMUSG00000087138 |
| 139 | Ladr 139 | A030009H04Rik | chr11 | 69153963 | 69156143 | + | ENSMUSG00000043419 |
| 140 | Ladr 140 | 0610005C13Rik | chr7 | 52823165 | 52830697 | − | ENSMUSG00000085214 |
| 141 | Ladr 141 | Gm17344 | chr8 | 112385625 | 112392355 | − | ENSMUSG00000078143 |
| 142 | Ladr 142 | Gm16761 | chr16 | 29907605 | 29946603 | − | ENSMUSG00000084810 |
| 143 | Ladr 143 | Gm11538 | chr11 | 96064768 | 96066699 | + | ENSMUSG00000085983 |
| 144 | Ladr 144 | A230056P14Rik | chr7 | 63217901 | 63236238 | + | ENSMUSG00000087178 |
| 145 | Ladr 145 | Gm16685 | chr3 | 7612705 | 7690001 | + | ENSMUSG00000086143 |
| 146 | Ladr 146 | Gm17690 | chr3 | 95971387 | 95976337 | − | ENSMUSG00000091244 |
| 147 | Ladr 147 | 4933431E20Rik | chr3 | 107691768 | 107699131 | − | ENSMUSG00000086968 |
| 148 | Ladr 148 | Gm17565 | chr4 | 145686275 | 145688945 | + | ENSMUSG00000090554 |
| 149 | Ladr 149 | 1700030C12Rik | chr11 | 23397753 | 23399661 | + | ENSMUSG00000086459 |
| 150 | Ladr 150 | 2410133F24Rik | chr9 | 56947757 | 56979097 | − | ENSMUSG00000086728 |
| 151 | Ladr 151 | C530005A16Rik | chr4 | 116262338 | 116270235 | − | ENSMUSG00000085408 |
| 152 | Ladr 152 | Gm17254 | chr9 | 96968602 | 96973848 | + | ENSMUSG00000091219 |
| 153 | Ladr 153 | Gm17701 | chr6 | 127058407 | 127060485 | + | ENSMUSG00000091856 |
| 154 | Ladr 154 | Gm15489 | chr7 | 129282522 | 129302915 | − | ENSMUSG00000086942 |
| 155 | Ladr 155 | 9530059O14Rik | chr9 | 122481615 | 122588714 | + | ENSMUSG00000086476 |
| 156 | Ladr 156 | Gm17102 | chr7 | 48649068 | 48652817 | + | ENSMUSG00000091864 |
| 157 | Ladr 157 | Dio3os | chr12 | 111513594 | 111516278 | − | ENSMUSG00000090962 |
| 158 | Ladr 158 | Snord123 | chr15 | 32170324 | 32174417 | − | ENSMUSG00000090401 |
| 159 | Ladr 159 | 1700023L04Rik | chr6 | 29935329 | 29943776 | − | ENSMUSG00000045709 |
| 160 | Ladr 160 | Gdap10 | chr12 | 33506737 | 33511769 | + | ENSMUSG00000059937 |
| 161 | Ladr 161 | Gm17500 | chr11 | 51938032 | 51941281 | − | ENSMUSG00000092028 |
| 162 | Ladr 162 | Gm17692 | chr17 | 6314199 | 6492328 | + | ENSMUSG00000091795 |
| 163 | Ladr 163 | Gm12784 | chr7 | 35332225 | 35341223 | + | ENSMUSG00000086631 |
| 164 | Ladr 164 | 2810011L19Rik | chr12 | 106574804 | 106622141 | + | ENSMUSG00000086023 |
| 165 | Ladr 165 | Gm16618 | chr16 | 20511206 | 20517839 | − | ENSMUSG00000086837 |
| 166 | Ladr 165 | Gm16912 | chr17 | 29598841 | 29628870 | − | ENSMUSG00000087551 |
| 167 | Ladr 167 | Gm12592 | chr11 | 3205429 | 3231181 | − | ENSMUSG00000053263 |
| 168 | Ladr 168 | Gm13261 | chr2 | 10260910 | 10295668 | − | ENSMUSG00000086748 |
| 169 | Ladr 169 | C330002G04Rik | chr19 | 23111880 | 23150343 | − | ENSMUSG00000087169 |
| 170 | Ladr 170 | Gm16869 | chr9 | 3000282 | 3038313 | − | ENSMUSG00000087580 |
| 171 | Ladr 171 | Gn16938 | chr7 | 105325704 | 105334107 | + | ENSMUSG00000086325 |
| 172 | Ladr 172 | F630040L22Rik | chr9 | 108007296 | 108020674 | + | ENSMUSG00000087645 |
| 173 | Ladr 173 | Gm17445 | chr7 | 26601673 | 26605673 | + | ENSMUSG00000084812 |
| 174 | Ladr 174 | AY512931 | chr8 | 46146056 | 46150772 | + | ENSMUSG00000066158 |
| 175 | Ladr 175 | Gm6410 | chr8 | 4678462 | 4688494 | + | ENSMUSG00000090435 |
| 176 | Ladr 176 | A930007I19Rik | chr19 | 29560845 | 29597649 | − | ENSMUSG00000086309 |
| 177 | Ladr 177 | 3010001F23Rik | chrX | 148803116 | 148851241 | + | ENSMUSG00000084885 |
| 178 | Ladr 178 | A330076H08Rik | chr7 | 69075799 | 69127242 | − | ENSMUSG00000087490 |
| 179 | Ladr 179 | Gm15850 | chr1 | 138022755 | 138027760 | − | ENSMUSG00000086264 |
| 180 | Ladr 180 | Gm10425 | chr12 | 112665085 | 112669157 | − | ENSMUSG00000072830 |
| 181 | Ladr 181 | Gm16629 | chr15 | 92174790 | 92208519 | + | ENSMUSG00000085294 |
| 182 | Ladr 182 | 2900052L18Rik | chr11 | 120091116 | 120092899 | − | ENSMUSG00000043993 |
| 183 | Ladr 183 | 2310031A07Rik | chr11 | 46253864 | 46260750 | − | ENSMUSG00000091190 |
| 184 | Ladr 184 | 4930506C21Rik | chr17 | 8486231 | 8503945 | − | ENSMUSG00000087478 |
| 185 | Ladr 185 | Gm16733 | chr7 | 20355960 | 20360752 | + | ENSMUSG00000085994 |

TABLE 1-continued

| SEQ ID NO: | lncRNA | Gene name | chr | left | right | Str* | ID |
|---|---|---|---|---|---|---|---|
| 186 | Ladr 186 | Gm11574 | chr11 | 96910005 | 96912746 | − | ENSMUSG00000085262 |
| 187 | Ladr 187 | 2810429I04Rik | chr13 | 3477489 | 3493644 | + | ENSMUSG00000086566 |
| 188 | Ladr 188 | A230004M16Rik | chr11 | 41523844 | 41786619 | + | ENSMUSG00000087306 |
| 189 | Ladr 189 | Gm17392 | chr17 | 55696464 | 55702805 | + | ENSMUSG00000090426 |
| 190 | Ladr 190 | Gm17699 | chr1 | 130667176 | 130670998 | − | ENSMUSG00000091877 |
| 191 | Ladr 191 | A730099G02Rik | chr10 | 48939228 | 48945459 | − | ENSMUSG00000091943 |
| 192 | Ladr 192 | Gm17644 | chr1 | 12657644 | 12663171 | + | ENSMUSG00000066918 |
| 193 | Ladr 193 | Gm17255 | chr9 | 80849043 | 81097197 | + | ENSMUSG00000090679 |
| 194 | Ladr 194 | Gm17638 | chr15 | 77792104 | 77797556 | + | ENSMUSG00000091802 |
| 195 | Ladr 195 | Gm16755 | chr11 | 120347653 | 120349896 | − | ENSMUSG00000086218 |
| 196 | Ladr 196 | Gm16702 | chr17 | 8571910 | 8582333 | − | ENSMUSG00000086627 |
| 197 | Ladr 197 | Gm11934 | chr4 | 33390544 | 33397112 | − | ENSMUSG00000086127 |
| 198 | Ladr 198 | Gm15396 | chr7 | 51835338 | 51845994 | − | ENSMUSG00000087560 |
| 199 | Ladr 199 | Gm3906 | chr9 | 43921006 | 43930030 | + | ENSMUSG00000092003 |
| 200 | Ladr 200 | Gm12976 | chr4 | 128939209 | 128942254 | + | ENSMUSG00000087575 |
| 201 | Ladr 201 | Gm16862 | chr17 | 45871455 | 45925543 | + | ENSMUSG00000086615 |
| 202 | Ladr 202 | Gm17496 | chr16 | 95237977 | 95288624 | + | ENSMUSG00000092023 |
| 203 | Ladr 203 | BC051077 | chr5 | 117762529 | 117765548 | − | ENSMUSG00000091333 |
| 204 | Ladr 204 | Gm17632 | chr3 | 116191884 | 116196276 | + | ENSMUSG00000090721 |
| 205 | Ladr 205 | Gm17275 | chr1 | 182732699 | 182739614 | + | ENSMUSG00000090986 |
| 206 | Ladr 206 | Gm17596 | chr9 | 57379094 | 57385436 | − | ENSMUSG00000091932 |
| 207 | Ladr 207 | Gm17327 | chr7 | 35009774 | 35015255 | + | ENSMUSG00000090311 |
| 208 | Ladr 208 | Gm17599 | chr4 | 43043871 | 43045354 | + | ENSMUSG00000091065 |
| 209 | Ladr 209 | Gm17517 | chr8 | 60650232 | 60777663 | + | ENSMUSG00000091944 |
| 210 | Ladr 210 | Gm17336 | chr10 | 128082940 | 128086867 | + | ENSMUSG00000091431 |
| 211 | Ladr 211 | A330032B11Rik | chr19 | 37248333 | 37271031 | + | ENSMUSG00000085432 |
| 212 | Ladr 212 | 1700007J10Rik | chr11 | 59539419 | 59553656 | − | ENSMUSG00000086330 |
| 213 | Ladr 213 | Gm11542 | chr11 | 94538879 | 94548978 | + | ENSMUSG00000085051 |
| 214 | Ladr 214 | 4833417C18Rik | chr11 | 95720179 | 95722358 | + | ENSMUSG00000086015 |
| 215 | Ladr 215 | Gm17282 | chr13 | 69948792 | 69954972 | − | ENSMUSG00000091909 |
| 216 | Ladr 216 | Mir706 | chr6 | 119983540 | 119986489 | − | ENSMUSG00000090388 |
| 217 | Ladr 217 | 6430562O15Rik | chr13 | 100166879 | 100182819 | − | ENSMUSG00000085195 |
| 218 | Ladr 218 | Gm7782 | chr13 | 65480701 | 65553664 | − | ENSMUSG00000090514 |
| 219 | Ladr 219 | 2610027K06Rik | chr11 | 85605163 | 85645725 | − | ENSMUSG00000087013 |
| 220 | Ladr 220 | 1110046J04Rik | chr13 | 34027689 | 34028499 | + | ENSMUSG00000085457 |
| 221 | Ladr 221 | Gm17675 | chr2 | 120358640 | 120365582 | + | ENSMUSG00000091714 |
| 222 | Ladr 222 | A730081D07Rik | chr13 | 41051783 | 41096520 | − | ENSMUSG00000086693 |
| 223 | Ladr 223 | 2610206C17Rik | chr7 | 91838150 | 91925059 | + | ENSMUSG00000085236 |
| 224 | Ladr 224 | 1110019D14Rik | chr6 | 13821526 | 13994373 | + | ENSMUSG00000084815 |
| 225 | Ladr 225 | Gm16706 | chr11 | 79830856 | 79843370 | − | ENSMUSG00000086787 |
| 226 | Ladr 226 | Gm17317 | chr4 | 146510387 | 146831128 | + | ENSMUSG00000091833 |
| 227 | Ladr 227 | Gm16889 | chr4 | 146392344 | 146866310 | − | ENSMUSG00000084976 |
| 228 | Ladr 228 | Gm17452 | chr4 | 146120857 | 146399068 | − | ENSMUSG00000092143 |
| 229 | Ladr 229 | Gm16739 | chr5 | 110351668 | 110352500 | − | ENSMUSG00000085131 |
| 230 | Ladr 230 | Gm11602 | chr1 | 63161045 | 63204864 | + | ENSMUSG00000084799 |
| 231 | Ladr 231 | Gm16684 | chr17 | 32947089 | 32958642 | + | ENSMUSG00000085948 |
| 232 | Ladr 232 | Gm17548 | chr3 | 63767555 | 63772581 | + | ENSMUSG00000091540 |
| 233 | Ladr 233 | Gm2366 | chr8 | 46102570 | 46107739 | − | ENSMUSG00000091546 |
| 234 | Ladr 234 | Gm17529 | chr12 | 60054082 | 60068998 | + | ENSMUSG00000092098 |
| 235 | Ladr 235 | Gm17451 | chr6 | 38501531 | 38504007 | − | ENSMUSG00000092140 |
| 236 | Ladr 236 | 3100003L05Rik | chr7 | 131769184 | 131852449 | − | ENSMUSG00000086254 |
| 237 | Ladr 237 | 2810425M01Rik | chr10 | 76949409 | 76979175 | + | ENSMUSG00000086832 |
| 238 | Ladr 238 | Gm17238 | chr18 | 67933366 | 67934511 | − | ENSMUSG00000091127 |
| 239 | Ladr 239 | 2010110K18Rik | chr18 | 34911463 | 34918339 | + | ENSMUSG00000085410 |
| 240 | Ladr 240 | Gm17499 | chr10 | 90612260 | 90613339 | + | ENSMUSG00000092024 |
| 241 | Ladr 241 | Gm9917 | chr9 | 107461141 | 107470746 | − | ENSMUSG00000053666 |
| 242 | Ladr 242 | Gm16568 | chr9 | 15135017 | 15139789 | + | ENSMUSG00000089702 |
| 243 | Ladr 243 | Gm16624 | chr5 | 24202720 | 24210508 | − | ENSMUSG00000084903 |
| 244 | Ladr 244 | 1500026H17Rik | chr10 | 89149116 | 89163611 | + | ENSMUSG00000087686 |
| 245 | Ladr 245 | 1700109K24Rik | chr15 | 76914873 | 76926744 | + | ENSMUSG00000087126 |
| 246 | Ladr 246 | 2010204K13Rik | chrX | 6988943 | 7022269 | − | ENSMUSG00000063018 |
| 247 | Ladr 247 | 2010320O07Rik | chr18 | 38369426 | 38388799 | + | ENSMUSG00000089983 |
| 248 | Ladr 248 | 2610035F20Rik | chr14 | 122869506 | 122872801 | − | ENSMUSG00000085555 |
| 249 | Ladr 249 | 2810430I11Rik | chr2 | 27738445 | 27742572 | − | ENSMUSG00000085765 |
| 250 | Ladr 250 | 2900041M22Rik | chr11 | 117472561 | 117475171 | + | ENSMUSG00000054418 |
| 251 | Ladr 251 | 4732463B04Rik | chr12 | 85380419 | 85394757 | − | ENSMUSG00000086299 |
| 252 | Ladr 252 | 4833412C05Rik | chr7 | 74929611 | 74948382 | − | ENSMUSG00000085850 |
| 253 | Ladr 253 | 4930544I03Rik | chr12 | 91991648 | 92208208 | − | ENSMUSG00000092100 |
| 254 | Ladr 254 | 4932430I15Rik | chr5 | 93233246 | 93238514 | − | ENSMUSG00000072828 |
| 255 | Ladr 255 | 4933427G23Rik | chr5 | 23321436 | 23337715 | − | ENSMUSG00000086697 |
| 256 | Ladr 256 | 5330411J11Rik | chr2 | 59220559 | 59225528 | − | ENSMUSG00000087455 |
| 257 | Ladr 257 | 5430416N02Rik | chr5 | 100849861 | 100858535 | − | ENSMUSG00000084877 |
| 258 | Ladr 258 | 7530420F21Rik | chr1 | 151922003 | 151947004 | − | ENSMUSG00000084952 |
| 259 | Ladr 259 | 8030451A03Rik | chr4 | 63640888 | 63810958 | + | ENSMUSG00000073821 |
| 260 | Ladr 260 | A230028O05Rik | chr16 | 25059725 | 25069144 | + | ENSMUSG00000085040 |
| 261 | Ladr 261 | A330094K24Rik | chr18 | 77968420 | 77972209 | − | ENSMUSG00000090400 |
| 262 | Ladr 262 | A930001C03Rik | chr19 | 4439003 | 4448332 | + | ENSMUSG00000087132 |

TABLE 1-continued

| SEQ ID NO: | lncRNA | Gene name | chr | left | right | Str* | ID |
|---|---|---|---|---|---|---|---|
| 263 | Ladr 263 | AI854517 | chr7 | 86645003 | 86679283 | + | ENSMUSG00000085554 |
| 264 | Ladr 264 | Airn | chr17 | 12934177 | 13052988 | + | ENSMUSG00000078247 |
| 265 | Ladr 265 | B230354K17Rik | chr17 | 45570801 | 45579493 | + | ENSMUSG00000073393 |
| 266 | Ladr 266 | C130021I20Rik | chr2 | 33496713 | 33501869 | + | ENSMUSG00000052951 |
| 267 | Ladr 267 | C130071C03Rik | chr13 | 83861160 | 83880913 | + | ENSMUSG00000050334 |
| 268 | Ladr 268 | Emx2os | chr19 | 59499594 | 59533125 | − | ENSMUSG00000087095 |
| 269 | Ladr 269 | Fam150a | chr1 | 6349537 | 6384812 | + | ENSMUSG00000087247 |
| 270 | Ladr 270 | G730013B05Rik | chr16 | 50526417 | 50559548 | + | ENSMUSG00000085617 |
| 271 | Ladr 271 | Gm10561 | chr1 | 55283095 | 55292466 | + | ENSMUSG00000073675 |
| 272 | Ladr 272 | Gm11019 | chr13 | 98204925 | 98266960 | + | ENSMUSG00000078952 |
| 273 | Ladr 273 | Gm12100 | chr11 | 30650832 | 30656147 | + | ENSMUSG00000087474 |
| 274 | Ladr 274 | Gm13939 | chr2 | 109742553 | 109753476 | − | ENSMUSG00000063751 |
| 275 | Ladr 275 | Gm14261 | chr2 | 168591643 | 168593608 | + | ENSMUSG00000085322 |
| 276 | Ladr 276 | Gm15270 | chr10 | 24269247 | 24316914 | − | ENSMUSG00000087400 |
| 277 | Ladr 277 | Gm15283 | chr12 | 75027468 | 75050772 | − | ENSMUSG00000087700 |
| 278 | Ladr 278 | Gm16070 | chr1 | 17666108 | 17717727 | − | ENSMUSG00000085125 |
| 279 | Ladr 279 | Gm16091 | chr8 | 74671500 | 74684754 | − | ENSMUSG00000087502 |
| 280 | Ladr 280 | Gm16233 | chr3 | 144610525 | 144617842 | + | ENSMUSG00000085773 |
| 281 | Ladr 281 | Gm16704 | chr19 | 34549298 | 34556036 | + | ENSMUSG00000085164 |
| 282 | Ladr 282 | Gm16707 | chr9 | 119349396 | 119353948 | − | ENSMUSG00000086780 |
| 283 | Ladr 283 | Gm16789 | chr16 | 35806033 | 35809032 | − | ENSMUSG00000086400 |
| 284 | Ladr 284 | Gm16882 | chr18 | 37906213 | 37927896 | − | ENSMUSG00000085906 |
| 285 | Ladr 285 | Gm16896 | chr6 | 89254624 | 89277615 | + | ENSMUSG00000085988 |
| 286 | Ladr 286 | Gm16952 | chr17 | 71094669 | 71104922 | − | ENSMUSG00000087105 |
| 287 | Ladr 287 | Gm17256 | chr12 | 88673438 | 88676605 | + | ENSMUSG00000090672 |
| 288 | Ladr 288 | Gm17278 | chr13 | 65691229 | 65692497 | − | ENSMUSG00000091589 |
| 289 | Ladr 289 | Gm17311 | chr1 | 152006173 | 152012078 | − | ENSMUSG00000091113 |
| 290 | Ladr 290 | Gm17322 | chr9 | 57845848 | 57855258 | + | ENSMUSG00000091267 |
| 291 | Ladr 291 | Gm17396 | chr9 | 117161654 | 117163814 | + | ENSMUSG00000079669 |
| 292 | Ladr 292 | Gm17431 | chr5 | 5781530 | 5783636 | + | ENSMUSG00000091282 |
| 293 | Ladr 293 | Gm17443 | chr8 | 33118976 | 33126231 | + | ENSMUSG00000091819 |
| 294 | Ladr 294 | Gm17513 | chr2 | 177758513 | 177763441 | − | ENSMUSG00000090944 |
| 295 | Ladr 295 | Gm17514 | chr13 | 66284015 | 66304572 | − | ENSMUSG00000090945 |
| 296 | Ladr 296 | Gm17520 | chr1 | 173353316 | 173367449 | − | ENSMUSG00000092117 |
| 297 | Ladr 297 | Gm17560 | chr1 | 93193780 | 93200982 | − | ENSMUSG00000091871 |
| 298 | Ladr 298 | Gm17575 | chr3 | 96179569 | 96192787 | − | ENSMUSG00000091380 |
| 299 | Ladr 299 | Gm17609 | chr4 | 145191866 | 145301871 | − | ENSMUSG00000090398 |
| 300 | Ladr 300 | Gm17685 | chr7 | 152080465 | 152083366 | − | ENSMUSG00000090767 |
| 301 | Ladr 301 | Gm17718 | chr1 | 138518675 | 138521227 | − | ENSMUSG00000091667 |
| 302 | Ladr 302 | Gm17724 | chr5 | 110814854 | 110817092 | + | ENSMUS000000090661 |
| 303 | Ladr 303 | Gm17735 | chr13 | 66345152 | 66365458 | + | ENSMUSG00000090502 |
| 304 | Ladr 304 | Gm2115 | chr7 | 91677485 | 91726847 | + | ENSMUSG00000085128 |
| 305 | Ladr 305 | Gm4349 | chr3 | 95231593 | 95235009 | + | ENSMUSG00000091761 |
| 306 | Ladr 306 | Gm6634 | chr3 | 70576301 | 70611213 | − | ENSMUSG00000086538 |
| 307 | Ladr 307 | Gm6846 | chr10 | 21550305 | 21564657 | − | ENSMUSG00000085422 |
| 308 | Ladr 308 | Igf2as | chr7 | 149845598 | 149856261 | + | ENSMUSG00000086266 |
| 309 | Ladr 309 | Miat | chr5 | 112642248 | 112657968 | − | ENSMUSG00000086878 |
| 310 | Ladr 310 | Rgs22 | chr15 | 36067976 | 36070140 | − | ENSMUSG00000091092 |
| 311 | Ladr 311 | Sox2ot | chr3 | 34459303 | 34579773 | + | ENSMUSG00000090828 |
| 312 | Ladr 312 | Tdrd5 | chr1 | 158185426 | 158233795 | − | ENSMUSG00000060985 |
| 313 | Ladr 313 | Tsix | chrX | 100626856 | 100680296 | + | ENSMUSG00000085715 |
| 314 | Ladr 314 | Ttc28 | chr5 | 111308822 | 111718800 | + | ENSMUSG00000033209 |

*DNA strand: + = positive; − = negative

TABLE 2

Upregulated Mouse and Human lncRNA orthologs upon induction of pluripotency

| SEQ ID NO: | lncRNA | chr-mm9 | left-mm9 | right-mm9 |
|---|---|---|---|---|
| 50 | Ladr50 | chr10 | 66375237 | 66383006 |
| 129 | Ladr129 | chr11 | 74986062 | 74991135 |
| 136 | Ladr136 | chr5 | 152171284 | 152216658 |
| 150 | Ladr150 | chr9 | 56947757 | 56979097 |
| 164 | Ladr164 | chr12 | 106574804 | 106622141 |
| 236 | Ladr236 | chr7 | 131769184 | 131852449 |
| 32 | Ladr32 | chr7 | 99886168 | 99889978 |
| 48 | Ladr48 | chr1 | 57416066 | 57434348 |
| 88 | Ladr88 | chr6 | 52258383 | 52264826 |
| 58 | Ladr58 | chr5 | 129084981 | 129106568 |
| 259 | Ladr259 | chr4 | 63640888 | 63810958 |
| 176 | Ladr176 | chr19 | 29560845 | 29597649 |
| 263 | Ladr263 | chr7 | 86645003 | 86679283 |
| 264 | Ladr264 | chr17 | 12934177 | 13052988 |
| 56 | Ladr56 | chr11 | 93994799 | 94017090 |
| 267 | Ladr267 | chr13 | 83861160 | 83880913 |
| 84 | Ladr84 | chr5 | 116573623 | 116579119 |
| 111 | Ladr111 | chr8 | 111599122 | 111797711 |
| 157 | Ladr157 | chr12 | 111513594 | 111516278 |
| 272 | Ladr272 | chr13 | 98204925 | 98266960 |
| 230 | Ladr230 | chr1 | 63161045 | 63204864 |
| 277 | Ladr277 | chr12 | 75027468 | 75050772 |
| 154 | Ladr154 | chr7 | 129282522 | 129302915 |
| 279 | Ladr279 | chr8 | 74671500 | 74684754 |
| 145 | Ladr145 | chr3 | 7612705 | 7690001 |
| 282 | Ladr282 | chr9 | 119349396 | 119353948 |
| 142 | Ladr142 | chr16 | 29907605 | 29946603 |

TABLE 2-continued

Upregulated Mouse and Human lncRNA orthologs upon induction of pluripotency

| | | | | |
|---|---|---|---|---|
| 201 | Ladr201 | chr17 | 45871455 | 45925543 |
| 141 | Ladr141 | chr8 | 112385625 | 112392355 |
| 192 | Ladr192 | chr1 | 12657644 | 12663171 |
| 43 | Ladr43 | chr8 | 89996711 | 90049453 |
| 135 | Ladr135 | chr8 | 81819022 | 81831584 |
| 110 | Ladr110 | chr13 | 99870661 | 99877535 |
| 130 | Ladr130 | chr6 | 52195051 | 52199794 |
| 18 | Ladr18 | chr12 | 110779211 | 110809936 |
| 134 | Ladr134 | chr16 | 84713268 | 84715487 |
| 74 | Ladr74 | chr12 | 110973191 | 110987665 |
| 21 | Ladr21 | chr12 | 110842155 | 110899919 |
| 158 | Ladr158 | chr15 | 32170324 | 32174417 |
| 311 | Ladr311 | chr3 | 34459303 | 34579773 |
| 313 | Ladr313 | chrX | 100626856 | 100680296 |
| 30 | Ladr30 | chr6 | 83642800 | 83662195 |
| 47 | Ladr47 | chrX | 100655714 | 100678556 |

| SEQ ID NO: | chr-hc19 | left-hg19 | right-hg19 |
|---|---|---|---|
| 315 | chr10 | 65473608 | 65477165 |
| 316 | chr17 | 1946762 | 1954455 |
| 317 | chr13 | 34116876 | 34220938 |
| 318 | chr15 | 75660404 | 75699561 |
| 319 | chr14 | 96342568 | 96391908 |
| 320 | chr16 | 26306223 | 26376651 |
| 321 | chr11 | 82783096 | 82790139 |
| 322 | chr2 | 200761331 | 200775882 |
| 323 | chr7 | 27277134 | 27283643 |
| 324 | chr12 | 130624758 | 130646888 |
| 325 | chr9 | 117806328 | 117983873 |
| 326 | chr9 | 5582670 | 5629781 |
| 327 | chr15 | 89905832 | 89941709 |
| 328 | chr6 | 160303155 | 160413129 |
| 329 | chr17 | 49002131 | 49028278 |
| 330 | chr5 | 87960259 | 87980578 |
| 331 | chr12 | 119969729 | 119982930 |
| 332 | chr16 | 72438983 | 72698902 |
| 333 | chr14 | 102023636 | 102026673 |
| 334 | chr5 | 73669250 | 73730264 |
| 335 | chr2 | 206950705 | 207007651 |
| 336 | chr14 | 62187023 | 62217777 |
| 337 | chr16 | 23673394 | 23690117 |
| 338 | chr19 | 16205669 | 16222211 |
| 339 | chr8 | 79716708 | 79814703 |
| 340 | chr3 | 38532681 | 38537742 |
| 341 | chr3 | 193692107 | 193721538 |
| 342 | chr6 | 43991381 | 44043849 |
| 343 | chr16 | 71757936 | 71765413 |
| 344 | chr8 | 70356940 | 70361515 |
| 345 | chr16 | 49315971 | 49372596 |
| 346 | chr4 | 146521236 | 146540150 |
| 347 | chr5 | 71895453 | 71900248 |
| 348 | chr7 | 27224096 | 27228917 |
| 349 | chr14 | 101292457 | 101327362 |
| 350 | chr21 | 26945089 | 26947227 |
| 351 | chr14 | 101521835 | 101539271 |
| 352 | chr14 | 101361216 | 101417326 |
| 353 | chr5 | 9546382 | 9550405 |
| 354 | chr3 | 181328327 | 181461409 |
| 355 | chrX | 73014340 | 73073529 |
| 356 | chr2 | 71099447 | 71128657 |
| 357 | chrX | 73040495 | 73072548 |

Additional human Lairs were identified in human skin fibroblasts upon induction of pluripotency reprogramming. These human lncRNAs include SEQ ID NOs. 368-408 as listed in Table 3.

TABLE 3

Human lncRNAs upregulated during pluripotency reprogramming of primary skin fibroblasts.

| SEQ ID NO: | lncRNA | chr-hg19 | str | left-hg19 | right-hg19 |
|---|---|---|---|---|---|
| 368 | RP11-426L16.8 | chr1 | − | 113362792 | 113393265 |
| 369 | AC008069.3 | chr2 | − | 16973247 | 16978722 |
| 370 | RP11-5N23.2 | chr10 | + | 6622381 | 6627641 |
| 371 | AL513497.1 | chr1 | − | 28835514 | 28837109 |
| 372 | AC021224.1 | chr18 | + | 29992145 | 29993199 |
| 373 | RP11-308B16.1 | chr5 | + | 12574969 | 12804475 |
| 374 | AC022409.1 | chr19 | − | 23582041 | 23598873 |
| 375 | AP002856.5 | chr11 | + | 131123317 | 131170666 |
| 376 | AC074289.1 | chr2 | + | 64370373 | 64479993 |
| 377 | RP11-342C23.4 | chr9 | + | 97320996 | 97330312 |
| 378 | AL133167.1 | chr14 | + | 96342729 | 96391899 |
| 379 | RP11-277P12.10 | chr12 | − | 10485460 | 10490891 |
| 380 | AP003486.1 | chr11 | − | 130434325 | 130628495 |
| 381 | RMST | chr12 | + | 97858799 | 97958793 |
| 382 | KIAA0040 | chr1 | − | 175126123 | 175162079 |
| 383 | AC010627.1 | chr5 | + | 14651755 | 14653492 |
| 384 | RP11-69I8.2 | chr6 | + | 132223103 | 132241705 |
| 385 | AC009163.1 | chr16 | + | 75507023 | 75529305 |
| 386 | AL136362.1 | chrX | − | 91354536 | 91360178 |
| 387 | MIR17HG | chr13 | + | 92000074 | 92006833 |
| 388 | RP11-771K4.1 | chr12 | − | 31516415 | 31522235 |
| 389 | AC078819.1 | chr12 | − | 104424522 | 104426026 |
| 390 | AP000689.1 | chr21 | − | 37502670 | 37648524 |
| 391 | RP11-562F9.2 | chr4 | − | 93189918 | 93198226 |
| 392 | RP11-168P6.1 | chr13 | − | 54689924 | 54707001 |
| 393 | RP11-168O16.1 | chr1 | + | 200993077 | 200997920 |
| 394 | RP11-713B9.1 | chr11 | + | 115045697 | 115046044 |
| 395 | SOX2OT | chr3 | + | 180721562 | 181508734 |
| 396 | RP11-403C10.2 | chr8 | − | 9757574 | 9762876 |
| 397 | RP11-697K23.1 | chr3 | − | 45720535 | 45730626 |
| 398 | AC020928.1 | chr19 | + | 37264055 | 37267978 |
| 399 | RP11-366M4.3 | chr4 | + | 165798156 | 165820117 |
| 400 | RP11-20D14.6 | chr12 | + | 8940853 | 8948385 |
| 401 | AC126775.1 | chr5 | + | 146939557 | 147041572 |
| 402 | AL691420.1 | chr9 | + | 118235807 | 118353358 |
| 403 | AC005753.1 | chr5 | + | 141227143 | 141231803 |
| 404 | RP11-799O21.1 | chr10 | + | 6821560 | 6884868 |
| 405 | RP11-129K20.2 | chr3 | + | 62936105 | 63110738 |
| 406 | AC112484.1 | chr3 | − | 128679210 | 128684200 |
| 407 | AC005394.1 | chr19 | − | 28926300 | 29218587 |

DNA strand: + = positive strand; − = negative strand

In other embodiments of the present invention, improved somatic cell reprogramming includes the absence or repression of the lncRNAs disclosed herein to be downregulated during reprogramming of the somatic cells. The lncRNAs which are disclosed herein to be downregulated during induced pluripotency include the mouse lncRNAs (SEQ ID NOs. 415-424) as listed in Table 4A and the human lncRNAs (SEQ ID NOs. 358-367) as listed in Table 4B.

In some embodiments, decreasing the expression or cellular activity in mouse cells includes using one or more of the mouse lncRNAs encoded by SEQ ID NOs: 415-424, or decreasing the expression or cellular activity in human cells using one or more of the human lncRNAs enclosed by SEQ ID NOs. 358-367 as listed in Table 4B.

TABLE 4A

Mouse (mm9) downregulated lncRNAs during iPS cell reprogramming

| lncRNA | SEQ ID NO: | chr-mm9 | Str* | left-mm9 | right-mm9 |
|---|---|---|---|---|---|
| 2210408F21Rik | 415 | chr6 | + | 31170351 | 31287404 |
| D030054H15Rik | 416 | chr17 | − | 8075373 | 8139217 |
| Gm13986 | 417 | chr2 | − | 117683027 | 117936938 |
| Gm14005 | 418 | chr2 | − | 128021729 | 128255085 |

TABLE 4A-continued

Mouse (mm9) downregulated lncRNAs during iPS cell reprogramming

| lncRNA | SEQ ID NO: | chr-mm9 | Str* | left-mm9 | right-mm9 |
|---|---|---|---|---|---|
| Gm14488 | 419 | chr2 | − | 30568667 | 30575577 |
| Gm16625 | 420 | chr8 | + | 25532876 | 25550480 |
| 1700020I14Rik | 421 | chr2 | + | 119420033 | 119433238 |
| 2410006H16Rik | 422 | chr11 | + | 62416379 | 62418309 |
| 9430037G07Rik | 423 | chr9 | − | 88490163 | 88494354 |
| Gm17480 | 424 | chr17 | + | 25931839 | 26101729 |

*DNA strand: + = positive strand; − = negative strand

TABLE 4B

Human (hg19) liftOver coordinates of mm9 in Table 4A.

| lncRNA | SEQ ID NO: | chr-hg19 | left-hg19 | right-hg19 |
|---|---|---|---|---|
| 2210408F21Rik | 358 | chr7 | 130794788 | 130934427 |
| D030054H15Rik | 359 | chr6 | 159420370 | 159509319 |
| Gm13986 | 360 | chr15 | 39537299 | 39872516 |
| Gm14005 | 361 | chr2 | 111966340 | 112252695 |
| Gm14488 | 362 | chr9 | 132251908 | 132259983 |
| Gm16625 | 363 | chr8 | 40009983 | 40028634 |
| 1700020I14Rik | 364 | chr15 | 41576169 | 41598737 |
| 2410006H16Rik | 365 | chr17 | 16342356 | 16345222 |
| 9430037G07Rik | 366 | chr6 | 86386845 | 86388510 |
| Gm17480 | 367 | chr16 | 597538 | 767429 |

Additional human downregulated lncRNAs were identified in human skin fibroblasts upon induction of pluripotency reprogramming. These human lncRNAs include SEQ ID NOs. 408-414 as listed in Table 5.

Table 5. Downregulated human lncRNAs during induced pluripotency in human skin fibroblasts

| SEQ ID NO: | lncRNA | chr-hg19 | str* | left-hg19 | right-hg19 |
|---|---|---|---|---|---|
| 408 | C17orf91 | chr17 | − | 1614805 | 1619504 |
| 409 | AC005323.1 | chr17 | + | 10286461 | 10527704 |
| 410 | RP11-834C11.4 | chr12 | + | 54519882 | 54526627 |
| 411 | RP11-792D21.2 | chr4 | + | 79567057 | 79603853 |
| 412 | AP000769.4 | chr11 | + | 65211929 | 65212028 |
| 413 | RP11-90J7.3 | chr10 | + | 80008497 | 80434724 |
| 414 | NEAT1 | chr11 | + | 65190245 | 65213011 |

*DNA strand: + = positive strand; − = negative strand

Embodiments of the present invention include lncRNAs which are upregulated or downregulated upon induction of pluripotency and/or inhibition of Mek and Gsk3, referred to herein as "2i inhibition" or "2i conditions." In some embodiments of the present invention, improved pluripotency by reprogramming of a somatic cell, includes the presence of the activated lncRNAs (i.e., Ladrs) in a pluripotency cell reaction. Methods for reprogramming of human induced pluripotent stem cells is described herein and has been previously described in Loewer et al., 2010, *Nature Genetics*, 42: 1113-1117, the entire contents of which are herein incorporated by reference. For example, reprogramming of induced pluripotent stem cells may include induction of the Oct4, Sox2, Klf4, c-Myc (OSKM) transcription factors and/or the "dual inhibition" of Mek and Gsk3 also known as "2i."

In some embodiments, the lncRNA and lncRNA fragments of the present invention include fragments of the sequence that are at least 20 nucleotides (nt) in length. In one embodiment, an lncRNA molecule includes a nucleotide sequence that is at least about 85% or more homologous or identical to the entire length of a lncRNA sequence shown herein, e.g., in Tables 1, 2, 3, 4, or 5, or a fragment comprising at least 20 nt thereof (e.g., at least 25, 30, 35, 40, 50, 60, 70, 80, 90, or 100 nt thereof, e.g., at least 5%, 10%, 15%, 20%, 25%, 30%, 35%, 40%, 50% or more of the full length lncRNA). In some embodiments, the nucleotide sequence is at least about 90%, 91%, 92%, 93%, 94%, 95%, 96%, 97%, 98%, 99% or 100% homologous or identical to a lncRNA sequence shown herein.

In Tables 1, 2, 3, 4, and 5 disclosed herein the genomic coordinates are provided for each lncRNA. As understood by a person having ordinary skill in the art, any lncRNA transcripts that overlap by at least 1 base pair with the genomic coordinates of the lncRNAs disclosed herein, should be considered isoforms of these lncRNAs with analogous functional roles during somatic cell reprogramming or pluripotent stem cell differentiation.

In order to determine the percent identity of two nucleic acid sequences, the sequences are aligned for optimal comparison purposes (e.g., gaps can be introduced in an nucleic acid sequence for optimal alignment and non-homologous sequences can be disregarded for comparison purposes). The length of a reference sequence aligned for comparison purposes is at least 80% of the length of the reference sequence, and in some embodiments is at least 90% or 100%. The nucleotide positions are then compared. When a position in the first sequence is occupied by the same nucleotide as the corresponding position in the second sequence, then the molecules are identical at that position (as used herein nucleic acid "identity" is equivalent to nucleic acid "homology"). The percent identity between the two sequences is a function of the number of identical positions shared by the sequences, taking into account the number of gaps, and the length of each gap, which need to be introduced for optimal alignment of the two sequences.

For purposes of the present invention, the comparison of sequences and determination of percent identity between two sequences may be accomplished using a Blossum 62 scoring matrix with a gap penalty of 12, a gap extend penalty of 4, and a frameshift gap penalty of 5.

Methods of Pluripotency Reprogramming or Pluripotent Cell Differentiation.

Methods of enhancing pluripotency reprogramming or pluripotent cell differentiation are disclosed herein. The lncRNAs described herein, including fragments thereof that are at least 20 nt in length, and inhibitory nucleic acids and small molecules targeting (e.g., complementary to) them, can be used to modulate pluripotency reprogramming. Methods for enchanced pluripotency reprogramming include the addition or activation of Ladr molecules disclosed in Tables 1, 2, and/or 3 and/or the inhibition of the lncRNAs disclosed in Tables 4A, 4B and/or 5. Conversely, enchancing pluripotent cell differentiation includes the absence or repression of the Ladr sequences in Tables 1, 2, and/or 3 and/or the addition or activation of the lncRNA sequences in Tables 4A, 4B and/or 5.

For enhancing pluripotency reprogramming of a somatic cell or differentiation of a pluripotent cell, addition or activation of at least one lncRNA may include one of many known suitable methods. For example, the somatic cell or pluripotent cell may be contacted with (e.g., cultured with) synthetic lncRNAs or in vitro transcribed lncRNA encoding the lncRNA or a fragment thereof. Additional non-limiting examples for increasing the presence of lncRNA in the presence of somatic cell for induced pluripotency reprogramming includes delivery vectors, viral viruses, and chemical synthesis.

Enhancing pluripotency reprogramming of a somatic cell or differentiation of a pluripotent cell may include inhibition or repression of at least one lncRNA may include one of many known suitable methods. For example, the somatic cell or pluripotent cell may be contacted with (e.g., cultured with) an inhibiting nucleic acid of at least one lncRNA. Inhibiting nucleic acid molecules include antisense oligonucleotides, interfering RNA (RNAi) including small interfering RNA (siRNA) and short hairpin RNA (shRNA). Inhibiting nucleic acid molecules used to practice the methods described herein, whether RNA, cDNA, genomic DNA, vectors, viruses or hybrids thereof, can be isolated from a variety of sources, genetically engineered, amplified, and/or expressed/generated recombinantly. If desired, nucleic acid sequences of the invention can be inserted into delivery vectors and expressed from transcription units within the vectors. The recombinant vectors can be DNA plasmids or viral vectors. Generation of the vector construct can be accomplished using any suitable genetic engineering techniques well known in the art, including, without limitation, the standard techniques of PCR, oligonucleotide synthesis, restriction endonuclease digestion, ligation, transformation, plasmid purification, and DNA sequencing, for example as described in Sambrook et al. Molecular Cloning: A Laboratory Manual. (1989)), Coffin et al. (Retroviruses. (1997)) and "RNA Viruses: A Practical Approach" (Alan J. Cann, Ed., Oxford University Press, (2000), the entire contents of all of which are herein incorporated by reference).

In some embodiments, inhibitory nucleic acids of the invention are synthesized chemically. Nucleic acid sequences used to practice this invention can be synthesized in vitro by well-known chemical synthesis techniques, as described in, e.g., Adams (1983) J. Am. Chem. Soc. 105:661; Belousov (1997) Nucleic Acids Res. 25:3440-3444; Frenkel (1995) Free Radic. Biol. Med. 19:373-380; Blommers (1994) Biochemistry 33:7886-7896; Narang (1979) Meth. Enzymol. 68:90; Brown (1979) Meth. Enzymol. 68:109; Beaucage (1981) Tetra. Lett. 22:1859; U.S. Pat. No. 4,458,066; WO/2008/043753 and WO/2008/049085, and the references cited therein, the entire contents of all of which are herein incorporated by reference.

In some embodiments, a method of enhancing pluripotency reprogramming of a somatic human cell includes the addition or activation of at least one human lncRNA selected from Tables 2 and/or 3. In other embodiments, a method of enhancing human pluripotent cell differentiation includes the addition or activation of at least one human lncRNA selected from Tables 4B and/or 5.

In some embodiments, a method for enhancing pluripotency reprogramming of a somatic cell or differentiation of a pluripotent cell, includes inhibition or repression of at least one human lncRNA selected from Tables 4B or 5. In other embodiments, a method of enhancing human pluripotent cell differentiation includes the addition or activation of at least one human lncRNA selected from Tables 2 and/or 3.

It is understood by a person having ordinary skill in the art, that any of the modified chemistries or formats of inhibitory nucleic acids described herein can be combined with each other, and that one, two, three, four, five, or more different types of modifications can be included within the same molecule.

The following Examples are presented for illustrative purposes only, and do not limit the scope or contents of the present application.

Example 1

Single-Cell Transcriptome Analysis of Activated Genes During Reprogramming

Figure 2A:
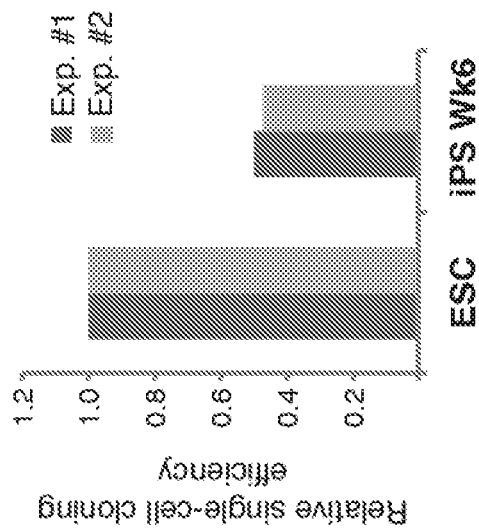
FIGS. 2A, 2B, and 2C show induced pluripotent stem cells as described herein, according to embodiments of the invention.
Figure 2B:
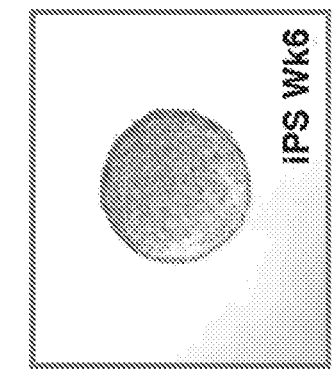
Figure 2C:
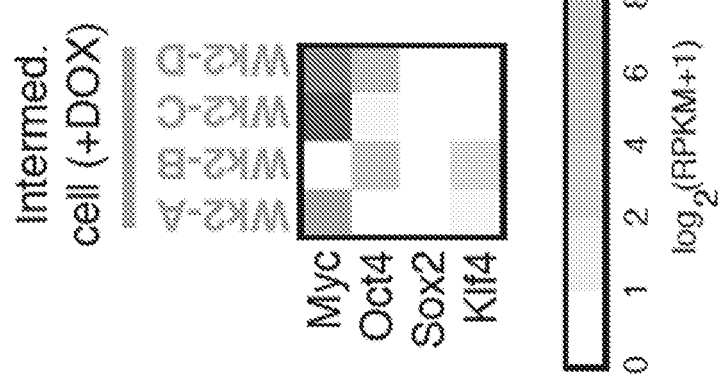
Figure 3:
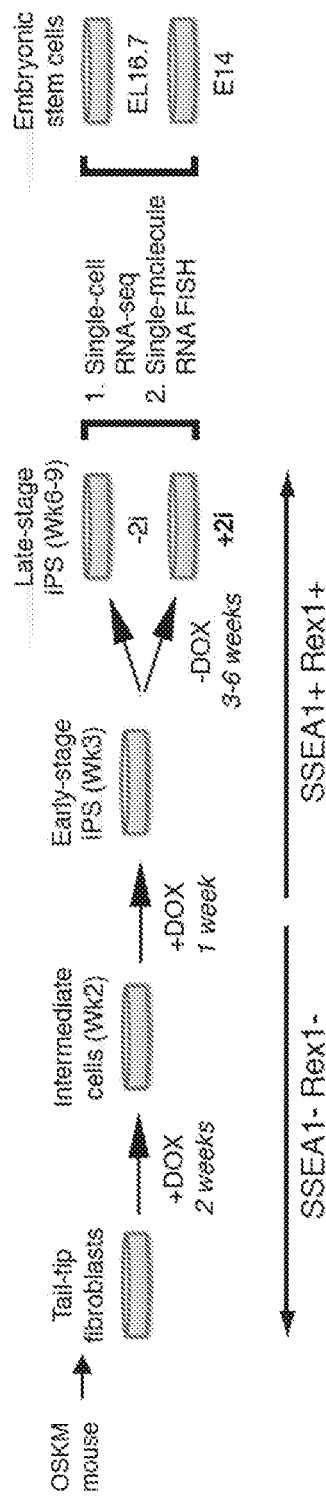
FIG. 3 is a schematic showing induction of pluripotency in tail-tip fibroblasts, according to embodiments of the invention.

In order to characterize the transcriptomes of individual reprogramming cells at defined timepoints, single-cell RNA-sequencing was performed as described (Ramskold et al., 2012, Nat Biotechnol 30, 777-782, the entire contents of which are herein incorporated by reference) using cells from the "reprogrammable" mouse (Carey, B. W. et al., 2010, Nat Methods 7, 56-59, the entire contents of which are herein incorporated by reference). Tail-tip fibroblasts (TTF) from these mice, which harbor doxycycline (dox)-inducible OSKM transgenes (FIG. 2A) were generated, and these cells were cultured in the presence of dox for 3 weeks. ES cell-like colonies that expressed SSEA1 began to appear after 3 weeks, and these early-stage iPS cells were cultured for an additional 3-6 weeks in the absence of dox. Late-stage iPS cells at week 6 (Wk6), which had single-cell cloning efficiencies of ~50% when compared to ES cells (FIG. 2B), were also cultured in 2i conditions to facilitate establishment of the pluripotent ground state (Silva, J. et al., 2008, PLoS Biol 6, e253, the entire contents of which are herein incorporated by reference). Additionally, two different ES cell lines (E14 and EL16.7) were cultured to compare similarities between ES and iPS cell transcriptomes at the single-cell level (FIG. 3).

Figure 4A:
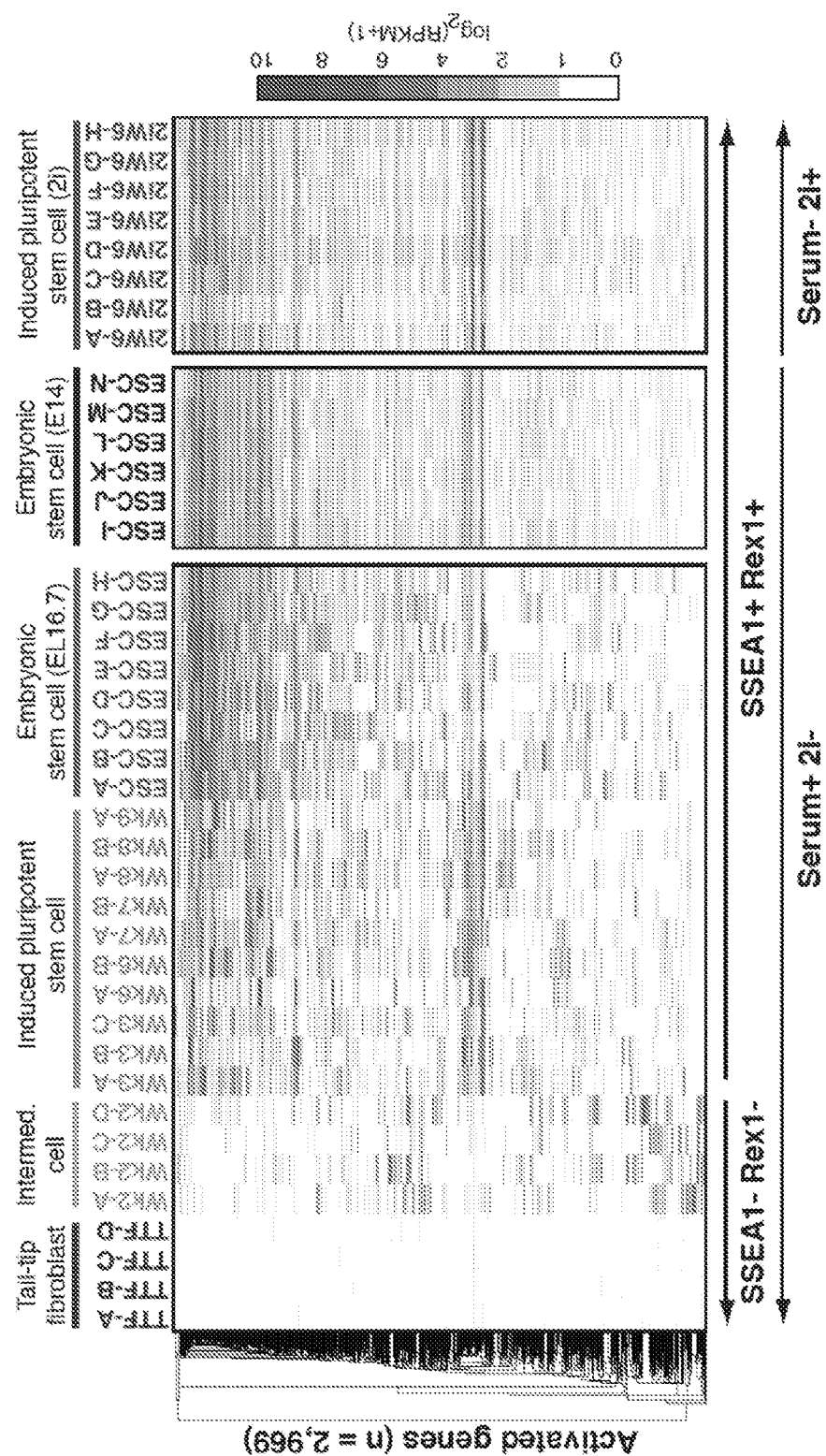
FIG. 4A shows activated genes in tail tip fibroblasts as described herein, according to embodiments of the invention.
Figure 4C:
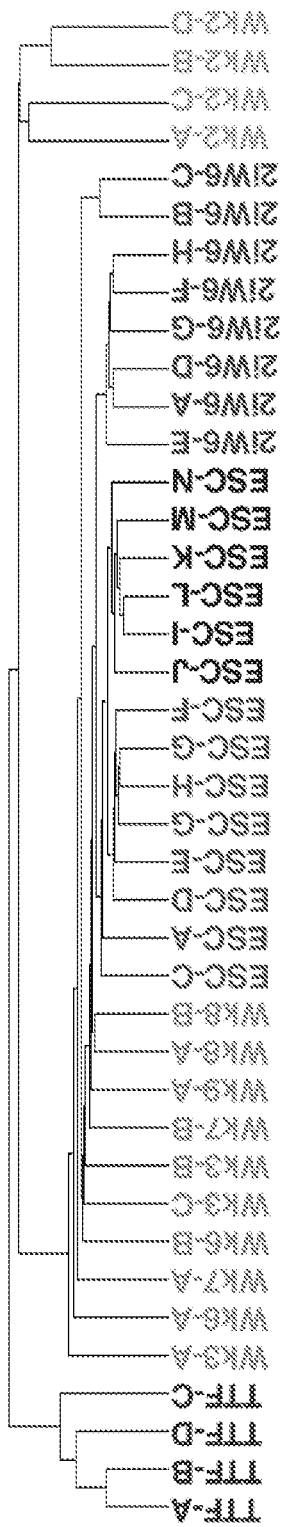
FIGS. 4C-4D show a timeline of induced pluripotency as described herein, according to embodiments of the invention.

Protein-coding genes that were activated during reprogramming and the acquisition of pluripotency were first examined. That is, approximately 3,000 activated genes were expressed at 10 RPKM (reads per kilobase per million mapped reads) (Mortazavi, A. et al., 2008, Nat Methods 5, 621-628, the entire contents of which are herein incorporated by reference) or higher in non-TTF cells, while being off in TTF cells (expressed at less than 1 RPKM) (FIG. 4A). When hierarchical clustering was performed, the cells from both ES lines clustered together, along with the late-stage iPS cells that were cultured in 2i conditions. Both early- and late-stage iPS cells cultured in non-2i conditions clustered together, suggesting different latencies in their reprogramming/remodeling kinetics (Hanna, J. et al., 2009, Nature 462, 595-601, the entire contents of which are herein incorporated by reference). In late-stage iPS cells, imposing 2i conditions pushed their protein-coding transcriptomes (FIG. 4B) to more closely resemble the pluripotent ground state of ES cells (FIG. 4C).

Figure 4D:
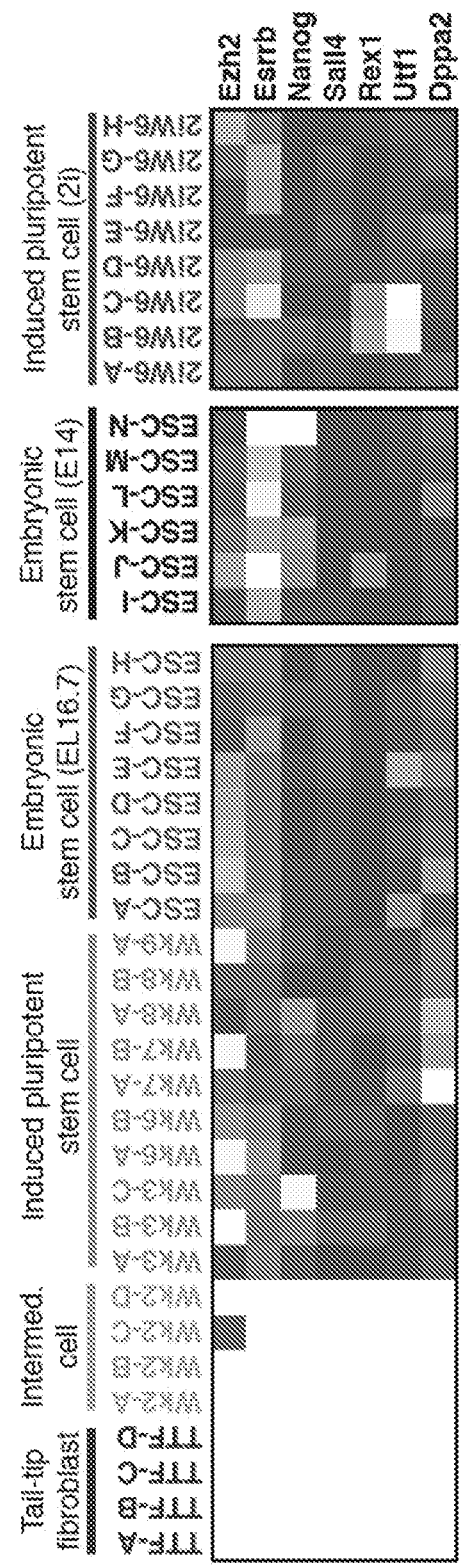
Figure 5A:
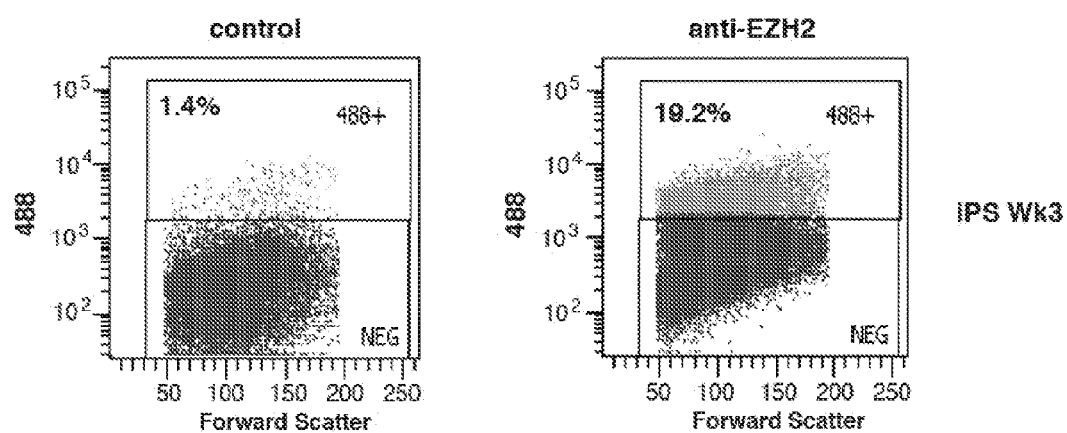
FIGS. 5A, 5B, and 5C each show a forward scatter plot of iPS cells at week 3 (FIG. 5A), week 6 (FIG. 5B), and week 9 (FIG. 5C), according to embodiments of the invention.
Figure 5B:
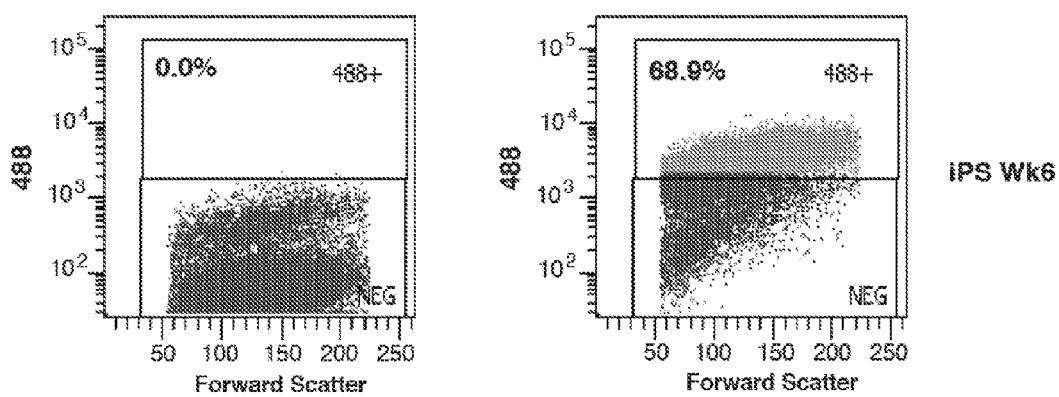
Figure 5C:
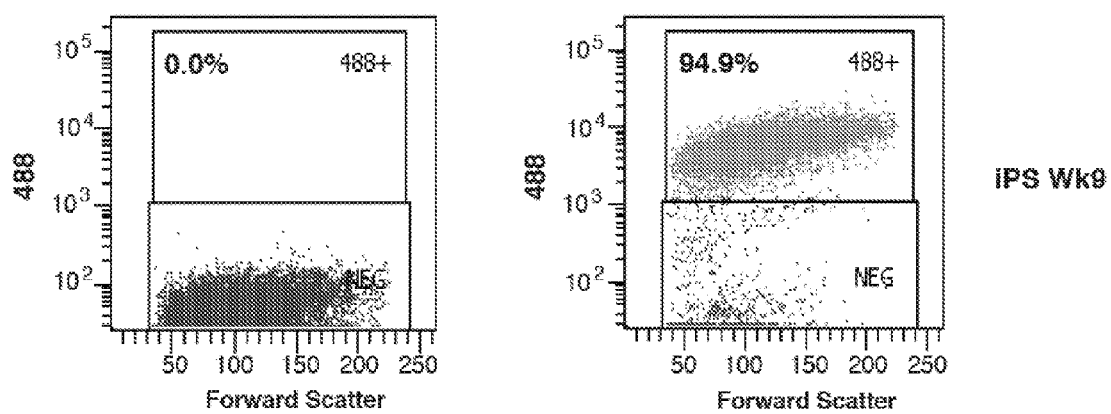

The expression patterns of known pluripotency-related genes that are widely used as faithful predictors of proper iPS cell reprogramming were next examined (Buganim, Y. et al., 2012, Cell 150, 1209-1222, the entire contents of which are herein incorporated by reference). It was found that the genes Esrrb, Utf1, Lin28, and Dppa2 were all expressed starting at week 3 (Wk3) in this reprogramming timecourse, as well as Nanog and Rex1. However, Polycomb histone methyltransferase Ezh2, which physically binds to numerous lncRNAs according to (Guttman, M. et al., 2011, Nature 477, 295-300; Zhao, J. et al., 2010, Mol Cell 40, 939-953, the entire contents of which are herein incorporated by reference), was heterogeneously expressed in both early- and late-stage iPS cells (FIG. 4D and FIGS. 5A, 5B, 5C). This heterogeneity in Ezh2 expression was attenuated under 2i conditions (FIG. 4D).

Example 2

Visualizing Single-Cell Transcriptome Dynamics Using the Self Organizing Map (SOM)

Figure 6:
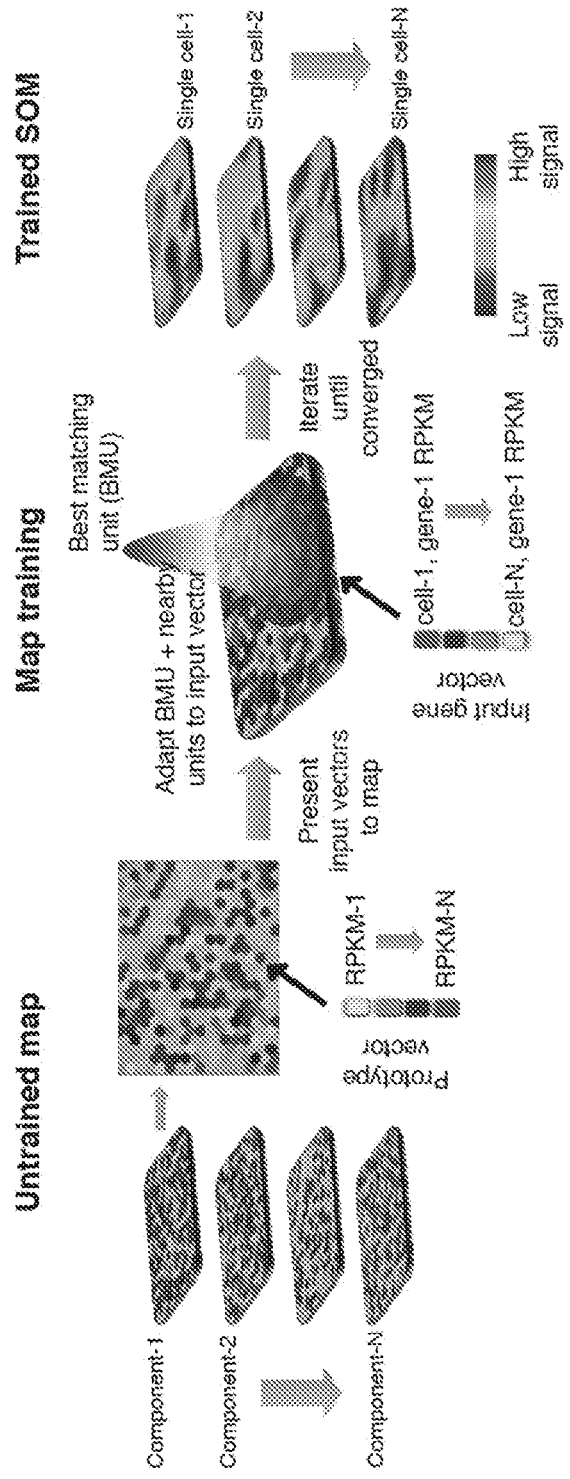
FIG. 6 is a self-organizing map to identify dynamic changes in the single-cell transcriptomes of reprogramming cells to facilitate visualization of gene sets that are coordinately expressed during the reprogramming timecourse, according to embodiments of the invention.
Figure 7A:
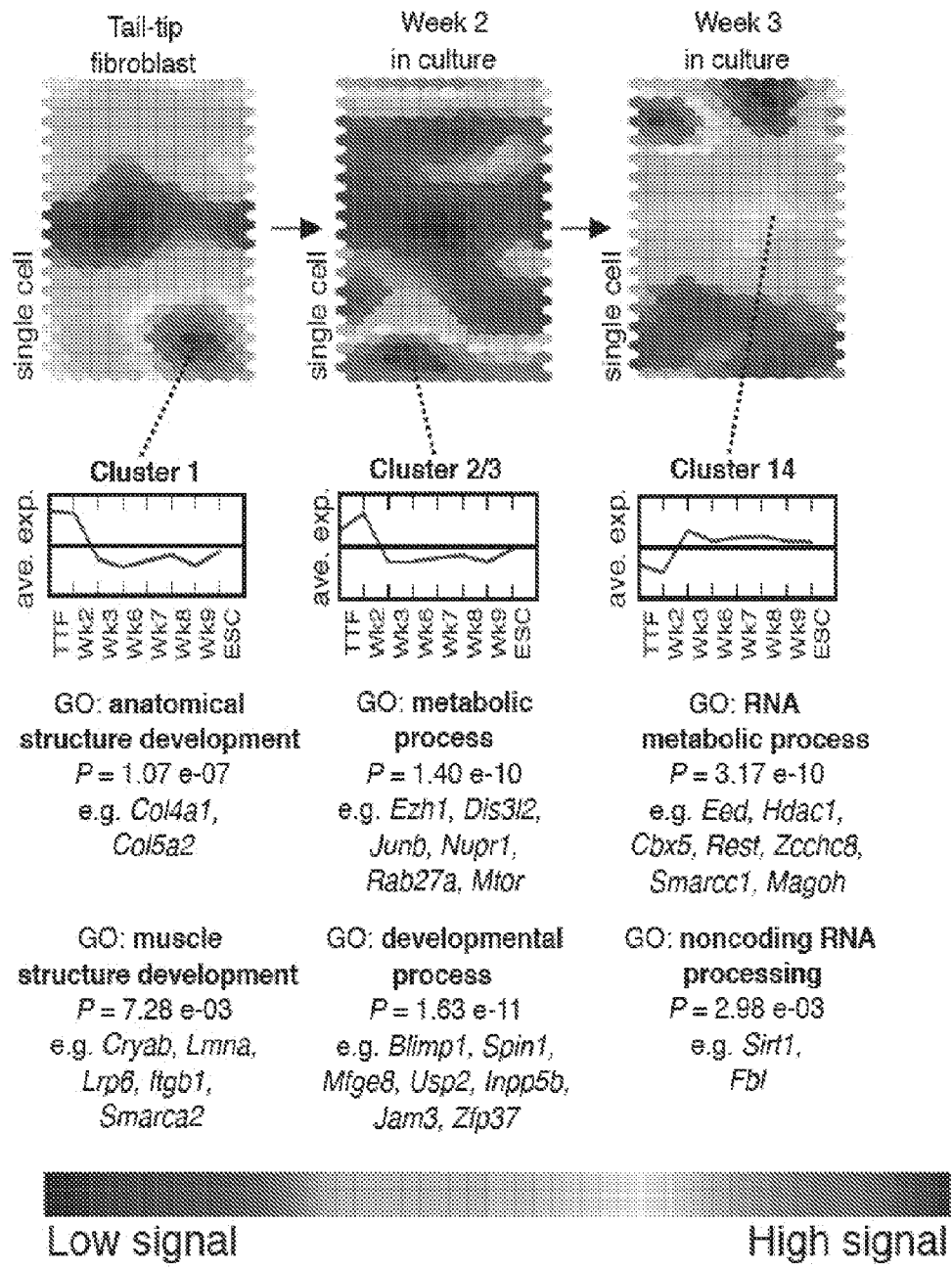
FIG. 7A is an analysis of tail tip fibroblasts (TTFs) that strongly express genes involved in body axis anatomy and development of muscle, as described herein. Intermediate reprogramming cells at week 2 (Wk2) expressed numerous genes that are required for proper germ cell development and fertility, including Blimp1. By week 3 (Wk3) of reprogramming, individual cells began to express genes that are involved in RNA metabolism and noncoding RNA processing Late-stage iPS cells at week 6 (Wk6) strongly expressed hundreds of pseudogenes which can be processed into small regulatory RNAs in oocytes. Late-stage iPS cells at week 8 (Wk8) expressed known pluripotency factors at high levels, including Oct4, Nanog, Esrrb, and Sall4, but did not exhibit full activation of germ cell regulatory genes such as Stella and Prdm14, which are highly expressed in ES cells, according to embodiments of the invention.
Figure 7A:
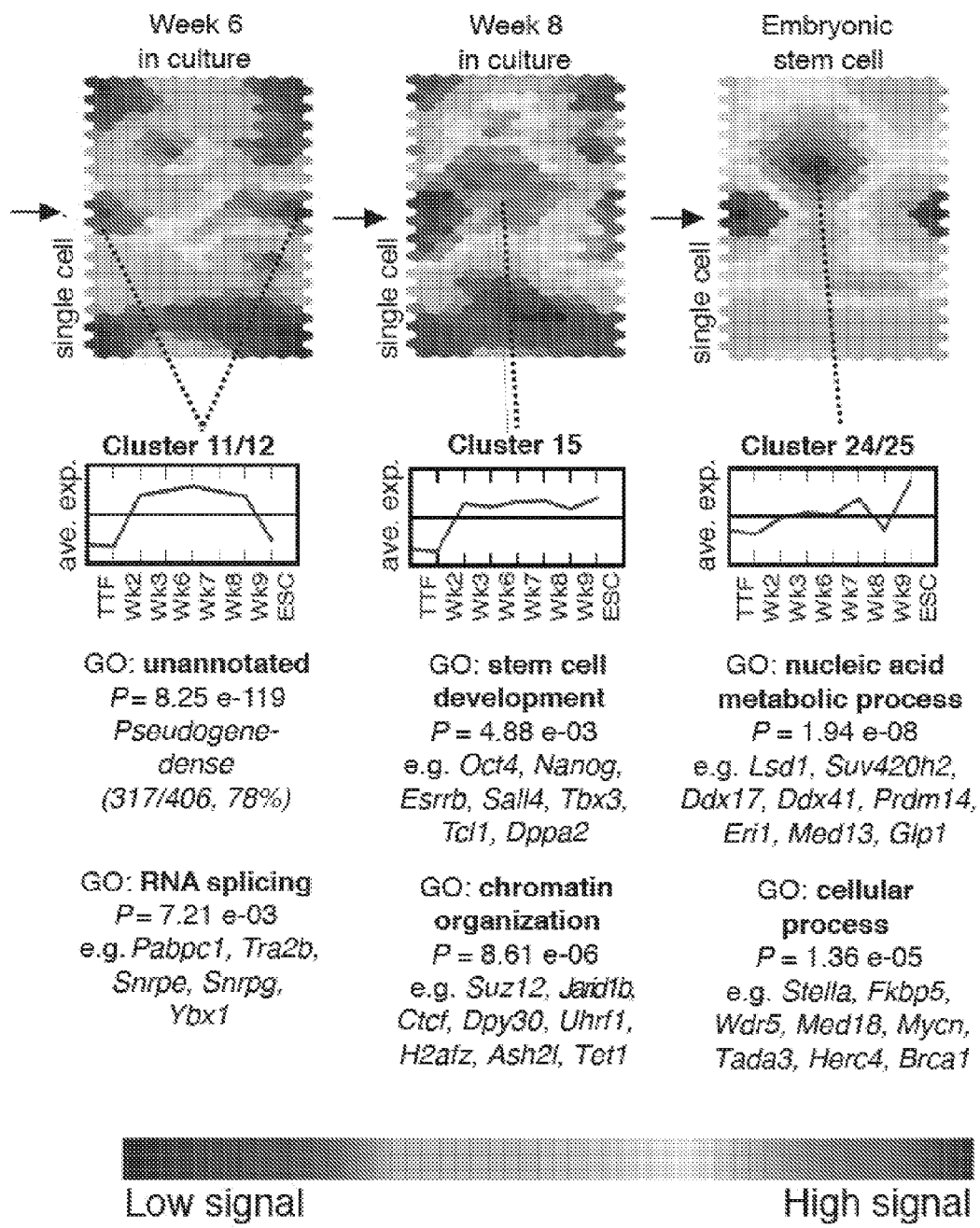

In order identify dynamic changes in the single-cell transcriptomes of reprogramming cells, a self-organizing map (SOM) (Kohonen, T., 2013, Neural Netw 37, 52-65, the entire contents of which are herein incorporated by reference) was generated, which facilitates visualization of gene sets that are coordinately expressed during the reprogramming timecourse (FIGS. 6 and 7A). The 5,000 protein-coding and lncRNA genes were used with the greatest variance among the single-cell RNA-seq data to train the SOM. The results of FIG. 7A show that TTFs strongly express genes involved in body axis anatomy and development of muscle. Notably, intermediate reprogramming cells at week 2 (Wk2) expressed numerous genes that are required for proper germ cell development and fertility, including Blimp1 (Ohinata, Y. et al., 2005, Nature 436, 207-213, the entire contents of which are herein incorporated by reference), Spin1, Mfge8, Usp2, Inpp5b, Jam3, and Zfp37 (FIGS. 7A-7B) (Eppig, J. T. et al., 2012, Nucleic Acids Res 40, D881-886, the entire contents of which are herein incorporated by reference). These results suggest that somatic cell reprogramming takes advantage of existing developmental programs in germ cells, where global reprogramming of the epigenome occurs as part of normal embryonic development (Hayashi, K. et al., 2009, Cell Stem Cell 4, 493-498, the entire contents of which are herein incorporated by reference).

By week 3 (Wk3) of reprogramming, individual cells began to express genes that are involved in RNA metabolism and noncoding RNA processing (FIG. 7A). Surprisingly, late-stage iPS cells at Wk6 strongly expressed hundreds of pseudogenes (FIG. 7A), which can be processed into small regulatory RNAs in oocytes (Tam, O. H. et al., 2008, Nature 453, 534-538, the entire contents of which are herein incorporated by reference). Late-stage iPS cells at week 8 (Wk8) expressed known pluripotency factors at high levels, including Oct4, Nanog, Esrrb, and Sall4, but they failed to exhibit full activation of germ cell regulatory genes such as Stella and Prdm14, which are highly expressed in ES cells (FIG. 7A). These results indicate that while the transcriptional landscape of late-stage iPS cells are quite similar to ES cells, there are also notable differences in expression of both protein-coding and noncoding genes at the single-cell level.

Example 3

Germ Cell-Related Genes are Expressed in Late-Stage iPS Cells

Figure 8:
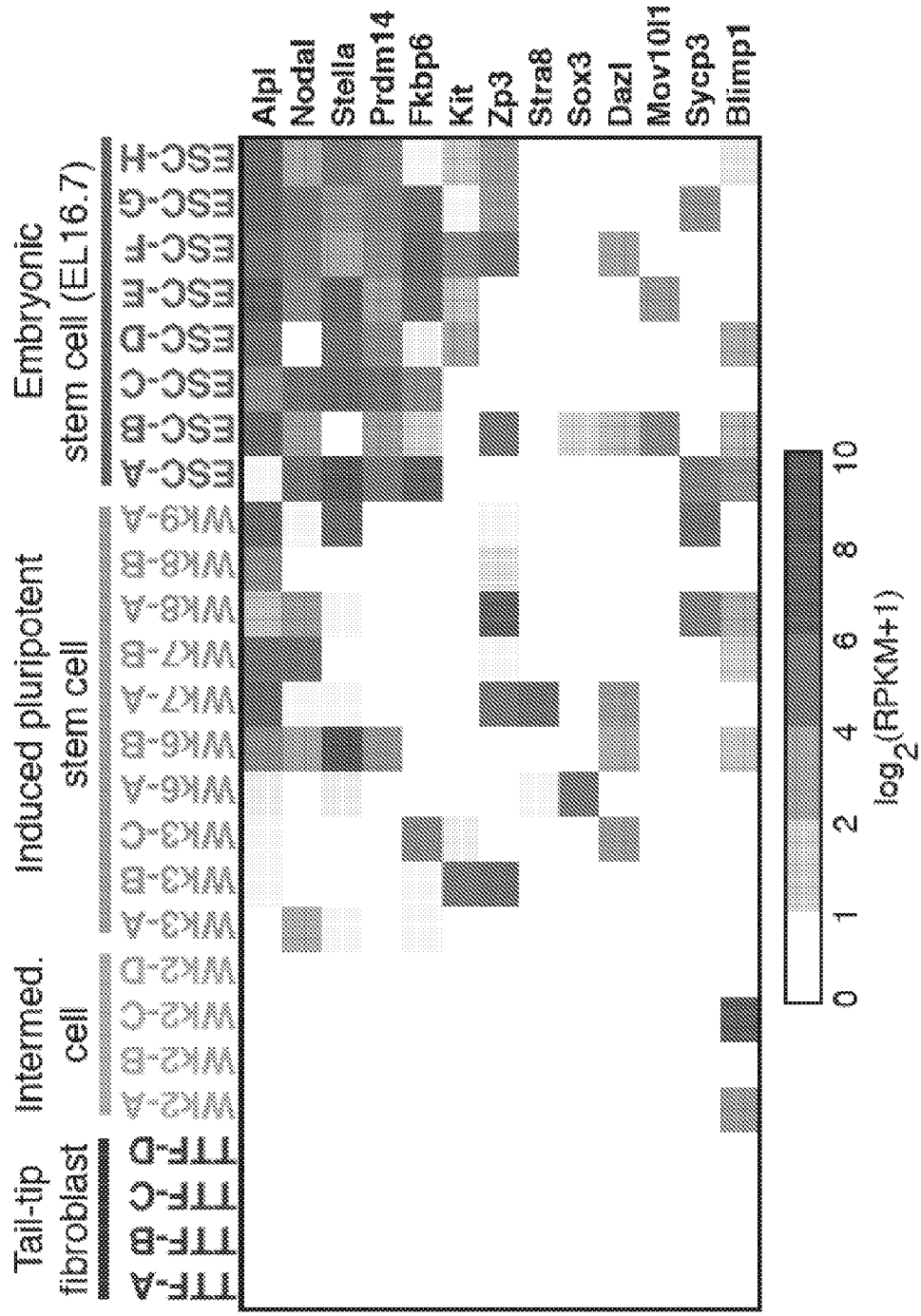
FIG. 8 shows the expression pattern of germ cell-related genes determined by log 2(RPKM+1) (RPKM=reads per kilobase per million) using small molecule fluorescent in situ hybridization (smFISH) showing that Stella and Prdm14 appear to be heterogeneously expressed during the reprogramming timecourse, as described herein.
Figure 9:
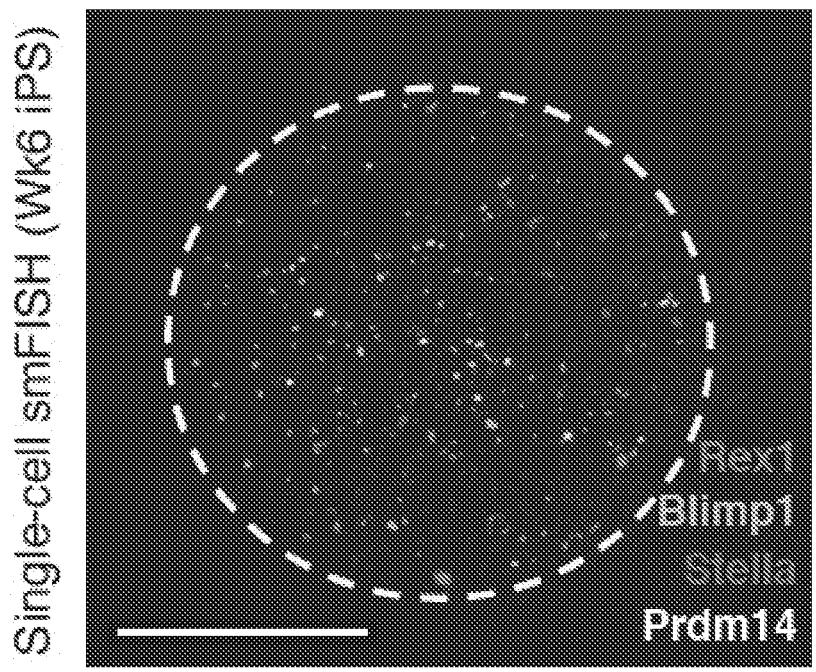
FIG. 9 is a fluorescence image of a single cell at week 6 (wk6) of iPS cell reprogramming using 4-color smFISH to characterize the full distribution of Stella, Prdm14, Blimp1, Rex1, Oct4, and Sox2 RNAs in hundreds of late-stage iPS cells (n=303), as described herein.
Figure 10A:
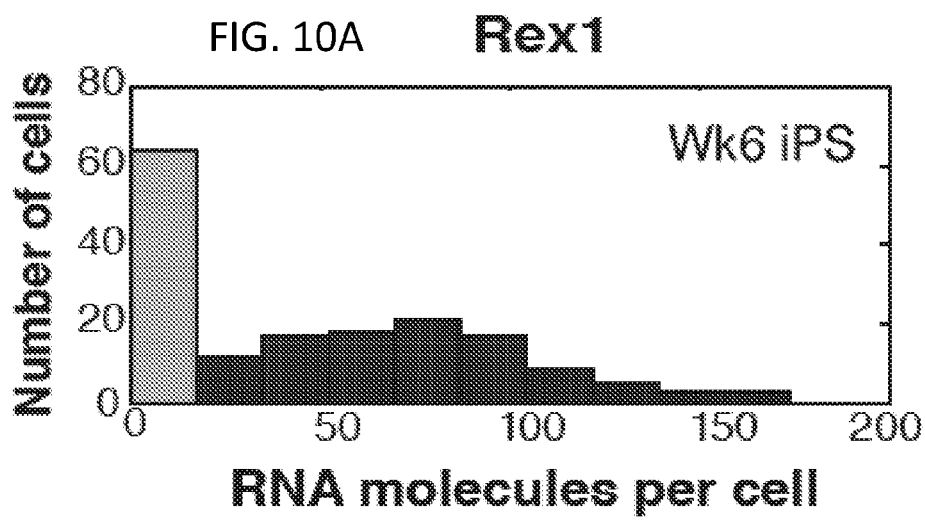
Figure 10B:
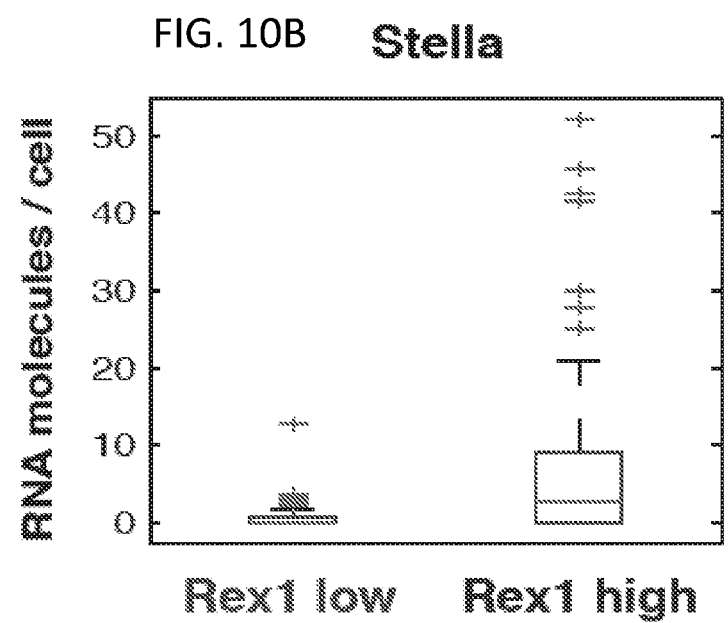

In order to validate the expression patterns of germ cell-related genes in the single-cell RNA-seq data of FIG. 8, smFISH as described in (Raj, A. et al., 2008, Nat Methods 5, 877-879, the entire contents of which are herein incorporated by reference) was used as an orthogonal, amplification-independent method to characterize the full distribution of Stella, Prdm14, Blimp1, Rex1, Oct4, and Sox2 RNAs in hundreds of late-stage iPS cells (n=303) at Wk6 (FIG. 9). The results of this amplification methods, Stella and Prdm14 appeared to be heterogeneously expressed during the reprogramming timecourse and were first detected at Wk6, whereas ES cells expressed these genes more uniformly (FIG. 8). Using 4-color smFISH, it was observed that Stella, Prdm14, and Blimp1 levels were all higher in individual iPS cells that also expressed greater levels of Rex1, while cells with low Rex1 expression generally did not express these genes (FIGS. 10A, 10B, 10C, 10D). These results suggest that late-stage iPS cells with high levels of Rex1 may exhibit more germ cell character.

Figure 11A:
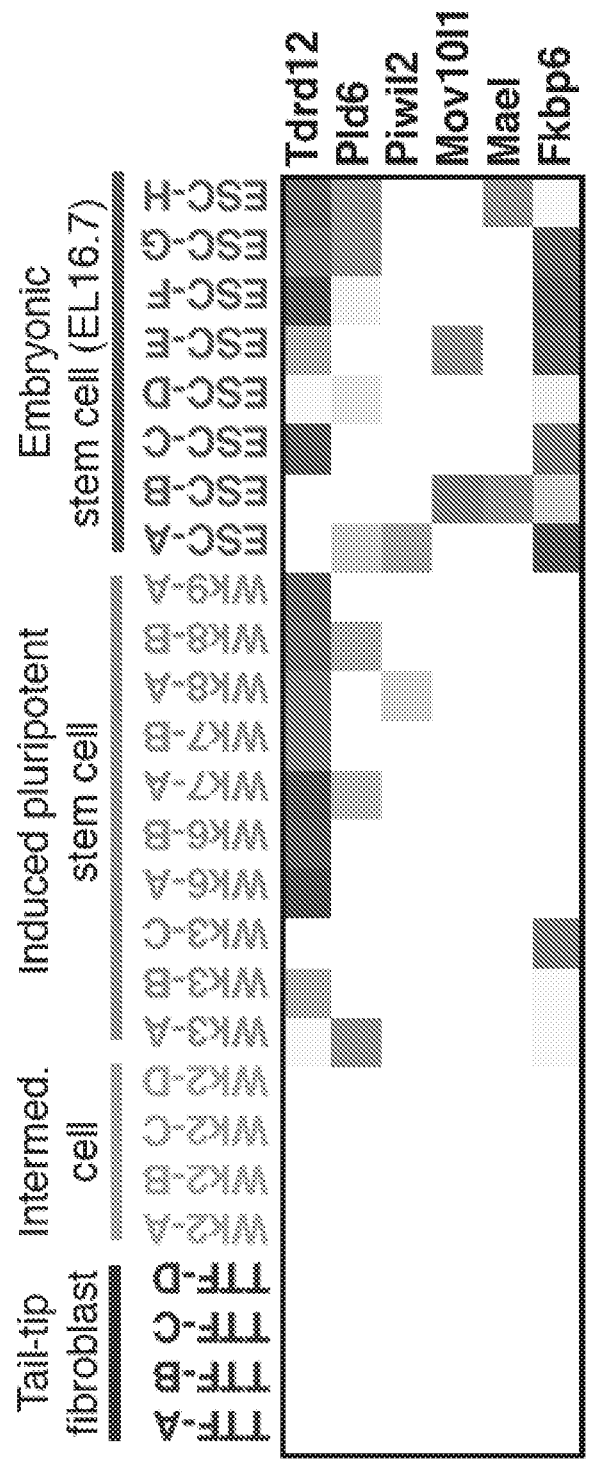
FIG. 11A shows the expression pattern of germ cell-related genes using small molecule fluorescent in situ hybridization (smFISH) showing that late-stage iPS cells began to express Piwil2 which associates with Piwi-interacting RNAs (piRNAs), as described herein.
Figure 11B:
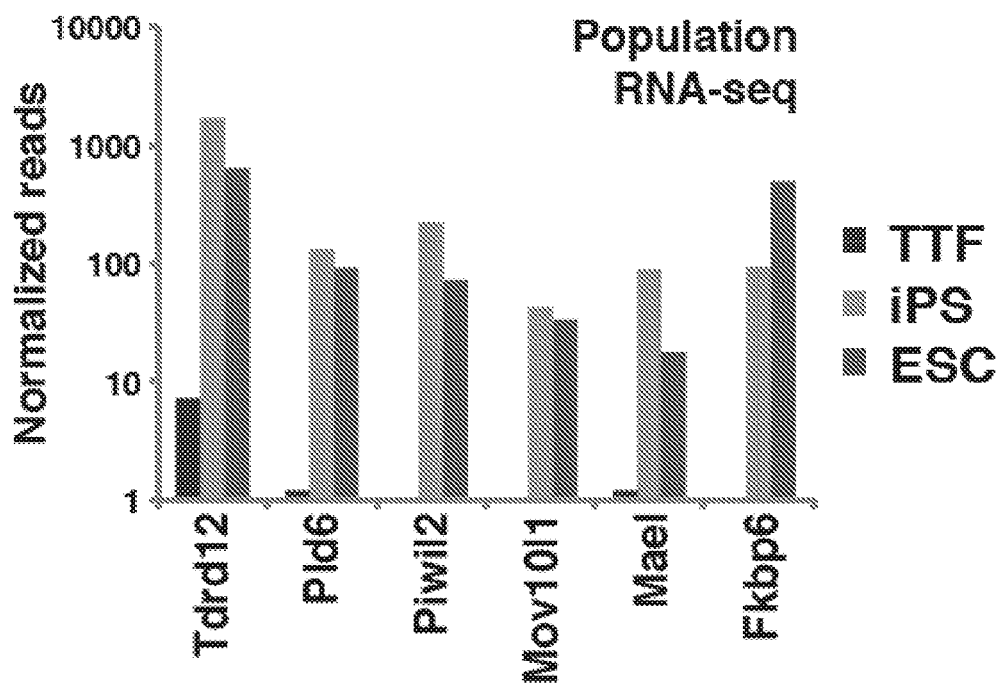
FIG. 11B is a graph showing that at the population level, iPS cells expressed genes involved in piRNA function and biogenesis, as described herein.
Figure 11C:
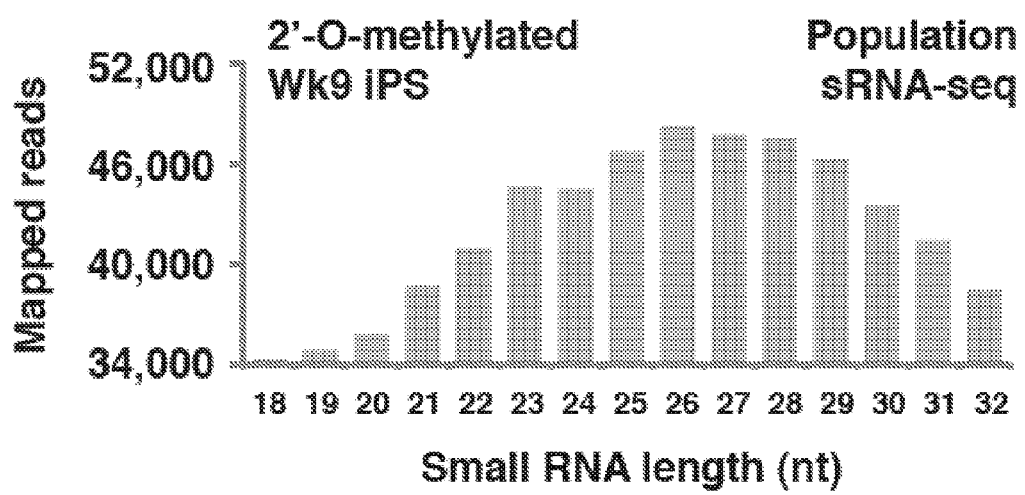
FIG. 11C is a graph showing that the 2'-O-methylated small RNAs that were cloned and sequenced from iPS cells exhibited a characteristic size distribution peak of 26 nucleotides (nt), as described herein.
Figure 11D:
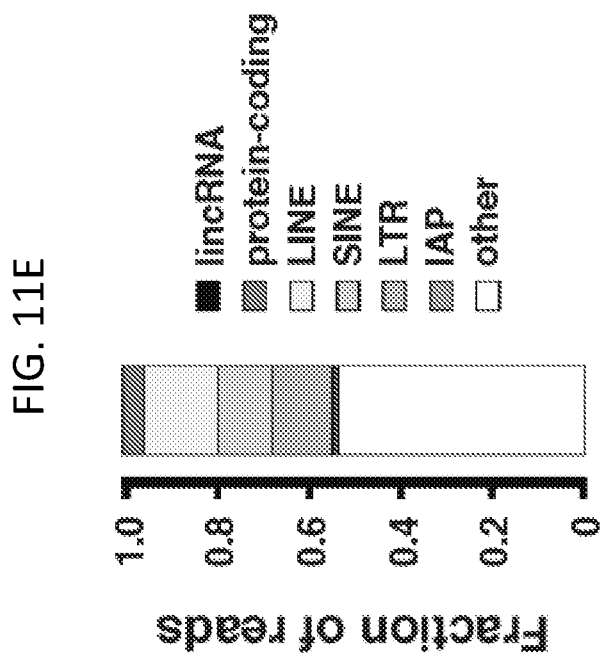
FIG. 11D is a graph showing that of the 2'-O-methylated small RNAs sequenced in FIG. 11C, 40% had a 5'U, indicative of primary piRNAs in the germline, as described herein.
Figure 11E:
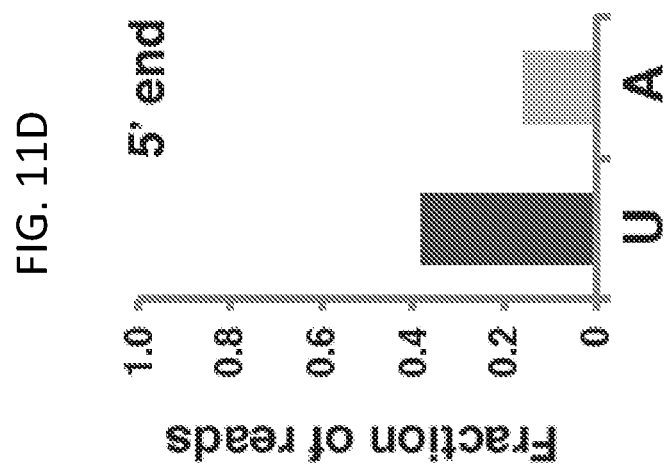
FIG. 11E is a graph showing that 40% of the 2'-O-methylated small RNAs of FIG. 11C mapped to retrotransposons, as described herein.

Additionally, late-stage iPS cells began to express Piwi12 (FIG. 11A), which associates with Piwi-interacting RNAs (piRNAs) in the germline to epigenetically silence retrotransposons (Aravin, A. A. et al., 2007, Science 316, 744-747, the entire contents of which are herein incorporated by reference). At the population level, iPS cells expressed genes involved in piRNA function and biogenesis (FIG. 11B). The 2'-O-methylated small RNAs were cloned and sequenced (Li, X. Z. et al., 2013, Mol Cell 50, 67-81, the contents of which are herein incorporated by reference) from iPS cells, which exhibited a characteristic size distribution peak of 26 nt (FIG. 11C), analogous to Piwil2-associated piRNAs (Aravin, A. A. et al., 2008, Mol Cell 31, 785-799, the entire contents of which are herein incorporated by reference). The sequencing showed that approximately 40% of 2'-O-methylated small RNAs had a 5'U (FIG. 11D), reminiscent of primary piRNAs in the germline (Luteijn, M. J. et al., 2013, Nat Rev Genet 14, 523-534, the entire contents of which are herein incorporated by reference). Moreover, approximately 40% of small RNAs mapped to retrotransposons (FIG. 11E). Taken together with a recent study in human iPS cells (Marchetto, M. C. et al., 2013, Nature 503, 525-529, the entire contents of which are herein incorporated by reference), the results suggest that piRNAs are activated during epigenetic reprogramming.

Example 4

Long Noncoding RNAs Activated During Reprogramming (Ladr)

Figure 12:
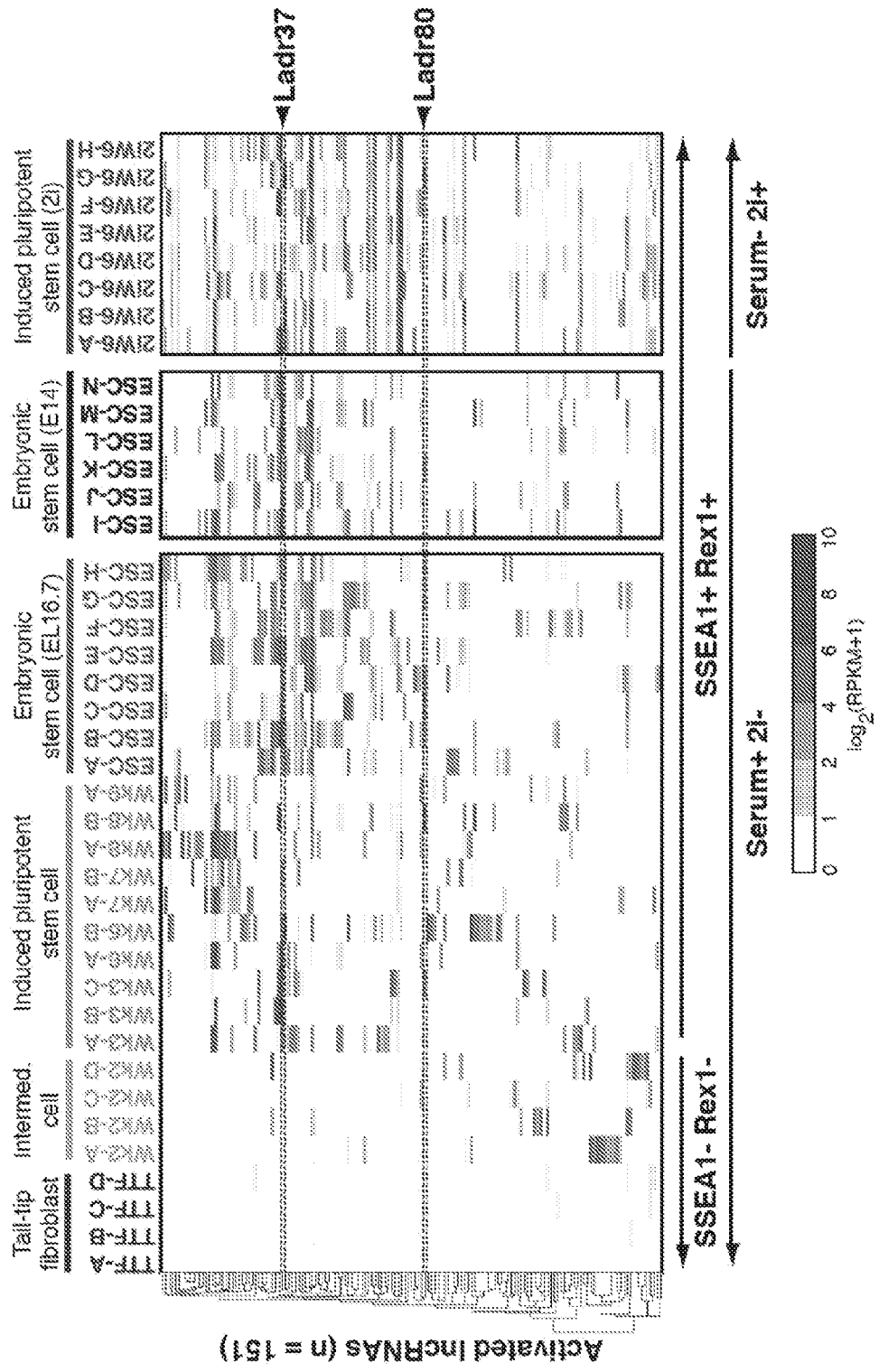
FIG. 12 shows long noncoding RNAs (lncRNAs) that are activated during reprogramming (Ladr), according to embodiments of the invention.
Figure 13A:
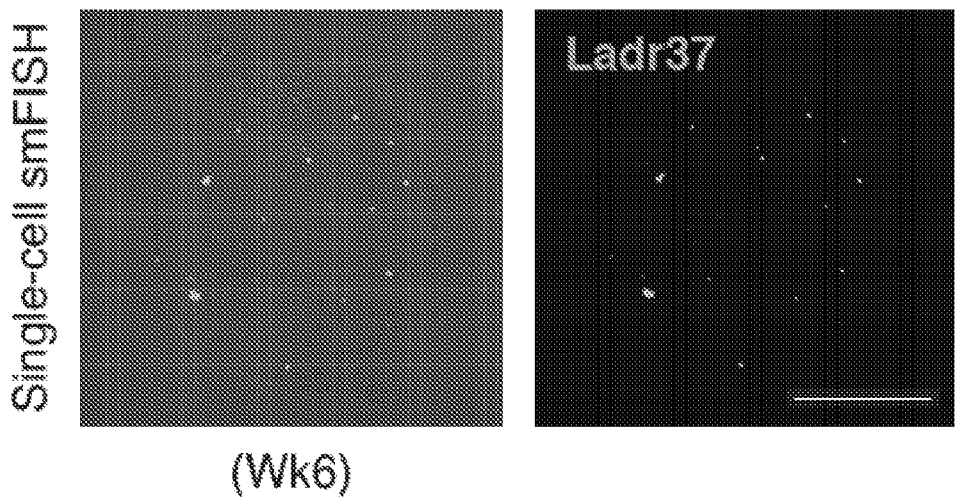
FIG. 13A is a fluorescent image of a single cell at week 6 (Wk6) of iPS cell reprogramming using smFISH, with Ladr37 probe, as described herein.
Figure 13B:
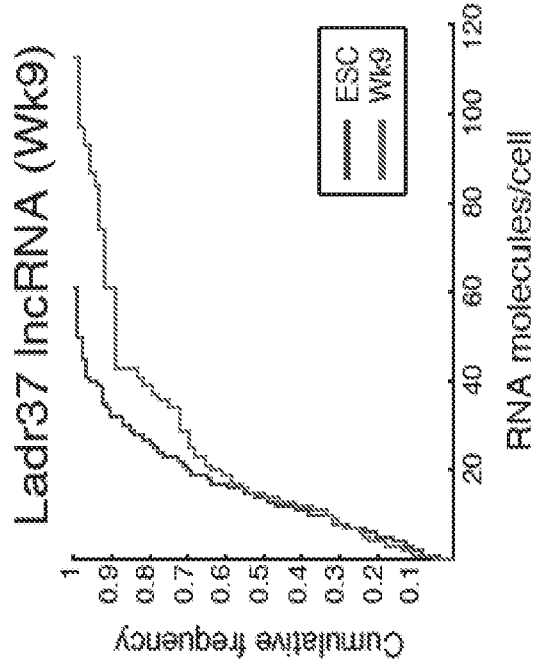
FIGS. 13B and 13C are graphs of cumulative frequency of Ladr37 lncRNAs at week 6 (Wk6) (FIG. 13B) and week 9 (Wk9) (FIG. 13C) compared with ESC (embryonic stem cells), as described herein.
Figure 13C:
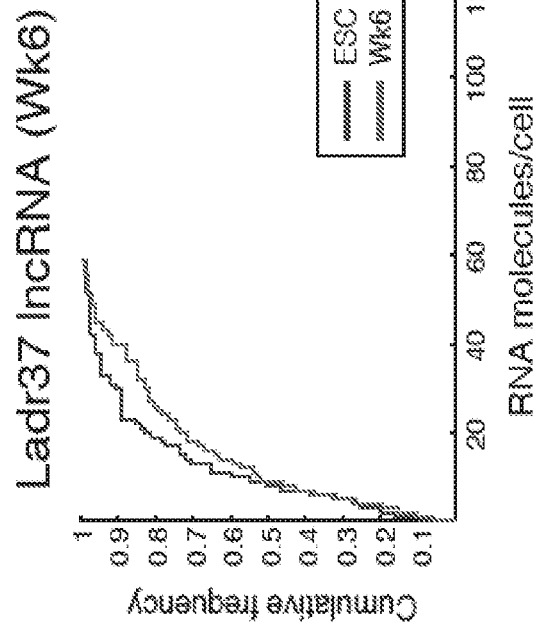
Figure 14A:
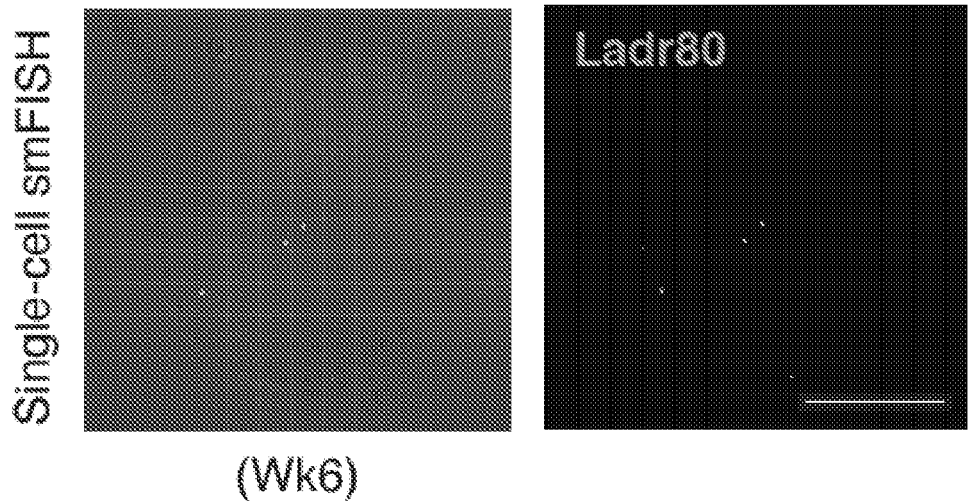
FIG. 14A is a fluorescent image of a single cell at week 6 (Wk6) of iPS cell reprogramming using smFISH, with Ladr80 probe, as described herein.

The changes in the lncRNA transcriptome during reprogramming were examined. Similar to the analysis of protein-coding genes, the focus was on activated lncRNAs (FIG. 1; Tables 1 and 3) that were expressed at 10 RPKM or higher in non-TTF cells, while being repressed in TTFs (below 1 RPKM). The results showed that approximately 150 lncRNAs were activated during the acquisition of pluripotency, and some lncRNAs showed apparent heterogeneity in their expression patterns, even in 2i conditions (FIG. 12). To validate these observations for specific lncRNAs, smFISH was used to characterize the expression patterns of 3 Polycomb-associated lncRNAs (FIGS. 13A, 13B, 13C, 14A, 14B, 14C) in hundreds of cells (n=351). Ladr37 was strongly expressed in both iPS and ES cells, and Ladr80 was weakly expressed in both cell types (FIG. 12 and FIGS. 13B, 13C, 14B, 14C). The distributions of Ladr80 expression in late-stage iPS cells at Wk6 and Wk9 were indistinguishable from ES cells, but Ladr37 expression was aberrantly high in a subset of Wk6 iPS cells relative to ES cells (FIGS. 13B, 13C, 14B, 14C). Also, a subset of Wk9 iPS cells expressed even higher levels of Lad37 (61-113 lncRNA molecules/cell) relative to ES cells (median: 14 lncRNA molecules/cell) (FIGS. 13B, 13C, 14B, 14C), revealing a broad range of heterogeneity in Ladr37 expression, even in late-stage iPS cells.

Example 5

Polycomb-Associated Ladr lncRNAs Repress Developmental Genes in iPS Cells

Figure 15A:
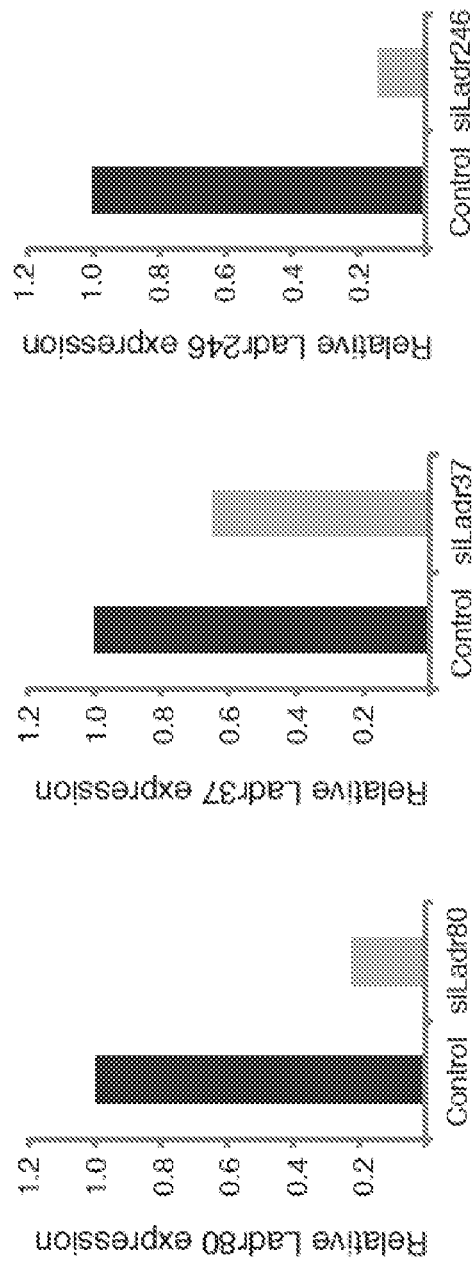
FIG. 15A shows graphs measuring relative expression of Ladr80, Ladr37, and Ladr246 compared to controls, in late stage iPS cells in the presence or absence (control) of Ladr80 siRNA, Ladr37 siRNA, or Ladr246 siRNA, as indicated, as described herein.
Figure 15B:
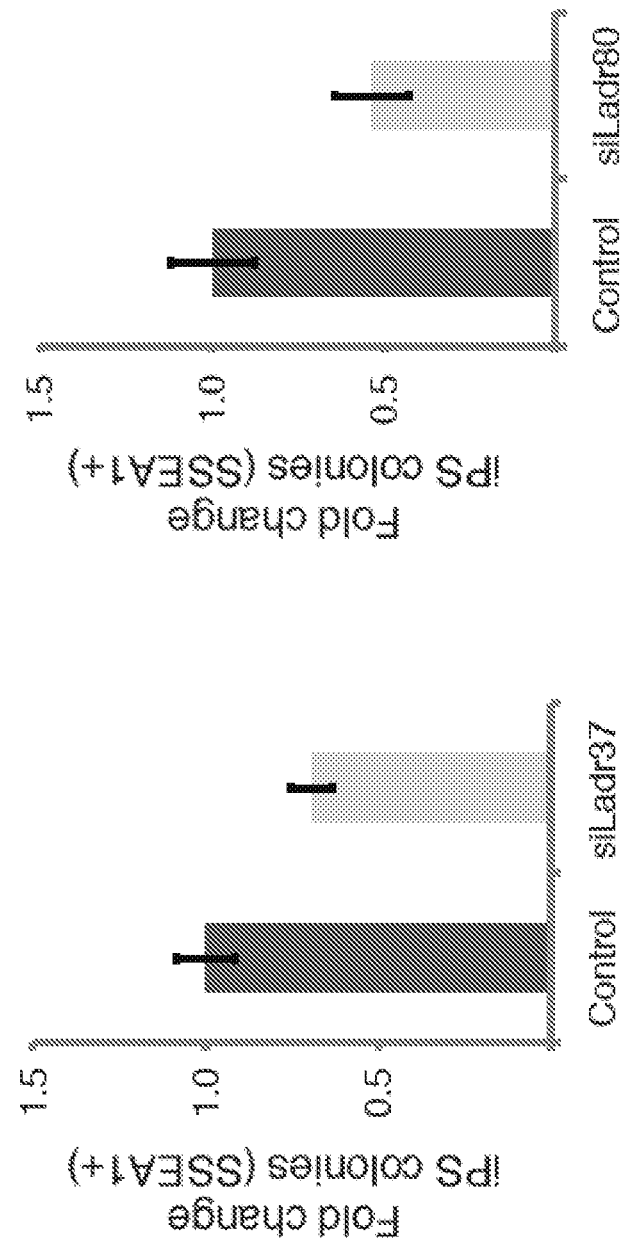
FIG. 15B shows graphs measuring fold change of reprogramming efficiencies in the presence or absence (control) of Ladr37 siRNA or Ladr80 siRNA, as indicated, as described herein.

In order to examine the functional roles of Ladr80 and Ladr37, a pool of 2-4 small interfering RNAs (siRNAs) per lncRNA were used to knock down their expression levels in late-stage iPS cells at Wk9 (FIG. 15A). While knockdown of Ladr80 or Ladr37 had modest effects on reprogramming efficiencies (FIG. 15B), Ladr80 knockdown resulted in the significant upregulation of muscle-related genes in iPS cells.

Figure 16A:
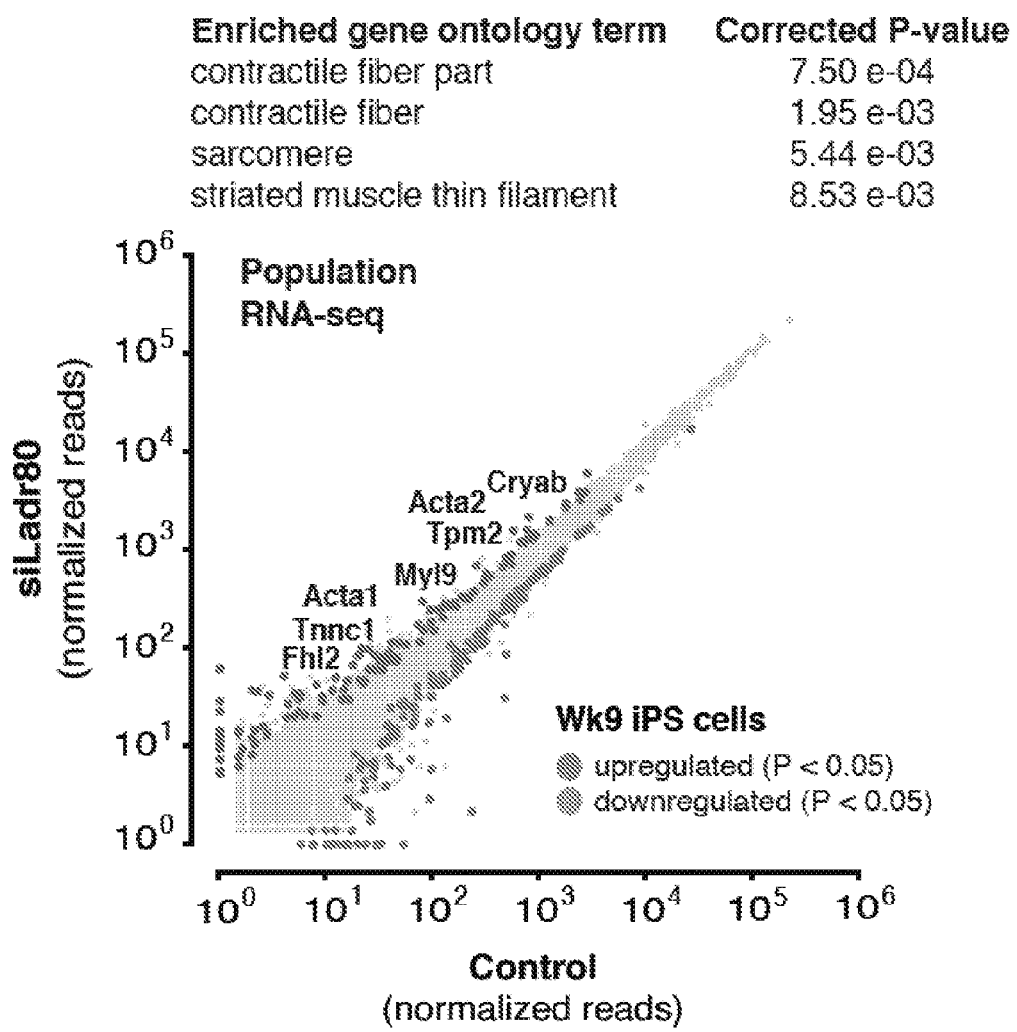
FIG. 16A shows differential expression analysis of significantly upregulated or downregulated genes in iPS cells in the presence (siLadr80) or absence (control) of Ladr80 siRNA, as determined by population level RNA-seq, and gene ontology (GO) analysis for significantly enriched GO terms in upregulated genes, as described herein.
Figure 16B:
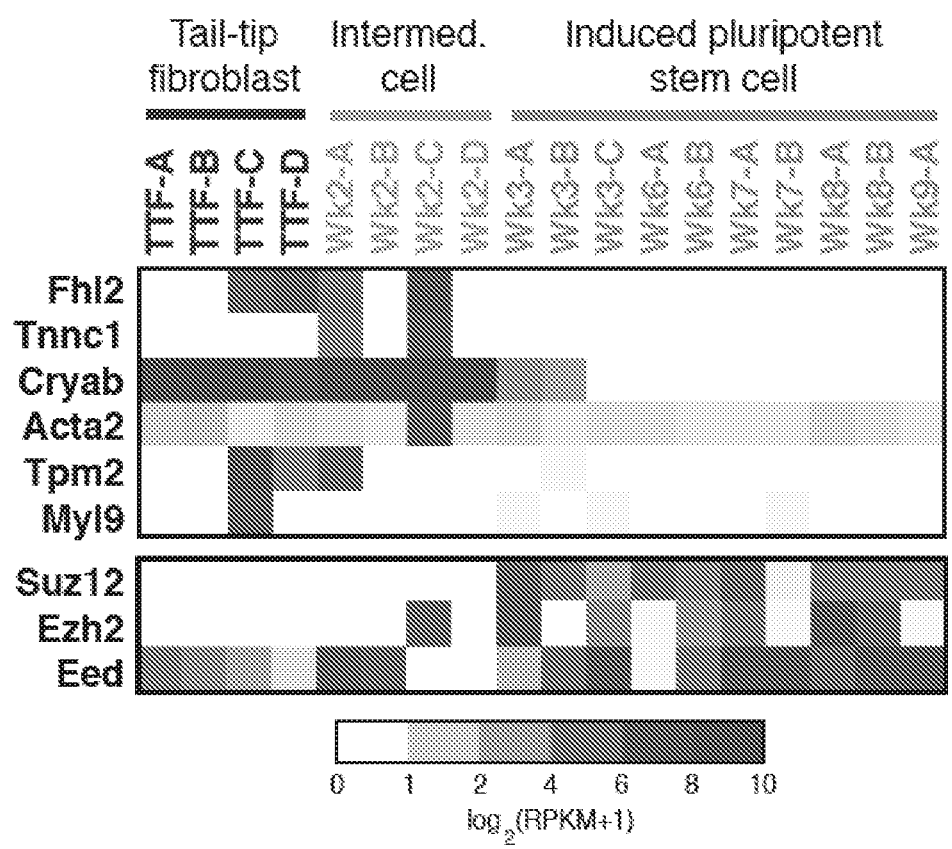
FIG. 16B shows the expression patterns of the indicated genes in the indicated cell types, as described herein.

Gene ontology (GO) analysis showed significant enrichment for the GO terms "contractile fiber," "sarcomere," and "striated muscle thin filament" (FIG. 16A). These muscle-related genes were also expressed in TTFs and intermediate cells at Wk2, but their repression at subsequent timepoints coincided with the activation of the Polycomb genes Ezh2 and Suz12 (FIG. 16B), along with the Polycomb-associated Ladr80 lncRNA (FIG. 12). These results indicate that Ladr80 activation is required to repress a subset of the myogenic program during the course of iPS cell reprogramming.

Figure 16C:
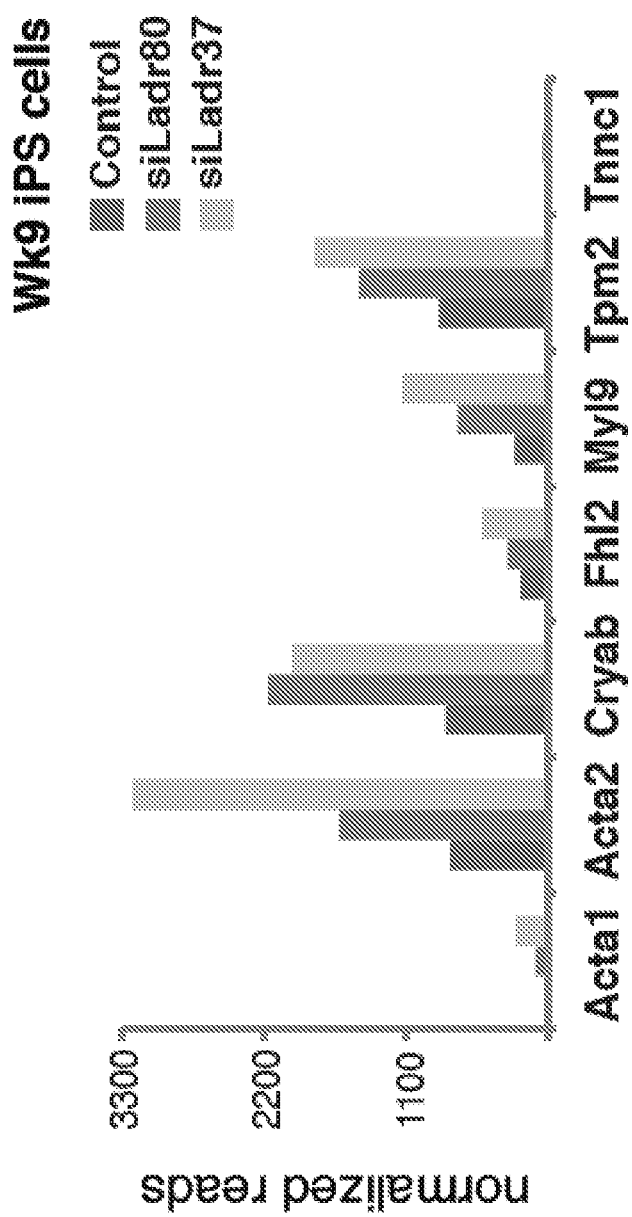
FIG. 16C is a graph showing gene expression of the indicated muscle genes in week 9 (Wk9) iPS cells in the presence of Ladr37 siRNA, Ladr80 siRNA, or control, as indicated, as described herein.
Figure 16D:
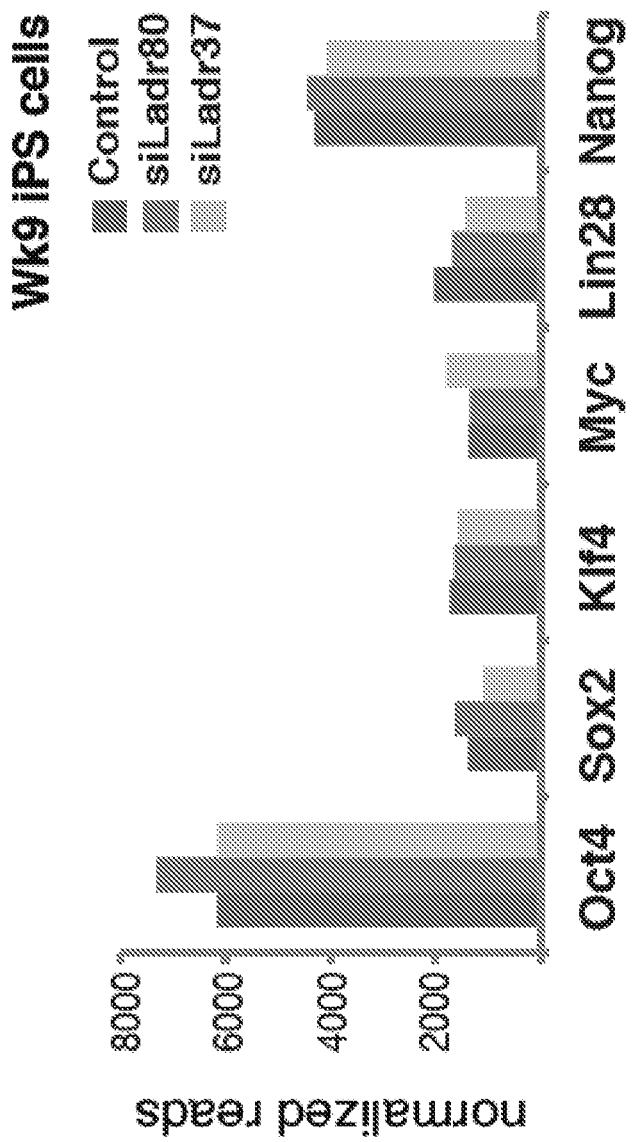
FIG. 16D is a graph showing gene expression of the indicated reprogramming/pluripotency-related genes Oct4, Sox2, Klf4, C-Myc, Lin28, and Nanog in Wk9 iPS cells in the presence of Ladr37 siRNA, Ladr80 siRNA, or control, as described herein.

Furthermore, Ladr37 knockdown resulted in the upregulation of a subset of muscle genes that were also upregulated upon Ladr80 loss-of-function (FIG. 16C), suggesting that lncRNAs may act redundantly during cell fate reprogramming. In addition, Ladr37 knockdown also led to the upregulation of two homeodomain transcription factors involved in limb development: Alx4 and Six2. However, both Ladr80 and Ladr37 knockdowns did not detectably perturb the expression levels of the reprogramming/pluripotency-related genes Oct4, Sox2, Klf4, c-Myc, Lin28, and Nanog (FIG. 16D), consistent with a specific role for these lncRNAs in repressing developmental genes during reprogramming.

Figure 16E:
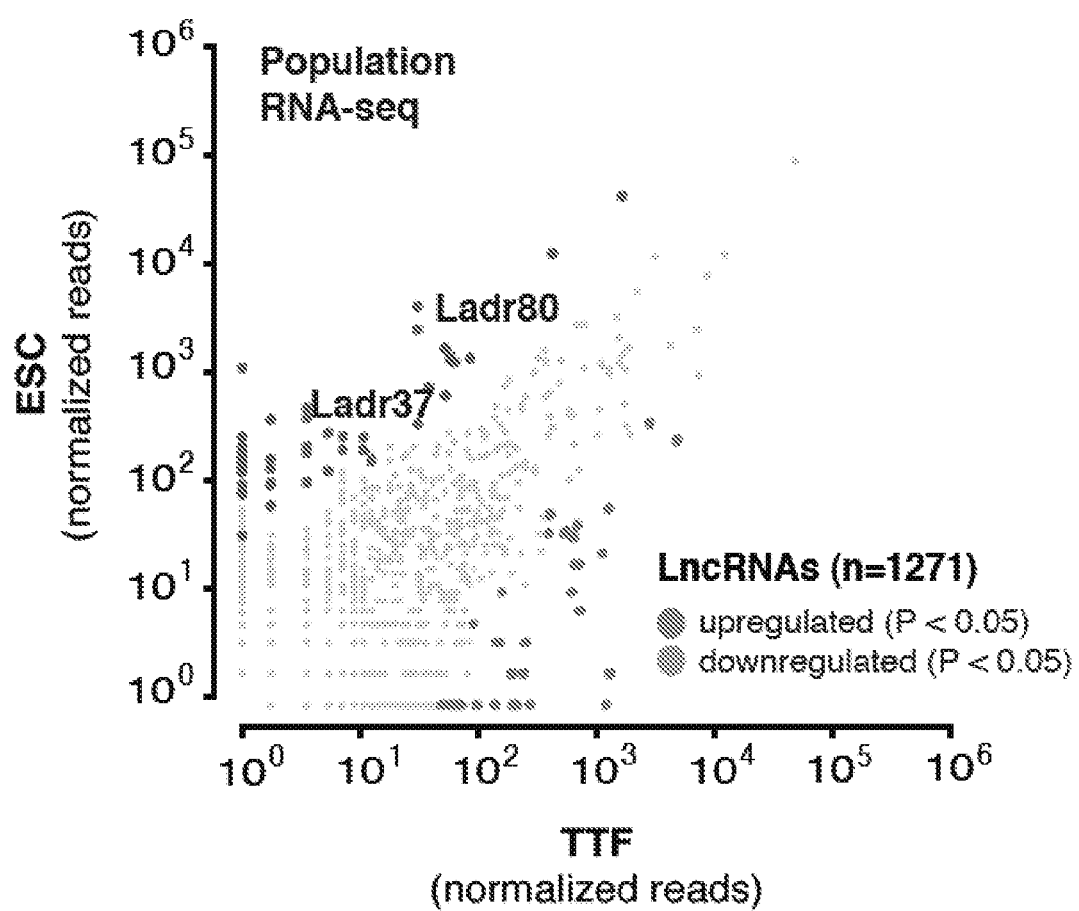
FIG. 16E shows a graph of differential expression analysis of significantly upregulated or downregulated lncRNA genes in ES cells versus TFF cells, as described herein.
Figure 16F:
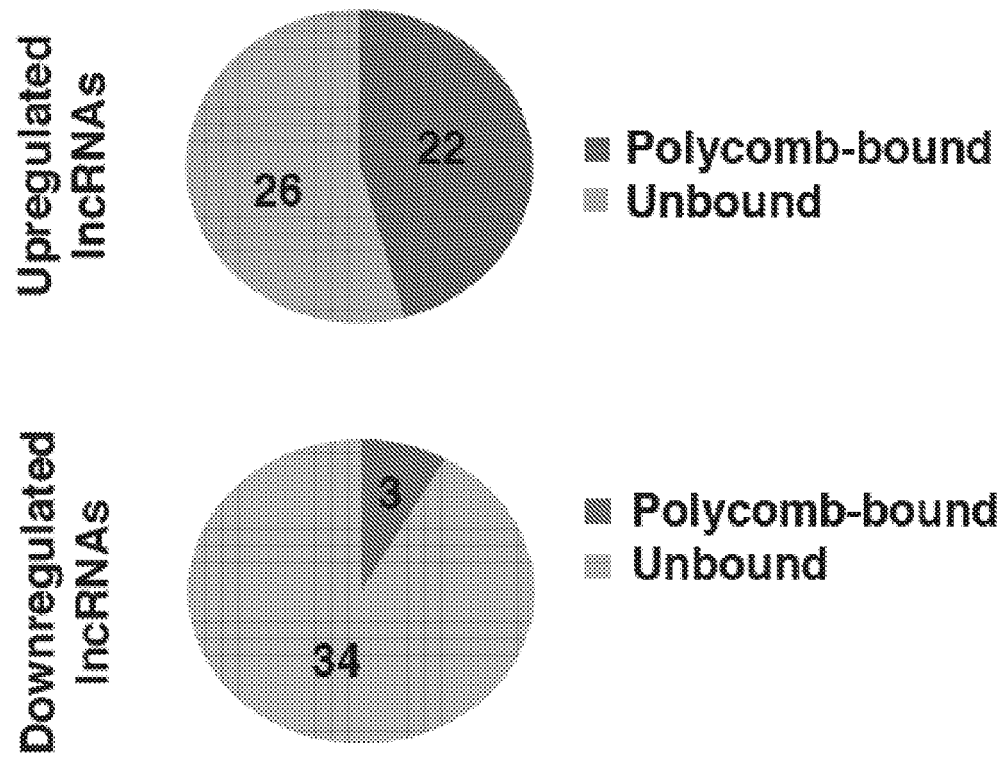
FIG. 16F shows two graphs indicating the fraction of upregulated or downregulated lncRNAs that associated with Polycomb proteins in ES cells, as described herein.

When the differential expression of all Ensembl-annotated lncRNAs was analyzed in populations of ES cells and TTFs, Ladr37 and Ladr80 were among the 48 most significantly upregulated lncRNAs in ES cells versus TTFs (FIG. 16E). Of these 48 upregulated lncRNAs, 22 lncRNAs (46%) associate with Polycomb in ES cells (Guttman et al., 2011; Zhao et al., 2010, supra), whereas of the 37 lncRNAs that are significantly upregulated in TTFs (downregulated in ES cells), only 3 lncRNAs (8%) associate with Polycomb in the pluripotent state (FIG. 16F). These results suggest that additional Polycomb-associated Ladr lncRNAs have functional roles in silencing lineage-specific genes.

Example 6

2i Induces a PGC-Like State in the lncRNA Transcriptome of Late-Stage iPS Cells

Figure 17A:
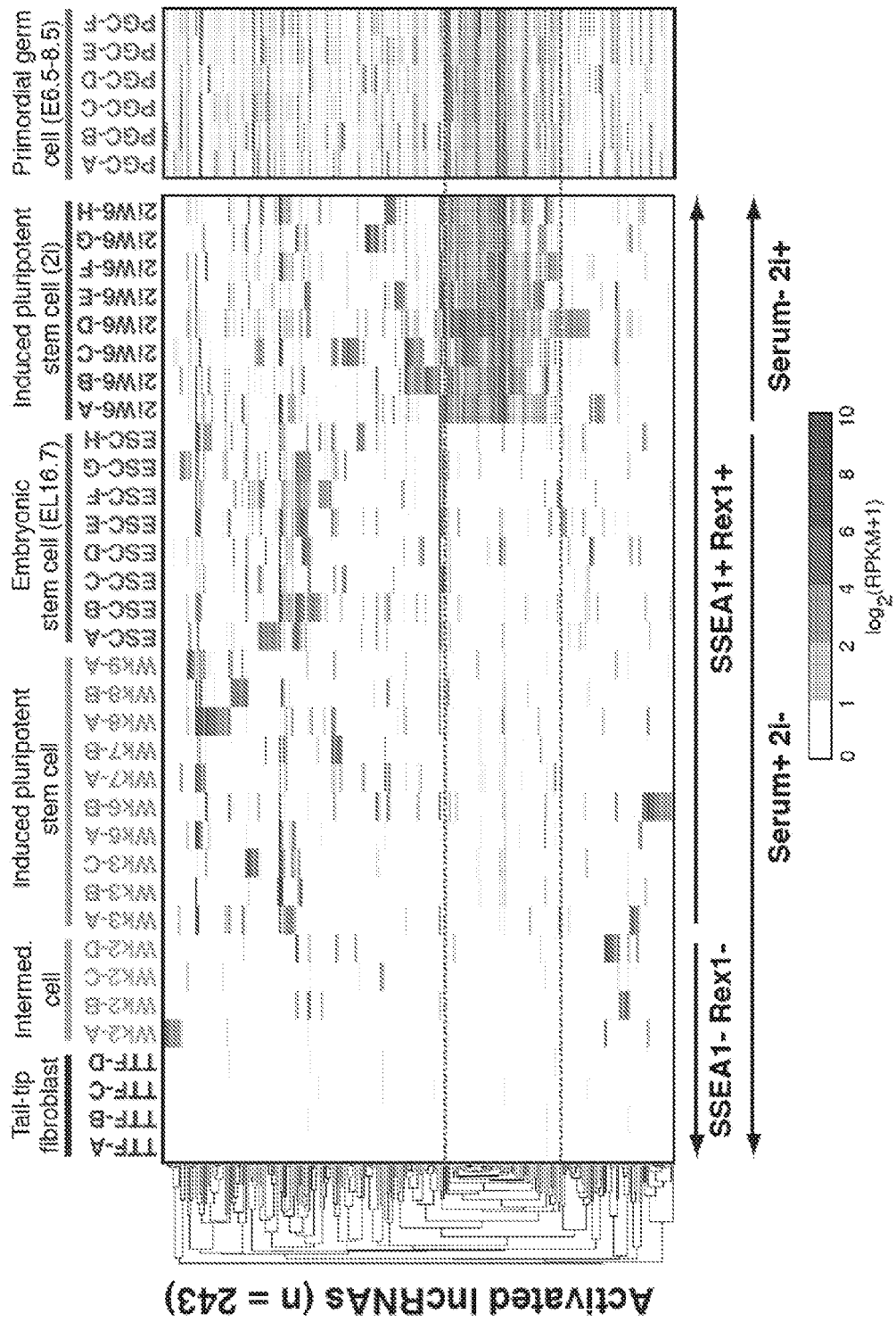
FIG. 17A shows long noncoding RNAs (lncRNAs) that are activated during reprogramming (Ladr) in iPS cells, ES cells, and primordial germ cells (PGC), as determined by single-cell RNA-seq, as described herein.
Figure 17B:
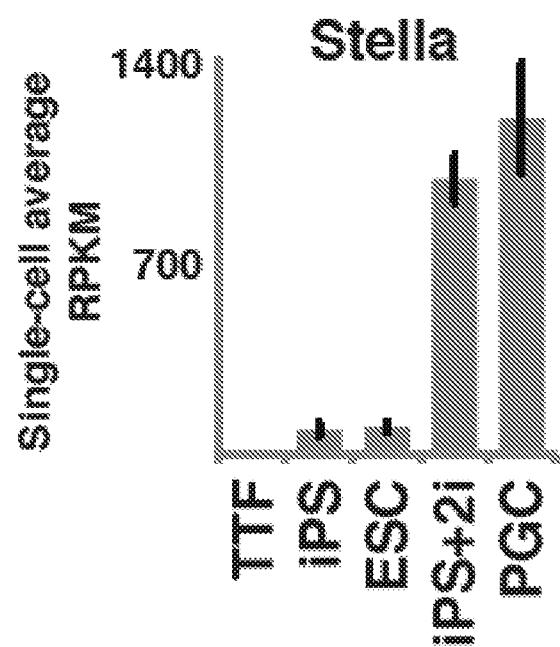
FIG. 17B is a graph showing single-cell average expression levels of Stella in the indicated cell types, as determined by single-cell RNA-seq, as described herein.

It was next examined whether 2i conditions altered the lncRNA landscape in late-stage iPS cells at Wk6. For example, 2i conditions produced a coherent activation of 92 additional lncRNAs (FIG. 17, Tables 1 and 3). Given the delayed activation kinetics of germ cell-related genes in late-stage iPS cells, it was examined whether 2i conditions might enhance their germ cell-like character. Single-cell RNA-seq data from E6.5-E8.5 PGCs was analyzed (Magnusdottir, E. et al., 2013, Nat Cell Biol 15, 905-915, the entire contents of which are herein incorporated by reference) and it was found that a coherent cluster of 2i-activated lncRNAs in iPS cells was also coherently expressed at high levels in PGCs (FIG. 17A). The 2i conditions also resulted in a significant upregulation of Stella (FIG. 17A, FIG. 17B), which is the definitive marker of PGC specification (Leitch, H. G. et al., 2013, Development 140, 2495-2501; and Saitou, M. et al., 2002, Nature 418, 293-300, the entire contents of which are herein incorporated by reference). These results show that iPS cells treated with 2i adopt a more germ cell-like character, similar to ES cells (Hayashi, K. et al., 2008, Cell Stem Cell 3, 391-401, the entire contents of which are herein incorporated by reference), that is especially prominent in their lncRNA transcriptome.

TABLE 6A

Early activation: Wk 2/Wk 3

| SEQ ID NO: | Ladr No | lncRNA |
| --- | --- | --- |
| 34 | Ladr34 | 4930461G14Rik |
| 142 | Ladr142 | Gm16761 |
| 130 | Ladr130 | Hoxa11as |
| 49 | Ladr49 | Gm10143 |
| 158 | Ladr158 | Snord123 |
| 125 | Ladr125 | A930029G22Rik |
| 131 | Ladr131 | Gm17477 |
| 79 | Ladr79 | Gm17279 |
| 94 | Ladr94 | Gm13830 |
| 91 | Ladr91 | Gm12898 |
| 141 | Ladr141 | Gm17344 |
| 107 | Ladr107 | 1110020A21Rik |
| 136 | Ladr136 | 1700028E10Rik |
| 147 | Ladr147 | 4933431E20Rik |
| 144 | Ladr144 | A230056P14Rik |
| 133 | Ladr133 | A330040F15Rik |
| 132 | Ladr132 | C030037D09Rik |
| 137 | Ladr137 | Gm10575 |
| 143 | Ladr143 | Gm11538 |
| 128 | Ladr128 | Gm11818 |
| 113 | Ladr113 | Gm12059 |
| 138 | Ladr138 | Gm15545 |
| 115 | Ladr115 | Gm16244 |
| 145 | Ladr145 | Gm16685 |
| 117 | Ladr117 | Gm16845 |
| 148 | Ladr148 | Gm17565 |
| 146 | Ladr146 | Gm17690 |
| 114 | Ladr114 | Gm17716 |
| 135 | Ladr135 | Gm4890 |
| 134 | Ladr134 | Mir155 |
| 37 | Ladr37 | 4930500J02Rik |
| 17 | Ladr17 | 4930566F21Rik |
| 46 | Ladr46 | Gm17300 |
| 36 | Ladr36 | 2410003L11Rik |
| 41 | Ladr41 | 2500002B13Rik |
| 30 | Ladr30 | Vax2os1 |
| 16 | Ladr16 | 2310043M15Rik |
| 29 | Ladr29 | 9230114K14Rik |
| 122 | Ladr122 | Nespas |
| 80 | Ladr80 | Gm16096 |
| 70 | Ladr70 | C430002E04Rik |
| 127 | Ladr127 | Gm15522 |
| 35 | Ladr35 | Gm16957 |
| 54 | Ladr54 | Gm16986 |
| 129 | Ladr129 | 1700016P03Rik |
| 116 | Ladr116 | 3110045C21Rik |
| 69 | Ladr69 | 4930509G22Rik |
| 40 | Ladr40 | 9530027J09Rik |
| 22 | Ladr22 | 9830144P21Rik |
| 111 | Ladr111 | D030068K23Rik |
| 68 | Ladr68 | Gm17561 |
| 71 | Ladr71 | Gm17605 |
| 55 | Ladr55 | Gm17656 |
| 66 | Ladr66 | Gm17710 |
| 110 | Ladr110 | Gm807 |

TABLE 6B

Late activation: Wk 6+

| SEQ ID NO: | Ladr No | lncRNA |
| --- | --- | --- |
| 18 | Ladr18 | Meg3 |
| 21 | Ladr21 | Rian |
| 3 | Ladr3 | 1810019D21Rik |
| 23 | Ladr23 | 4930513N10Rik |
| 95 | Ladr95 | C330013F16Rik |
| 150 | Ladr150 | 2410133F24Rik |
| 57 | Ladr57 | Abhd1 |
| 39 | Ladr39 | Gm13110 |
| 26 | Ladr26 | Gm16641 |
| 108 | Ladr108 | Gm16723 |
| 25 | Ladr25 | Gm17250 |

TABLE 6B-continued

Late activation: Wk 6+

| SEQ ID NO: | Ladr No | lncRNA |
|---|---|---|
| 38 | Ladr38 | Gm17335 |
| 97 | Ladr97 | 2010300F17Rik |
| 96 | Ladr96 | 4930467K11Rik |
| 99 | Ladr99 | 9530080O11Rik |
| 119 | Ladr119 | A930011O12Rik |
| 4 | Ladr4 | B230208H11Rik |
| 100 | Ladr100 | BC046401 |
| 83 | Ladr83 | Gm13657 |
| 102 | Ladr102 | Gm14817 |
| 86 | Ladr86 | Gm16827 |
| 81 | Ladr81 | Gm17440 |
| 103 | Ladr103 | Gm17501 |
| 82 | Ladr82 | Gm17594 |
| 85 | Ladr85 | Gm17637 |
| 65 | Ladr65 | Gm17659 |
| 98 | Ladr98 | Gm2464 |
| 14 | Ladr14 | 4930526L06Rik |
| 2 | Ladr2 | 4930444M15Rik |
| 19 | Ladr19 | 3110056K07Rik |
| 27 | Ladr27 | 2310010G23Rik |
| 28 | Ladr28 | 2810442I21Rik |
| 42 | Ladr42 | 4933404O12Rik |
| 139 | Ladr139 | A030009H04Rik |
| 90 | Ladr90 | Gm16159 |
| 77 | Ladr77 | Gm16283 |
| 62 | Ladr62 | Gm16880 |
| 109 | Ladr109 | Gm16972 |
| 72 | Ladr72 | Gm17362 |
| 53 | Ladr53 | Gm17418 |
| 33 | Ladr33 | Gm17491 |
| 104 | Ladr104 | Gm17502 |
| 76 | Ladr76 | Gm17597 |
| 124 | Ladr124 | Gm17713 |
| 43 | Ladr43 | Gm2694 |
| 61 | Ladr61 | Gm2788 |
| 63 | Ladr63 | Gm4419 |
| 74 | Ladr74 | Mirg |
| 47 | Ladr47 | Xist |
| 87 | Ladr87 | Atp10d |
| 84 | Ladr84 | C330018A13Rik |
| 149 | Ladr149 | 1700030C12Rik |
| 24 | Ladr24 | 4930404I05Rik |
| 10 | Ladr10 | A330048O09Rik |
| 5 | Ladr5 | Gm15728 |
| 48 | Ladr48 | 4930558J18Rik |
| 64 | Ladr64 | 9330185C12Rik |
| 123 | Ladr123 | Gm10492 |
| 20 | Ladr20 | Gm15441 |
| 1 | Ladr1 | Gm17586 |
| 7 | Ladr7 | 2700086A05Rik |
| 121 | Ladr121 | 4833407H14Rik |
| 12 | Ladr12 | 4930481B07Rik |
| 93 | Ladr93 | 6030442K20Rik |
| 13 | Ladr13 | A730011C13Rik |
| 126 | Ladr126 | Gm16046 |
| 92 | Ladr92 | Gm16973 |
| 9 | Ladr9 | Gm17291 |
| 101 | Ladr101 | Gm17481 |
| 73 | Ladr73 | Gm17525 |
| 11 | Ladr11 | Gm17698 |
| 6 | Ladr6 | Gm2529 |
| 8 | Ladr8 | C430039J16Rik |
| 112 | Ladr112 | Gm8378 |
| 140 | Ladr140 | 0610005C13Rik |
| 75 | Ladr75 | 1010001B22Rik |
| 50 | Ladr50 | 1110002J07Rik |
| 31 | Ladr31 | 1700007L15Rik |
| 105 | Ladr105 | 1700023H06Rik |
| 51 | Ladr51 | 1700086O06Rik |
| 32 | Ladr32 | 4632427E13Rik |
| 106 | Ladr106 | 4930480K23Rik |
| 78 | Ladr78 | 4933407K13Rik |
| 88 | Ladr88 | 5730457N03Rik |
| 58 | Ladr58 | 5930412G12Rik |
| 52 | Ladr52 | 6720401G13Rik |
| 44 | Ladr44 | A230072C01Rik |
| 56 | Ladr56 | B230206L02Rik |
| 120 | Ladr120 | C030010L15Rik |
| 45 | Ladr45 | C330046G13Rik |
| 151 | Ladr151 | C530005A16Rik |
| 59 | Ladr59 | E130018N17Rik |
| 118 | Ladr118 | Gm10658 |
| 67 | Ladr67 | Gm10785 |
| 89 | Ladr89 | Gm11714 |
| 60 | Ladr60 | Gm14022 |
| 15 | Ladr15 | Gm15787 |

TABLE 6C 2i-induced activation: Wk 6

| SEQ ID NO: | Ladr No | lncRNA |
|---|---|---|
| 220 | Ladr220 | 1110046J04Rik |
| 224 | Ladr224 | 1110019D14Rik |
| 212 | Ladr212 | 1700007J10Rik |
| 159 | Ladr159 | 1700023L04Rik |
| 239 | Ladr239 | 2010110K18Rik |
| 183 | Ladr183 | 2310031A07Rik |
| 219 | Ladr219 | 2610027K06Rik |
| 223 | Ladr223 | 2610206C17Rik |
| 164 | Ladr164 | 2810011L19Rik |
| 237 | Ladr237 | 2810425M01Rik |
| 187 | Ladr187 | 2810429I04Rik |
| 182 | Ladr182 | 2900052L18Rik |
| 177 | Ladr177 | 3010001F23Rik |
| 236 | Ladr236 | 3100003L05Rik |
| 214 | Ladr214 | 4833417C18Rik |
| 184 | Ladr184 | 4930506C21Rik |
| 217 | Ladr217 | 6430562O15Rik |
| 155 | Ladr155 | 9530059O14Rik |
| 188 | Ladr188 | A230004M16Rik |
| 211 | Ladr211 | A330032B11Rik |
| 178 | Ladr178 | A330076H08Rik |
| 222 | Ladr222 | A730081D07R1k |
| 191 | Ladr191 | A730099G02Rik |
| 176 | Ladr176 | A930007I19Rik |
| 174 | Ladr174 | AY512931 |
| 203 | Ladr203 | BC051077 |
| 169 | Ladr169 | C330002G04Rik |
| 157 | Ladr157 | Dio3os |
| 172 | Ladr172 | F630040L22Rik |
| 160 | Ladr160 | Gdap10 |
| 180 | Ladr180 | Gm10425 |
| 194 | Ladr194 | Gm17638 |
| 192 | Ladr192 | Gm17644 |
| 221 | Ladr221 | Gm17675 |
| 162 | Ladr162 | Gm17692 |
| 190 | Ladr190 | Gm17699 |
| 153 | Ladr153 | Gm17701 |
| 233 | Ladr233 | Gm2366 |
| 199 | Ladr199 | Gm3906 |
| 175 | Ladr175 | Gm6410 |
| 218 | Ladr218 | Gm7782 |
| 241 | Ladr241 | Gm9917 |
| 216 | Ladr216 | Mir706 |
| 213 | Ladr213 | Gm11542 |
| 186 | Ladr186 | Gm11574 |
| 230 | Ladr230 | Gm11602 |
| 197 | Ladr197 | Gm11934 |
| 167 | Ladr167 | Gm12592 |
| 163 | Ladr163 | Gm12784 |
| 200 | Ladr200 | Gm12976 |
| 168 | Ladr168 | Gm13261 |
| 198 | Ladr198 | Gm15396 |
| 154 | Ladr154 | Gm15489 |
| 179 | Ladr179 | Gm15850 |
| 242 | Ladr242 | Gm16568 |
| 165 | Ladr165 | Gm16618 |

TABLE 6C-continued 2i-induced activation: Wk 6

| SEQ ID NO: | Ladr No | lncRNA |
|---|---|---|
| 243 | Ladr243 | Gm16624 |
| 181 | Ladr181 | Gm16629 |
| 231 | Ladr231 | Gm16684 |
| 196 | Ladr196 | Gm16702 |
| 225 | Ladr225 | Gm16706 |
| 185 | Ladr185 | Gm16733 |
| 229 | Ladr229 | Gm16739 |
| 195 | Ladr195 | Gm16755 |
| 201 | Ladr201 | Gm16862 |
| 170 | Ladr170 | Gm16869 |
| 227 | Ladr227 | Gm16889 |
| 166 | Ladr166 | Gm16912 |
| 171 | Ladr171 | Gm16938 |
| 156 | Ladr156 | Gm17102 |
| 238 | Ladr238 | Gm17238 |
| 152 | Ladr152 | Gm17254 |
| 193 | Ladr193 | Gm17255 |
| 205 | Ladr205 | Gm17275 |
| 215 | Ladr215 | Gm17282 |
| 226 | Ladr226 | Gm17317 |
| 207 | Ladr207 | Gm17327 |
| 210 | Ladr210 | Gm17336 |
| 189 | Ladr189 | Gm17392 |
| 173 | Ladr173 | Gm17445 |
| 235 | Ladr235 | Gm17451 |
| 228 | Ladr228 | Gm17452 |
| 202 | Ladr202 | Gm17496 |
| 240 | Ladr240 | Gm17499 |
| 161 | Ladr161 | Gm17500 |
| 209 | Ladr209 | Gm17517 |
| 234 | Ladr234 | Gm17529 |
| 232 | Ladr232 | Gm17548 |
| 206 | Ladr206 | Gm17596 |
| 208 | Ladr208 | Gm17599 |
| 204 | Ladr204 | Gm17632 |

Figure 18A:
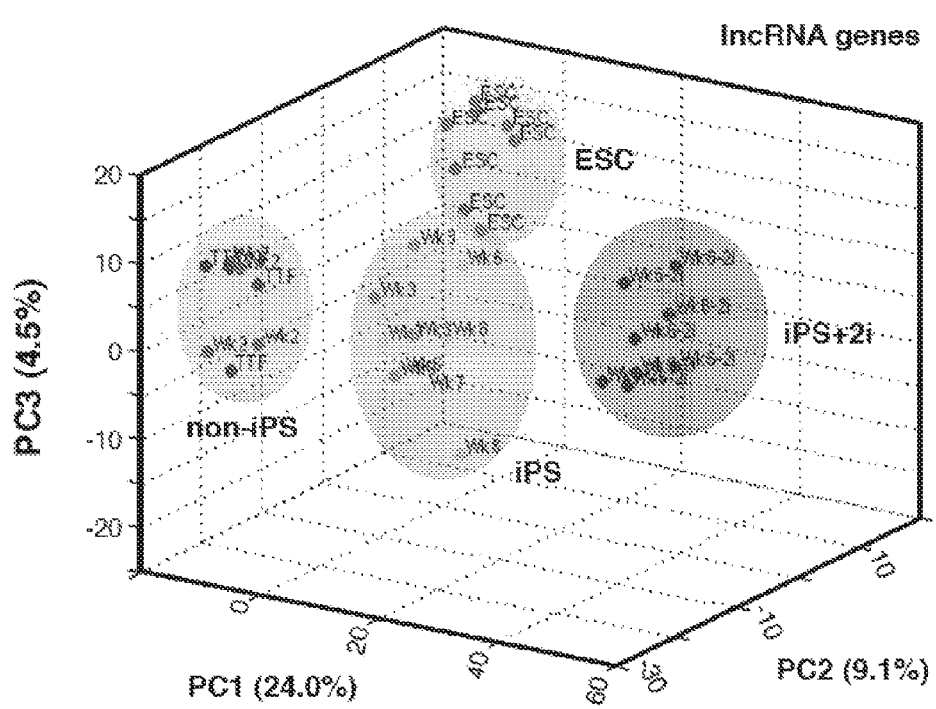
FIG. 18A is graph comparing Ladr lncRNAs with lncRNAs in ES cells, as described herein.
Figure 18B:
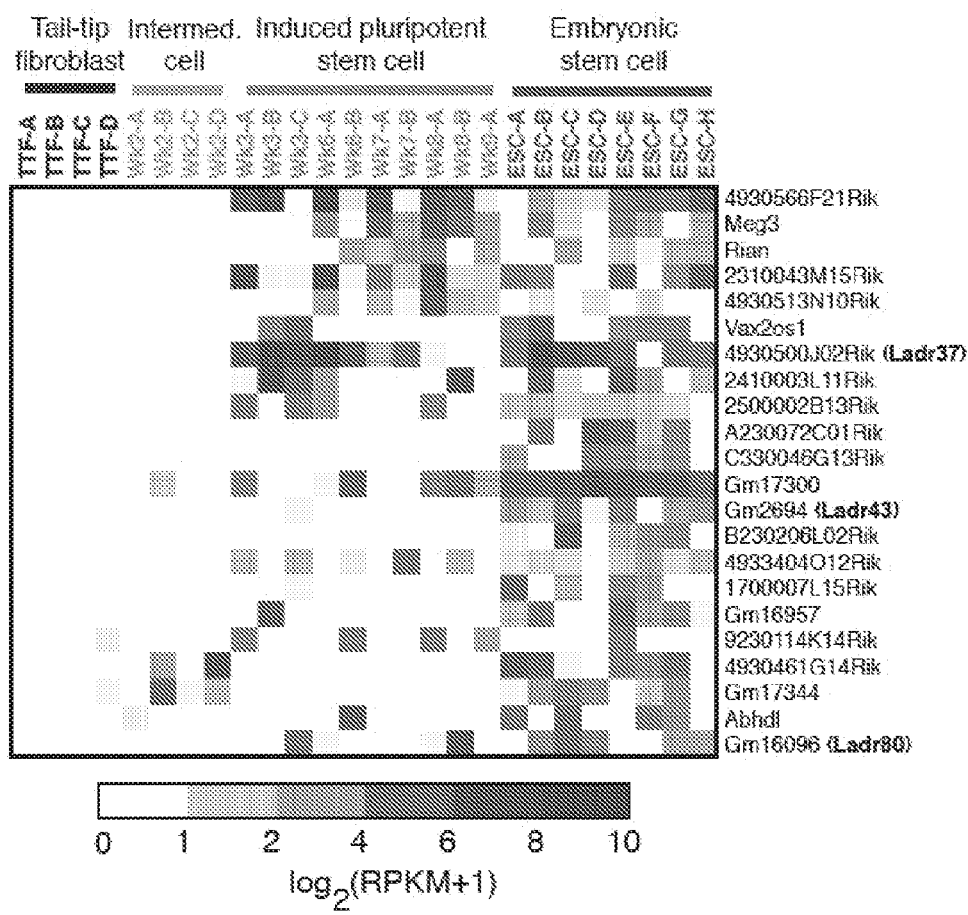
FIG. 18B shows the expression patterns of the indicated lncRNAs in the indicated cell types, as described herein.
Figure 18C:
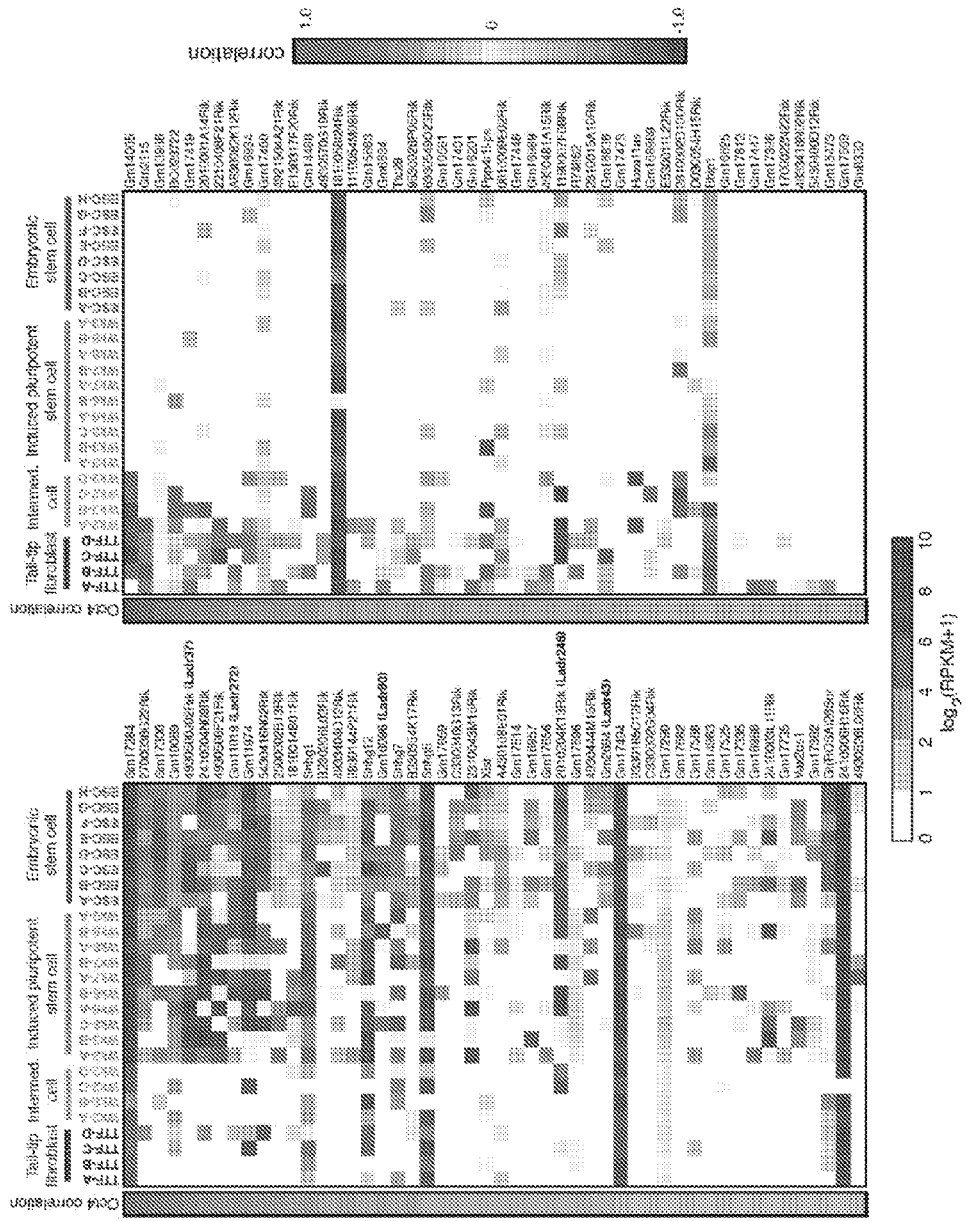
FIG. 18C shows the expression patterns of the indicated lncRNAs in the indicated cell types including relative Oct4 correlation as indicated, as described herein.
Figure 19B:
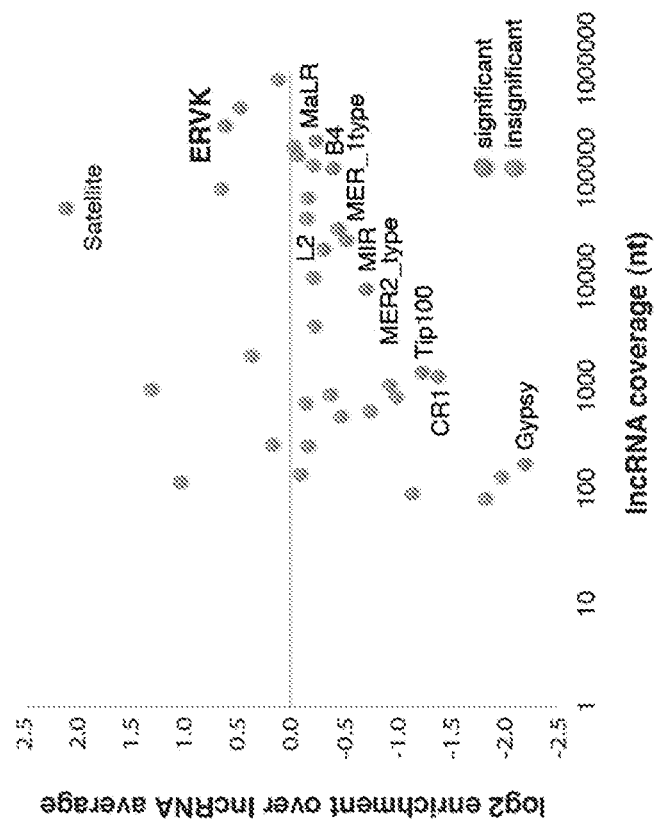
FIG. 19B is a graph showing the enrichment of elements (e.g., ERVK) in Ladr lncRNAs versus, as described herein.
Figure 19A:
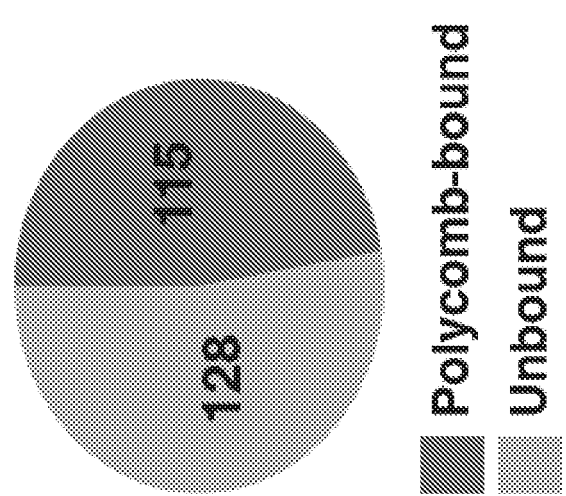
FIG. 19A shows a graph indicating the fraction of the Ladr lncRNAs (115) that associate with Polycomb proteins (Polycomb-bound) in ES cells, as described herein.
Figure 19C:
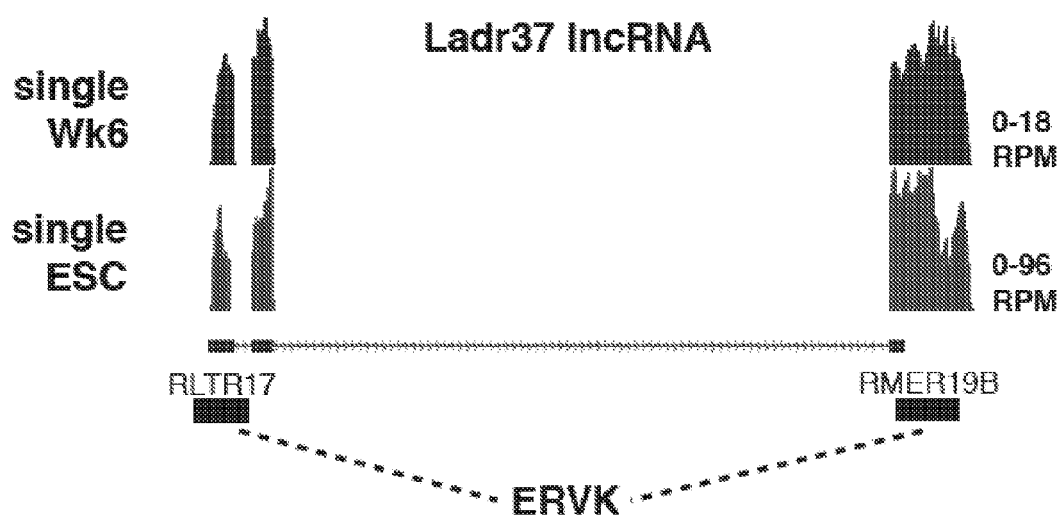
FIG. 19C is a schematic showing that Ladr37 is flanked by two different ERVK elements whose sequences overlap with its 5' and 3' exons, as described herein.

Ladr lncRNAs have both common and distinctive characteristics when compared with lncRNAs expressed in ES cells (FIG. 18A, 18B, 18C). Of the 243 Ladr lncRNAs, 115 (47%) associate with Polycomb proteins in ES cells (FIG. 19A) (Guttman et al., 2011; Zhao et al., 2010, supra). Ladr lncRNAs are also enriched for the LTR transposable element ERVK, an endogenous retrovirus (FIG. 19B). It was previously shown that lncRNAs containing endogenous retroviral elements are expressed at higher levels in ES cells relative to somatic cells (Kelley, D. et al., 2012, Genome Biol 13, R107, the entire contents of which are herein incorporated by reference). Although Ladr80 was not comprised of any ERVK sequence, Ladr37 was flanked by two different ERVK elements whose sequences overlapped with its 5' and 3' exons (FIG. 19C), which may contribute to its high levels of expression in both ES and iPS cells (FIG. 12) (Kelley and Rinn, 2012, supra). Of the 92 Ladr lncRNAs that were strongly upregulated in response to 2i, more than half (n=47) were associated with ERVK elements. Taken together with results from a previous study (Kelley and Rinn, 2012, supra), the results suggest that endogenous retroviral elements are involved in Ladr lncRNA regulation during reprogramming.

Example 7

Ladr lncRNA Regulation by ES Cell and PGC Transcriptional Networks

Figure 20A:
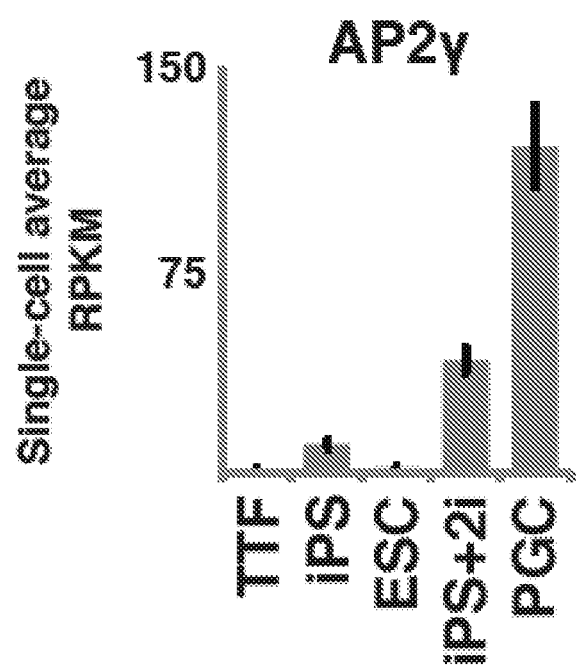
FIG. 20A is a graph showing expression of AP2γ (in RPKM) in the indicated cell types, as described herein.
Figure 20C:
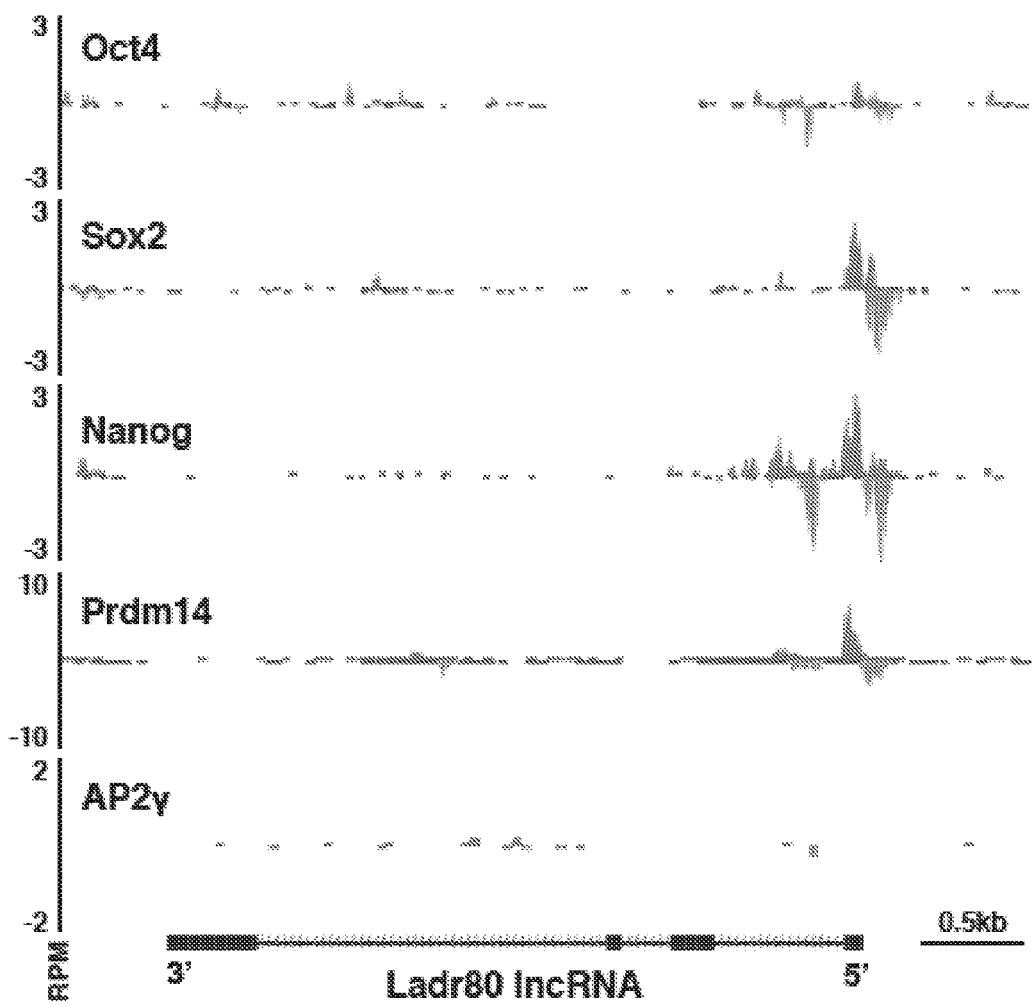
FIG. 20C shows ChIP sequence data for Ladr80 lncRNA, Ladr169 lncRNA, Ladr37 lncRNA, or Ladr43 lncRNA, as indicated, analyzed with respect to Oct 4, Sox2, Nanog, Prdm14 and AP2γ, as described herein.
Figure 20C:
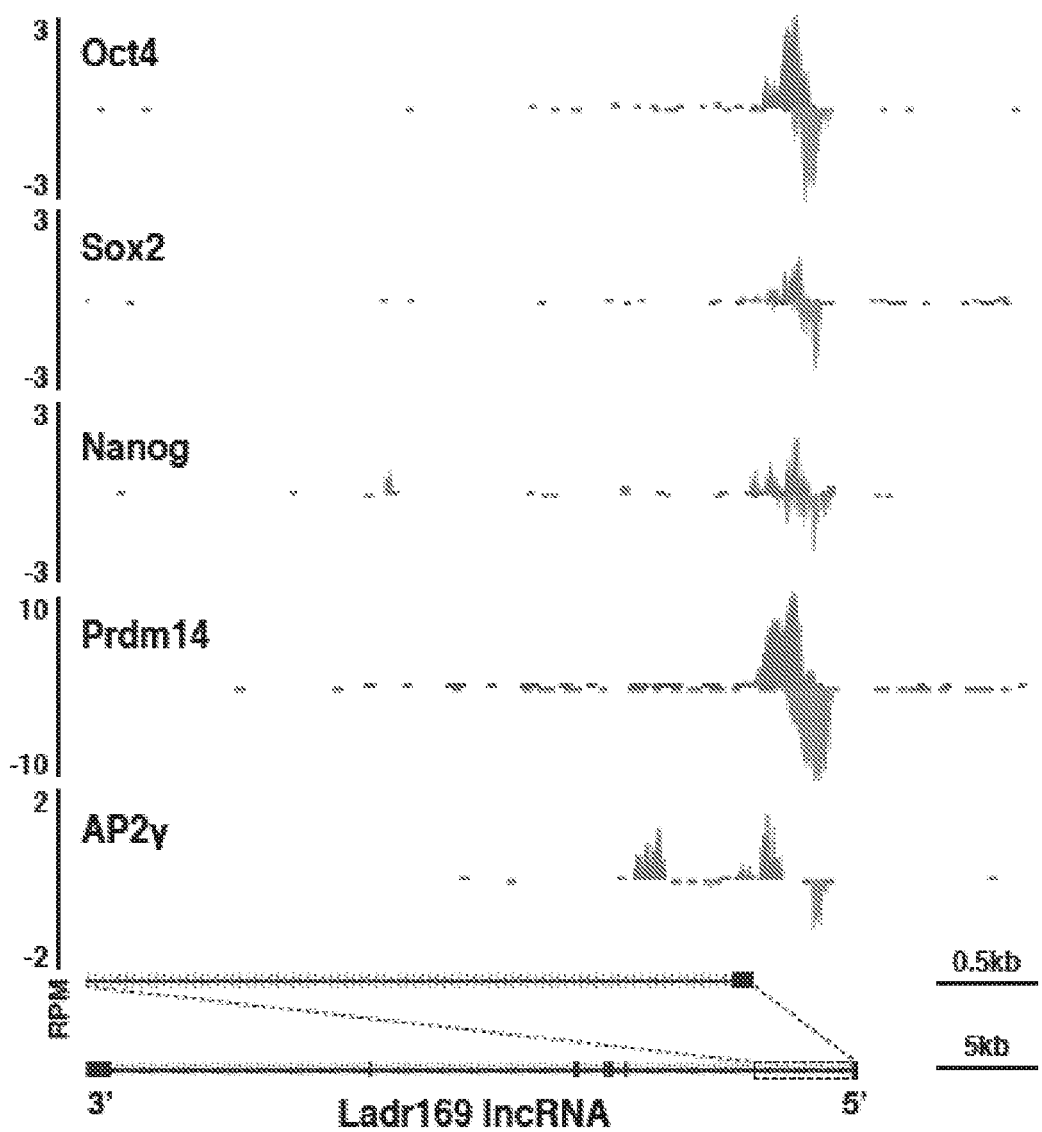
Figure 20C:
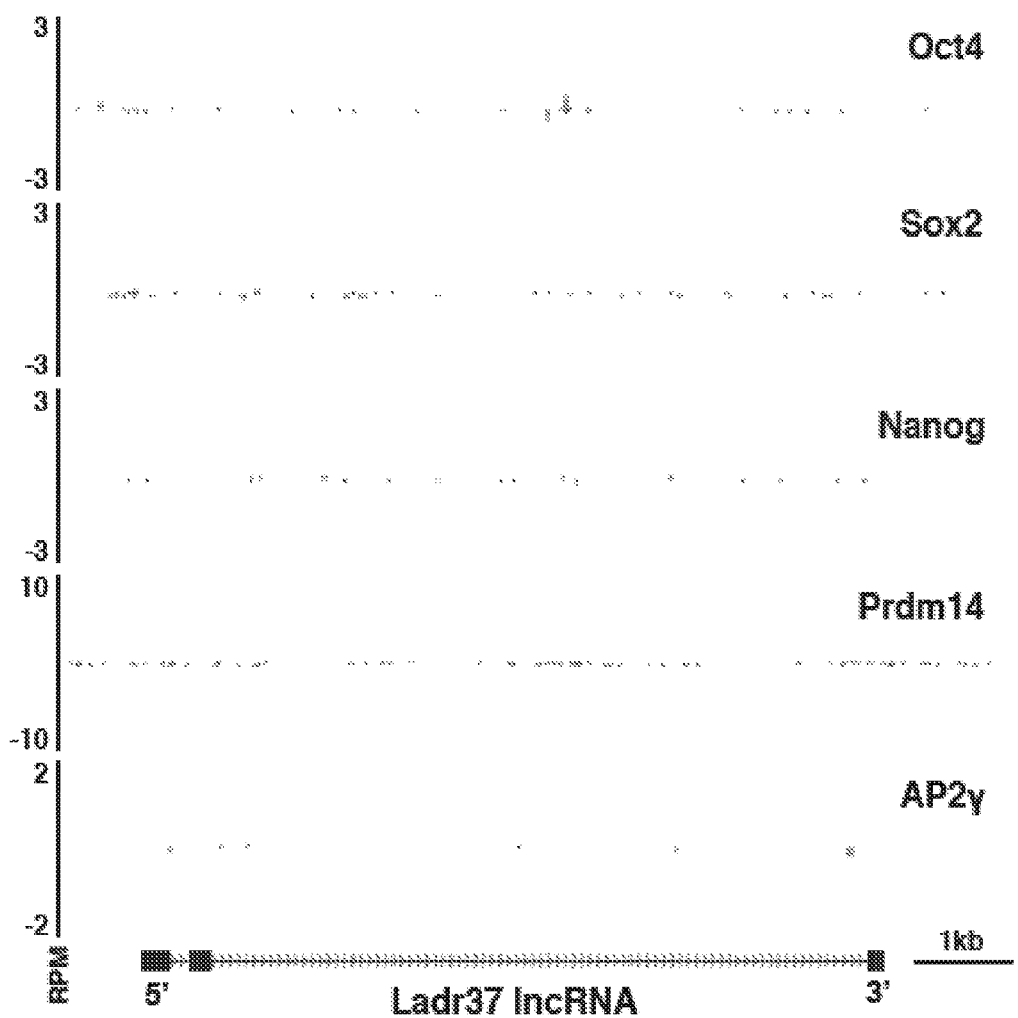
Figure 20C:
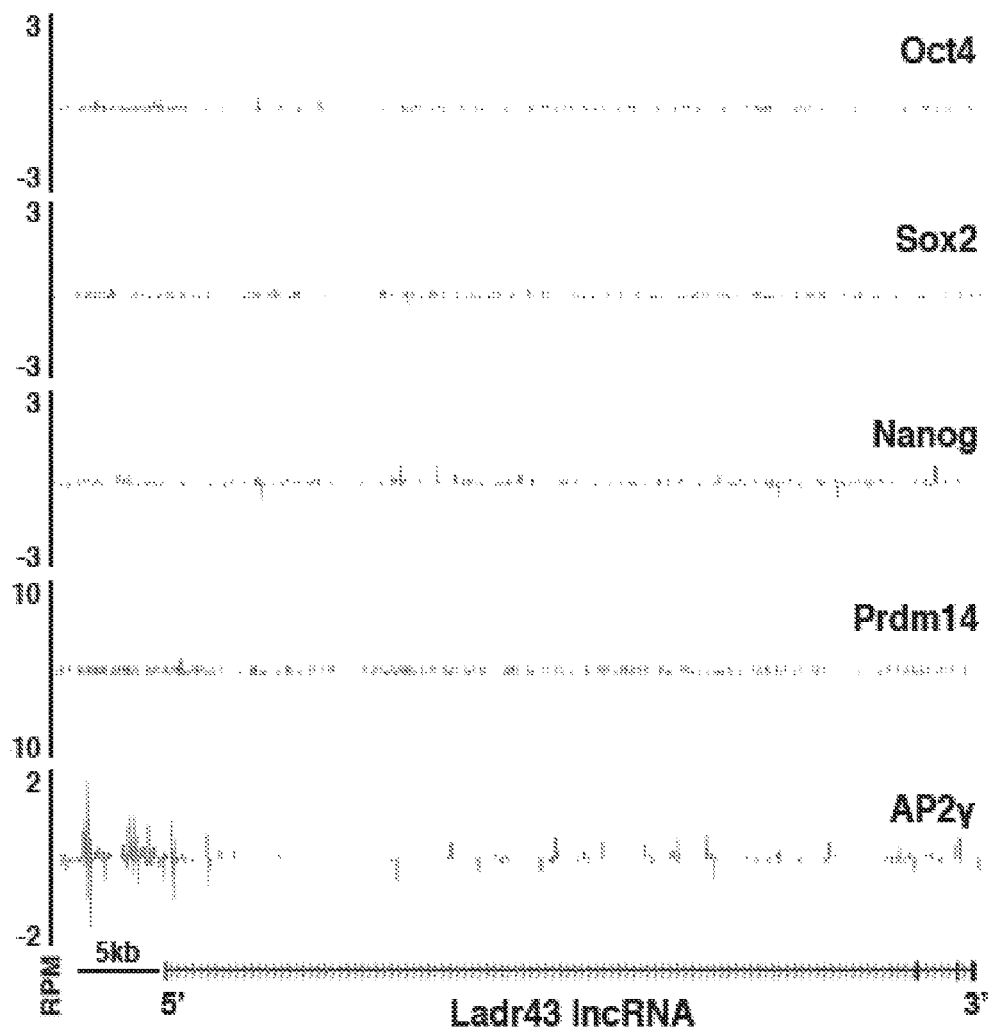

In order to examine whether Ladr lncRNAs were regulated by ES cell or PGC transcription factor networks, chromatin immunoprecipitation high-throughput sequencing (ChIP-seq) data was analyzed for the core pluripotency factors Oct4/Sox2/Nanog (Marson, A. et al., 2008, Cell 134, 521-533, the entire contents of which are herein incorporated by reference) and for Prdm14/AP2γ, which initiate the specification of PGCs (Magnusdottir et al., 2013, supra). Late-stage iPS cells, both in the absence and presence of 2i, expressed 5- to 20-fold higher levels of AP2γ relative to ES cells (FIG. 20A). Moreover, of the 243 Ladr lncRNAs, AP2γ had the highest number of binding sites within lncRNA promoters (n=86) (FIG. 20B). Prdm14 and Oct4 exhibited the second (n=71) and third (n=31) highest number of binding sites, respectively (FIG. 20B). Ladr lncRNAs whose expression patterns correlated most strongly with Oct4 were generally expressed in ES cells, while lncRNAs that were anti-correlated with Oct4 tended to be expressed in TTFs (FIG. 18C). It was also observed that many of the Ladr lncRNA genes were bound by multiple transcription factors. For example, the Ladr80 promoter region was bound by Sox2, Nanog, and Prdm14, while a 2i-induced lncRNA, Ladr169, was bound by Oct4/Sox2/Nanog and Prdm14/AP2γ (FIG. 20C). However, the Ladr37 promoter was not bound by any of these factors, while Ladr43 was bound by AP2γ (FIG. 20C). These findings suggest that both ES cell and PGC transcriptional networks regulate Ladr activation during iPS cell reprogramming.

Example 8

Ladr lncRNA Suppression of Lineage-Specific Genes

Figure 21B:
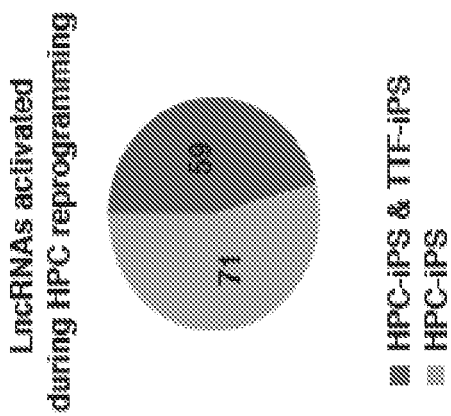
FIG. 21B is a graph showing the fraction of lncRNAs activated during HPC reprogramming, as described herein.
Figure 21A:
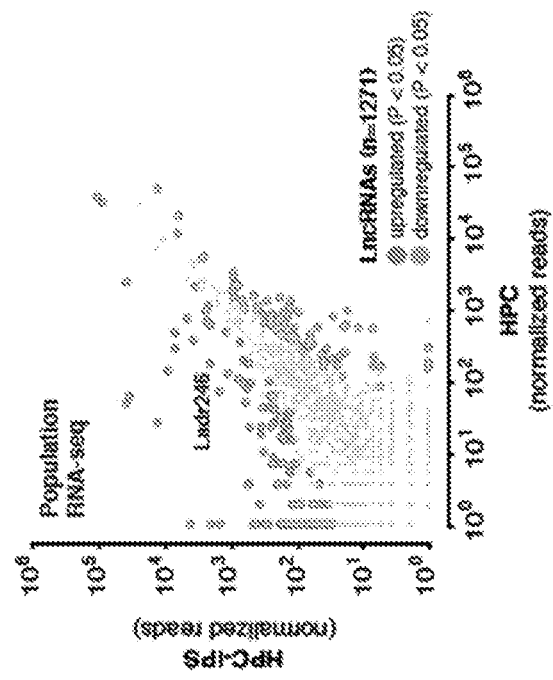
FIG. 21A is a graph showing the amount of upregulated lncRNAs or downregulated lncRNAs, as indicated, in iPS cells derived from hematopoietic progenitor cells (HPC-iPS cells) compared to HPC cells, as described herein.
Figure 21C:
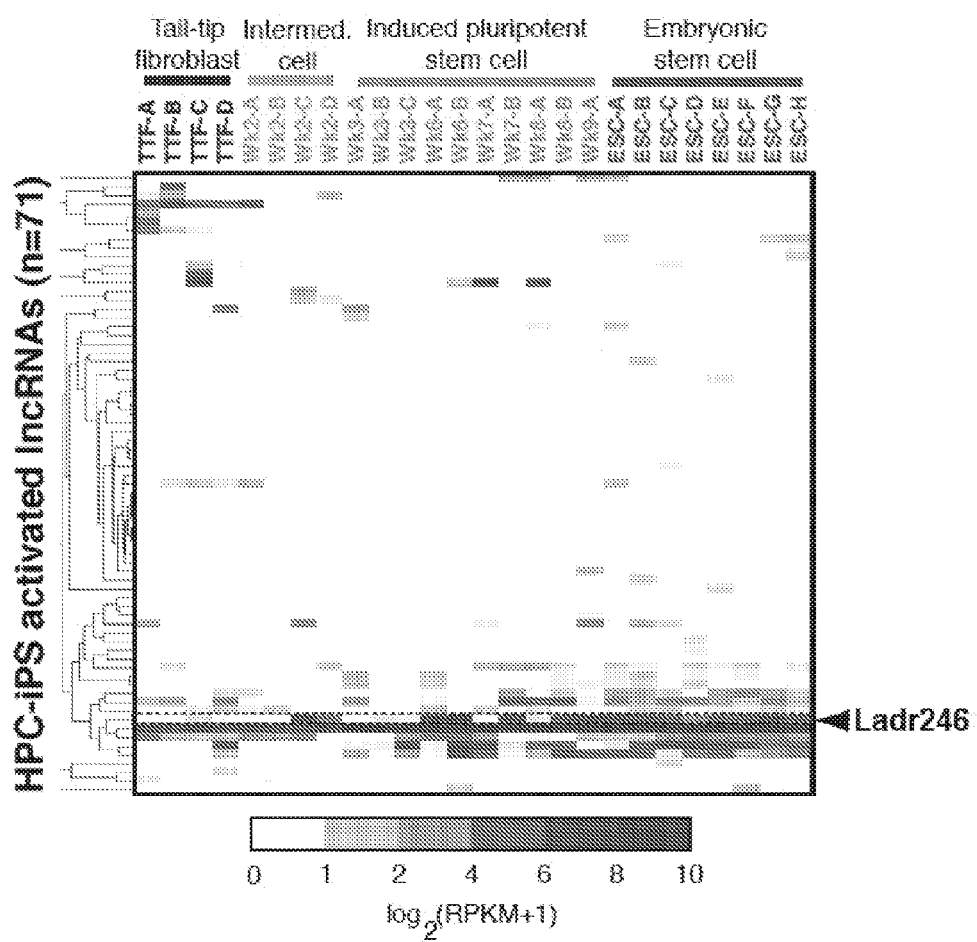
FIG. 21C shows long noncoding RNAs (lncRNAs) that are activated in HPC-iPS cells during reprogramming, according to embodiments of the invention.
Figure 21D:
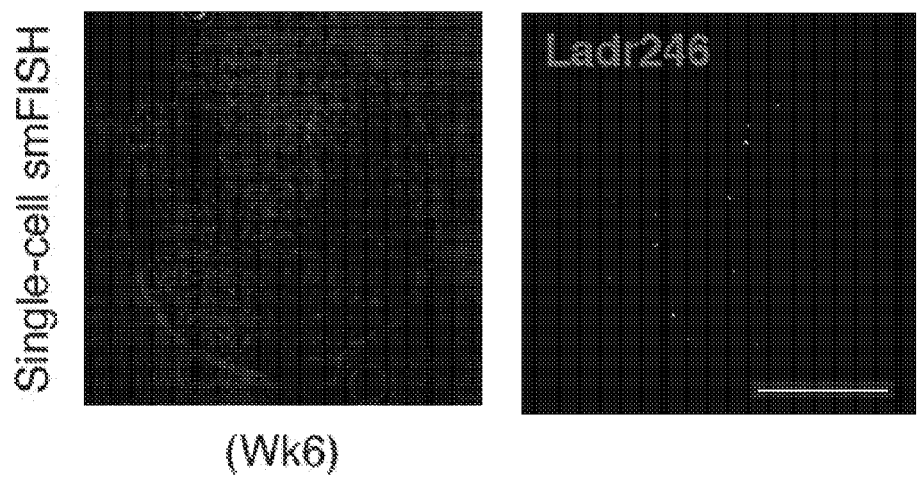
FIG. 21D is a fluorescent image of a single cell at week 6 (Wk6) of iPS cell reprogramming using smFISH, with Ladr246 probe, as described herein.
Figure 21E:
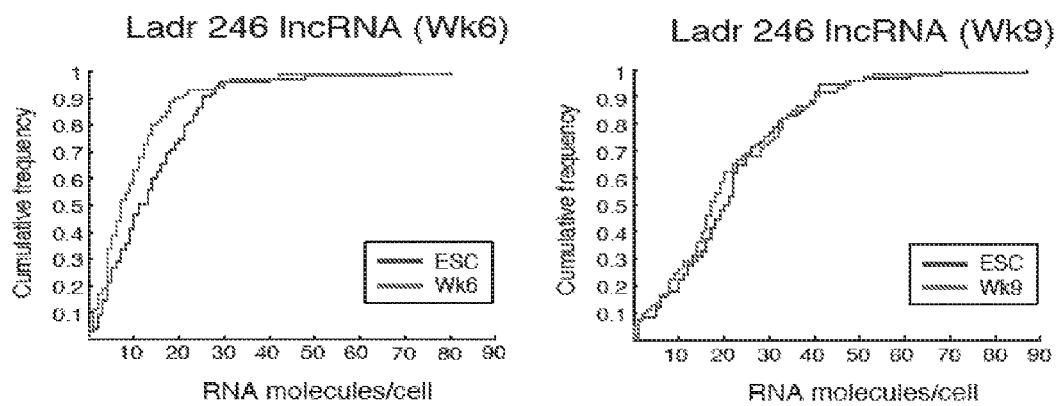
FIG. 21E shows two graphs of cumulative frequency of Ladr246 lncRNAs at week 6 (Wk6) and week 9 (Wk9) compared with ESC (embryonic stem cells), as described herein.
Figure 21F:
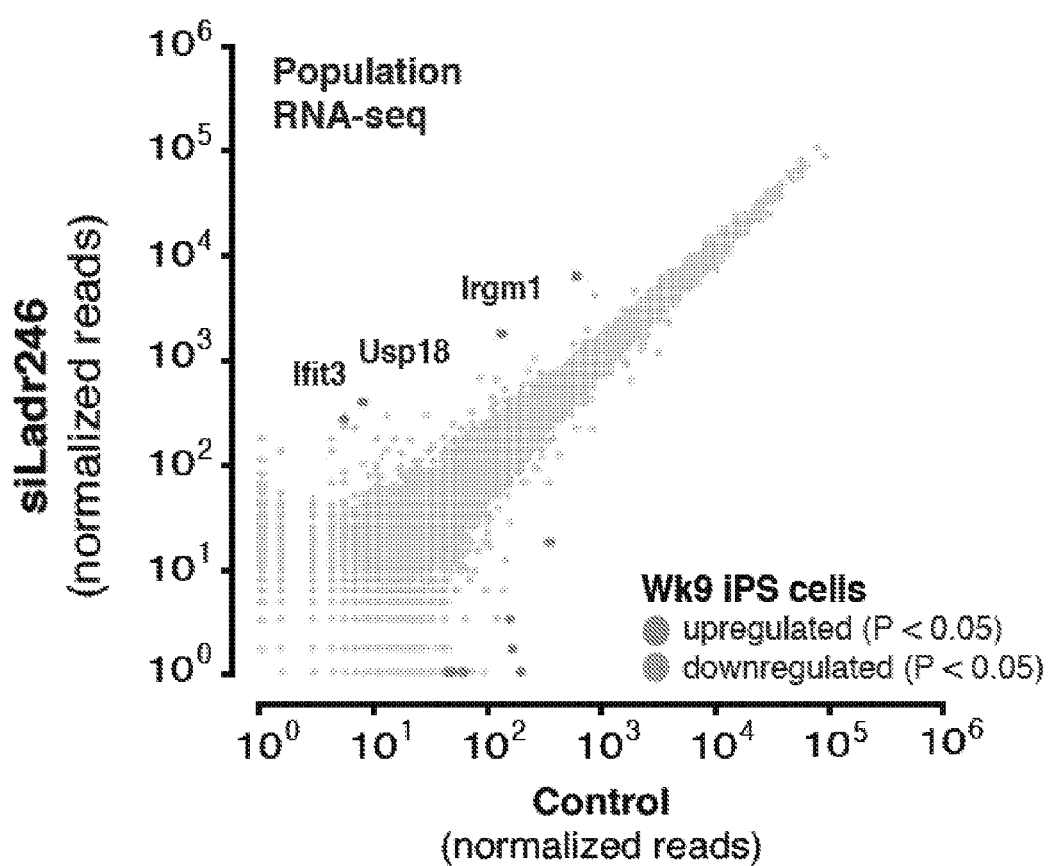
FIG. 21F is a graph showing differential expression analysis of upregulated or downregulated genes, as indicated, in week 9 (Wk9) iPS cells in the presence (siLadr246) or absence (control) of Ladr246 siRNA, as described herein.

To search for additional lineage-specific Ladr lncRNAs, upregulated genes were analyzed in iPS cells derived from hematopoietic progenitor cells (HPC) (Chang, G. et al., 2014, Cell Res 24, 293-306, the entire contents of which are herein incorporated by reference). This analysis revealed that 130 lncRNAs were activated during HPC reprogramming into iPS cells, and more than half (n=71) were upregulated specifically in HPC-iPS cells, while the remaining lncRNAs (n=59) were activated during both HPC and TTF reprogramming (FIGS. 21B and 12). Of the 71 HPC-iPS lncRNAs, most were not expressed in ES or TTF-iPS cells (FIG. 21C). However, a small number of HPC-iPS lncRNAs were prominently expressed in ES cells, while exhibiting apparent heterogeneity in our iPS cells and TTFs (FIG. 21C). One of these lncRNAs (Ladr246) was examined using smFISH, which showed that Wk6 iPS cells expressed Ladr246 at aberrantly low levels relative to ES cells (FIG. 21D). In Wk9 iPS cells, however, the distribution of Ladr246 expression was indistinguishable from that of ES cells, indicating relatively late activation kinetics for Ladr246 (FIG. 21D, 21E). Additionally, when Ladr246 loss-of-function studies were performed in Wk9 iPS cells (FIGS. 15A, 15B), it was observed that Ladr246 was required to repress three genes involved in interferon signaling: Irgm1, Usp18, and Ifit3 (FIG. 21F). These results are consistent with a lineage-specific role for Ladr246 in repressing hematopoietic genes during HPC reprogramming.

Example 9

Knockdown Analysis of Ladr272 and Ladr43

Mouse Ladr 272 and Mouse Ladr 43 having orthologous sequences in the human genome as determined by liftOver analysis were analyzed in knockdown experiments. Specifically, differential expression analysis of significantly upregulated or downregulated genes in week 9 (Wk9) iPS cells were made deficient for the Ladr272 or Ladr43 using siLadr272 and siLadr43, as indicated in FIGS. 22A and 22B, respectively. Gene expression was determined by population level RNA-seq as described herein, and gene ontology (GO) analysis for significantly enriched GO terms in downregulated genes. Bonferroni-corrected P-values are shown in FIGS. 22A and 22B. Individually labeled points are a common set of genes downregulated in both Ladr 272 and Ladr43 loss-of-function experiments.

Example 10

Figure 23:
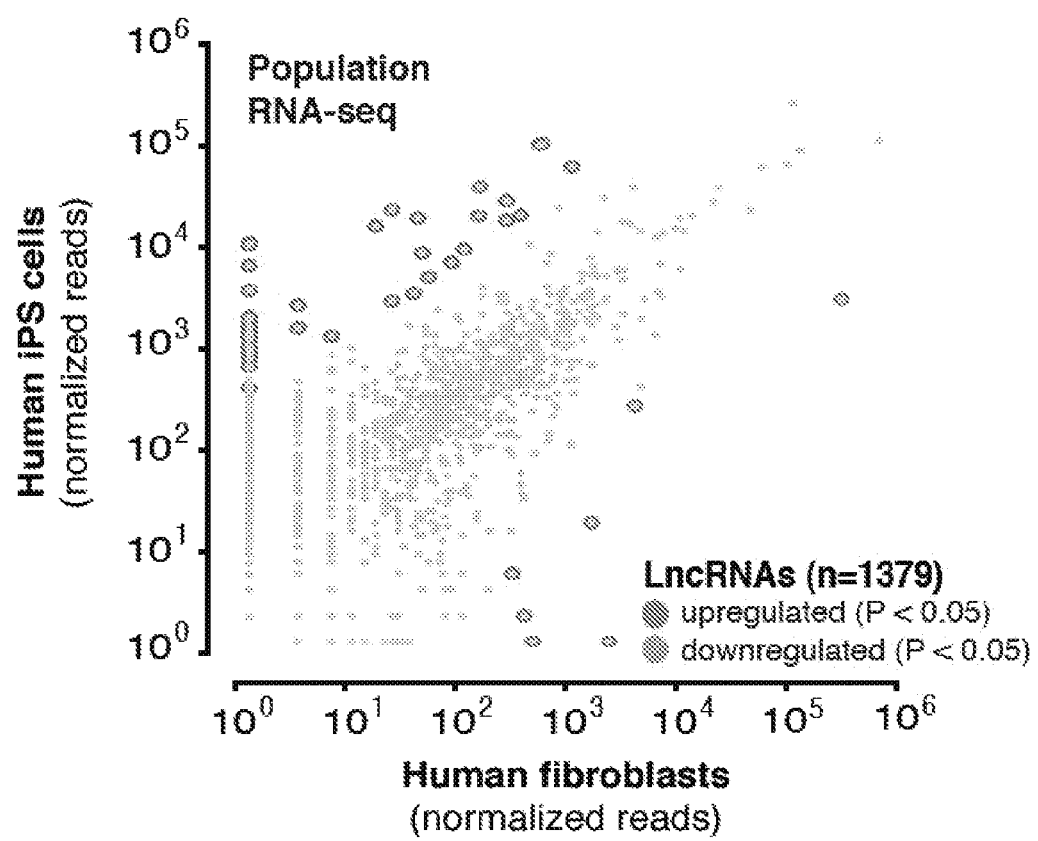
FIG. 23 is a graph showing differential expression analysis of upregulated or downregulated genes in human iPS cells compared to human fibroblasts, as described herein.

FIG. 23 shows a graph of human lncRNAs that are significantly upregulated or downregulated during reprogramming of human primary skin fibroblasts into induced pluripotent stem (IPS) cells. The upregulation or downregulation of genes in the human fibroblasts and the human IPS cells was determined by population RNA-seq (GEO accession #:GSE41716).

Materials and Methods

Example 11 iPS Cell Reprogramming

Tail-tip fibroblast (TTF) cultures were established from 3-8 day old reprogrammable mice homozygous for both the tet-inducible OSKM polycistronic cassette and the ROSA26-M2rtTA allele (Carey, B. W. et al., 2010, supra). Maintenance of animals and tail tip excision were performed according to a mouse protocol approved by the Caltech Institutional Animal Care and Use Committee (IACUC). TTFs (+doxycycline), iPS cells, and ES cells were cultured in ES medium (DMEM, 15% FBS, sodium bicarbonate, HEPES, nonessential amino acids, penicillin-streptomycin, L-glutamine, b-mercaptoethanol, 1000 U/ml LIF) and grown on 6-well plates coated with 0.1% gelatin and irradiated MEF feeder cells (GlobalStem). For "2i" conditions, iPS cells were grown in ESGRO-2i medium (Millipore). For lncRNA loss-of-function, iPS cells were transfected with siRNAs (IDT) using Lipofectamine RNAiMAX (Life). For SSEA-1 detection, StainAlive SSEA-1 DyLight 488 antibody (Stemgent) was used to detect SSEA-1 positive cells at specified time-points during reprogramming, which were isolated using flow cytometry on an iCyt Mission Technology Reflection Cell Sorter inside a Baker Bioguard III biosafety cabinet.

Example 12

Single-Cell and Bulk Sample cDNA Synthesis and Amplification cDNA synthesis was performed using the Smart-Seq protocol as previously described (Ramskold et al., 2012, supra). Specifically, the SMARTer Ultra Low RNA kit for Illumina sequencing (Clontech) was used to generate and amplify cDNA from single cells isolated using a micromanipulator or from bulk samples. Intact single cells were deposited directly into hypotonic lysis buffer. Poly(A)+RNA was reverse transcribed through oligo dT priming to generate full-length cDNA, which was then amplified using 20-22 cycles. cDNA length distribution was assessed using High Sensitivity DNA kits on a Bioanalyzer (Agilent), and only samples showing a broad length distribution peak centered at 2 kb were subsequently used for library generation.

Example 13

Single-Cell and Bulk Sample RNA-Seq Library Generation and Sequencing

Single-cell and bulk sample RNA-seq libraries were constructed using the Nextera DNA Sample Prep kit (Illumina). Briefly, cDNA was 'tagmentated' at 55° C. with Nextera transposase, and tagmented DNA was purified using Agencourt AMPure XP beads (Beckman Coulter). Purified DNA was amplified using 5 cycles of Nextera PCR, and library quality was assessed using High Sensitivity DNA kits on a Bioanalyzer (Agilent). Libraries were sequenced on the Illumina HiSeq2000. Single-end reads of 50 bp or 100 bp length were obtained.

Example 14

Read Mapping and Analysis

All reads were trimmed down to 50 bp (if necessary) and mapped to the mouse genome (version mm9) with TopHat (Trapnell, C. et al., 2009, Bioinformatics 25, 1105-1111, the entire contents of which are herein incorporated by reference) (version 1.2.1) while supplying splice junctions annotated in the ENSEMBL63 set of transcript models. RPKMs for the ENSEMBL63 annotation were obtained using Cufflinks (Trapnell, C. et al., 2010, Nat Biotechnol 28, 511-515, the entire contents of which are herein incorporated by reference) (version 1.0.3) with otherwise default settings. For downstream analysis, the biotype classification of genes and transcripts in the ENSEMBL annotation was used to identify noncoding genes. Hierarchical clustering was carried out using Cluster 3.0 (de Hoon, M. J. et al., 2004, Bioinformatics 20, 1453-1454, the entire contents of which are herein incorporated by reference) and visualized using Java Treeview (Saldanha, A. J., 2004, Bioinformatics 20, 3246-3248, the entire contents of which are herein incorporated by reference). For differential expression analysis, reads were aligned against the refSeq mouse transcriptome using Bowtie version 0.12.7 (Langmead, B. et al., 2009, Genome Biol 10, R25, the entire contents of which are herein incorporated by reference). Expression levels were then estimated using eXpress (Roberts, A. et al., 2013, Nat Methods 10, 71-73, the entire contents of which are herein incorporated by reference) (version 1.3.0), with gene-level effective counts and RPKM values derived from the sum of the corresponding values for all isoforms of a gene. The effective count values were then used as input to DESeq (Anders, S. et al., 2010, Genome Biol 11, R106, the entire contents of which are herein incorporated by reference) to assess differential expression. LncRNA transposon enrichment/depletion analysis was performed as previously described (Kelley, 2012, supra). For ChIP-seq analysis, sequencing data were downloaded from accession numbers GSM307140, GSM623989, GSM307137, GSM307138, E-MTAB-1600, GSM307155, and GSM623991. Reads were extracted using the fastq-dump program in the SRA ToolKit and mapped to the mm9 version of the mouse genome using Bowtie 0.12.7 with the following settings: "-v 2 -k 2 -m 1 -t --best --strata", i.e. retaining only unique reads and allowing for up to 2 mismatches in a read. Enriched regions were called using ERANGE 3.2 (Johnson, D. S. et al., 2007, Science 316, 1497-1502, the entire contents of which are herein incorporated by reference) with the following settings: "-minimum 2 -ratio 3 -shift learn -revbackground".

Example 15

Small RNA Sequencing and Analysis

Oxidation and beta-elimination of small RNAs were performed as previously described (Ameres, S. L. et al., 2010, Science 328, 1534-1539, the entire contents of which are herein incorporated by reference). The Illumina-compatible NEBNext Small RNA Sample Prep Set 1 (New England Biolabs) was used to prepare small RNA libraries for sequencing on the Illumina platform. Sequencing adapters were removed from reads by finding the 3'-most complete match to the adapter sequence and trimming the read after that position. The resulting were first mapped to the collection of ribosomal repeats (annotated using the RepeatMasker file downloaded from the UCSC genome browser), snoRNAs and snRNAs in the mouse genome (version mm9) using Bowtie version 0.12.7 in order to remove common contaminant reads. The unmapped reads from this filtering step were then aligned against the mm9 genome to determine the number of mappable reads. Both bowtie mapping steps were carried out with the following settings: '-v 0 -a -t --best --strata', i.e. no mismatches and an unlimited number of locations to which a read could map to. Enrichment of repeat classes in sequencing was estimated by calculating RPM (Reads Per Million mapped reads) scores for each individual repeat annotated in the UCSC RepeatMasker file, then summing over all the instances of each repeat class in order to derive a total repeat class RPM score.

Example 16

Single-molecule fluorescence in situ hybridization (smFISH)

smFISH was performed as previously described ((Raj et al., 2008, supra). Up to 48 DNA probes per target mRNA or lncRNA were synthesized and conjugated to Alexa fluorophore 488, 555, 594, or 647 (Life Technologies) and then purified by HPLC. Cells were trypsinized, fixed in 4% Formaldehyde, and permeabilized in 70% ethanol overnight. Cells were then hybridized with probe overnight at 30° C., in 20% Formamide, 2×SSC, 0.1 g/ml Dextran Sulfate, 1 mg/ml E. coli tRNA, 2 mM Vanadyl ribonucleoside complex, 0.1% Tween 20 in nuclease free water. Samples were washed twice in 20% Formamide, 2×SSC, and Tween 20 at 30° C., and then twice in 2×SSC+0.1% Tween at RT. 1 µl of hybridized cells was placed between #1 coverslips and flattened. Automated grid-based acquisition was performed on a Nikon Ti-E with Perfect Focus System, Semrock FISH filtersets, Lambda LS Xenona Arc Lamp, 60×1.4 NA oil objective, and Coolsnap HQ2 camera. Semi-automated dot detection and segmentation was performed using custom-built MATLAB software with a Laplacian-of-Gaussian Kernel, using Otsu's method to determine "dotness" threshold across all cells in the dataset.

Example 17

Self-Organizing Maps (SOM)

The 5000 genes with the greatest variance among the libraries were used for training a self-organizing map. Prior to SOM training, the data vectors were normalized on a gene-by-gene basis by subtracting each vector mean and dividing by its standard deviation. The SOM was constructed using the R package 'kohonen.' The total number of map units was set to the heuristic value 5*sqrt(N), where N is the number of data vectors. The map grid was initialized with the first two principal components of the data multiplied by a sinusoidal function to yield smooth toroidal boundary conditions. Training lasted 200 epochs (presentations of the data) during which the radius within which units were adapted toward the winning unit decreased linearly from h/8 to 2 units, where h is the map height (always chosen as the direction of largest length). Further analysis, including clustering and visualization, was performed with custom python code. Clusters were seeded by the local minima of the u-matrix, with a value for each unit defined as the average of the vector difference between that unit's prototype and its six neighbors on the hexagonal grid. All other unit prototypes were then assigned to clusters according to the minimum vector distance to a seed unit. The lists of clustered genes were submitted to the Princeton GO TermFinder (Boyle, E. I. et al., 2004, Bioinformatics 20, 3710-3715, the entire contents of which are herein incorporated by reference) server (http://go.princeton.edu) in order to determine enriched terms.

Example 18 lncRNA Analysis of Induced Pluripotent Stem (iPS) Cells

Raw RNA sequencing data were downloaded from the National Center for Biotechnology Information (NCBI) Gene Expression Omnibus (GEO) and analyzed for differential expression of lncRNAs during mouse hematopoietic progenitor cell (FIG. 21A) and human skin fibroblast (FIG. 23) reprogramming into induced pluripotent stem (iPS) cells. The GEO accession number for FIG. 21A is GSE36290. The GEO accession number for FIG. 23 is GSE41716.

As disclosed throughout and as evidenced by, for example, FIGS. 15A, 15B, 16A-16F, 20A-20C, 21A-21F and 22A, 22B, and Tables 1-4, the disclosed lncRNAs participate in modulating pluripotency reprogramming and pluripotent cell differentiation, and may be utilized to enhance these cell fate methodologies.

While the present invention has been illustrated and described with reference to certain exemplary embodiments, those of ordinary skill in the art will understand that various modifications and changes may be made to the described embodiments without departing from the spirit and scope of the present invention, as defined in the following claims.

SEQUENCE LISTING (424 sequences)

SEQ ID NO: 1 - DNA, 1358 bp, Mus musculus
gctcctgcagagacaggttctacggagtggccccaactcggatgcctctagctccctcccgatctccacaccaactcagaccgaggtctatgggaggtttgtttgattttcttcacttggatgcatagtttcactgtacagcgagcagactggatttcaattccctgagatgctcctgcctcggccccctgaaagcggaactcacagatgagcgtcaccacgcgggaacctatttgctgttttgaaggtgtgacacagtgatttagttccttaccccgttctgctgcgacgtcctcattctaaatgggtcagcagtctgaaaaggacacggctgttgaggggcacagccccaaccccagctcagatccccaaactatccacgatgacacgaaggcttggaggacgctcactaatgattctaatctccggagggtgctaggggcttcacctgcggccgtggaccatctcttcgggtagtgtgcgtgcactgtaggagttgtgcactttgcccaacccttctctgccgcatttgaaactactttgggtgcattctgctgctactttttctgtgagacttctcgctgctgttgaaaaagtaaaaaagaaggaaagtaggagggatcaagttttcatttcgaggttctgaacgttctatttgaccctgtcttctctgggaatcgtgaaaaggtgactcgttctgtaacataggtgacaaggaaaagggggtaagcaggctggagggggcctgtgtgtgtcctttgtgtcaaatttggtttcttgagacaaggtttagaccaggctggccccaaactctcagagatccgactgcctctgcctctctagtgctgggattaaaaacatgtgccaccacacccagcctcaaaaagtaattctttacattgtatttctttggggagtgggggggggggagcttttatctttcactggctgtagccagagtctcagaatacagagaattactccttatgccttgtggtggtttgaatagaaatggcctgcatgaattctaaatgccgtgtctaaatgcttggcccatagggaatggcactattaggaggtgtggtcttgttggaagacgattgtctctgtggggacaggctttgaggtcttatatactcaagctatgcccgtgtgtgacttacagtttcttgcagccttcagaatgcagaactctaactaagcccatcctccagcagcaagtcggccctgattcagtcttgctactctccatgacaataatggattaaacctctgaaagcgtaagccagacccaatgagatgttttcctttagaagagctgccgaatggagtctcttcatggcaataaaacccctgag

SEQ ID NO: 2 - DNA, 6298 bp, Mus musculus
ggttctaggaatccttgtttattaacagactaaataacaaggtctaggagcaggtttcaataatgactgtaattttgaagcagtaatgggtttaatgacattttcaaccacctgacacaactgtcacagatctgaaaatagtgatgatgttcccagagaccactggagatgtggttgtggcgatgtatgttgctgaaggagacactggcaaagatcaatgtaaccgagacttttttttccccatccacattgatgcagctgctgagttccagagttggtgatgagccaggctgaccatcttcagcatccttggcagctgtcattttgaaggtcacaggtggtcatggggaagaggcacccttgaggtggggcccctgggagcttgccacaggaagcattgagcctggggctcactgaggaagctaggctgaccagccagctatcccagggatcttcagtttcctcctccccggcggtgggattctaagcatgcacctggcattttcttctgggttataaggaattcatgtcttcatggccatactgactgagctatctcccaggctcccagtcagtgctttaaaaaacaaaaacaaaaaacaacaatgaagtaaacagaaaaccaaagacgtcactcacaatataattgcaaaacctacacaaccaaatgctactgggatccaaaagagaaccagaataccagagcataccagaaaactggacgtgtgttgggaccaatgcccgcagcacttacactgcgaacgctggctctctcctcacagggatccatgcactgtcaccccctgctcctctgacgttctggcagagagcaggcattgtgtgacacagtcgtctagaagaacaggagcagcatggagatgaaaaagaggaagaaaggaagggaagacaggtggataggacggacgaggaaagggaaatgaagaagggactagaagggagggagagaagaaggtgagggagggctggggtgggagagaaggagggggagggggaggagagaagacaagagaacaggaaaggtgctacaagagaagggaatgtctgggtgtgacattcaggaaggccctatgcccttcctgaagattcttccgcagttgacagcggcaagtctgggtgaacatgcagagagctccctctcccagtttgcaaggacactcatcccaggcttccattgtggctggatgaggaggttttcctgccttcagaccaccccaaataccttcctctccaccccgtggaggtttgaatgagaatggctccagcgtaattgaatgcttactcatcagggagtggcattacctgggaagagatagaaggcgtgaccttgttggtgtggccttattgaaggaaatgtccctgggaatgggtcattgaagtttcaaaagctagaccctggccagggtctttctcttcctgccgcgctccctcagaactggctgaagaacactagctacttctccagctgcgtgccgccatgttccctgtcatggggataaagggactaaatccctctgaaacggtaagcaggcctgaactaaatgctttcttttataagcactgccgtggccaccgtgtctcttcacagcgatggaacaccaagacaacctccttcactccgggagaggcaagggtggtaggctttgaagtgtttgtcagggtccagacaactccaggcaaggagcgcaggggcaccgctgataaggtcagatgtctggaattcctgatgtggtactttgctcgcgcgcgagaaacggctcccagagattgtctgcatcttaagaagaaacattttagtaccttcatcctctgctccacaaatatttactaagcatcttcatcggagacagtagatggcttgtggctccttgtacccttaggacacctctgctccattgtcaaaaagcagattccagctgttttcctctgtgtggttaaagggaggtccttagataaagtggatggactgtgagaggaggaatccatgtctcagctcagtggatgctgctctggggtgatggccaaatggaaggaccccagagggactatcatgggcacagtagtaaaggccatgggctctgcaggagtgacctggactgatagacatgggacagatcagtaggctttcgagcctgtgttaagactcttcagagaaacacccaatagaagatacacagaggtgatttataatggaaactggccacacaattagggatgctagagttctccaccatcttctatctagagaacagggagagttggtgattctcactgagttcccagacacaggaaccacaagccccaggttgggacagggtggatatgtcccttgtttccaccatgtctttgttctgttgagaccctcagtggactggatggtaccaccaggtttatcagccagatgctgagctctttccagaaactactcagcgacacgcccaggactaactgttcatcagttctctggctatcttctagctcagtcccgttgacacgtgagattaactatcataccttcacctgtatctaaagcgttctttggggggctgggggtttgtccaagcaagcatgatgatctgaactcaagccccagcacccatgtcacaagctgggcgtggtgatgcatacttacaaccccagcattggggaggcagagacagagacaccccagaggcccgccagccagccagccagccagcctagctgaattagtgagcctaggtcactgggagagaccttgtctcaaaaagcaaggtagacagtttccgaggaccaacacctgaagttgaactctagcctccatacacataagaatgtgtcttcatttacatacacatatacatgtacacacacgaacagacatgcacattctctctctctctctctctctctctctctctctctctctctctctttccacacatgcctacaccacatcacaggcacatagacatacagacacacacacacacccctcttatgtaactactctatagtctgtgtagctctgaccacccctcagacaatttctgctgcctggaagaagacaggaaagcaaacaactgtaagtggaatgcagtgaggagagctggagccaagaaggccacagcagctaaactgaggggctggggagagggcagaggtctgtgcagaaggaagagtgtaagagcagagccctgtaaaatagcactgctgggtttgggaacagggtcctgcggtcaaaactgatcaccgcaggaatccagtagcagggcaggcaacaggctctgagggccaccaaaagagctgacagacggacagacagacagacagacagacagcatttgctcagactcacctttagaagtcctgtgttgataaggtgggccaggtggagtgaagacaagggtttcagtaggaagctatacctgactgacagtgtagtacagaaaactgggagattagctatgtgaggttgtggcctgtctggaaggaaggagcagccctgagatttgaggggtaatgggcctaggtaggatgtgatggtaaagaagggagccaaggatgactgtgttctaccaggcaagctgagcatggagggggaggatgaggcttgggattgagatggttctgggaaagccctgggggagcccagtggacactggaattggggtttgaagctcaggagggaggtcagaccaattctgagtcagggtcaaacttcaaggattctgttgtcatggtgaaagggacccactgtagacctagaggcaggcagaggggccattcttgtgcaagttcctacaactctgggaaattggttttctttcatcacgtctgtttctcccactgtaaaaggtagatggcttatgcttgtggtgaaggtcacaccggatggtgcatgaggaagctcaaggacggttagctgctgcctggaactcttcacggctgaaggttgtgatggctggagtggcccaggataggcagcctgagaagggagaagcctgggacagctgggaccgtgagcaagaaagggtgttctctctctcctggggcttggggtatagccagttggtggagtgtttgcctagcatactcggtgcccagggtttgatctccagcatcacataaaacacaactataatctagcttttgggaaggaagtggaagtaggaagatgagaagtttcaggccactctcagctacacagcaagtttgaggccaggctgggctgcatgagaccctgtctctaaacaacaacaacaactttaaattaataaaatagtgttctctcagtttattactgagccaactgatgactaaagactgtagttcaaaatcttttaaaaataaattctcacctcttctattgaaatacagtcaatagcttagttttagaagcaggccaaatgaaatgtactctctgcacttttagatgaacggagccacactctaagcaccacagggtaggtttccaagggatgtggcaacctccactgagagaggagctttctggtaatcagctgtgtgactttgaagagccaccagctccctctgagcctgcactaagctctctgtaatgttgactctctggctagatggaaatctagcacgaaagcctgtttccaagtacttggttggacttgagagagcaatgagggctctggttgtaagggatgtctgtacgccagcagagaaggttccatccgcagcaggcccagagcctacacagtcagggctggaggtagggcagaacaaaggtgctctgtccaggagttgggggcctgggttctgttcctaactggttctgagagttcatgggtggtcccaagctccgtgactacaacggacacctgcgctagtgggtaccctcatgtttacaataggttggggaagagaggagttgaacaacttctcataatgaatgagatgtcttttttaaaaagacaagttagtagatttctgttaaccttggtttcttccacaaaacagggttctgaatgtgtatctcagggtctatgagagtaaatatgctaaagtagcatctattatgctatataacacacacacactatacatacacaaatacatatactggggcataaagagatattcagagcacagcacgggtcattggggaaggggataaaatgagaacagaagggaacatgagtctcctacgtacatacccagttccacaatggctgctaggccagtggcttccaaatggccagtgaaagaagaaaataaaacccacttgaggccatcctttctggcttaaaatttgtcagtggcttacttaactatagcagatgccttcatcctcacgggctctttctctctcaaagcccctcatacagatcctcattctctggatcatggagaactgaaggagagctcttccctgctgagacaactgtttctctgctcaattcacccaacctttttcttagggagcttcctgtggtccaaggtgggctggccagcatcactctgtggaagcgtcctgtggggttcatctcctttcaaactgtgggtcctccatctctccagcctctgcttcctctcacccatcatgctccacgcagaagacagaaccccatcctgcatgctgaagaggcagggtgtgaggactagatctgagagcttgctgtctggagatctgttgccccccccccctagtcaacattacagagagcttagcgcaggctcagagggagctggtggctcttcaaagtcacacagctgattaccagaaaggttctctctctcagtggaggttgccacatcccttggaaccccccccccccacaatgcatcttcatagaggacacagcacccagtagcagctaggtgttggattgagtaaatggtgacccaagagaaaccaaaatggcggctactaaggcagggctccctggggaaaacctctggcgaggtagaagacaaggtgggaattcactgatgagaaaaacagtgagctctaggtcaattactgacaatttacctagggcagatgaggagatgttgtctaattgcggcttcacataacactcataaaaactagtgatattgttggaagcaagttgagccctgaaaagagaaagctgaaggtggcacagatctgtgacatccagacacattctccgggggaaaggttacaaagttactgggctagtgactagtcatgagtcatccccagagtaaacagataacaggcaagaaggttacatggtgacaattcagagaccgctgaactgtgaagattatgtggggcctctcaggctaagcactttcagaa

SEQ ID NO: 3 - DNA, 3126 bp, Mus musculus
caaggacagagcttcatacttggccactcgcagcagcctgagctttgacccacaccccatcgaccaactggcacagaactgtttgctcgtagaggggggtgggtggcactctgaaggctatccagcacgatccggccctttcccttggcaattctgtgacactttccaatctaaggccgacagagcaaggcaaccagatttttttctacagcaccctcccaggtgagcagtgggcctggagcccttctgtaacctggcatctgtaggtcttctcattaagaacgagagtcagaagaggaaaggacttaacactcattacaactcagtcatggggtgagtgagcaatgcaaacagggaaaactcactcccacttggccagggtgcggggtgggtatgggagggggcatgcgcctaggcctttgcgctcattgggcaggtagcccctagataatgttcggacagcacccactcacccacgcctggccagtcagctgggacaggcaggcctaaaccagccggcctcacctagaggcgtctgcccccgaggcagacaccgcccgacgccctcgcttcagcggttcccaggagagcaggcggcagagaccaagtgatctaccgctaaacctgagcccacctcgaccctatttctgacgtgtcctctgctagcggggggagtgggagggagaggaaggggcctcggggggatggatcccttagccgctattgtcaacttcctcggcaggagtggatgtctgtaaaggttggaaggtaaggtggctctgggaatggcctagcacgcttccacgcggtagtcgctcaaaagtttcaaacaagaccttgtcctactggccgtgccactgggtcgcgtcgctccaggtctcccctcctcccctccccctcgaagtagtgtccctgccactccgcagttccaccacccacgcgggcccccacgctcacctgttgcagcactttgtccagggactccgcccgcgctaggctgtctgcgctgagtccactcgcctcgcggcattgtggactcagggcagccgcctcggcgcgaactagcgacttgtgcagcgtccccacctaaaagcaccgagggtaaccccatgagccgctgtgcctcaacaggctctgaagcgtcccgaggtcccctctttcccaccctacctgtcggctgcgcggctccaccacttgccaaactaggaggattaagtcggtctcgtccgagcctaggtccggccccagcgcaccggcagtggccccgaacaaaaccaccagcgactgaggttcgggacaagggtctgtggccgagtctactgcgggatctgggcccgggggtgggggcggcggcggcggcggagtcatggccgcagaggaagggggcgctcggccacacacgcggaccgacgaggcgcacacacgtaccgaccgacagcagacagacgagcttgggcgggatccggtgtgttgggggcggcacctgcggccgggtgtagtgggagctgcagagacccgcccgcggtgccctttggggctgggcggtgcggctgcctatccctgcctactccggcgagttacctgcggcccggagaggccacgtgatcaggacggcccagggaaccccgcgggagggccaaaaccctgcccaggaggcaagagctcacttctgctgaggcgtgcgctcgccggctggagtcccacctcttgctgcagtccggcgagactcctgggacgaatccattctttctcctacttcctctctagcaggcactctgagtcctccgcaaaagaatgtgcaggatcagaggcctctttccattctgcaagggtcacgcaagacccatggaattcaacaggaggcaatctagggactataaaaggtcgcgacgtctggcttgaggttaatggaagttacaaagggtcaaaagccgacagtgagcgctaccaggtatccactggaagtcggtgagagagatccgttggggaaagggagggaggtaaagatcaagggttcttagaactgtgggcggtcactagagatcacagagaaggacgtgcccatacaggtgtcgggtcggcgtagtgccggcagtgcaaggcgcacgttactgtggacctgaaggctcaggccttggtgccaaggtaggaaaatcgtgcttaaactttagagagctgtatcctaaatgaagccgtgtctgctggtagagatctggaagttcagcctaccaaccccacttggggtttgcctgcttgtttttgtctctcttggatgatgatagaagtgttatctggctattgaaagcactccagcagagagcggctagagttgagatgtgtagagttgagtctgcatcccccaacccagttcagaagagtcccattcatcccatgcagtttggtgaaactcccttactgttgtttccaggccgccctgtgggctcaggatagtttcccacctactcgactgtaattagtactctggcgagagtaaaaaggtactggcgtgggacttagaatacaggatgccaccggctgaagaagaaccttgtgtgtttggaaaagcgggctgcttcctatcggtcttggataaaaggcaacccagagcccgggtgcatccctaactcatgcccaaggaaggtcgtgcggagccagaggacctagaatgtatagtgcgccttctgggtttgtccacacaatagcgcaggaacacagcgacccaatatagtgagaagtggccgcagcgcacaccctgagacccttcaccaggcggcccacccggagcctgcctactcagccccgctaccacgataagcctggaatgtcaaatatttgttctaggaacccagtgaaaccttgaggtaaagcccctcccctcctccctcccattccggagcgcgcctgcgtcagtccaggctttccggtaaggacactcccttccaactagttccttctcgacacccctgcaacccatcgtcctgactatttaaacttcacaaggtcttcgctacaggctcaggttcagtgaggcagagtcttggcttccctacccagttatcccagagctactggtatcggtttctacccacaacctccgagcaaggctcccctttcaacctgtagacc

SEQ ID NO: 4 - DNA, 6453 bp, Mus musculus
gaaaactcagagtttatttttcttttcttttcaagtgagatttcaaaacattactttaaaaaacaacaacaacaaaacccccaagacattatttaaggaattacccacaattctgcctttgaaggtgctgccactggaaaactaggcatttaaagactgttaagtgaaacaagaaattcaataaacatcagaaaaatgcaatccatgttttcctccaaaattcctgtttttgaaatgaaatctttttttttaagatttatttattattatacataagtacactgtagctgtcttcagactcaccagaagagggcgtcagatctcgttatgggtggttgtgagccaccatgtgattgctagaatttgaacttaggaccttaggaagagtagtcagtgctcttaactgctgagccatctctccagcctggaaaaaaaaaaaaaaatttgtcctgaaattttatggaaatacaagatacactgcatagatttctcgagcaaccttgccattgtataaaaactgattcataaatcctgctagcacagggatactttgatctgttagccatctctataggccacgccctcgttacacttgcatcacagcggcccctctgaatcaattgttataaagatctcataggcgagaccacagagggctggaggagctcaagcgcctggctggggtggggggtaaggggtggggggtgatgacttcagagcccccttggatctcgggttaaaaggagctgagcagaaccgggaacagcagggccgggatctcagcgaaggctctaaggggcctgagcatggcaagcacggcacccgtaggttggcccgctacccatcttctcccctcttgttaaaaccattagattgcattcctgaagctagccttcacggtttcatttgttcacttcctcctcctaaggccgatcaccaaggtccagctatcaaagtactgatgtccatcagtcaaaagccacctttaaggctgaccatgcccaatcaaaacaaactaattcaccctaacactgatctcctctcccctttataaccacatttgcctctgggccatggtctgtctcctcttagaggcagtcttttgttcctctgggcagaataaattctcccttgctccttttcctcccctcatcctccatcttttgtctttgtcctttattccctgccctttgtccctaggggcaaataaatctttgtgctgagaacttggttttgtgtcctgtgccgaatccagtcctttcactcagtactggagcaagggacaggaatgccttgagttcaagaccagcatgggctatctagtgagtctgagtctatcctgggctaaatagcaagaccctatttaaagccaaccaatcaagcaaccaacaaacaccaaaccaaaaaaatatctgcttctcccaaaatctcttgtgctatgtgtttgctaatcacactcacttctgtgtggccttatgggatgtgtattaattatggattttacaagcatgcctacttctgtgtgtagttatgtaggagggagactggagaactcagacaaatatactttttttttaattgctcttactattttttggtaaatatttatttatttatttataatgtatatgagtacacatgtggttgtgagccatcatgtgattgctgggaatttgagttcaggacctctgcttgctccggttggctccgcaggctctggcctaaagatttatttattattatatcttaagttcactgtagctgtctttagagacatcagaagaaggtatcagatctcattcaggaccttcggaagagcagtcagtgctcttaactgctgagccatctctccagcccctgaggcaaatatcaactctttctgtagctgatgttgctgtagctatagctgttgtagtagctataactatagctgtagctgtagctgtagcgcacgagagagagagagagagagagagagagagagagagagagagagagagagagaatctacattcaggtacatgcacttgagtgtcagttgtgagccactaagtgagtgctgggaattgaacctgtgtcttctagaagaactagctcttaaccactgagcaatctctcaagccccaagaagcaaatatcaactctttctgtagctgatgttgctgtagctgtagctgtagctattgctgttttactttccttgtttgagacaggcattactgtagcctggctggcctggaatctactatgtaactcaggctcctgagtgctgggattacagatttccactaggcccaggctatcattttttttttttaatttttatgtgcattggtattttgcatacatgtgaatatgtatgaaggcgccagatcccttggaactagagttgtagacaattgtgagcagctgggaattgaacctaggtcctctgaaagaacagctggtgctcttgaccactgagcatctctccagcccctcgctgtgtttcttaatacagcagtcatttgtgtgtctgtgtgtctaccaaacctgattaaaatttatttgtggcacatttctaccacatcctccagatgaggatacaatgaacagaatcaggggtgaactatgtccaggggatttgggggccattcatttattcagtgttcagagagtgcacgtaacattctagaggcgctcactgttaggcttaggtcccagttcacactggtgagcacccagggcgggccctgggctgagagggctgacagagcagccagtgctgccctggcctgactcacttcctgtgtcccagaccattactgccccgggcagtctgctcacactggcaggccacttcctatgtctctatgtggactttagtctgtgtgcaatactgacccctatcgcctaggattcagttttaactatgtccttccttccttccttccttcctccctccctcccttccttcctcccctccttcctttcactggggcctcattaactagcccttgcttgcctaaaatgtgttatgtagaccaggttggtctcacactgtcagagattcacctgcctttgcctcccaagtgtttaattagaagcttatgcacttaattaaaggcattcatttgtatcattcgttcaaatggtgaaacagccatcactctgttctaggtctagaagcactgttcatggaaattaagcttaagccagattggttcacacgcacacccctaaaatagtcctgtgcctaattgtacagatatgaatagatgcatgttctctacctcctttggtgtcatccttactattaaactatctcgagattccatttcatcttagtcagaaaggctaccattaagaaatcacacacgcaaaaaaaccataccaaaccaaaccaaaccaaacaaacaaacaaaacagaataaaacaaaacctcaaaccaacaaaacaaaacaaaatcaattaaaataaatctcctccttccaaaagctgtgcatagtagtgaccccatgtctttaatgttaacacttgggaggcagatgcaggcagatctctgtgagttcaaggccagaatggtctatatagtgaattccagtctatccaggacatagagagagaccctgtctcaaaacacacacacacacacacacacacacacacacacacacacccctaaaaatagacctaccatatagtatactactcctgggtgtttaccaaagaaacctaagacagcaaccgcaaagatctgtgtgcacagacacatatgcaggcatgtttaaagctgcacccccgctgccaaggaaagaggtcagcccaggcactgaacagtggctgagtgaatagagaaaactcagtgtacctgcacaatcgggtttttgttctgccatatctcagaacaaacttaggccattttcagaagaaagatgaaactggagatcatgttaacggaaacaagacagttcacaaagacatataccacagattctctctcctgtggaatctgctttggaaatggatatctataaaacttgaacgtagatggcagtacatgggaagagtaaaggatttgagcacaagggtgggtcgagcatcacagagcaacaggctgcatacaagcaaaccacgggatacacaggtttgaaaatgtcactatgaaatacatcattttgtgctatgaatatactaataaacttttaagaacccgaggcattaaattttacttcctttgaatcattagcacacgcctgaagtacattgcatgcatttgaggtgtttatcgactaattaaaactctacctaaagataaacagcagcctggatggagctgaggaggtggctcagcagctaagagcacttgctgttcttacagaggacctgggtttggttcctggagcccacgtggcagattgtaaaccaaccccagttccagggcacctgtagcttcctcctgaccgcacagcaggcacccatgtggtgtacttacagacaaccgcgcatacacactaaaataaatgaataaaagtgaaagaccaaaaagctaatcaaaacccccaagccccaactgaccgctgaggactgagaacgcttctggtgtaggagtcttccaactgaccacgatgtctgtttaacattgatggctcatgcaaacaaacacacacgcatacatgcatacacacatacacacatacatatacatatccccctaacttcatagctgtcttcagcatttgaaaggaaaatgcgtaactgaaacaaagattattgacgccaaagaagggtttcatcatacagttaaaacaatgctcatgaaaattatttcagtgatgagttattctgcttaatggaagatcttttttaaataaataaataaagattaaaagatttggaggaaaagtcaacttcctgtctgtaacttaagacagttattaaaaaacaaaaaaaaaagataaggtttattcaaacaaacttacctcaagtttaccagtaggtgtcacaatttaaatatgctgatatcatttcccacagagttccgagtttttcgaaaaatatttttctacgactccagataactgaatggacctgaggaacacgtgaaaataaatgatcaatggtaataaccaacgtttccgaggttttatgattgtagagaggggtttatttaatcagtgtctcaacttattcaaaaggctggggagttccttgagccacgcctacaaaatgtgtttaagatcttggactgctttgataaaaaacacttttggagagaatagggtggcacacgcctttaatcccagcacttgggaggtagaggcaggaggatttctgagagttcgaggccagcctggcctacaaagtgagttccaggacagccagggctacacggagaaaccctgtctcgagaaaccaaaaaccaaaccaaaccaaaccaaaccaaaacaaaaaaacccaaagaaaataggagaagataaaaatcgaaaatatttcaaattctgggtcttcatggtcaaatggtacatttttgaaagactgcatgtgaacacgttaaactttgagggggggggaaatgaaaagaaaggaaagaaagaaaacaaagggaaaggaagaaaaaagaagggggtggggagcggacagaggaaaggcaaaagcggacttgttttttttttttttttttttttcttttttcttctgtgcaaaagtacttttgcaaaaagttagccaataccagacctctccggggagcctcttcccgcctggctcaggtcggttcctggagacacggtcgcttcactgcgggaaattgggctgccttgtagcagcgccctattaaggattaaagaacatttctttcaactgaaataagacttctaaatttccaaaagctctggacctaaaaacaactgacagaccgcggcaaggaacaaaacagcaactttaccaggagtggggttcgaacccacgcagacatatgtccattggatcttaagtccaacgccttaaccactcggccatcctggtgcaggcgtgctctcttctctttgctgttcctacaaagctcacaataccgtcctcattttccccagttactcgaggatgcttctgcgcaggctgcgcggcgctttcccgacccggctacagagactcggagactgccgccggggtttcgcgccgccgccgccgccgccgctcactgtcgccccgagatctcggcggcagcgaaggaactgcaggagcagagagcgggacagagctctgggccggcgggcgccggctctccttgctcactgtaggtgcgcgggcgcgacaaacaaactccacagctaacttctgggctccggagcggaggtgggaggggtccctcgggcggtgtaggcacgggtccgcagggcaaccatcagtgtgtttcttctaaatcgaataggttcccggggcccggcacctgtgcgcgcgcggctttccttcctc

SEQ ID NO: 5 - DNA, 4360 bp, Mus musculus
ggcctgcagcggagttaccgcctgagtcggctgtctcagcctcctcgcacgaggtccagggtgaccgcgcgctgaagccagagccaccgcgggcctcaccagggcccgatcctgtcagtgcaggggcaagccgcaaggagcagcaaggtgtgtggtcagtgcaacctcggttccataaccagcaacacacacacagagacacacgtacatatacaggtatgcacacagttacaaatatacatatacatacatccccattcacatacatataaacagatatacgcctgcactcacatacacatacagatacatacacacaagtatacacaaatacacagttaatacgcatacatacatacatacatgcatacatatatactcacatatacatgtatatcacacacatatatatacacacagaacatacacattcaatcatatatacacataaatacagttacatatatacacatacatgcatacatatattcatataaatacatacaaacatttgtgttttatacacacaaatgcattttctcctacagtaagaggattacagaccaattttatttatttatttgtttgtttgtttatttatttatttgattagttttgagacagggtttctctctgtatctttggctatcctgaagctcactctgtaggccaggttagcctcaaacccagagatccacctgcctctacctcccaagtgcagggattaattaaatgtgagcttcaccgtttgcctggtgaccaattttattttcatctttagcttttactttgagccaggtatgcctttaattcgagtacttgggaggcagaagcagatggatctctgtgagttcaaggtctacagagtggcctctaggacagctagggctacatagtgagaccctgtcttaaaaactcgaaagaaaactaactttaattaatttgtgtgtgcctcgctgcacatgtggaggccatgtgcatcaattttcaagagttggtcttctttcttatgcagacgtcctgggaatcgaacttagctgtcaagcttggccgtttgaatcgcaagatcatccttgactgcatatccagctcatggccagcctggtggtgtacttaactacctttggagtcaagcagctgccatctgggggagttcagctgtgtccacttacaaaagaattaccttagctggactttttgaccgtttacatcccctcacggaagaccctcacctgagtatccactggctccctataatttattgtgtgcaactctgccttaattgcacatggcttgcctggagggcaggggtggggggaggagactagagtactcagattaagaaagactaggagagaggtctttatctaagcagctatgggaaaacccttaccctgttggccaaatctttttttttttttttttctctaggctggcctcgaactcagagatctgcctgcctctgcctcccaagtgctgggatcaaaggcgtgtgccaccactgcccagctgctgtccactggccaaatcttttctggtaccatcccatctctggaggaaggagaacccactctcctgtaggtactcctcacctatgctctgtaaggaagcccaataaattcattggttcccccaaatgaagtatggcagtagactcatgccccggtttgtcactggaatcttaggtggaggggtagacatcatttatgccccctcccatggaatgctatcagcacacaagggatttttatcaacactgcaataaaggagaccctgtctcaatcaaaacagaacacatcacagaagaaggagatcagatggcactccaaggatgacagtaccccgcctctctgcttcctctgtaggccaacttgagtgaatactggttctttagatcactaacatgccatgctcctgacttggctcaggggtgattttgatgataacttctctctgtggcaagcacaggatacagtgccacagtgcactacactgataacagggatggctgtgagggatcaacacagccacatagctaacacattggggacatgccacactccctccctcctgccactctctgctcaccttttctttctctcatatatatatattttttccatctcaaacaaaactttgggctggagagatggctcagagcataagagcactgtctgctgttccagaggccctgagttcaattcccagcaaccacatggtggctcacaaccatctggaataggagctggtgcccccttctgacatgtaggtatacatgcaggcggaacactgtacacataataaataaatctttttaaaaaagaaagaaagggttggtgtggtggtttccatgagagtggcccccacaggctcatctacttgaatactttgtccccagttggtagaactgtttgaaaaggattaggaggcttggctgtcttggttacttttctattgctaagaagaaaaaccatgccaagtcaactagcataagaaagcatttagccatttagtggggttggggatttagctcaatggtagagcgcttgcctagcaagcacaaggccctgggttcagtcctcaggtctggaaaaaaaaaaagaaagaaagcatttagcttgattacagttgcagagggtgactccatggctgtcacagttgggagcaaggcagcgggcagacacaacactggagcagcagctgagactttgcatttgagacaccaaccataagtgggggttggggagagcaaacgacctggaaatggattctgggagcttttgcaatctcaaagaccatgtctgtaagactccactgaaccttagccaccagggaccctaaccacgtggagccagggatcgatgcaaaagcaagaggagtttattgttccatcctgcacccgaaggagaggtggtacccccaggcagcctgtttggtgagtttttatacagtttccaagggcagaatagagcatcagcaactagacacaatgtgattggcaaagcagtgtgactttttttttttttcttttttcgagagagggtttctctgtgtagccctggctgtcctggaactcactttgtagaccaggcgggcctcgaactcagaaatccacctgcctctgcctcccaagtgctgtaattaaaggcatgtgccaccacaccccaatgcagtgtgacttttaaactggtccttagggaccacctaggtagcaaatgcttcccttatctgcaggtggccaatagttccattccccctgtggtctttctgaggaatataaagagcctctcccctccagaggagatcctgagctgatctcttcaagtccagtgacacacctccaccaacatggccacactgaagtggaaacttgtagtttctttggaaagttagctatatcaaatgatgttttgttggggctcataggtaaaaggatgtcttgctaaagcagacacatgaacaaatgctttcctgaagtagacccaggtgaaagaatgttttgctggggcagacatggttgaaagggtgtttggatataacagactcaagaaaggacctgtgatgaaggagtatatatgaccccacagacagtgggagaggagcactgaatgttggtttggtttgctccgcctcgctatttattcttcactaaggacacgcatgtattggtttgccttacataccattgttgagctcaacttgtggtaatgccgccattgagagaaactcgccaaagaactgttcgtgaggttccagagttagcttgctgcttctgctgccttgcctcaggccagttggtgaacctttctgtttcctcagaattgaactatagctcctggtttgtgcctggtatctgcctgcagaaggactggactataactgctggttcctgcctggtgttgaaagaaaatgaaatgtaagaccagtgatccatgcaactcatggcaattagtccaaagagttgtttgtgagcttagaagcctggagctgagaacattgtggagcaggccaggacatgcccagacaggcccattgttaagacattcctgaggctgcttggccataaagttaaagagaatgacatgtcctgactgccctgacgcctccctatctcctgcccttctgacatgggttaaatgttaaccagatgctctgctgttacctcaatctgcacatacagtctgctgatgtttaaatgaaccaatcatgtgaaaccacgccaattcctccccaaaccccagatccttttctataaaaacccctagctttcgagccacgtggccgacaaacgttgtctcctgtgtgagatacttgtcggtgcggagctccgtcattaaactaccttgtgtgtttgcatcaa

SEQ ID NO: 6 - DNA, 4279 bp, Mus musculus
ggtggcatccctggcgcgaaggtggcaccatgtatcgctttctgctagggaacaagttagtctgctcctgctggttgggggttcgagctgcggggaggaggggatgatgatgtgtctctctaggatcctttgtagtccgagggtgagtgacggtgtcggggaaggggtggaagggagccgtctcgtagctagtcagtgccaaggtgtaggccacccagtgcgtgggtctccctgtaatggagtgaaagggtatttgttgggatgtctggatctcggttggtttgggacctctgcctggagtcgtgctccagcagtgaagtgcagaaagctgtgaatatggtctgtgggctgcgccagcgctggtgcgagcccctgcagggagactctgtagtggtcggaaagagctcgactgagctgcggaatagcctgagtagcatcattgggacctctgcgacttggaagaaacgactatatcctggagctttagagaggtggcaaggcagagcctgtggccacggtaaggggttgtgggagccagccctttaaagaagctgttcaacttagaagtgttgaagtctggaggaatgtgcacgctgggggaagtttgtacgtctctggccttgattcttgactcagcacatggcatagtggaaggcaatccaggcaaattcaagccccctattggggacctgatgtttcacagaaaggtgttcacagagagcatgtgggaaacagtacaggtgaagtccgaataggatatattgggagattagggtatcttgtgaagctgggtacaggtgtgtttgtttctgagacagggtttcactgtaacctggctggactggaataagagattcacctgcctctgcctcttccgcgctgggattaaatcatgccataccacatttagcttgtgttaagatctctagactcttttttttttttcttttttggttttttgagacagggtttttctgtatctgtatagccctggctgtcctggaactctgtagaccaggctggcctcgaactcagaaatctgcctgcctctgcctctgcctcccgagtgctgggattaaggcatgtgtcaccaccgcctctttacacttaaggtcttagtgcataaaaccatttggaagtaaaggatgtacttgctgtctcagcaatgctcttgagcagttgttaaccacaatgcatgtgggtcatctagagataaggagagtctatggtcaactgggcatggtggtttatacctctaattccagcatccaggagggtgaggcaggaggattgcagagttccaaagctattgtggtctacatagcaagttccatgccattcaggactacatggtgaaaccctatcccaaacaaaattcatggtgaggtggctaatgcttgtaattcaggaacctgaggctgatgcaggaggcccagatgagttttacatttacttgtttatatagtttgtgtgtggggggggtggggggtgggagtgggggtggtcaagggacatcttaggagaactgattttctccttacacaatggatcccagagattcacctcaggttgttaggcttggtgtcggtgtccttaccttggagccatcttcatagctcggtggcacacacctttctctgagtttgaggccagtctggtctacagatgaacttccaggacagatagagctacagagaaaccctcagaaaacaaaagaactcccacatcttgtcccccaacatcatgtcccgtgaagttgtaccatcaaataccctccactccaggcatacctcatagccctaccaactaaataaaatacagtaaggtcttgcagaaatagtaacaggacctagcccaaggtcaactccagccatccaaccttcagtatcagggactagatcccctggcttcataacacctcctccacctgagaagcagaggggctctgggatattacaagggaccaggaatgtccagaagacctcccccttgcagtttctctgggcacaaggtttcagagttttaagtcttgatccaggctgtggatcactctgtagccatagtggctgtggactcgagcaatcctcttgcctcagccttccacatgctgtataccatgcctggttcagttgatagaatgcttgcttagcatgttttaagccacaggcttgattcttactagttcataatagggtgtggtggtctataactgatatcctaacactcaggaggtagaggcaggaggaacagaagttgaaggtcatctttagctatgtaaggagtctgagaatgcaagactctgtcttaaaaataaacaaacaaaaaaaatctcaaagcctaaatgaagtgtgattgtacacatagaattaaaaactagaattaaaaaccaaaaccagccgggcatggtggcacacgcctttaatcccagcactcaggaggcagaggcaggcggatttctgagttcgaggccagtctggtctacaaagtgagttccaggacagccagggctatgcagagaaaccctgtctcgaaaacccaaaaaacaaacaaacaaacccaaaaccaggttaagtggtagacacttataaccccatgtaatggaagactaaggttaaggtgggaatattttaagttgaaggctagactatagattgccattaacatggaaggactggtgcagtagtatccggggtaaagtgccttgtcatgtgagtgtatatatacacacaaggtaaatgttgtaaagacaataaagagaaccaaggtgtgtcaatagttcctgttgttaagtcctattctaggtgttcttttcgatttaatactccccactccaaccctgggaacgaggtgtatgtctctcttaagctgggtggcatttctctttaagaagcagaggcagaggttccgagttccaggacagccagggatacacagtaagatcatgtctcaaaataaaccagcaaaccatgaggaaacggaagcatgctgagtggaatggcccccttgttggtggcaggtctgagcccacaccagtctgtattatagtcactccaccctgtctgctacaaactcatctgggtctgccttgagtcagtgccctgccctgattttgccagctgctcagaaacctcagtgtgctcttgctacttgaagagcaagccacccagcaggtttgtggatggggaggtgtggcagggtgaggtgaaaaccctcaggtatgttagctgctgttcctccaattcagcagttgatcatggaccatcaggataacagctgaaaatggtatctgagagcatccaggttcagaaaaacatcaggtcatgtaagaccagggcttggtgcccttgacttctctggtgcacaggggctaccatttcaccatggtattggtagcatgctggatgtcttttactcatgaactggagagatcagatagtctcagatggactgagtcctcaggaagatggaagtgtcccacatgacgagtggtaagttctttttgggtaggtaaagggaagaagctggtactgtgcctccttgacttttggcaaacaacagtggtctgccattgtggtggtcctgggtctactactctatggcctggactgtcctgcctactgaaaagggggaatggagtgtggggaactgacccaaggctgtcttccagagttagtgggacctttgggccttgggctgaaacctagcttcctccacaggtctggtttcaagtgctcctacaagggtgaagtgggaagaccctgataagctctgccctactgccacccccatgcctaatacatgacaatagaaatcaaaccctgggctggtgagatgactcagcggtaagagcactgactgctcttccgaaggtcgagttcaaatcccagcaaccacatggtggctcacaaccaccatatatctgaagccttcttctggtgcgcctgagcaagcagggactgagtgagcagccgacccagagtgagaagaggttctaaaaattcaatttccaacagtcacatgaactctcacagccatctgtacagccacagtgtactcacatacagaagataaataaatcttaaagaaaaagaaaccaaatcccagggctggtgagatggttcagtggttaagagcactgactgcttttccagaggtccagagttcaaattccagcaaccacatggtggctcacaaccatccatgagatctgatgccctcttctgatgtgtctgaagacagctacagtgtacttatatataataaataaattttttaaatc

SEQ ID NO: 7 - DNA, 39860 bp, Mus musculus
aggtgcaagagctgaagcgagttgaggaggctgaactgagaacaggatgcaagaagccctgttgtctctacaccacaaggtatgcccaaattcgacaccttcagtctctgctccctctcctcccctcacccgagtttgaaaggggacgtcgagatagaagccccggttcccactccactcctctctctatctctcaccaacccagaaaagttgatgctgggctagggaagaggggagagtgggggcggggatgggagcgcggcctgaactgaagtgtgagggtatcagtcactgccggcgaggaagctccggcttgtgaactcttcttgaaccgagatttaagtctgcagccataaatcactgagacatacactccaccattcaacgctgagagcggccggtagtggccccgcttaccttaacttctgacggccgccgcgggctcgggctcaggctgcggccccgggtcccctcggcgcgggatgccaccgaccctcagcatccgccgagccggcgtgcgggcgggcgtgcgggcgtgcgggcgtgcgggcgtgcgggcgggagaccccaaggccgggactcggcggagagccggaccgctggctgctccggcggctggcccccggcggactggggcggctggaccccctcccctcccctcccctcccccacgcccgcccccgccctacccgcggccgcggccccagataagcgctggcgcggccgggctccgcggggctagtggcaccgacttgggtatgtttcttatgaatactgcgccgagcaggggtcggtcggggggtgcggtaaggggtgccggggcgggcgggaggggagagcagagcggctagggaagcgccggcgtggggggatggggctgaggcgaggggaggaacaggagcagagcgagctccgcggcagcgggaggagggcggcctcccccaccccacgccctccctctccttcctaggcgtcactaaagtccaggaaaattatgctaatgaggacaaacggctttcacaaaggggctctcttgtggggttctattttttaagaatctgtctgagaaaccacgcaattccctgccatggacattttcatggggtggggggtggggaaagaagagaagaagaaatgagttgccctgactttgggcagttttcttcacctgccgctcccaatacagacaccctaaagccagtccctgtggtgtagggcctatttccagacacctcccaaatgcaattcaactgcctttggttaaatttctaggcttaacggaaggaagtatcccagggagatggacaactgtccctacagtaaaatgaacctttgtgggctcaggcacacacaaagatattcagaaacttaagtctccacctcttgtgtacccattgcacagtaccggcgggcacggaagcaggtagtccatgaggaagatagctaaggaaccaacacaaatggacatccgggatatttcaccctctaattagttgaatggccttccttttgcttggttgaggaaaagcctacatttgcttggtaatatgccacaacgttaaagaggatggggtcgttcccaatgccccgttcagcttcccagcttcagaaacaaactcctccaaagcacgggggggggggggggcggagaagagagaaaaggagctttcgtgcaattccgaggcgtcaacgagggtccctctcaaaggaaggtgttaaaaatataagtagtatgtttaaactgtcagggagccaaagtgtcaccttagagcaaaaacaaagccaggggggaaagggagaaatcaaaaaagcactccgggccagggtggcctcatgcataccaatggtttttgtcatttatggctgggcaagatttatgactcggctccccaaagctgtaaacagagcacaaaacagcaaacacttgctccttatggcagattgcagcggcgcaacttgaaagggaagagcccgggacgtgtaggaggtgagagccggccgcaaaatccgctcggccgctttttctcttcaaaccctcagggtcggatgtggcatttgaagaaagaaggcgtgggtcaataatcaacccgcactttctcctccaaactgctgacgcgactctcaccgccttctcagctaagccagctgcagggaaggccgtgagaaccagacctaggagtggactgtctgagccaagggggctgagagcgttggagcaaagggctagggcgtatgcaacgcatacctttcttgcaccaccaaatcaagcagcccgagtgccaagaccaggccggaccgaaggaagtgcaggagccgcgggagagctcagctccgtgcgccctcgactagcacctaggtggctctgggcggtgggtcccagccggcaaaatagagctctgatttcaataagcgggtctggcgtcctggcacatagattgcgggtacccgcggctcatctgaaatccaaaaggctggctttgaagcaagcataggcgagattgttaaaattaataatttataatagcaaggttttgttggcttgttactgggttgtgatcgaagattcgctgctatttgatatccatttctagaaattgctcactgccgctttccaggcgaatcccgcagttccacagcctctcccaaaccaccaagcttttctttgctcagcatccgtgggcttccccatcttttctaagtcccgtgatttccagagtgaccagaagaagcgttttctaaggcacagaagagtacttgtagcaacggggtgcctgatggaacctttctgccattcaaggggtgtcctgcccatctctgagggggctcaccgctccaagactctctgtgcaagccagggaggaaggtgaggagtaacttttggcaagaagtatcgttaaaatccaaagatggggagggaaggtattgaggaaatatgctggcctatgaagatgaggatggaactttgagagtccaggggaccagtctttctaatagctaatcgtttggccataacctgggtggctttagctctttcctgggaggggagagaaaaagccaactgtgctctatgaaagcagttattggcttcttactgtgcatgctttttatacagaaccaggctggagagtctgttgttagatatttattctcttgtcggcactgaagccacaataaaaagatgcctctaacaaacctttactccatttctccttctttctagtgaaactatattatttatgagtctttaactgggtcaaaaatgcaccagaactgggtcataaatcatatgaaatgctgacaagtaattgaacagcaattaaagcttacattttatttccaaggggtgttttagagcactcaaacagcctcagttaagcacagttaccaccgaggtctgcacgagggagggcagaatccaccctgcctggggaagtaaatctcactcaagtcggagaagcctggtttgaattttttaaataaaggaatatgaatatttttttttaactaaagaaggcaaatttgattcctaactcctcacagggatctctttatctgcttcaaggagcaaagtaaagactaatttctttcacctttccaaagactttcactcttcccaggagcagaaggtccccaaagcccaattagccccagcctggccaatattttggagcggagcagtttaactaatctccctccatacaggcaatagctccctttcaggggatataaagccagagaaatgttgtctctgcttgctaaggactacagctacagaattccctccaatcttgggcacataggccagttctttaactctccaggctggcttagggtgtacagaaagcacccaacccaaaaacactggtgggagctcaaactaagccccagacccccttctgcaaatcacaccgaccagacctccgggcagctggcatgctccccagcaccccaggcttctctctctccatccctcccaggcagctattgctctggaaacaatggcatgccctccaggttggactcactgggtccggcattgggaactctgcctccccccccccccaacccagcactgaacaaagtggctggaagcatcatcagtaaaatggcagtgtgtctgcacattctcctcattgattttcctcttacatttgctcaggctgctcaggtcagccctaacccttcaccctgctcagcaaacactggccaaatggagagagaccccctttctcagctactggcccacacctttgtcataaggtctggcccttctagcttcttgctggccacctctcctaaccagagcttccagccacctctgctgcctgagagaaccctacctccgtctggagcttagctcctgggacttcagcccttcaggttgcagtgggacaaagcaaccccaaaactagagactactaggcccatcttgtagcccccaagtgccctcttctttacatcccacaatactttccagggaattaaactcagagtctgaggagctactgggaatctttcaaatgctttcagttctaaaacagaaacaaaggaagacagagggagggtgagggtcctgtgcatgatccagggtctccttgcctgacctctgtctcccacagccataactcaccctaggtatgaacaatcagaggaaataccttaaaataaatcccatcctcctggtgtggccgagagtcccatcggctagcttgcccagaactgctccatgagaactgaaaactgcaaaccgctggaagagcactcgctcgctccggagaaggggaaggagatggagaaggaggaggtgggtgcgtggggggttggggggggaagctttcgctctaaaaagaacctagaaatgtaatcgccaacgaagcctgcctgggtctccgctcccaataccacaataatgtgcagcatcgtgtgctcacgtggtcagacgtcaacttaaatccttttatttgaaatagggaatcactgaaggaaccaggtttccaagcagaacatttagatttgcgagagaaaagtagggactgtaaccagtccagggttggagttctatctcaccagcaagagcatgaggggggcaccccacacacatacataccacacaaaggcgcttgtctcctacgtacatttctttacacacactccaaacacagggaaacagcaatgctgtctgtcttcttcgtgttcacttaactttccctatggcctcccctttacagacaaattgaattcagcatgcccggtcgccaccccctccgggcttctcggacccacagactagcatatcaaaagacaagacgcaagcctagaaatgactggctagtcactggatcagtcagcagacttctttatggcctgcaattgtatggagtttgctaacacccacgctatacaccacagccactgatgaaaccaaaggcttgtaattacctgacaaaatgttcaagtctctgctccaagtccagttggttttgttcggaggcagcctactaggaaagtggtgctccgctatagagttgtgggtcaggattttgccaaatctgaagagacctaatgccctagccaaacccatacttatgcatttcctccgtgcatagctgagtgatacatgaaagtatatgcctccaaagatgaaaaatgtaagaggaaattatctaattgcctctggaacagggggaagcgctgaaggccaccagagtctcctgtgctagcccagtcagcctgagaccctcccctcagactgtcctgtacactcacccctaagacaacccctcatctaccagctgaaactgacctgaaccagttctgcttagtagaacctggctaaaacaaataaactgtcctcccagtctccacccctactcttgccttctgtttggtaacattgcctatgcatctcaacttttccatgggcctctaaaaagttccctgcctttatttctgaactgtgttttgagaatgccctcttatttctgaggagcccatcttcagtcttcagctggctccaagtggggtgctcagttgttgcaactgcaggagactgtgtctgagcctccctacttttctctccagaaggaacccaaagggggtctgttgagaacattaggccctaagtaaagatggatgtacatctcctgagggaggagggtgcacacatcacagcagcaatacaaagggagacctggcctgccgccttgggagtgagaactagcctaagagacttccaaggttctagctgggagaagatctatagaaactcccctagccatgacctaagtcagaggctgcctggcccaggtttgggagataagaaacagaccaaatgctggcttccaaaacacattcttccgtccttcgaggattcaatctactgtcttttgtgtcttctgctccatgtgatacgcactcctcagtcattcacaaccagcttttcagataccacagaaagggacctagaaatatggccaagtctgacaactccctcccccagatttttattttttatttttattgcagagtcatccattggaagatgagaagagcccctttcagaactctttcaacagttttcaagcaaactgaaactctgaaggccataaatcaatagtagcagtctctgatgctgtctcagagaggtggcttagcttcatttgaggccccttggcatctcactcctatgctggagcctctatgtcaccaacatatccattgatgccccaactgctgcttaacaactaacattaggatcgatgggggtggggctgagaaggggaaaagtatcagaggaagtcaaaagaaatttaacttatgagaaaacaaacaagcaaacaaacaaacaaacagcttaggttgggcatcccacacagggacccagccatcggctgaaggaaaactgggggtggccagtgggaaagtaactagcccctttccactcacccccactctgccagggctgagaatccatgctgtgagccaggccacccagagccaaactgagggaaagttggcttggaaggagcaggtgaccaagcgtgcagaccattagtcaatatttgcctggctgctggcagattagatacacctgtactcaaacagtgcaatctgatttctctatcaaaactatactcaaatgataaatctttacttaacatgaattatttcctgtgggtacaactgtaatacaaatgggctccaagctctctagacacaagtggatgtgtataccgtgttatactgcagcttttaatatcgacagttgtcctgttatttgcagttatgcaaatcacagagttgtaagttcctaaaatattccaactatacttgctacatccagacacccagagatgagaaagtaacgtcattactaagactgtttatttcctatctgataaaataattgtaccccaaaccccaccccaccactgagtagcatgttggaatttattaacaatctgatatctttctggggagctaattttaggaaagatttggacctaggaaacagaaaacaaaatctgagaagtttgctgctgctgctgctgctgctgttgttgttgttgtaaaaaagaatccctgagttggtgatgcctcatagctcaatgatagtgtgctttcttgcccagtatactcagaggctctgggttccattcccagcacaagaagaaaattaacccctgaaagaacaaagcaaactcatccgctcataccaagcttctgagagctattccactaacccctcccccaaacaggccagtaatttatggctcttttacaaggtaataaaccacagcaattacctccctgcatctcaaactaaaagaacaaattaagccagaacttggaaagaattttaaagagttttccccttgttccaaatagaaaaaagaaaaaaaaacattcatacatagaggagctgagcttttgctgtgggaagcattgtgggtctgctctgataagagactgaggcagactcttcaaggcctacacactggaaagactgcatagaggacagagaaaatgcaggttggtggagacaagttttctcaccccagagctgggactggctggcagtctccaaactcacagcctccagggtctgtccacagccacagcccacatggcagctgccttgctgccctgggccctacttgtttttgctttacagttgggtgtagtggtctgtttggggcttgtaggaagacattcactcaccccctcaggctctccctacttcatcttttgcttctgcactctctgcctactgtagactttggagcctgctctttgtctgcctcgtgcccatatggtcctccaggagcccagctccaaactctgccaaagttaaatattgaccaaaacctctttcaaccaattctagttgccaggagcgggggtgggggtggggtgggcgggggaggtatacttctcccagcctcctggtgcaaagtcccaaacctggggaagagtttggtgcaaggcttacctccaaagatgtttaaatctgaaccaggaatggtctccagttccaggtgctcagggaatctttttttccagtgtccaggcactctgcagagaaataaacaccagagggtgaatagtggctgtgaaggaagggagtgaagactggagctagaaacgtgtcctgtgtgggcgccagggtggccccagggtgacgcggacatggagttgtcgccagggcactggtccatgagacacactcatagctcgaaatattccagtctacaaatggcccgaagatggtgatttatttttgtaaaacaaatacatacttcatctctgcacccacaatcttagtttccttttgtatagcttttggggggtgggggggatgaatcagagggagggaagaagaaggcagctttgctggtgatgctggatccagtggctgagctctggatgtaccccagcttggggaatgtgaacacaagctttattttcttttgcaaacaatggaaagccttgtctggaagcattcaatcagactgtgctgaaaccccactaatagtgttcatttctgttggcgggaaatcagacccctgctcagccccacagatcggaggcagtattgggaggttttgtcctctgatttacccaattgctggggcaagctatttcttggtcctggtgggcttgcaggactaaaacagtgcccagtcactaaaaccggaacaactactgtttctagaaaccaagcaagaccaaagtgctggacaataaataccagccatacctgtgcaagcccccacccacccccagcctcatgcctccccactttaacacctccttgcctgctaaccaggaaatggccaaggtgcctccaaatagctttttgacatcaggaaatggcagagaatggtaccagcttgttagtcctctgcttgttagtcctgtgcaggacttttgcttctatagccctgaccctaaactactcactcgccatttgccaacctgctccaaaccagccctgtgtaggtttatcctacccctatgcaatccggctggcagccagcaaagaaccaccaagaagctagggagttgcctgactcttggcttgggagcctcctagaccgctgagggggtagcagcaaactggcagctgccttctgccacaactccacccgcagcctttgccctgcacaagggtgcttagggccagccagcatcctcgctgggcccctttgttttgtcaaactcctacttttccaggggagagccccctggtcttgagactcctggtgccatcctgatcaaggtggggtctagctgctacttacttggctactcaacttcatcccagaaagatctgtgccccggttctcaccccctccccctcctcttaccccctcctcctcttcctcctactcctcctccaccaccaccatcacaagcacaaggcttaggagcattgtaattattatggttattattgttgttgctatcttttttattctcaagtctaatattcatgattcctgtttcccataaatccttcagactaatgagtcacagagagacgctgctcgagtctcttgctctgcaatggctgcagccgttgttgtggcctctctccgcgttttttttttttttggcgtctacttgctccctcgctcgcctagcgctggtgatttatgaacgccgggaaaaattgaacaaagccgcgtgctcctcctgtggtatctctgaagccttccccagcgtgaatcagaacattaccaactgtctgcgcttctgtcccacttcatcaccaaaaccaggatatgaccggaaaaaaaaaaaaaagtctgagccggaactcacatttccctggacacagcctccctggactcccagcagccttgcaagaaagcctttgacccggcattctgttctccacgtggaagggctcttgcccgaaggagttaaacgcttttggagataaatctgaaggtgtgtgtatttaaaaatcaaataggaagttggagtctcactactgagagattcgttcctagaagtgcggccctgacgactcagatccactcctgatgatctgcattaattatttaacgagtcacatgaccacaagagatcacaatttcaatatctccctctattctgacaggcgctacacctttgtcagctgcaaccaaagcccatacttggcttccccccccccacccctccaggcctccagaacacaaccaccctttccctaaaagggaacagcatggaagtgctaggttgagcatagcagtcatgctactagcccggcaaagtaccagacatccctcacctgaacccaggggtcaagacacctgcttgagtgccaagactagggggtggagagagttagttatatattctcacaaggcagccttagtgatacatgcattcttctttcagactatacacacacctgtgtggccctacacatcagcaaaagcctagagagatatctatatgcccagccttctattcttgtttatcaccaacgaaaacagaataactccttcagcaggaagatgcctatgcacttctgttcattcagagtgatggcaaaggctctatgccctacatgctcactatcatgggggaactttaagagccattcaactgcttcagtgtccttgcttgtgaactgagacacttgaagcaaaatggtctcctttcaatttgaacacttaaagtccccttcaaattagaagttccaaggtagaagctacaggctagaaggtttcctgacacctcctagtactatcccatgtcttcctccttcccctcctctgatttttcataccaccctctttattgttgttgttgttgttgtttgcttctttgtgtttgttttttcaaaacagggtttctccatgtcaccctggctgtcctggaacttgttctatagaccaggctggcctcgacctcaaagatccacctgcctctgcctgtcaaataatgggattaaaggtgtgcaccaccactgactgggcacattccatcctcttggtggtgcaaaacagttttgttttgttttacttgatccaatgtataatataggaaaggggataccagaaacagccattgggaaaagctgagcctgagttcttccttgcaggtgtgtgtatgtgtgcatttatataagcagacatcaatagaatgatagtgaaggtctttgcttctagagaacccactcacagggatgggaagttggaagttgttctttgctacatttattctttgagatgtctccttccactctaaagggctgctgctgttgctgatctgtttctctgctggaactgctggagggaaagcagcaggggacagtgacacagtgtgagagcttaggggaacagaggtgcccaggagatgtgggagaaggggaagaaggagaaggggaagaaggagagggactagggcaccccgggattgctggtataaagacagagtcggtgtgaatgggcccacccatatatctgagtaatcttcccatgagctccatcctgggtattaagtactccactatgcctgtcacagatgaattcctgctgtaataaaacaccaggtatatcgtagatttcagcaaaactagcaaagaacgcctgcaaactgacatttttcttcaagggggagagtgttaagtacttaattcaaactgtgaccattaaagtgtctcttatccgatttaggttgatttcagatgttgacaaaacttttctctccagagtcatgcacagcttggctctgtgactaaatcggataagtgtgtactgaggggggatgggaagtaaagggaagagaacagaagagcatccgtgcaggggtcgttttggtaagagaacggtgcagcttactcaaaatactgtttttaaaggtcaagggtttgaaggactagtaggtttgctttaaaaaaaaaaacaattaatgagatagaaaatttgtcctctcggtgaactcttatggttagcctgacaaagggcagacaatgaatgattttagggatgcacagtgagattttctaagctgttacagcaagctcccttaaaggctgaatcacaaatagaatacctaccacgaagagatcatttgtagcattttcagtaatcctggttttacaaaacaccaatactatcaattgtcaatacaaaaaaatgctactttatcccaaatcagcagaaaaaaaaagctgttttgactctctcttccttttctgaatgcacaaatgaaagatgtcctacctaccatgatctccaggaagcctttcagatccgtccttccccactgaggagaaatataagaatttaccttatgtgatgaaaatctgagttgaaaaaatattgaggttttgtggcttgatactcaatttccactgagtgatacacacacacacacacacacacacacacacacacacacacatatccaaaatgttgcctatttgcctgagagaaagcattatttacattatccccccccctcctccaaagacttttcccagagaatgcctttcagaattgctgttgaattacaaagaagtatttattgtatgaggtgattaatgattcccggggaaattgctattttcagtgtgatttaattttgctttacaagtgcatgtagtgtgtgtgtgtggggggggggctaataagttgtagcagcagctacattgcctccagaaatgcttagctcctgttcacaccttacaaagcacactttatgcctggtccttcctggcttgggaaggggtgtgtactccttccccatgaattttcttggcctctcagagactagagcccattgcttctttctaaaaactggattatctatgggtagagaaaaatttccctggtctgaagcatgggtggctgagcttgtcccactaatgaaaatggttttaaatctcttctaacattacagagttagataaacattctctctctctctctctctctctctctctctctctctctctctctctctctctctctctctcacatttactataaaatcccccaaactgctctgtttcaaggccaggtacatattcagtgtgtgtgtgtgtgtgtgtgtgtgtgtgtgtgtgtgtgtgtgtgatgcctgagcatcaaatttcaaccattgcacaaatactagagttacagagattgagagatgagttttcatgttttcaaagatctggctctctgggagtgcacagtaacaccacagagcatttgaggaaagtggcccagattagtctggcttccttccaacagtgaattcttccagacctaccttgtgtaggggtagggtgcattttagggtatcattacgcttctgatttcctcctagggtgctttggagagtgtggtgggaaagttcactttactctataagctcttctcagagaagcaaacaaaaaattcccaagctgtgctcagcgcaaagaccttaagaccagccaaaaaccaaaaggcaagcgcaaccctttgcataaactattttttatctccagggaaacaggcagatgaagtgtgaaggtgcagcaaacgccaagggaatgcctgtttccaagtgtgctcagagttcagcctacagaacagctgcagaagctccaggcctctgctctgcaaggtctcacctttcactgcagggacacacacggttctatgccttacagagacttgaagcctgaaagcctggccaagtttgggaagaagaggagccctctcagggctcaagagccttcccgctttttggaacacttccacagtgggtcaagcttggcaagaattcagaccaagttaaacacacacacacacacacacacacacattgtgagtgtgcttagaatgtgaccccagctcaccctgtctacaaggcttctgcgcactaggtcaagtatctcaaccaagaggaggcttggggtagtttggtttggtttggtttttaagcttagaacacacacaaatctgtctcttaggtttttaatgtcttataaactgaagtttattcttagcacattcctctttatacaaccatatctctctgtacagttgtaagtgagtctaaatgcatttccctctccccaacgctgtgccccagtataagacaacaatatctctctaacagtatcttaaataaatgcaaggagaggaaactacatgccacacctaccatcaaggtctacacactttgaaaattaaataatctggtgaggtccacaaagtctactcagtaaagctcatgtgagctgccttaacgcagaagaggaaggaaggttagaaagctgggaagctgggaaccggcctgcttcttctgcatacaagtacatgtccccagtcagcacgtgctgtctggctgactcaaaggtagtcgatggccagtgctttcttacaggtgtccaatcctggcaaagttgtccaggtcagcaggttgttccactaagcagtaacgaggacgaggacagacgtcctcttggaggggtcacaccaaccagggataatgtcttctttttggttatggtttccagcaagttggattttgttttggtgtctcgggtttacttagggaagagcagatgaggacaggagcaggagatgagtagggcacataagtgagagaaactgatccaggtctctagattatatggaggagggaatgggtgtggaagcaccagggagagggtggggatgggggtgtgggctgtgagtttgtgctttcccaggcgggccggcaggggccgaggcagtgttggaagatcgcatcttggtgttgggaagtttgtggtctttcttccacttcattctccggttctgaaaccagatcttgacctggcgctccgacaagcagagcgtgtgggcgatctcgatgcggcgccgccgggtcaggtagcggttaaagtggaattccttctccagttccaagacttgctgccgggtataggcggttcgagagcgcttaggttcgcctccgttataactggagttgactgaacaccagaaccccgaaagagaaggccaaagaggaagaagtagaagaggaggaggggaggagagaggagatagggtggggaagagcaatcggacatcatcattatataataacctgacaccaagttcacacaagatacataaaaaggcaaagaaaatgtttcacaggctattgacaacgggaaacacccgagagccataaagaatggtgctgggctttggggctgaagaaaagcttcaaagacacatggccgggagcctctgccagggcaattaaatttatgggggctataattactgccctaacagtttggcgtctcgtaaatctcaggataaagggaccctgggtacaaaagggttctcacgttaggaccaggctgcgggcggcgcgcacacacccacagccaaagcgccggccagatgggggtcccctcccgcgccctgccccgcgcccccacgcccgctgccctcccggcggcgccacataccggcgctcacgtggatcttcttcatccaggggtacaccaccggctccttgcccttcgggcccgccgggccctggtccgccagcagcagcgggcacgcgggggcgctgccccccgtcgcgacagccggggtggtggggccgggagcgcagtgccgagggggcgcggggggctgcggggccgggctggggtgcgcgccgggggccggggactgctcgggtcgcgcggggctggccccgcggcaggcgtagggacaggcggcggcgggcgcggggtacaggcccccggggtagctgggctcgcgcgcccgcggcgcgtagtaagcggggggctggcgggccgcgtgcgggttcggggccggcaggtgcggggcgctctggggccgcgggtagccgggacccccgcccacggcgccgtccccaccgcccgggccaccgtgcggggcgaactcctcgaaaggagggaacttgggctcgatgtagttggagtttatcaaaaacgagctcatggtcattaatttgtgaagtgcaaaaatactaatttttctcgcggtgtcgtttttctgcgctcgccgaggcccctccccctctcgccgcgcttcccatccccccccccccccccccccggccccggcgcccgcccctccccccgctgtcaaacgactgcccctccccctcccgccgtcgccgccgccgaagtccgcgccgctcctcccccgcccgcgcgcgctccccgtggccctgcgcgccccgcccccgcgccccacgtgctgcgatccggccaatgggaaatccgcgcgcgcggacccggatcaggaaacgcgcgggggatgcgtgatggatgctgctagccttcagggtgggagaagcgagcttgggttcctcgggccccccaacttgggttccggctgagaagttggggcctgttagactgcgggtcctttcgagccctgttcctgcccacgtctgtcctaggcctctgggcagctggtcgccacgactcagcgccgatctccagtccaaccaggcttcgggtggtcctccgagggttcgaggccctccaggagagggaagggcactgggaccaagaggcagaccctggctttttatcctagctctggaataaaacgaaggaggcctacggacccatttttctcgccctttgattctttgtccacgccctacacatccacccggctgttagggagtccctgctttgcgaagccagggctggagctgcacagggaggatgggtagaagggccgctgaacaagcgggtcaaggaagtacagcaagcgagggcgatccactaaaacctcgtggatacttatttttactttttttctttcagacgcagaatttgtacattattttttcatttaaagacttggaaccttcctatattgcagttgatggaggtgctgaggagagctaaatgtgcctcctttattaggcgctattgtgagacctccaccccagagtgggaagagagacgacgcctgcacaaaacccggcttcgaatccagtaacttcgcgtttcagaacaatcaccaaacaaaaacaagtttgagatacaataagaccctgcctggtctaattgtcaatcggtcttttctaacttttccctcccttctccttttggatgctgtttcctcgtgcaggatctaaaccaagggctatatttacagaccagcccgcgattgctgaaaaattagcattttaacgatatcagtagctctggaaaggagagagaagggactgttgcctgccatttggtaattgaaatttgatgggtaaactaattatgccattattattaacaaataaattacttattaattccacctaatgttgatctttgaagtaaatactgatgcctcactcgtacctggaattgtgctctttctttcttctgaatagcagacacgcctagatcctttgcatgatggtaaagcagtgcaaactatcaccgccattctaaaaaataactctcctctgggtatgcaaagcagtttccgttggtgcaccttgctgatttttcagagagcaggatagaacaacggccttctcaaacgcagaccaggaaagttataacccaagcctagagacacttcagaaagaacatccattctatcttcattcatatctgttactcacttgagctactaaatactgggatatatcctatttgatagatagtcatttaatgcttagacacatgaagactattattgagactaatctttaaagtaatttagggaaagaggttaaaaaaaggatcatgttagtttcttattgaaatcatcctgaagtagtacaaagagattttccacactgggtgtctgtgctggtaaagagagctgtccactgacaggaagcaccatgattttttttttaaatgaaaatctgagccatagatggaaaccaacaaagattctaatctctagatatcttctctagactggaggaaggaaatctagcctgatgtggctactttaaactgatatctctctctagcaagaaaatagcaagaaaataggtacacaaatgagacaggagacatctctaacattagtagcacacagacagaccatacaaatacacatgcactgcatatctgcatgtgttcaggttggatgaaaagcttgaggaaatctagtctgcttctggtgtcaccaaccctgagcactggaggagtcctaaccatgtctgtttaatattatttacagagtctaagacacaaaaatccatgttgtttagcctcagaatggtctacagagtttccacgttttaagtattaaggaggcactgttttgtatacggttaagctagaggacttaactctgtttcctgaggttctattaaggaggatgggctgacacaatcccccaaggcctgtaacacgtctttgagctcctatcataaacacaaacggagccaggaccaccaagtgttatctcacacaccgacattttgacattttactgcaagatttatggctgtaataaacaatctcagtacctttcctgaaccttccacagcctccctttgcaagcaagccatagcaaaaatcccatggaatcaaataatcatttggaaaaaaaacagtaaacctaagaagcatctcttgccttcaacatgagatccaagacaccaaacgaaaggtagaaagaaagtaactcaattaggaaaacaagccaaagtttaccacagcagcatcttgcctggggatgggatgccctgaaatggagcagagagggagcctgctaatcttcgcacaccaactggctctagtcccaagcggggttgaagcactattttttccttgggaaactggtaagcacaattgttcctttccatgtgcagggatagcatatattccccaaatcgctatcttaaaaccccattaagtgaaataacttttcatcatgtccttgcatcccagatggagtcgaagggagtctgagggagagggagggcgagaaggacccagtgtttgcagcctggtttgaatctgatttgaatcattttgaatatatttggaacagccttcccacttgaatgcaaccctgtcccaagtttcaaagtgaccgaacagtgacaccgtgtgcattttgtttcttattaatcttacacattgacagtctttgttaagtcacaggcgcgccctcaccagccgacattttcatatttgttagacgcgctgacctgaagttcacctcggccttggactttgcgcttctaaaaggtctatacagtgtcttttagagagctgggtgctttgcccaggtcagtccttcccaggaaaaaccaaggggaaaaggcaaaggaaatgtaagcattatgggatgtattgactgtatttgtcctttgttctttagcatgagggcctccgggctgtcctctatctcaaacacttctctagactgaattgggaaatggcaggattttaaactgcctggtagtggcatgtaagggcttcctcccacttacaccaggttacggaaaaacaacacttgaccagaccaattttttaccaattaatttgttttgggtgcaatttcctggtgatggtttaaaataacaattaagaccagacataggactaatattcattttagaattatacatgagtttttacccaggattatctatattatctaaagatcaaagtcctctaaagagataagcactctcaaagcagtgacttccacaggtatcttttgtcactaaactagctaaaaggttgctttttgaatattgatgctaaagtgtttcttgaggatggatgtcacatggctttaaccaaaagtacaatgaaaaattccatggaagagtcataatttctgggtgagcgatttgggggctgggttccgttcttttcatttcaagagaagaccagatgtggtgtgcttactgctataactccagtgaccacagctctttccatttcatctggcaaaacctatttggctccaagctcctggccagagtaaaaacttacctactgtacaatagacaggctctggttacttgcttccatgaaggtagcatttgagaaatatttactttaccactgaatatacacttggtaccgttaaatctaatcagcctgaatgtgtggggttgtcttaaacatccctgcaaggttgacattctgagcccttaagttattcccaaaattaagaagaggaaaatattttatctttgtcaccattgttttcctaccttgatcatttgaaggtcaatatataggaaaggaaaatatgttccctaggaaatagagtccaacccagacacttaaagctaatctagatgtatgaaaaataaaatattggttaacacttcatttgcaacagacaaatgaggcatgattccccgtctgcttcttgaatacagtgttccttctctctcccaccctcccagctcctccctagcctgccttcccaccctgagtctccctcgtccccacccccaccctgttccacactgattatttagaagactcttctggagaacagaagccgtggttttacaacatggcatagcatgcaggaaagcagcagttccctgcctatgtctgtaccatgactctggcagattgtagcagtcctcttacatcccacggtggcttaataataactataacagaaaaacttcagcagcatgaacatagcggcactaatgagcatgtgcttgctggtggtgggggctttaggaatcctatccctgtccttagggcttccacttctctgctctgacaatcttggcatttggtgaattgcagttagggagcaggatcagagtctatgcctgaaaattgccaagaatacactttgtaagatatctgccctttcctcccacactttggagattattatatgtattacaacataaaacccaagcaccctggccaatcagaatcactctcctttttgtcatataaagggggcataatgaaacattagaaacttgatacttgggttttaatggtcctctgatgaattctaagcatatctatttgatgacaaacccacaaaccattcttggttctttggcgtttaaggttttggtgttttgataatctatgcctatttacctgctgctattccctcagaatggaagggatcattcaatatgaaatacagcatgtattactcctgaaaagaggaattttctatcctttcctctgtaattgaggtcattcaaccaccagggttcacctggagtccacaccgtgatacacgcgtcactccgagccattttatcttttgtggtgatagtcaagatcgcagctcgaaattgacatcaaactctgtctgggcagatgactaagagtgctgcacaatgtaaacttttgaccctcaactttttgacctgcagttgtaacgtgctaaccacaaagatacacagcactgagcttcagggggaaggggcgctctggatcttaggcagttctctcaccaccgcctgatggaatagaggatggagtgtatattttttgtgtgtatttgtgaccatgttccctgtcaaaccagcctcctgcttcttttttaagtcaaaagttaggagctagatccatttgaattcacctgcgactccactaacaaggacaatttaggggagaactggagaatcttttgaaaacaaaagtgtaagaaaagaaggggaggagaggaatcgggcagagcggatggggtggattttgttttatttaaaaataaaggcgcagccttgattgttgggagacttggcccaggcaggccagttgactgtgaacttgtactaaagcgagctctgctggcgattcctagggtgtgcagatttatcttctctgaatttacttaacccggcagtgaactgcgtggacgccatttgttaggcgatgacagacttcacctccagcaaaggctgcttcacaaaatcgcaataattacccagtaaccttcataacaaatattatgtttgtgagaaagggatctgacagagaaagacaaaattctttttttcagaaaacaccgaacaaaacaaatctgggcttctctttcagttctggagcctaggacggtgggctccctccccagtttggttcagcctgggctgaacccggcactcctgccttggcatcctgtttatactgatgtcactaactagaagaaaattccccccttagaagccaaggggctgcagcttaagagtctctgctttttttagggcgagcaagccatgggtagaccccagccagagaaggggagatgctaagggcctcttggaagctgagagagttgtcttcatctctaactccagtcttctgtagtgtacttgtttggatgtaacattatccaaatgaacacaactgtttctgctagaaaactctctctctctctctctctctctctctctctctctctctctttctctctctccctcttcagaaccaaatgaaaatcacaggagaaaaaaggatcttggtataatgttgtgaaattagaccagggaaaccctaacaaacccctaagtgtgaccagaagcttcctctgatagttgaggggatatattctttttggcttgtagaaacaaacaaggccctgcgcacttctgccaccttctccttttacaagagagcacacagatttctgccaccagctgaagctgaatgtcttcataaagccctcagtgggagagggtttttttttccctctctaagttcctcttttaagaaaaaagacccaaaagaatccacaaaatgaacagatatccaactaccttcttaagtatgcttcccatgaaaatagtaagaaagaaaacatttcctccaataacagtcacacagttgggactggatgctgtatttcttaaaagtcacttaactccacgtgggttgacctgccctcttaaattctacttaatccttgtgaagattaaaagagacagaagtaagcaagctgacaatactcatagtcttttttttttttaatttgtgccaaagagccctaggaatgtatttggttggatatgataacatcaggccttttacccatccccacatcccagggtgtggccaatggatgctgcagatgctctttttcctaggtacaccatgaacctgccagcatttctatgactcttgttccttttggtttgtttgggttttctttcttttgctctttatttcaaccacccagaaattatacaagcaaaatcaccagacacagaaccaaaacagaaccacagctcaacactgtctacccaaactcggagcagcaaaacaaaggctccatcattcttagccacagcagatcacaagaacctacccctgtaaatgctttatcctagttccttctaaggaagtggacacatcttcctgaatactcaaataccaatattcacttcacccaaaagtaaccccatgcattcatcagcttgccactagtcagggaaagtgggatttgtgagagagctttgatttttttttaagtcctaggtttttgttttctttggatctctgaatctgggacttctgtagatttatgttgaatgaaggagacttctgcatattaatacttggtatttcaaatcaacacttcaaaacatttctctttaagcacttggtaaaaacctttaccaactagtagtacttgaagaaaagtacctagctccagaaaaaaagaagagtccttaattttgtttttctaaccacagttggacattttggcttagctcctcagacaggactgggtggagtttattaggtctctggtgggtacctaccctgagaagacaccaggacaggccagaaagttcccacttaagcttggcttaagcacatgggaggctggggccccgatggaattgtacccaggaaatttatattttacctaacttcactcattggtacaatcttggagactgttttggaaaacatagattatgtaaatttcctgggatcaaacagaaagaacaaataacaaaagagaagaggaaatctcctactgacaaaggggtaatttcttcctaaagtaccctttatgatgtgtcaagaaaaacaacctaatggctctggggacttttaagttgggcatttgaagacacctcaatttcccttaaaactttaggcacagttttagaagagagaatttgtctgcagttggagagggttacatttctctatctttagtgttatctagggaagcccttaagctgccttttgagggtcctgtgcatagatgtcttattcctacaaagaccgggatgggaaaggaaagaagggaggcagagacaggcaaggcggaagaaaagaaagcgctttaacccctttcaattaccctgaggattcaaagactaaagttaaatccggccataaagtttattgcttcagactcacaggctggtgagaacactaccagtcaaatgaaaagaactaacagggttgggcctagcccggtgcggggacagcagagtacctcctaggtggggacccactgtccccaacatcctgtgggtgcagcctgctcctgctacacagccaaggccccagtcagtttccactctctccagtcggtctgaaactcaggcccaaaggctgcccgcctcaattcagtcttgccaaatgaccctggccctgcgaagacatattgcctcagccccacaaggaatcccgccagtgtcggcctcggtcctttccgggcctttctttcaaactctcgagttcagtttacccctctcctccagtggcctgcgtcccttcaactcccagagctccacgacccccaaagagcctgggcctgaccaaccttagaaagaaggcccggggctgccaagttttcacagacagacccattttcacacacgcgcgcgcgcgcgcacacacacacacacacacacacacacacacacacacaatcatctttttgcacgccggcgggagcagcggaagtcattaacatcacgattgtgcagcaattaaagttaggcctggggaagccgttctcggccggccacaggcattcttcaccgcgcagcctccacaaggctggctctggctttgctaatttaggcaggcagagggaaaagtttgttctcccattttgaatactgagccagacagaaagagaggacaagaaactttttaagagtgaaaataaactcaagaggcgagcttaccttaacatggagggagccatttttcagagttttgagaacttgtggtttggacacttctggacctaaaattgacactttgaatgaccaggcagcacacgtagcctgcaaaagagtcaaatggagtccagcgttagtgagattatatgttatgtggtatataatgttggatgtcaactccccaaaaccataaaacttactttaatggccccacgtgacgttttatagccagtgaggcgatctgtctgtgctatggatgattttacgatctaattcatagacaaaaccctattcatttggcacccaaatgtcatatagccggaactggggcttataaagtttactgttttataacttttaaaaggaaagacggcatccgtgtaagcagccagtaaatgtgcaaatctctagttgggctttagctgctctgaggagtttcccagtggagctaggatggggtaagtactttccatttgtagcaaattaattgtagcaaaagaagccaagtggttcagtaagggtagagggaactgagtgctggggttggttagtgggcagagggtttggggtctacagcctggcagagaagcctcttcaacaaggcctacaatagccttggatctatgtgggccggagtgtggctaacaaagccctggcttctctctctttctcttcctctcctttttggtacaaagttaacttggtttcctcagagatggacaaggtggactcaagctttggaacctcctacagcttttcccactatgttcttctggcctgaggtttctgatggttctgagtgaggaaagctatgagtcaaggtgttggtgtgaagccacaatgaacaggcaggctgcccaggtagccgcagactcagcagcctacagtactattggacagacagaaaagcagaaagagcagcttgctatttggcataaatcagaccaagagaacttacaatagaaagtttattttgttttgtttccagtcagtgttttttttccttaaaaacaaatacaaaaaaaaaaaaaagctgatcacagtttgcttaaacagccagacttggacaatatttgtaactttttcacaaaaacatacatcactgaagctgcgcttataagagccacttccagagttcgtgcaaagggtcctacaaaggcacgcagggacacaccgcttggagtcacagttttcgtcacagagccactagccactacacgttgaacaagttaatttgtgtcttatcaagtcacctctacaacagcattaattacacaaggaatataggtagtttgaataaaaatatctttaacagcttggagctattgagacaggaacacttccacgtacatgcacattaaagaactcaagtgcaacacacaacattggcactaaacgaggtgggggggctttttgtgtgtgtagtttttttttctcttttcttttttttttttttttgttttagttacttcaagtaacacagcttgcttcatataaataagttaaaacatctatttttttttcaagacaaagccattcaggacaaagagatgaacagaagcagatctacttatacaggcgctataatggcaataaacaggctcatgattaaaagatgaattagggcaacgagaacagggcttcttcacagaaggaacacaaggggagtttcagaaagtcaccttagtactgacactacagagagctgcccggctactactgctcagtactttggccgctcagatgctcaggggcggaaagccccccctgccgcggccatactcatgcttttcagcttattatcttttttccacttcatcctcctgttttggaaccagattttaatttgtctctcggagaggcaaagggcatgagctatttcgatccttcttcggcgggtcaggtagcggttgaagtggaattctttctccagctccagggtctggtagcgagtgtaggccgtccgggcccttttgccttctgggccacctatattgtctgtaacaaaaaagtcagcggtttagccaccaactcctcagcacctggttccaaaactcagccagggtcctgagctgcggagaaggctcaacaagttctccttcctcacccaccctccccaaatttccttctcccttcctttctggcgagaaaaacaaccggatttggactctgggaacaaccgacccacctgaggcaggaactctgggtttaaagacagcttggctttccctcgccccctagtctgctctttagccctttacgagttgtcctaagtgggggcactgccctcccagtctgcccaccgcccagaaacgcactgaagcactacttttttttctcagttcccaagtggcctctaggtcaccctcagttaaagttccagccgagctagccgccttctgttccagtgtacgcttggggcgcccgatttctttttcttccctttccttcgctttccctcttgccctcaaacttcagaatcccgcctgccctcgcctggcttattccccccaagccccttttagggggctctaattagtaacgctgtttccccagcgtagcccttcccataaattatctcccctgacaagcccgattcacggcccttactgccatccctacccctgcatgccctactccgctggcctgaccctgaagagagttccgaggcactggggttccagacggaatttcttcctctttcaacatttaaacttactcggccaccccattttcctccctcccctctccccagtatctgtgaatgcagatcgctgctgcagtaattgggaggaagtaaagagaaaggcagggaaaagggagccgcagggagaggctctgcgggctggagagaggcgagactaggagagagacgggagagaggctgcagagaacagagagtgaccaagacccgcgcccccacggacgcgtggatcagaaaacggctggctttaccgtgactaatgtgcagcttgcgcatccaggggtagatctggggctgagcgggcggcgccgggctcggctcgctctgggcgcccgcctgctcgctgctggcaggggcgtcctcctcggctgcggacgccgtgccaaccccctctctgctgctgatgtgggtgctgccggcgttggccgaggcgccgctggagttgcccagggagtttttcccgccgtggtggctgtcgctgccgggcgagggggccaccgctgagcagggcagcgggtcgggcggtggcgagtgcgtggacgtggccggctggctgtacctgggctcggcgggcgccgcactggccccagccgcgtagctgcgggcgcgctcgccggagccaaagtggccggaacccgaacggccgacgctgagatccatgccattgtagccgtagccgtacctgccggagtgcatgctcgccgagtccctgaattgttcgctcacggaactatgatctccataattatgcaactggtagtccgggccatttggatagcgaccgcaaaatgagtttacaaaataagagctcatttgttttttgatatgtgtgcttgatttgtggctcgcggtcgtttgtgcgtctatagcacccttgcacaatttatgatgaattatggaaatgactgggacatgtactcggttccctcctacgtaggcacccaaatatggggtacgacttcgaatcacgtgcttttgttgtccagtcgtaaatcctgcctgatgacctctagaggtaaactcgtgcactaatgggggagttgggtggaggcaagaggggtggcgcgcgcgccctgggcgcgtccccgccacccgttgccgccgttcagtcggactcgagcgccacccgctggagactgggcgcatcgcttcgcttccgacctcgggcttcaagggccggggtcgaattgaggttacagcccattatggcaaaattattgcatttccctcgcagttccattaggatgtaccaattgtgaggccgtcagctgccgatcgcacgcccggcgaggatacagaggattcgggggaggtggtgacttagaattatttacaacaactttatttccccggctttgtatcccctcttatttttgtgtagaggttggggtcggtttgccagcccggccggcagctgtgaattttgaaaacacagatatcaccttcgaggaagggaagacgatttagccaattgaagaaataaatcctgcccacagcagcagccacaattacggctctgtttttgtgaacgcatgaaggacagtgcccctgccgctcttaaaccacaggcgtctattaaagacagcttttgtgtagtgtttctccgaggcgaggtcaaattccatacactcgtataaccagaatcatttttttcctccgtgcaaatatgtttttcgtgccattagtttgctatctgatttgtttatttatccagcctggaagatcttcatccctggtccggttcctctgatcagcccggccccaggtagcagggttcttggtgaacccagagattgggccctgatacccaaacggcctccgaggctgcttggaagctgggatcggtgggtagagctattgggatctcgcttagaccactgggaataaattgcgggaactaatggaatcatttcgtggctgtgtctagtatcaccgtagttattttcctgggctccgaaagacgaaagtaaatcacaaatgtagctgagaagagagcagactctctctactagaggcctggcatctcaggcgtccctggcacgtttggaagccaggactcttgcggctctcatggtcttgggccccctctttgggtcctgaaagctgcgaggtggattgcgtccgagctgtatgaggctgagagtggaaatcgggagctgggagcctgcgggagcctagtcgctcccaagctgtaaacccaggttggcttgcctcggctgaggctgctactctcccactgacggttacgcgccgatagagagatttggttctgtcggggaaggggggtgttcctctttgttcctcaggcttcttgattaggggcatcctgagaggccgggacagggctggggcccagctcgtagaccctttcttttcagtagccagagccgatttggcgatgccctttagaatttgatggcgagggaccaaggcggaaaagcccaggcaccaaacagggcactgcctggggctccttcttcccccacaaccccgcgtctgtggctcacagagcgcagaggcgctaacacagcagcagggccaattctgggtgcatcgcgggcctcgcaagctggcttgggcagccttggggagaaaacctgtgtgtttgtgtgtacagtgcgtctgtcccacagctgacgttgggtgtgtggggttttgtttgtttgttttctgtaataagtaaatgcgtagccgcttgcaaaggtttggacgcttttccctaagctgcgggagaagcaggctggaataaaacttggggagcagacaagggcaccagggggcaaagccaatagaggttacaacgctggcctggtccctgcactggagtctactcgcccgctttggcctcagagtcttccccgctggcctgcgtggagttgatgagtttattttcctttttccacttcatgcgccgattctggaaccagatcttgatctggcgctcggtgaggcaaagcgcgttagcgatctcgatgcggcgccgccgagtcaggtagcggttgaagtggaattccttctcaagctccagtgtctggtagcgcgtgtaggtctggcggcctctgcgcccgtgactcccatacacggcacctgtgggcagaaatgaggtgcgaataagcgaggcaaaacctacccagccccgtgtgcctcccagccattagtctctaaactggaaattactctgcttcactccagcttctcacatcacaaccgagagaaagaaagaaagaaagaaaaaagccggctggatggcaagaattatttcataaccaagcaagatgtttttcacctaaaaacgatttgagtgggaagttattgattttgacaaatgtggtttgtaagagaaccattagacttgaagaaatagcatggccattcttaatttgaggggccaaagtcactgtttcgagggagtgtagcaattatttgtctgtgggtgcagtggggattctgggagcagtatggaaattgaatgcttacattgtgtctgtgaaagacgctatccaggctcctcagatctcaatgtacttttggaaagttaaatatggccagtcttctcaaatctttgcatattgttagcaagttatgtgatccacctgaaaacactccactggggagagtttaagctctaaagcgactgtaagttgcaaacttccccttaggctctgtccctgctccaaagggtaaggggagtctctgtgtgagatcgttgaaaacctgggccaaagagagggtgctgtgagtgaggtggtgatggactggcagtgaggactgtgttgggctgtctgggtgccagaggtacccaagggtgagacaactcactccccaagccaggtgtgaggttcaggcagggtctcaggagaagacagaagttgactaagagttgaaagttaagtagaagataaaagagggaggcagggaggagggagggagaaagagagagagagaatatgaatattctgagaaggtggccctccaaagctttggtggagacacagaaagaggtcaaatgtggaaatgagggcctctgcatctgtctgcctgggcttctggacttccaaagggcagaagagagaggattggggtaggaacctggaggagtttgcctatgctaccttctggaggccctctctgcttggaaacctgagggggtggtaccagggtgcaactgggcaggctttctcatctcaaccagtttctctctctctctctctctctctctctctctctctctcttgttgtcccttaagttacagggttcataaggcttggcagtgaatccttcaccctcccctaaagtgtcaccttacagggatctcatggccctgcctttcctctggctgggcctgattgtcccatgggaatgtttgggtttctctctctctctctctctctctctctctctctctctctctctctctctcaaattaaaaaaaacaacagagagagaaggaaattttgttcattctttccttctttcttcctattctctcctcccttcctaatctctccttccttccttccttccttccttccttccttccttccttccttccttccttccttccttccttccttccttccttgtctccctgccagcttttcattctccctacactctctggagtggggaagcagggaaaagccttacccgcacaggaattcatccgctgcatccaggggtaaacagggcttgtgtacttccggtcggtgccttcctcatggagggctttgccctgcacgctgccgtcaggtttgtactgctgctcgggagaaaagtgcaggtagtccccggggcccctctgcttgttattgcccgagggtgaggcgccactgaggtctttatcagaatagaaacatgaggccccgtactcgtaggatgcccggttgcaggccaagaccgagttggactgttggtaaaaacaaggtgaggtgtatgtcttgtccggaagactcgacgccccgtaagaggccgggaagggcctcagcgcgtcatagccggccgggtagaggggcagctggcccaagaaggagtcctggccgctgggcaggctcccagggaaagtgggattcacaaaataggaactcatttgcgcgcccctctgcaggactgtgatttgttgtgtattagtacatctggctataactattagtagtcatcgaactggtttgtttctggatggccgaacgccaaaagcgacagcagcaaatcgcaccagctgacgcagcggcggccaatgggaaagagcgccggagcccgctccccggggaccgcggcgaccgaggcagcaaagttacaaacagcccccagcccgcccgcccgccgcccgcccggcagattaatgggcacacacagcctgcccgccccgctctcccccacacatccccaaacgccagcggcgggcacgacccgggcagagatgtgcaaatctctgcactagtgcccaggtcaatgagcaggcctgctctttccttttttgccttcatgggttttgctgggtttcctccccaaacaggaaacctgacaagcccgagccagggggtggtgacacggatggttttgcttagagcctcctgtcccagtcagaccctgggtcacacctccccttgtgctcccttaatcatgggtgtgggttcttgaatgggaaaaggggctctgagaagccaggccttcacgctctgcttttgaactgtatgctttaggggttccctgggcgccttattccctcccattcttattacaggttgggccttactgccctaaagctgaaagatcaatcctcactgaccaggcccacaccaaagccagggccttcctacagccccttcttctcagtaccgccctccatgtgtggttcttctgcaatggtccgtgcctgtgtgggcttaaagcaaatacctacaccggctgtgcactgcatcctgtctttgaacttagagaaaggaaaggctaaaactcatggttttccacaagaaatgatctacagaagggtgtttgtgagaccggagcagaaagccatccgtggggcatgactcctctcacccagcttcaagcatcccaggactccctaagttactggacctgcttagtgcagctacggaaaaacaaccggatacagtatctcccagtctcattccagaagcaggagagacacggggaccttggttgagcagggcacggagtgcagcttctggagcccagagcttcactcaaaggatcattaatggacttggtttcaaggtcacacggagatgggcacggtcgtgtcgcaagcatacccacttgtcccctaccttcccaccctaaactactcctgctgctacagtatctctaaaaccagatctgtcaccctgtcacttgctccaggatcctgaattaccttgaccatcggcccaggcctggggatactcagacaggatgtggaaagcctgtttcgggcttgcctgtacgtggatcagggtcattttgttaaagaaaaacgcgatatcggtttgaagtcacttttatgactgtttgggctagaattagcttaaaaaaaaccaattctgtgggtgtctaagagatctagctggggctcaggaggttgtgtgtaagatctgtaaaaccctgacccttgtgaactgatggggatcgggcttgggggaggtgacacttggcagtggtcccgtaggaatctattgcagagttctttaatctcttccttgcttttcgatcccccccctttctcccctcaaaagaggaaaattgaaaaaggacttgcctaagatcggcctccagagagcccgtgaaggcacaccaaaggaaggctgtaccacaggccttgtgtttaacgtctttatctctccaacccaagaaagtttttttttcctttgtatataaatgagctgttcaggagagaataaaattttacgtttctcacagagaggatgcaatatgtgggaaatgaataactcaggaagaaaagaaaggtggattttttttttcttaaaaggctgtttgaagaaaataagtttgagttattggttcttaaacaacaaacaatcagataacaattatttccagcaatactgttggaaatgaaagtagccatttcccaggtgctaattgttcacatctatcagttctctttgacgcagctctgtctcacacagagttggagctgatgacagcttgccaccattattgctatggtttgatctgaattttagacttaattgtctcagccaataaaagaatttgttttctcacctagaagccagaaaatgtatttctagcttctgtaaacattaaggtggaaaaaatattaagttgaaatcttaacatgtaagcccaggctagtgtgcatttaagttagcagtcaatctatctattcttccatatacatgtatataaacatatgtataatatatatatggagagagagcgcgtcctgacagagtggagaccaggaactccacaccttcaatagagcctcatcctgagatgatgagaataatcaccgcaggactctgctagctcacagccacacagaaaacttaccttttatcttctcttcaaagagggtaagatggcagtagggtcacacagttttgccctttccctggctgcccattgagcccctccacttctgccagcctggagcctggcttgcaggtgtgtgggaagacccagaaggtccacctccatccagtcaaatctctaggccagaacccaaagcacacaggtgtgggcctctgtcagttaccagccctctcctggagctgccttccatgccatagccaatcctcagggccagtcaggtcagcaggcctcggaactacaaatggtctctccgatgtcagaatcccaaagccaaagcgttccccaactggcgtgagccctcaggacgcctttgggacgcgcagtttggacagaagcagccatgaccagccaggcggcctgtacaaacagtctccatggtgctgggttaggggagagggaaggacccgaatctattccagcggctgagctttctgtcatgggtagccgaagcaagaagatttcacagccaaataaacccttggagactgcccctcaggtccccttttgtgccccccttcccctgcttctggggattctgaggggcccgtacagcagtcgcgccaggctcaaagaggcgggacgctgctggcgccggtcccggcgacggccacagcgtggcagcagcgagctccctgttcggtcgcaataaataatccgcctgcggcagccgcagtcaggcagccagcggccctaggaggcaaatgcggcgctttatctgcccctgcccggggcgcatccacagagctgtccggcggcaaacattccaagcatctacacgtccttcttaattgtctggcctaggccgacatactatcttgagataggaaaacagcagcagcaacaacaaccaaaaaccaaataaacaaaaaagaaccatagccagggaactcgcgactgatgcttgggtagctctgtctcccgggggcaaatctaacctggtcagacccgctttcaggcccacccaccatgactggtgccaccgtgccatgcaaagccattgctaggcccgcagctcttagtgctgtctcgctgctagctgtagtcctctcgctggaagccggggaggtggaggaccgtggacaccaacctgccactgtacttaggtggcttgggactgcgaccctgctattgcccagacaccattttgcaaccttccctcagaaacctcagatgtgctccttccacctgcgtcaacacagcagcccctgcacggaaacatcaccccctcaccttagcacccaattaactcggttctctcctccaacacagaattccacacacgcatctagcccctcttccagggctcgagaaatcactctaaccagaaaaccgggcaaacgaagcaggcaaccatcggagaactctgaattagtaagttttgtttctgtgtttgcttcctttcctagcccccacaggaaaaaacagtgtgccgaagctaacaaaacgcccgtgctactttgctcgcctctccgtcctcgttcccaggttgggaactacctctggctattggggaagtcagttgaatcaattgggtcacgaatgaaataatcccaaaccccagaggccagtagggaacagtagaatgccaaatgacttcctttggggcttcccgagggtcactggggaatggaggggggagggggcgaagacccaagcggtgctgcgccgtgccaaggcgctgtgccacagagggaaggctgatccgccttgagggaggagggaaaaggagtgattgtaggtggtggcggtagtgggtgagaatgagtgacgtgtttggactgtggtgtatattggggctgaaaatgaaaggacagtactgaaagagcgtgaaaaaggccccttttcaaagtcgttcctggtgccctctcttaccactgtagtacctcacccacctttgccctgtctccttcccacaggtctcaccttcagaccgcggctcccagaagcttctgcctctctgacagctgtcgcttcggcagcccaagagacgaattgtcctccttcctggtgccagaggacgcaggaaattagccaggttgcaagttgcaaagcagcggcggctgctccaggaactggacgcgctccacctccagcgacaacggctggcctgggcctggcagcggcttcccctcgctcgccatcgccggacaaagcgcagcccaggcaggctggcaaggcagagctccgaagcacgcaggatggagcggagcaaaagaatgcggctctattctcgcaagggaaattataaaaaagttcatgttcacggttcctatccacatgaccgacagcggccaatggaagggccgaacaactcataaagttgtattgcaaagttgtaaattttcataaacaacaacggatttatgaccctttccccatcactaagaggaggcggctcttacacagacgccatcttaccaccgagtctgtcccgatttggggctgcaggtttttcagacccttttaggtccgattttatttaaaaaaaaaaaaaaaaaaaaaagtcctaagaaactggcccagcctagtcaggggataagaatggagaccttcgcgggcccagctcaggatgctctaagctacttccaccgcctctcgcccctggtctctcaccgctagccccttccccagccacagtccttcctcagcaacaggacttggacttggttgcgccgcagggtttgaggcccatgtcgtccaagaatccctcagctgcagtgttggaccctggggcatcctcaccctttctgaaggctaagtgggggtactgcagcagggaccctgaattccatgtctttcctacccctggactgtactcaggacgcatgtggaatccgggatcaattggagggtaggtaatacccttttagagctcagtctacacctttagaggaaagttgaatttggaattcgttcatggaatttatgaaagtttgagaggccgtagatagaatatgtagcattaacaaatagtcttttttcaatggatctaaatagatattggtgcacatacaatagccagacaaaaaccatctacaaagaggaaggcatatatacaattatagtcacagaaaaacacagaaacccacacacacaattatagacatgagaaatgttgatgcacacgcatgtgtgtgggaatgcatacaattataactataagcaagcacacagagaaatagaaatgtgcttaagtacacataaaaacatgtgaaaagagacatgatacatttgtccatgaatagctaaaatttggactcagggacagtggctctgcatttgtttcccgtgtctctttggcctacagccagggctggtccttcagctatggccacttccccttgcacaagaccctctggataaagcagtccgtgtttctttgtcaccaagcatctttattgttacataaaacacaggtagctgggctgggaagcgtgccttctctgaaccccaggctggggggtgggacgggacatgaggagacaagggagatgatggccccggtgggtgctggacttcccccacccactacagaattagttcaatacaacacaccatgctacaaagtcaccccattaaaacatccttccaaagtcaagacattcctttacaaatgagctccaagattatagaaatgacaacaacacaaaaaaaatctggttcaaatatacagtatttgtccttgtaggaaaagtcagggtatacatatttgacatggctgaacagtaggacacaaaagcaagggggagaggacagtgagtctgggaacatctccttagtcccacaaaaacaaaacccagagctattccagaggatggcagccagctcgggaatgctcccctcctgaagtagggttaatggccctgaccttgtgtcaaagccagagaaagagggattctaggttacagcacttggtatgctttggaataaatatattatttttcaatttaaatagaagcc

SEQ ID NO: 8 - DNA, 2753 bp, Mus musculus
caaatgagattgcacctgcactctgaggaagctaaagggagtttacaggatgattagctcatggtctagttgggacttcgggtccttgtgaggaagtccttggcctggtaagtcttaagcaccgactctctctctctctctctctctctctctctctctctctcttaggaacgtttcatgaaaataactgtacactgtttgaatgaagaaatgagagggcatcttctcagaagctgaggtagtctttcttctgtaatgagctttgagtagcagagggataaagcattggtcttccaaatataacaaggaggacaaatgaaaatataaaagagagatttgagatggaaaaaaaagaagaaaataagagagataagaaaagaagaaacagctaaacgtgtgcctacccttttatggaacttttcagggagagaattttgaggtgctctgactccccagataagagctgattccctgtttgcagaggaacacacacacacacagctttccatctccatgtttggtgcccacagcctcatgacagatcttccatggtggttcttatgacgttgtgcaaagcccctggaagactccttctgcaggtcacttccctaaacctgtgtttaatggggaggtggggagaaaggagggagaaaaggaggagggagagccacctggaagaagcacacctccacatatacccctgcatgccttctcaggcaggtcccacctgcagcctgtggcccccatgcacaacagaatagtcctgagtgaggctccaaatgcaaaatcataaacttatttaaaacattatgagaattatttttgcttttttgtaactcagttgcaaaattctcaagtgtgaactttgttgataactacgttgtgctacaatgttaaaaggctagacatatcagcagggccacctagtgctagacttagtgctagagacagaaaggatgctagcagtagagaaaccattagtgcggtattcaggggtagagtgcttctgtccctactgaatcaattgtctctgctttcgcagagtttgacctacagaaaagagtaagtgactgggtgcaggactcaggcaggaaagctgggtggccagtatcctcgtgaactggagatccacagcatggagatctgtgctaagaggctcagcaagtgcacggatgctggtggccgagcaagttcttttctagagatataaaaagaagtcattgaaatgagtggtttttcacttttgcaatcttattaagagttcataaatcagatcggaaaagtggttcaatgggtaaaagtgttcatgtttgtgaatgccagagcccaacatgtagaaggtgagaactaactcccgaagactgtcatgatgcacctgtgcttcttggcatgcatgcacaggcatgcacgcacacacacacacacacacacacacacacacacacacacacgtcacacactctcaataatttccaaactgatcaaaccagagaaagtctttaaaaagttataaaccatcatttattcactatgatgaaagaatcaccagaatgctggactgtttccagaatgttcttttgcgctttctgcaagtcctgtcctccagctgatagttggtacaggacaagatgaaactctggctgtttctctgggtctcaccaagggcaatggcagcgcacaaaagcaatgcaaatgagtaatctcaagacagttttctaaaatcaagaccatccagtggtggttttgttttgttgtttactttatgcttgtgggtgttttctctgcatgtatatatttccaccatgtatctgtctgttgcttttggaggacagaagagggcatcggaaccccctggactggagttgcagatggttgtgagccaccacatgggtgctcggagatgagcccaggtcatcttgaagagcagccattgcatttaactgctgagtcattttttgagtcctgggtgttttgagacaggcaagggcacagatgaagacaattcctaaaggccttctgagtttcctggattgccacatgttcctttgtattcatgtgtgcctcatgactttcatcaaacgatgggaacaggggacagaaaatggagagatgaggctgggcttagattgggaatgatggaggccacgtgacatctccagaagcaagcagaattgttcctttaattgggacaactaaagggctgcaggctctgcacagggggtggagtctatgcactcagggtacaggaggcttggagagatttacaggactttaaaggagactttgctaatggaagataccatctacccatcagttcctgacagtctcaaagtggaaggtatcactcaaagacatgcgttgatccttttattggaagtgttccagaacttaacagtccactggtgttatcatcagttttcctgtcctaagtttctcagtccacctgagccttttaggttattaacccttcggtgaggactgcaaagccacagttctgagaacggccttgctggaggatagcaatgccagaatagagtcctggctcctggcttcctgctatcaccagtccttgtctggaaggtgcacacagacaggtacctgggtaccccaacaccccaccacagtttctttcaagtcctttcaaaagcttccagattagcaacacaatggtattctacttcctgccctatataaactcggccttttctctcttgtaagcttccatctacctataataaagttcagtctaaaac

SEQ ID NO: 9 - DNA, 3508 bp, Mus musculus
tctgtggattgaactgcacatgctgcctacagtctgacgcttaggttctggggataggattttgtggtatatagtcccagcaggccttaaagatcacaatcctcctgcttcagcctccgggaccctgaggttgcaggcattctctaccaagcttggctacagagacctttttgatggagctgtgccagatgctaggattggcctccttgttagttcaaggttgagatgggagtggtgtcttaacatctattgtttgccaacagttattagaaacgtctgtatataatacatgtgagcactgtgtatatagaattaattttaaaaaagatttttcttaaaatatacttgtagagttggtattgtccatttttgtaaatttagaaaatgatgtcctccctgccccccagagttactttgccaggtggtggtggtacacacctttagtcccagtactcaggactcaagaagccaacctggtctacagattgagttccaggacagccagggctacatagagaaaccatgtctagaaaaaccaaaaacaaaatcaaacaaataagcagaaaacacaaaagcaactcagcattaacagtaagaagccaggcatggtggcacatgcctttaatcccagcactcgggaggcagaggcaggcgaatttctgagtttgaggccagcctggtctacagagtgagttccaggacagccagggctacatagagaaaccctgtcttgaaaaacaatttaaaaaaaagttagtaagagagaaggtcagatctgcttcccaagcccctgctgtttttctttcacattagtgtgtcaacgaattgttggtagttggagaactcacatatcaggtggctcacaacttcctacaactccagatccaagggattctaacaacccgagcctctggtcgccagtactgtgctcacacacagagacttagagtggcttgctttgtctttagatctggagatttaaattctgtagagtgcattatgtctattatctcaaatgggttttgtatggtgtgtgtgtgtgtgtgtgtgtgtggtgtgtgtgtgtgtgtgtgtgtgtgtgtgtgtgtgtgtgttagtgtgttactaaggattgagctcagggcttctttaactgaactatgtctgttgtccatatcagttctgtgcttggactagaaattatatgaacacattttaatctcttaggctgtttcttatcaatgtgattttgaataagatctttatcatatgcaaatgaataattatcaataaaatatcaccttgatagtttctcaagattgatatattgttccaatcacatgacagacagttatttatttatttacttacttacttacttacttacttttgacttttcaagacaaggtttctctgtgtagccctggctatcctggaactctctctgtagaacaggctggcctcaatcgagctcactagagatccacttacctctgcctcttgagtgctgagattaaaggaatgtgctaccactgctggctaaattatataacttttaaatactgtttttctatgtatgtgttgaatgtgtgcattccaccgtatatggaacactggctgtctggcttgatgacaaatgcctttatgtgctaagttgtcttgctggtcctgagttacctaatttatatgttatacattctgaaggcagggatttcataattagatgatttgaatggggaaaaccactacttttatttattgggttagacagaaaataggttcttatttgaagttgttaatatttgaaagcagaatgatagtggagtggatttcctctgtcttttccgttttgcagggggttggtccaaggcctttcacatgctaggcaagtgctctaccgctgagccgtgttcctcgccttgggataattttgttaggcagctcctggatctgcttggagccatggtcttttctatacatctgctttgaagaaagctttccttcattctactctgctgtaaataagtacgtgtggatagttattatcaggaatgactgattttcacctttccacaaaacccttaccagaagtttttttcaaagacacttaggcctgaaggtgagatgcctcagtggtaacctgccaccaagtctaatgacctgagttcagtccctgggaccagcatagcgcaagaagaaccgattcccacaggttttcctctgacctccatgtgtatgcttatggtaggcagcacatgcatggacacacaaacacacgcacgcatacacacataaattaatctgaaaaaaaagaaagactgtgtgggagctatgtacttattctttctctcttctcagtgattgacacctaggggcgtttcctcaggttaccccgtgacctgacctaggagcagggacacctaggacaggaaaccaactacagcttgtgctcactgtgactgcaggatgtgcttgttcctcccctacgtcatgtccttgggaaatatttctaatgctctaaatggcgtcatggaaaatacctttgatgtctgctgtcaggaatgggtctgtaatcagaaaaataagtttactgggtagtaattgggttatttgaaatcttacacagtacattgtagcggtactaatgcaccaaaagaaaagggcttacttggtacgtctagcttagtggctatgtagtatactggttttcaaacatttgagatcagggccaggaaccttcagactgaatggatagaacatagattgattcattataattaccccataaccaaaatactgaattataatgtgaaataaaaacattgtaatcaaaatttatacattttattttgaacatttttagtaaaaaattatatgcagattttttgaaagttatgtgatttctgtctttcctttgcaaatatttattatctactgtatgcttgttattatattcggtgctagggatttagtgataaggaaattatataatttacccccttcttaagctggccatctagaaagattatgtatgtacagataagtgaatatttatgataatataattgttagataaagaaaaatagaatgtattcatggagggattaaagaaggcttcttagagaccggttgctactttgtaagatagcgtgtaagtatgcataccatatagaaaggtaggggtgtgtgtgtgtgtgtgtgtgtgtgtgtgtgtgtgtgtgtgtgtgtgtgcgcgcgcgcgcgcaaagttctgtgcttttggattgctcttctgagtcagacatggttcacaggcttccattccggcacttgggaggcagagccaggtgggtttgaaagtttgaggctggcattgcctatgtagtgaattccaggacagccagagctacatagacaatgcatcagaaaagcaaaaccctttgattagtcttcagttgaaatatgagctgggggtaggcaaaggcatgtgggtctctgtaaattcaaggccagtctggtctatataactagatactctgtctcaaaagtt

SEQ ID NO: 10 - DNA, 1469 bp, Mus musculus
cagagtgactgtttaatattaaatcagcacagaactttaaggcatgcttcccaaaatctttcgtgcagcatcaggtgtgtatctaaacagtatagcatctaactttgctatagagtttgctataacagttgctttgcggttacaaaaaggagagagaggagagagagagaggagagagagagagagagagagcatattttcccagtttgtgatcagaactctctccacagatctaataatttactttgttgattaaatttttaacacatttcaattatttatgaagaaatgaaaaatccgttaaaaagacataaagggttcaactttcagaggcagcatctaaactacttgttaaatagcctggcgttttctgggtaggctgaggtgattctgtcgtgctctgtgaagagaaagtagtggctgagcattaggcagaattttaaaaaacaaaacaagtaaacaaaacaacaacaacaacaagaagccatcatcaccaccaagttcggaagatctcaggagcatttcacagccagcttgagatttgtctgaactgtccagtgttccatttccatcagtcttcctcctctgcttaaggagggacagcatttgggatccactcccgaagtcactttcctcaggaactgcattataaagaggaccttgtgatgcagagatgactctacaggtctgattgtgtgttcaggcagggaatggcggcacatgcttttgatcctagcattagagaggcagaagcaggcggatctctgagttggaggctagcctgatctatagagttctgggacagccagggcgacacagagaaacactttttttgaaaaacaaaaaacaaaaaaaaaactccaacaataatagtaataaaagattgtgttttcaacttgaggtctcagaggtctttcctgtgccatctcagtctctttaaaagccaagcctctaggacatgggacgtgaccttcctgtcccaaactgacactcttgcattcattctctctctctctctctctctctctctctctctctctctctctctctccctccctctttctctcttggttggatcttactgggtagaaagcctctgccaagaacagactctgtagggggctctgtttcctgaagagaccctgcagaagcaaccacaggacaacagagaacagaggcagcccggcagccttcgcccctcacagtgccacttggcaccaccgctcgcactgcctttggggacagcacctaccctcctaccctccgtaggttgggggcggggggatgggcaggagtctgctaggacaaagtcttcactcgctccgttctatcttatgaatcacgtacctgcttttcaagcacatgggactggaaacgaatttctggcatggtgaacgccagagttccacgagttttgaaaaagaccacgactccctgccctggcattcctcaggtgacacacttgctgg

SEQ ID NO: 11 - DNA, 1831 bp, Mus musculus
aattctcaaaaatgatgcttactctattccctctaatgagaaagataaagagtagttattgagatatataaaatatatctaattcataagttaaaaactttattcggcatggtgttagaccctttattaatccttcccttcaggaaaatgtttgtatttgtagggcaaatattttaatgacattcttccttggaatgacttgtaaatagattttataatagcaattttatattttacttatatttatcactttaatcaaaagctcatgtctggataaatttcattatgtttgatttttttttaaatgcttcttcctttgttgaaatgctttaatggggcgccaaatctgccactgtaactgtcattctccacggtagaaagaaatgtatgaatcttccagcatttaataaaaggaaatgtaagacccaagaacctacaagagaagaaaccctgtcagtctcccctctgtgcccacttggtgaacattctctctccccaccatatcaaaagttaatcctgtggaaaattctcctcgaagcatgctttggagcatcacttatatacaaggctggtttttccagtttcataaaacgtgagctcatgtctagggaatcttcccaactagaacaggcagagaagaaaaagaaaccgtttattctcaaagtcttggggctggagaggcttcccctggaagctgagaacgctgagaagggccagggctgcggtgaccaaggcttgcataaccctccagagacctttgtttgctgtttgcatgtttatttgttcagcttcactgatgagaacgagtgggataaatgtttaagtgttttcttgtttaaaaagaaacaggatatttggaaatgggcttacagactcctttactgattaaagaacaatcagtcatcaaagatgttaatgccacataatcaaaaatcatataaacaaaactgaaaagaaaacacttcaatgtcaaaatattaactgtatttacctcagggtagtgaagtaatggtaactttactttttcatttttaatgttggtgtaaataaatatagttttctaaaatgtgcatgtgcactacttcatttttattttataaaagtacaaaacaaaacaaaaatacttgcagctagaaagacagggtcagaagaatgcctccttgccgaggtgtctatacagtgtctgaggaaatatgccctacactagtctctagtcctaagaaaaacttcaaggtaggttctcagtcctaaaatagttagaaaacaagtaaacaatgcatgtagaagcattgagtgtctccagaccaagcactggagtcatgtacaggaaggtacagaaagagatttacagggcctgcaattaaacagaagtatcacaaagaagtgtcatggcactagaaccttggaaggtagcatataccgagccagctcattctcttaagaagctgagacacagaaatgagacttccacataggaatacaccttcccagctagcacaggagggcacagcagcaagccagcttctctcaagatttaggcttgtgaacatggcaaattgctagagcaggatgaaaatgaagactttagagaaagaggaggaggaagaagaggagggaaaggaggaggaggaggaagaggaggaggaggaaaaggagaggaggaagaggaggaggaagaggaggaggaagaggaggaggaggaaaaggaggagaaggaagaggaggaggaggaggaagaggaggaggaggaaaaggaggaggagaaagaggaggaggaagaagaggagaaggagaggaggagaaggaagaggaagaaaatgtcaagataact

SEQ ID NO: 12 - DNA, 4514 bp, Mus musculus
ctgggccctgtggagaaggttctccccattggctgctccggagtccacctgccctgtctgagcagcccgaaagccattggccgccgccgctgtcgcttagcaagaagccagccttagtcttcgctttgggttgcgaggggtgactagctagctcagaagcgtagccatcctctctccattggtcgctcgaagctggacactgtgcctcacatctacaaacttaggaactctagctgtatggcggcgcgtctaggggaacctcgtcggctccgtgtggaacctgggtgttttaagtgttcgtgccgtttcctcaggctaagccgcgctcgaacggatgcggtgctgggggtcacaaaatgaggtgccacccccaaacattacgtcatcggggtgaccattgcctggggttcctcgcagtctaaactgctttataatccggatggatgcggttctggcgtccgcctgcctctgggcgtacgcaccacgcacggcccctccctctgcgggagagctggacagactttgggattccgagtgtaaaagaaaccggaaccaccgagacctgagacctgggacacgctgcgaccggaagtgggggaggtgacgttgggaagtgctggcgtggcctgggccacaaccaaggagagcttaaggtagtatgctgataggcttcttacgcgagagaaggagggagcccagatctatttcccatttaagagagctcccttttctccgcccctgacgggagctggcattactgttcccgttgagctttcccgcgctttgctgccccgccccttggaggtgggaaaaggggcggagtcgccagggagacgaattgccttgacactcacccacctgcgctggctcaggtttttgctggatccatctgcaggcccagtgtgccacctggcgcgctctctaccctggccccgcgccgccgccgcccaccgcgaccgcagccgtttcaaatgacaagggtttttaaatttctgttttattttcactttttgcagtgttcggagtggaacctagtgcttcacccagtccaagcaagcagcccaccgacatagcagcttggcgagtgtttttgttttgttttggcgatactgattattggacgttgggagtcgcacacgcttggcaggtgcactcgtaacactgaagctactctataccctatcactttttgggacagggtttccactaagttgtcctgcctgcctagtaactagggctacactgttgcgccatcaggcccaggtttgggtaaagcttttaaaagaaggctctgttacctccccttggactcccatagcagtggatccaaaaaattcaggcttatgtatgggaggaatcttggaaccactacattccacatgatgacatcagacaaatcgttctacctccctaaacctattgtctcatgaataaaatggtaactataatatccacctgccaagattatttttgtgagcatgaaaagcttagaaggcagagtgctatttatatagcgatagcaaacaacgggataaatgcagcccctacctttgcctcatctgccatatttctcagaggtgctgcagctcacagaactctttctgaataacgagagttctttactggagagctgaggctgtggctccgttggtagattatattttacaaacttgggttcgggttttatgctcataatcccagcacttggaaggtggcggcaggagtaccaagttcaaagctacttttggctccatagggagtctgatttccacccggaatacatgaaactcttgagtccaacaagggagaaaaaaccctactgaatatattccattcccatattttcctctgggtctttctataggtttaataattactattcatatacatgtattgtgattagagctttatgttctcattaatccttacaactctagaggaaagtattagtatggtcattttatagagaaggaaacaagcacaggcaggctagattaactgatttacacaaagtcagaagcaatgaagttaaaattttgagaattcaaaagagtaagtggtgaattacagattcccttgccaagagaattctgtatagaaatttgttcttcaattagatgtactagtcatttgtttaagaaatatttttcaaactagatgtagtggaagaaatcttgtaatcctaacacctgggaggtggaggcagaaggagcaagagttcaaggccagtctcaggtacatagcaagttccaaactgtactagttacttttctattgctgtggtaaaaacaccatgactgtggcaacttagagagggtttacttgggcttacagttccagtgggtggcaggcttctacattttttttaagattgatttatttattttatgtatatgggtacactatagctgtacaaatggttgtgagccttcatgtggttgttgggaattgaattttaggacttctgctcgctccggtcaactccgcttgctcagtccctgctcgctccggcccaaagatttattattatatataagtagactgtagctgtcttctgacacacctgaagagggcatcaggtctcgttatgggtggttgtgagctaccatgtggttgctgggatttgaactcaggaccttcggaaagtagtcagtgctcttaaccactgagccatctcgccagcccagagagctcacatcttgaactgaaagcaaaaagcagggaggaaactgggaaaggtgtgagtctttaaacctcaaagcctaccctggtgacatacgtcatctagcaagaacacacttccttagcctcctaaacatttccatcagttggattcaagtgcctaaggctatgggggataattcattcaaaccaccacacagaccagcctatgcaagtgagacaccctgaccaaatgaggggagtgtgaggaaaaatattttaattcaggtaatatttaataagcaccatctgtgatttaagcactatttttggctgggaaaaatttcaaaccagggacatttttaaattcaaaaactaaatttcaaagcagggaaggacaagaagaagcatgtgagggttgtagctgtacataggatgggtgaataagacttttctgataagattgctagtaagtggtccctgaagagctgcctgatttcccagctatctgggtcaagaacattccaggaaggaggtacagagggttcttagatggaagtgtgaaacaggggttagcagataggaggggtaagtcagctcatgggtgagctgaaggctgttctaaaagtctttcatgcctaccggatgtggtggtgcactcaggagacaggcagcctggtttccaagacagccagagctacacaaaaataaataagtaagtaagtagataaataaaaggagaagaaggaaagatggatgtggtggcatgtgcctgtaaacccagcactggaaggctaaggccaaaagaccacaagttttagtccaacttgggctatccagcgagagagaggctgtctctaagtttaagaaaaacagctggaaagatggatctgttgttaaggtcacttgctgctttgtagaggacccaggtttgattcccagcacctacatggcagtttacaactgactataactccagttttccaagtgatccagcactctcttctgcccttctcttaccacacacacacacagtatgcatacatacattcagataaaaaccgcaaaaataataaatttctaaaaagagtcttcccagagacagattgatttggggccatagctcagtgacgaagccttcctaaacaggtctaagacccgagctccaattctacaccacaagaagaaatgagagcagagaaaagtcacagatccctgtattcccagtacatggaataggctgcagcagaatcagaagtgagttccagaaagaccttgtccccaaagatgaaggcagttatgaagaggatctagggtgtgtgcgaagattggaggagggaaaagtctgggcatcatccagggcaagtccaagtgttcaaggtggcaagaagagaattctaggagcgaagcagaattctgaaaccttacagtaaccaaatttcctatttttaggagggaaggagaatgatgcgctgacaggttccacccacattcgtaatgggagaagtgaccttgtggagtaaagaaaacagagctcatcaagagtcttgatgagaacacacatggtgcattgatggggcaaaagcttttatagaacgagttcgtaagattggagaagagatgccaggtatggtagtgtaaccctttcacctagcatttgtgaggcagagccacactgatacatggagtgagatccaggactgtcagccagggctacataatgagaccctgtctctgatggattccacaatcccacaaggtggcaggagataatcaaccgagagttctctgaccacactgttctgtgggacacatgggtgcttacacacacacacacacacacacacacacac

SEQ ID NO: 13 - DNA, 2941 bp, Mus musculus
aatcctaggggcacagcccctgttctctaggagcttttaatacatgtgaactaacacacctgttaacagagcgaggcacaaatttgcatgaatattgtacatagtaaggggtatgagaaggaaaagctctgagtagctggttggaataggttcaagctcctcttacagcaggagttcaggttgaatgtaaggaggacctaggggaaactaataaaatattcaaggaacacctgctatataaagttgattgaggacagtagagactgacaagccacacattcatatatttagtcaaatatataaagggctggagacatgacccagggttaagagcactggctgctcttaacagagaactgtgttcctttcccagcacctctgcagtagctcaccactgtcagaaactccagtttcagggtactgagtactatatgctaatgaatgagacttggcttatacttgtaagagtttatgtgctaacagaatcagaccagacagctgacagttctagtctggtgtaatctgcgctgtaacagggagcatgagacattctggaagtgcctaaaggtggagagagtgcttactccacactcagcatcagaatcaaaagatttcctggaggaagtgatatttctgctgaggctggaagcatggtttaattagcagaacaaagaacattcagaccattcagactgaggaagagaaaatgcaacatggccatgataggaatgaaaaaaaactaatatgtgctgatgcgtagtgtgaggtgatgagtgagtgaggctagagaggctggcatggccccgacaagcagtgcactcactcagccctgttagctatgaaaataaactcaagccgcactgtggggctggaagaagaaaaatgaagatacacgagttactgtgtattagatggcaggtataattgagagtactttgtaaaaggaaggacagagacttcttggggcctggcagaatattttatagataagagtgaggagattaggtggagatttagccagaagaaattgtctgggtatggtgatccacctgtagtccctgcactgacatggaggctgggaaaggaggagtttgagaccattcttagagagtgttgggaatattctagaaagttcacaaaaatgcagcttctagatttcattcccagtagttctaatttgggctgatggtcagaactgagaatctgcacttcctatgcttttccatgaattctatgagttcacactttgagaacactgctgtgggatctatggctcaaggcctcagtgatatggaaccatggtggctttgggagaaggctggagtggagtggtaggccaccatgccataggtagttagttagtggcaagtgagcagagatcaagagggagatctgtgtttagcatttctgacctgctcttcccagctccctgaagtgcacaccaacagctgtgacaacatctcccagttctcggtggacagcatcaccagccaggagagcaaggagcctgtgttcattgcagcaggggacatccggtatggcccaatcacctcgtccttcatctccatcttcttcgttctgcctctttgtcctgtgtctggttaccagctgtcagctttatgtccctctcctttatctccttattctgtccttgctcagtacttgaggccctgaaggtgcagctgagacattgcttgagctactacaaaaagaaatgacattttaagagagttccaaaaagaagaaaatgccccaaagggcatttgagtttgtccaagttgcacttgactagcatgtgaaagaccatgggttcagttctcggcatcacaaaaaagaaaagcaaaaccagtcatcaaagtgagacccccaagtggaatccttcctttgaaggcagagaggaaatcttgttatacatgcagattctggagtcatacccattctgaatcaatattggaatagaggaatgaagaatacaaggctctctgcattttaacatgatcacaaactaccaagttagcaaaactgtaccattgattatccttgcttctctggctttcccagccaagaatctgccaggaatctaggaactgtggcaagggaaagtgggcaaagcatgcatgcagctctgagataactcttccaagtaaattgtgtattttcttcctgctagacggcgcctttcagaacagctggctcatactcctacagccttcaaacgagaccctgaagacccttctgcagttgccctcaaagagccctggcaggagaaagtgcggtgaggagggtagagggtagacagtggtctcagtacctccctcatattccaaggtatcttcaggtgctcacctcttccattgcccttctacatctaaacactcatcaggcttcctctgtggtctgagtccttaccctggcatcatcctgtgacttttttcttcacaggaggatcagagaaggttccccgtatggccatcttcccaattggcgactcctttcagtcattgtcaagtgtggagatgaccttcgccaggagctgctggctttccaggtgttgaaacaactgcaggtaaagaaatggaagcacagagcagcaaagaaaaaaaaaacgaaacacacagagaaaggggtgttgaaaggaaaggctcagtgcaactccagggagctctgctgggcacctgcttcctacccaggtctgaatgggaagatgaaaatgaaactggtttgcctttctccagagaagaacagctctatggggacctctgttggttgtttctggaactgcatctgccctgttctcatcactggatgtcattttttgatgggtgtgatttcagttaggattttgtaattcaggctggccttgaatcagttatggtcaaagatgggcttgtacccttgatcgccctgccttcacctcccaaggctaggatgatgtgcatgt

SEQ ID NO: 14 - DNA, 103070 bp, Mus musculus
acttcgatcctcttctggagtttctagtaatggcttccctggacatggctggaacactgcctcttcagggatgcttctcctaagatagaatggccgcagagacctgatcgtttaccacacatttcagaaggtttcaagttgtaaaaaggcaagtaaatgagttaatagtttactcttcttccaccctcctccaaatataaatggctaaagaaattaatgaagagactctttaggaaatgattaaaatgactgctttgacccacccgctggggacattttactatgcaggctctctgcaccgtattggttttggatttgatatgaggcagtagttcaacgtttgtgaagagaaacataaagatgcatagatagctatgaaaagataaagaatactctactactggagagcaaatggggagacagaaaggaaaacctgttttctctagggagcacaggccacctgccgagcaccgaagacttcctgagggcttaaagacccttggacagtagatgctcctttaaccagagcatgctgtgagctttcatttattcctggaagacttaaaattctggcttacattgcaaatatttcgtggatgataatccttttatgaaggataatctttttataatatatattcatatagtattatattatttatatttcattatatgttacatagtatacataaaatagatatgtatacataaatatatttaaatatatttatatgtagccgggcagtggtggctcacagctttaatcccagcacttgggaggcagaggcagacagatttctgagctcgaggcaagcctggtctacaaagtgagttccaggacagccaggactacacagagaaaccctgtctcaaaaacaaacaaacaaacaaacaaagaaacaaacaaaatattatcctttgtcgggcgtggtggctcacgcctttaatcccagcattcgggaggcagaggcaggcgaatttctgagctcgaggccatcctggtctacaaagtgagttccaggatagccagggctacacagagaaaccctgtctcacccccccaaatatatatatatataaattataaaaattatatgaatcatataaaatataaatatatatttaattataatgtatgttgataatagtattatgatatattctatattatttataatatataaatatataagtatataatatttatatagcacttttaaaattaatacactatatggttccgtataatataataacatataatgtattatatataaaaatagaaaagaggcccttggtcctgtgaaggctctatgccccagtatagggaaatgctggggccaggaagtgagagtggggtgggttggtgagcagggggaagggggagggggaaggagggagggggataggggatttttttcagagagaaaaccaggaaagaggatgacatttgaaatgtaaataaagaaaatacctaataaaaatagaaaaggataatccttttataaagattttataaagattttacttttataaagtatggctagcactcctaaggcttaagtactcaaaagagtcaatgaggctttaaagttactgaggtcttttccatgctttttatagcaatgaaaatgtggactagaaattgaatagcttttttttttttttttttttttttttttttttttttcatcatagctaacttctttacattgaaactctgaagacctttcaaataagagaaaataaaatgccaaggttctcttactgtctgaattgtgtattagttggtatatcattaaaagagctattagttttatggtttttatttctgtgtgtgtgtgtgtgtgtgtgtgtgtgtgtgtgtgtgcatgtacatgcgtgtgtatcataggtgtgtgtttagtggaccacttgctagttagttttcttctttcaccatggaggaactaacttaggcttggtggcaaacaactttacttgctgagccacctcacaggccctggtttggatgcacccttgagtaatacagtgcattagtgatctcacaggaacattactgttcctctgtgttttatgtatgagaattagcaggagtaggcacagcctgtgctctggagagaacaaccgagttgaatgcatcaacttcagagttatggattgaataggactctcagagtcagttctgaaaaagatgcatccttgtcatgtactgccaagattggtgtctcttttcccttcatctaaaatgtagccagcaatatctggaaattaacttggatctgatcattgtgttacatgggcccaaatgggtattcaatataggtgtaggcaagaagaagggagctaaaccaacagaaacagtaagtattcatcagtgcttctaaattcatgtggtcatgacacaggtcagtaagagaacattgatctgactctgcccatcaccaatttggaaatttgtaaaaagaaattttcatgtctttttactttttatcattttgggtctgcatccattaatgaaaaggagctgggcaggcatagtctgtccagcagtatgtcttacctttaacttttgtgactttaaatatttcttcatgttggtcatgtttttaacttatcttgaattagttcccaggatagaaaagacattaagaaagaatgtactggaatatgccatgcattctgtagtgtcctttctatctttgtgtgtagggggtccaccatcatgatcttgctgagtgtcagccctgataaaataaagcctgtccaagtttcttttttttttttccttttccattttttattaggtatttagctcatttacatttccaatgctataccaaaagtcccccatacccacccacccccactcccttaaacgcccaccccccctttttggccctggcgttcccctgttctggggcatataaagtttgtgtgtccaatgggcctctctttccagtgatggccgactaggccatcttttgatacatatgcagctagagtcaagagctccggggtactggttagttcataatgttgatccacctatagggttgcagatccctttagctccttgggtactttctctagctcctccattgggagccctgtgatccatccattagctgactgtgagcatccacttctgtgtttgctaggccccggcatagtctcacaagagacagctacctctgggtcctttcgataaaatcttgctagtgtatgcaatggtgtcagcgtttggatgctgattatggggtagatccctggataaggcagtctctacatggtccatcctttcatctcagctccaaactttgtctctgtaactccttccaagggtgttttgttcccacttctaaggaggggcatagtgtccacacttcagtcttcatttttcttgagtttcatgtgtttaggaaattgtatcttatatcttgggtatcctaggttttgggctaatatccacttatcggtgagtacatattgtgtgagttcctttgtgaatgtgttacctcactcaggatgatgccctccaggtccatccatttggctaggaatttcataaattcattctttttaatagctgagtagtactccattgtgtagatgtaccacattttctgtatccattcctctgttgaggggcatctgggttctttccagcttctggctattataaataaggctgctatgaacatagtggagcatgtgtccttcttaccagttggggcatcttctggatatatgcccaggagaggtattgctggatcctccggtagtactatgtccaattttctgaggaaccgccagacggatttccagagtggttgtacaagcctgcaatcccaccaacaatggaggagtgttcctctttctccacatcctcgccagcatctgctgtcacctgaatttttgatcttagacattctgactggtgtgaggtggaatctcagggttgttttgatttgcatttccctgatgattaaggatgttgaacattttttcaggtgcttctctgccattcggtattcctcaggtgagaattctttgttcagttctgagccccattttttaatggggttatttgattttctgaagtccaccttcttgagttctttatatatgttggaaattagtcccctatctgatttaggataggtaaagatcctttcccaatctgttggtggtttctttgtcttattgacggtgtcttttgccttgcagaaactttggagtttcattaggtcccatttgtcaattctcgatcttacagcacaagccattgctgttctgttcaggaatttttcccctgtgcccatatcttcaaggcttttccccactttctcctctataagtttcagtgtctctggttttatgtgaagttctttgatccatttagatttgaccttagtacaaggagataagtatggatcgattcgcattcttctacacgataacaaccagttgtgccagcaccaattgttgaaaatgctgtctttcttccactggatggttttagctcccttgtcgaagatcaagtgaccataggtgtgtgggttcatttctgggtcttcaattctattccattggtctgcttgtctgtctctataccagtaccatgcagtttttaccacaattgctctgtagtaaagctttaggtctggcatggtgattccaccagaggttcttttatccttgagaagagtttttgctatcctaggttttttgttattccagatgaatttgcaaattgctccttctaattcattgaagaagttggaattttgatggggattgcattgaatctgtagattgcttttggcaagatagccatttttacaatgttgatcctgccaatccatgagcatgggagatctttccttcttctgagatcttctttaatttctttcttcagagacttgaagtttttatcatacagatctttcacttccttagttagagtcacgccgagatattttatattatttgtgactattgagaagggtgttgtttccctaatttctttctcagcctgtttattctttgtgtagagaaaggccattgacttgtttgagttaattttatatccagctacttcaccgaagctgtttatcaggtttaggagttctctggtggaatttttagggtcacttatatatactatcatatcatctgcaaaaagtgatattttggcttcctcctttccaatttgtatccccttgatctccttttgttgtcgaattgctctggctaatacttcaagtactatgttgaaaaggtagggagaaagtgggcagccttgtctagtccctgattttagtgggattgcttccagcttctctccatttactttgatgttggctactggtttgctgtagattgcttttatcatgtttaggtatgggccttgaattcctgatctttccagaacttttatcatgaatgggtgttggatcttgtcaaatgctttttcagcatctatcgagatgatcatgtggtttttgtctttgagtttgtttatataatggattaaattgatggattttcgtatattaaaccatccctgcatccctggaataaaacctacttggtcaggatggatgattgctttaatgtgttcttggattcggttagggagaattttattgaggatttttgcatcgatattcataagagaaattggtctgaagttctctatctttgttggatctttctgtggtttaggtatcagagtaatagtggcttcataaaatgagttgggtagagtactttctacttctattttgtgaaaaagtttgtgcagaactggaattagatcctctttgaaggtctgatagaactctgcactaaacccgtctggtcctgggctttttttggctgggagactatttataactgcttctatttctttaggggatatgggactgtttagaaggtcaacttgatcctgattcaactttggtacctggtatctgtccagaaatttgtccatttcgtccaggttatccagttttgttgagtatagccttttgtagaaggatctgatggtgttttggatttcttcaggatctgttgttatgtctcccttttcagttctgattttgttaattaggattttgtctctgtgccctctagtgggtctagctaagggtttatctatcttgttgattttctcaaagaaccaactcctcgtttggttaattctttgaatagttcttcttgtttccacttggttgatttcacccctgagtttgattatttcctgccgtctactcctcttgggtaaatttgcttcctttttttctagagcttttagatgtgatgtcaagctgctagtatgtgctctctcccgtttcttcttggaggcactcagagctatgagtttccctcttagaaatgctttcattgtgtcccaaaggtttgggtacgttgtggcttcattttcattaaactctaaaaagtctttaatttctttctttattccttccttgaccaaggtagcattgagaagagtgttgttcagtttccacgtgagtgttggctttctgttattttttttgttattgaagatcagccttagtgcatggtgatctgatagaatacatgggacaatttcaatatttttgaatctgttgaggcctgttttgtgacctattatgtggtcagttttggagaaggtaccatgaggtgctgagaagaaggtatatccttttgttttaggataaaatgttctgtagatatctgtcagatccatttgtttcatcacttctgttagtttcagtgtgtccctgtttagtttctgtttccatgatctgtccattggtgaaagtggtgtgttgaggtctcccactattattgtgtgaggtgcaatgtgtgctttgagctttactaaagtttctttaatgaatgtggctgcccttgtatttggagcatagatattcagaattgagagttcctcttggaggattttacctttgatgagaacgaagtgcccctccttgtcttttttgatgactttgggttggaagtcaatcttatcagatattaggatggctactccagcttgtttcttcataccatttgcttggaaaattgttttccagccttttattctgaggtagtgtctatctttttctctgagatgtgtctcctgtaaacagcaaaatgttgggtcttgtttgtgtagccagtttgttagtctatgtctttttattggggagttgagaccattgatgttaagagatattaaggaaaagtaattgttgcttcctgttatttttgttgttaaagttggcattctgttcttgtggctgtcttcttttaggtttgttgagggattaccttcttgttttttctagggcattgttcccgttcttgtattggtttttttctgttattaacctttgaagggctggattcgtggagagataatgtgtgaatttggttttgtcgtggaatactttggtttctccatctatggtaattgagagtttggctgggtatagtagcctgggctggaatttgtgttctcttaatgtctgtataacatctgtccaggctcttctggctttcatagtctctggtgaaaaatctggtgtaattctgataggcttgcctttgtatgttacttgacctttttcccttactgcttttagtattctatctttatttagtgcatttgttgttctgattattatgtgtcgggaggaatttcttttctggtccagtctatttggagttctgtaggcttcttgtatgttcataggtatctctttctttatatttgggaagttttcttcaataattttgttgaagatgtttgctggtcctttgagttgaaaatcttcattctcatccactcctattattcgtaggtttggtcttctcattgtgtcctggatttcctggatattttgagttaggatctttttgcattttccattttctttgattgttgtgccgatgttctctatggaatcttctgcacctgagattctctcttccatctcttgtattctgttgctgatgctcaaatctatggttccagatttctttcctagggtttctatctccagtgttgcctcactttgagttttctttattgtttctacttccctttttaggtctagtatagctttgttcatttccatcacctgtttgtatgttttttcctctttttctgtaaggacttctacctgtttgattgtgttttcctgtttttctttaaggacttgtaactctttagcagtgttctcctgtatttctttaagtgatttattaaagtccttcttgatgtcctctaccatcatcatgagatatgcttttaaatctaggtctaggttttcgggtgtgttggggtgccctggactgggcgaagtgggagtgctgggttctgatgatggtgagtggtcttggttcctgttagtaggattcctacgtttacctttcgccatctggtaatctctggagttagtagttatagttgactctgtttagagattgttcttctggtgattctgttaccgtctctcagcagacctgggagacagattctctcctccgagtttcagtgctcagagcactctctgctggcaagctctcttacagggaaggtgcgcagatatcttgtttttggacctcctcctggtcgaagaagaaggcccaaaacagggcctatctcagaagctgtgttgctttggcagttcccagaagctgtcagcttctgtggtgcagactctcacctgtgcagactaaattcctaagttccagggagtcctgggaccaagatggctaccgctgctcctgaggctgaggccgcctcccgagccaggcagacacctgtcctctggtctggacggtggccggctgtctgcagcctgcaaagggtactgcctcagcggctctgtgcttccgcctgtcccagaagctgtccggttctctggcacaccctataacctgttcagactaatttcctaagttctgctgagtcccggaaccaagatggcgaccgctgctgctgaggctgaggcagcctcccaagccaggcggacacctgtcctctggtccggatggtggccggctgtctgcggcccaccaagggtgctgcctcagcggctctgtgcttccgcccgtcccagacctgtccaagtttctatgaggaattttgtctcacagatacacaagacaaaacatatattttgtctgtgtgaaaactgggggtttctccttaagaaagcagagattagcctgtctagattgggtattttaccatatgtgtgcagtgcttgcagaagccagaagagagtgtctgatttcctggaatcagttgttgaaggttgtgagccactgtgtaggtgctgggaatccgacccagatactttgtaagatccatggagctatctctgcagcccatctggcttcattctttgttttatttttttattgaactcgaccagctctgtcatgctccaggcaaactcctttgctccaatacctgtttttggtgatcacaacacctatagttttccatattcctctggctcctccagtcatccagcagcacttcagaacctgctgtggacttctaagccgagtgtcacgtcatacatacattcagtgctccacgctcccacatctaggatatagccctgttttcacagatgagaaagccaagctggagagtaacacagccaaaactggtgcagagaaccatccctggaccttgtgatttcttcacagcattctttacacaattccaggagtgtcacaagccagagtctttcctgaggatcgcatggaggatgtaagggataagagtgtgagttctggagctccgtttagattgctggagtaagattctcaactccactatcgataaactaggtaagagtggggaaggtccttaactttctcaaatctctcatcctcaaacatggaaaaaagttaatgcatcataagaatcaatgatgtgtgtgcatcacgagcatactaaaaagcatttatatagacagcatgtagcactcagcatagttccctaatagtgtagatgccaaaaatgaggaaaaaaatgtaagcaagtagaaagtatttcattacagaatagtatttaagtgatgtagaaatgacaagaaaactcaagttactgtatgcatatatgcttatgtgcctatgtatatatctatagtacacttaacccatatatatttacatatatatttatagtaaacttaatacacatctatatgtaaattttatgtagtggatttggccagaagggagtagtacaatatatatttaaagcaattaaatgagcaaacgaatgctttattataatatgccagagtgaaagtagcagcaattacataacctctatgctggcacatatttctgcttcagccaacttctcaggtatcaaaaggcaaaagtttagaaggcttaagaacatttacatgtttaacatgactttattgcttaatatgtttatgtagtacttgtttaatattgttttctgtaatattatataaaatataattgctattatttattttaaaagattgtttgtatgtttacacttgcttacttttacttttctactgctagcataacatttatgtgatacaagcttccaaagataggaaactctgtctgtttttctcaagcacaagaaacactgccctctagagtaggggctcaagtgaatggcgctgagtgaatggatgtctgtataagaagtttatgcctccaccattgtttaatttgctagactaggtagccttgtttatccaactctgaaaaatagcaaatgcaaatcttaggtgtttgagatccaactttattagcatccagtacaaagaaaagttggtaagttgaggactgagaggccatttgacattttaaggtagtagttctcagctttcctaatgctgcactcgtttaatacagttcctctcgtggtggtggtgacctccaaacataaacttatttttgttgctacctcataactgtgattttggtattgctaggaatcataatgtaaatatctgtgttttctaatggtcttaggtgaaagggtaattcagtccccaaggggtcatgactcacaggttgagagccactgtctaagggatttaggctggaaactctcaggagtgatacacaggtgatgacagcttttggaaaacaagtgtggaagcagtaacatgtcactcaatacaaccactccgaagaaggaggagctggacccccaaagttactatgcatctgcttgctataggaaaacagtctttgcccacctacttgttttctagccatgaaacttctattatttctaaataagaaaagttaaaggtcaggagaaatggatgtgtgtgagtgccagactgctggtgttcagatcctatttggtacaaagttattctcccttgaaataatgcgtcttacttcccagatgcaaaatttctcatctgattcttccatcacttttatttctctaccctgtctgtctgtctgtctacccacgcatcatacatctatatttataactatctaatctaacctagtcttatctgtgcatatccatataactacatttatatctatctatgtctatttcctgatgttttacattttaaaacttccaaaccaggtaagtctcatctatattcaaactatttctaacattatttcatttgctcttcaacttttgttggctacatgtgttaggacaaggccacaaacctcttcaccagagttctctcatcttaaagacatattaatcatagaacccaccctgctgagttgttgtaccaagcacactgacatagatatgtgttcagaatgtgaccagtgcatacagagagctaaatacttgctattaaagtatttaatatgactattaaagaaacatgaaatataaagcatatcacatgcttactttgaaagtcaagtttgctgaaaattttgttcttggagggaagtgctacttttatagttattttatatgtctagacatataatatatcatcgtctagatatgtgaagtacatcctttaattagcagatcatcaagctgtgacacacacttccacttttgctgacccgctgaatgtcttggtgatggacacagtattcctgatcagctgtgttgttaaatggctggtacccaggcaggcctccagctttagaatcatgcaagtcttgcatgatgtaatacatcttcttttcctgatgtaaattcctcttcttagctacttcttccatgatattaattttttgtctgtttttttctcatacatatttccatatgtatgtgtgtgtatttccttgtctgatttaaaaagaaaatttaaacttcaaatatgagtaacacttggctgctttcaacaaacactcatttgctctccacagaattcacccctcaatccttatacagctcagatcccacatttcattatttgaatacgtttttgacagtcctttaagcatccttggtccttgcttattgtatttatttattattaaattcattctttgacatattcatacatgtatatagcagtattctgactactcaatccccttattcccatacctctcttccacctccatcaaccctatatccttctcacaagtcactttccatatcttctatgtgtctctgttttgttttgagagtcttttaaccagggccccctgtgtgtctgtgggtttggaactctccagtagagcccaggatgcttaccagtatttacttgactgatggcagtgactccccatttccaaatactcataagtggtcactagttcagtgagaggaagggagggcaggggccattgagcccctccaccacccatgattggctattggtaggcttattattacagaagagtttgtataaatgatttgcttccagctgagtcttctgctactttatcatactatatagagaaactcatattagtagatgacatctaatagaagcgttcttagtattctaaccttagcacctaagcccgggtgtttgaactgtgaatctgtatactcatcctttcccctcaaagatgtcctcagtggagagagcctgacaattatcccttggtatatataccaattcattcttcactttcatgacttttaaactttacctcatctaacagttcaatattttgattctgtttgtgccctccatcttggggctgacttacagaacccatcacattggaaggctccttactgtcactggctacctgcagcaactgcatcatcctctcattctgtggtgtggagaacctacctttgtagtaactacaaaggtgtagttcaccacctctggctctacactctttctgcctccccttccacaatgatttctgaccctttggagggatgtgtggcatatatgttccatttatggctggacattcacaatctcttattctctgcaccttagctggttgtgggtctcgatattaatcaccatttactgcaaacagaagcttctctgaagagatgtcttcatccatgagcaactggcaattcctagctgatgggagaggaagagtcagtttagccattgtagagtgtagcccctgatgctccagtggataaccacacatccagggaaaattgggcagcacaatttggcctggataggaacaaaagtgcaccaagcagggtgagaagggaaggaggtatgaatctgggaagagctgggggagggacaattctcaaagaattaattttacatatgggtctttgtaaacagctattgccacacatatttctttaaaagagtgaagtcactggttccagctggtctggaactgactaagggtctggcctttgtcagacccttccctaatgttaagctgcctctggcagagagctgtcaatcaacagcctcttctctgatgatgagtgctctatgtgttatggactcctcttgcatctgaatgctctcataacacttgtggacacactactccacctgcaaggaacattgtattgaagccacgacccctgtttctttgtctccagtcatgaaggaaacatcactcaggaaaagacaagagtgccattttggtaatcctgatcgatctgcactcccagcagctgttcttccttgggcatggtggaagggcttaattgatgcctccagtcctgtgactagtgaaagtggaaattgggcagtgattggtggaaataacattgcttcatttgcatgtcacactactttcctggatataatatttggttcacttttcaagtcagcccggggctaccctcttatgccatacccttgttttgtaatagtaggctccatcaagcagtttctgttagaatgatcttttcttgtccacttgtgatctttatcatgggtagaacatgctgagttgataacacaaagaggaggggccatagtagagaacacaaagatttacagggagtaaccagaggcagaaacaggaggaactgaagcaagctgagatgacacagaatgatggaagaaagcaagaagaactcagaagccaagactatggaaggctgtgaaaagttaaaggttatgaaagactatgggccccagttgctgaggtccagggagacagcaaaccataaagggccaaagtaaccaagatctataatgatagatgctattaggagcctcaatatctgaaagccaaaaatctggttctttgtccattagtgtcaacatttgtgactgctaagagccattgatttctggtcactgagtatgaggctactgacactggaaagtcagagccattaagcccctggcttgagtacctagaactataagtccattcccttgggtccatattcctctatttttcaggactaagagaaataagtctctggattaattagtccagtccactgccccttggccttcaaagacccagaatttcctgtgctgaagaaactaccctttgcttttccatggcctccatctgcatagagtaaagaaagctcaggatttgggaagatcagtagacaccaagaaaggggagagagaggtgatgaagcaggatagacttaggcaaaggggcacatgggacatacacaaagaagcaaagagactgaagtgctcgcaaggagtcaaggggagtgggaggagaaggggagggggaaggagactctattaaaacaccccttgtccaaaatgccatattgagagactgtttcacagcagacttcctggtattgtggctcttagcaatcctaccatcccctcttccaccttgttctccaagccataaatgctgtgtatccactgggcttgagaacactcaggagctattgatctctgcattgtgctcaggtgtgtttctttgtagtggccatcacttgctttaaagataagcttcttcgatgagaggtggtagctatttggtgattgtaagtgtacgattcaaaatgtggttaggaattatgctagccttgtaaagtaatagggtcagttctcttctaagatccatgacctcaccattcctgaaaacttggctgggtttctaatactaggcatgatttctcccatgttgaatggggctaagtccagttaggcagcttgggttaccaccaacagtcagtgccatttacttcacctttatggatatcttgccattgttgtggttcataagtgtcacagatgggtaggactattaaatgcttccatctcttagtaccttgtgcagtattttctggtaccatggctacatgaacaagatgggaacagtagcagtatgaatttacatgttaatatggaagaggggaaatctcatgagatcctactcctagacaaagaattagcttttctcatggatgaaccccataattggttagccatacaaagtgatcagtcctgaaaccatatacacacaaataaccaaataagactaatcaggttgttcacacacacacacacacacacacacacacacacacacacacacatcatatatgtaacaacagtaatacagaagagactatccatttgagagtgggaggggatatgggaaaagttagacagaggggtcctctgagggactgttgtaaggaaagggagagagatgtaactatattttaaagatgtattaaaaacaactcccttaattctatagtgatacttgtagaggaattttaattcagcaatatgactggtctggaaagggattacatccaaataccttctaggtctgcataaactggctggaatgcagacatgccattgattacaatatgatctggctagaatacagatacactcttaatgcacacctttaatcctaaacaatgaaagtacagttagtttatagaaggaagcagccattttggtttgaaagtgacatgtaactgaggggaagacaaagtgacaaatcagagaaagatttgatgaatgagtcagagataggatgcacccagctctcatgagaacagcacaggaaggagaagtgacttaagagagctgcatagagagagggagagagagacagttcagttgaatgtggttaggtatggtacagttcagagtagggtagagttgagttccgttcagtcagtacagtggagttcagttcgtttgtgagttcatgcagttccatgtagatcagcagaggcagttttactgggacagttttacagagacaggttgtaggcaaagacagaacaagccagaagattacaacagatttccagagttagtttgaggtcaagcacagcaattcagtcagaagctaagagaagccagtttgagtgagccagcttggagaggagtttgggccagaacagctttctgagttgaaccagccagctaaagtttagaaagaacttgaaaggctgagcttattcagtagtaagccttggagatgacaattttaacaagtgaataaaagtttcttttaagatacttaatactgtgtatgataacttataaaataaaatattaataaaaatataaatatcagtcaactgattggtaacaatattaatgtataaaataatgtgggctccaacaagcatgattggatcagtggtttctgaagaacatgggaagatgacccaggaattccagtggttggtcactgtaaaaaatccccatctaagaaacatcaagcttgccagtgtctgtcagatcacttcagccaaccaatatcagaccctaacaaatgcaaaaagatacccaaagaggcttgtgttgcccatgacattttattgtggaaaagataactagaatagaaggatccttttttttttattagatattttctttatttatatttcaaatgttatcccctttcctagtttcctctcctctctccccctgctccccaacccacccattcctgcttcctggcccaggcattcccctatactgggggcatcgaaccttcacaggacctagggcctgtcctcccattgatgactgactaggcaatcctctgctacatgtgcagctagagccatgagtcccaccatgtgttttctttgagtggtggtttagtcccagggagctctggggttactggttagttcatattgttcctcctagggggctgcaaaccccttcagcttcttgggtactttctctagctccttcctttggggaacctgtgctctgtctaatggatgactatgagcatccacttctgtattagtcaggcacaggcagagcctctcaggagacagctatatcaggatcccgacagcaagctcttgttggcatctgcaataatgtctgggtgtggtggtggtttatgggatggatcctcaggtggggcagtttctggatggtccttccttcagtctctgctccaaactttgtctctgtaactccttccatgggtattttgtccctccttctaggaaggatcaaagtatccacactttggtcttccttcttcttgagttgaatagaaggtttctaatgctaagagcattgcagagttagttttcaacccttttgtctttcctttattgcagtaatggtaagcagttggcagggaggcactgacagaaaatccagtgactgttggccttgagcttaggaacaaattccaaatataacactaaagagatttgcactccgggcagcaaaataacagctttgtaagaaattttttttttccaagaagatttactacatgaaattgtactagtgattctttatgcctgttattgcgtagtagcataatctgggatgttgtcatatataggaggagctgagggagactctcgcatcaaggggttggccacatacacagctggagcaaccgggacagactagaaagggtaagagaaaacaagcagagttgttacacagtccaatcactcttcctggtcccagcagagtggagggcagagagctcagtagtcagctcacagtggggtttggcagacactcaagcccacccttctccagcatgttttacaaagaagagaatcaacttactctgttgcatcggaggataccttggtgtgcaaagtaggccatggcccctgctatgctgaattccaacaaggaaaatattgccagcacacctgcaattcctctcccagaaagctgaaatcaaatatacagaccattaggatgaacaggagggtctcagggtggacttcagaaacacctcggttcattgaaagtgctgttttgctaatgttcaactctgtgagtgatttatatatatatatatatatatatatatatatatatatatatatatatatataacaacaaggagactgttgccaagaaaaaaaaaaccacttacattccattaatccttaacagtctatttgctgaaaggaaaagtcttctgatattttaaagaaaaatcagaagaagtttgtatttctcccaaataagcatttgatgacaatagagaaataaccaggaggtgattgcacacaagcagacaatcttcctgttttagttgtaaaaaagtcacttaagacatggctattatatttatgcagaatttcaaagtggagaaaaaagaaattctgagttctatccattactcctgtcattctgacttcatctatctgcaaatatacttttttcactttgtatcttagcaatcacacccctaggcatagggttggaaatagaactttctcaccagagccactgtatgttaaacaggagatagcaatggatttattctggcagtgaagagagacagttatgtggccaatggcaggacactcaccaccatccagtagtcttgataatagtagccattgatgttcagatcacacagaaacagaatcactccaacaaaggcaaagatggtgctagaaatgtttattatcagggtgctcttcatctgatagaggtaacaagaacagtagtccatataaaagacaaatgaatttaaagggagtgggagtcttttcaagttaatggttcttaatctttgacatcttgttttagttgtgattgtactgagaactgaattcaaggtctgatgcatgctaggcaagtcctgtgcaactgatctatttccctaacatggaacaacattcgcagttaacataatgtctttcttctgcccttcggagtaggtgtgaaaattacaccgtatcctagttgtcagtcccccacccccaagaagctgtaaatattttaaataatagaaatataaaaaacagtatacatgtagcttgaagcagaatgccatccaacacttttatgtaacagctgtgtttacaagagcatctccactagacaactggagagtgtgcagagagtgagagactttggaacacccagttctgcatgggaccccttcatcaacctcttttcaaggctcaggatctatgggcaaggtcttgttatctacctcctctttctcaagacagaaagaacacaaagttgggtgggtagggaggttgggaagatctgggaggagttggcagacggaagagaaaatattcataatatgttttatgaaaaatttaaagtgaaaattgaaaacataactctactttgtaaaaacaataaaagaacaaacttaaggctttaaaaattttatttgattttaatttttttctgggtgttttgcctgcatgcatgtctgtgtaccatgaacaagcagtgcccaaggaagccagaagagagcattgaatcttctcccctaggaattatagagaccatgaatcacggtgtgagtactgagaatgaaactctggtcctctagaagagaattttttttttttttttccattttttattaggtatttcgctcatttacatttgcaatgctataccaaaagtcccccatagccacccaccccctctcccctacccacccactccccttttatggccctggcgttcccctgtactggggcatataaagtttgcgtgtccaatgggcctctctttccagtgatggccgactaggccatcttttgatgcatatgcagctagagtcaagagctccggggtactggttagttcataatgttgttccacctatagggttgcagatccctttagcttctttggtactttctctagctccttcattgggggccatgtgatccatccaatagccgactgtgagcatccacttctatgtttgctaggcccaggcatactctgacaagagacagctatatcagggtcctttcagcataatcttgctagtgtatgcaatggtgtcagcatttggaagctgattatgggatggatccccggatatggtagtgtctacatggtccatccttttatctcaactccaaactttgtctctgtaactccttccaagggtgttttgctcccacttctaaggaggggcatagtgttcacacttcagtcttcatttttcttgagtttcatgtgtttaggaaattgtatcttatatcttgggtatcttaggttttgggctaatatccacttatcagtgagtacatattgtgtgagttcctttgtgaatgtgttacctcactcaggatgatgccctccaggtccatccatttggccaggaatttcataaattcattctttttaatagctgagtagtactccattgtgtagatgtaccacatcttctgtatccattcctctgttgaggggcatctgggttccttccagcttctggctattataaataaggctgctatgaacatagtggagcatgtgtccttcttaccagttggggcatcttctggatatatgcccaggagaggtattgctggatcctccggtagtactatatccagttttctgaggaaccgccagactgatctccagagtggttgtacaagcctgcaatcccaccaacaatggaggagtgttcctctttctccacatccacgccagcatctgctgtcacctgaatttttgatcttagccattctgactggtgtgaggtggaatctcagggttgttttgatttgcatttccctgatgattaaggatgttgagcattttttcaggtgcttctctgccattcggtattcctcaggtgagaattctttgttcagttctgagccccattttttaatggggtgatttgattttctgaagtccaccttcttgagttctttatatatgttggatattagtcccctatctgatttaggataggtaaagatcctttcccaatctgttggtggtctttttgtcctattgacggtgtcttttgccttgcagaaactttggagtttcattaggtcccatttgtcaattctcgatcttacagagcaagccattgctgttctgttcaggaatctttcccctgtacccatatcttcaaggcttttccccactttctcctctataagtttcagtgtctctggttttatgtgaagttccttgatccacttagatttgaccttagtacaaggagataagtatggatcgattcgcattcttctacatgataacaaccagttgtgccagcaccaattgttgaaaatgctgtctttcttccactggatggttttagctcccttgtcgaagatcaagtgaccataggtgtgtgggttcatttctgggtcttcaattctattccattggtctacttgtctgtctctataccagtaccatgcagtttttatcacaattgccctgtagtaaagctttaggtcaggcatggtgattccaccagaggttcttttatccttgagaagagtttttgctatcctaggttttttgttattccagatgaatttgcaaattgctccttctaattcgttgaagaattgagttggaattttgatggggattgcattgaatctgtagattgcttttggcaagatagccatttttacaatgttgatcctgccaatccatgagcatgggagatctttccatcttctgagatcttctttaatttctttcttcagagacttgaagtttttatcatacagatcttttacttccttagttagagtcacgccgagatattttatattatttgtgactattgagaacggtgttgtttccctaatttctttctcagcctgtttattctttgtgtagagaaaggccattgacttgtttgagttaattttatatccagctacttcaccaaagctgtttatcaggtttaggagttctctggtggaatttttagggtcacttatatatactatcatatcatctgcaaaaagtgatattttgacttcctcttttccaatttgtatccccttgatctccttttgttgtcgaattgctctggctaatacttcaagtactatgttgaaaaggtagggagaaagtgggcagccttgtctagtccctgattttagtgggattgcttccagcttctctccatttactttgatgttggctactggtttgctgtagattgcttttattatgtttaggtatgggccttgaattcctgatctttccaaaacttttatcatgaatgggtgttggatcttgtcaaatgctttttctgcatctaacgagatgatcatgtggtttttgtctttgagtttgtttatataatggattacattgatggattttcgtatattaaaccatccctgcatccctggaataaaacctacttggtcaggatggatgatttctttaatgtgttcttggattcggttagcgagaattttattaaggatttttgcatcgatattcataagagaaattggtctgaagttctctatctttgttggatctttctgtggtttaggtatcagagtaatagtggcttcataaaatgagttgggtagagtaccttctacttctatcttgtgaaatagtttgtgcagaactggaattagatcttctttgaaggtctgatagaactctgcactaaacccatctggtcctgggctttttttggttgggagactattaataactgcttctatttctttaggggatatgggactgtttagaaggtcaacttgatcctgattcaactttggtacctggtatctgtccagaaatttgtccatttcatccaggttttccagttttgttgagtataagcttttgtagaaggatctgatggtgttttggatttcttcaggatctgttgttatgtctcccttttcatttctgattttgttgattaggattttgtccctttgccctctagtgagtctagctaagggtttatctatcttgttgattttctcaaagaaccaactcctcgtttggttaattctttgaatagttcttcttgtttccacttggttaatttcacccctgagtttgattatttcctgccgtctactcctcttgggtgaatttgcttcctttttttctagagcttttagatgtgttgtcaagctgctagtatgtgctctctcccgtttcttcttggaggtactcagagctatgagtttccctcttagaaatgctttcattgtgtcccaaaggtttgggtacgttgtggcttcattttcattaaactctaaaaagtctttaatttctttctttattccttccttgaccaaggtatcattgagaagagtgttgttcagtttccacgtgaatgttggctttccattcttaatgttgttattgaagatcagtcttaggccatggtggtctgataggatacatgggacaatttcaatatttttgtatctgttgaggcttattttgtgaccaattatatggtcaattttggagcaggtcccgtgaggtgctgagaagaaggtatatccttttgttttaggattaaatattctgtagatatctgtcaggtccatttgtttcataacttctgttagtttcactgtgtccctgtttagtttctgtttccacgatctgtccattgatgaaagtggtgtgttgaggtctcccactattattgtgtgaggtgcaatgtgtgctttgagctttactaaagtgtctttaatgaatgtggctgcccttgcatttggagcgtagatattcagaattgagagttcctcttggaggattttacctttgatgagtatgaagtgtccctccttgtcttttttgataactttgggttggaagtcgattttatccgatattagaatggctactccagcctgtttcttcagaccatttgcttggaaaattgttttccagcctttcactctgaggtagtgtctgtctttttccctgagatgggtttcctgtaagcagcagaatgttgggtcctgtttgtgtagccagtctgttagtctatgtctttttattggggaattgagtccattgatattaagagatattaaggaaaggtaattgttgcttcctgttatttttgttgttaaagttggcattctgttcttgtggttgtcttcttttaggtttgttgatggattatcttcttgttttttctagggcgtggttcccgtccttgtattgttttttttctgttattatcctttgaagggctggattcgtggagagataatgggtgaatttagttttgtcgtggaatactttggtttctccatctatggtaattgagagtttggctgggtatagtagcctgggctggcatttatgttctcttagtgtctgtataacatctgaccaggctcttctggctttcatagtctctggtgaaaaatctggtgtaattctgataggcttgcctttatatgttacttgacctttttcccttactgcttttagtattctatctttatttagtgcatttggtgttctgattattatgtgtcgggaggaatttcttttctggtccagtctatttggagttctgtaggcttcttgtatgttcatgggcatctctttctttagatttgggaagttttcttcaataattttgttgaagatgtttgctggtcctttgagttgaaaatcttcattctcatccactcctattatccgtaggtttggtcttctcattgtgtcctggatttcctggatgttttgagttaggatctttttgcattttccattttctttgattgttgtgccgatgttctctatggagtcttctgcacctgagattctctcttccatctcttgtattctgttgctgatgctggcatctatggttccagatttctttcctagggtttctatctccagcgtcgcctcactttgggttttctttattgtgtctacttccctttttaggtctagtatggttttgttcatttccatcacctgtttggatgtgttttcctgtttttctataaggacttctacctgtttggttgtgttttcctgtttttctttaaggacttgtaactctttagcagtgttttcctgtttttctttaaggacttgtaactctttagcagtgttctcctgtatttctttaagtgagttgttgaattccttctttatgtcctctaccatcatcatgagatatgcttttaaatccaggtctaccttttcaggtgtgttagggtgtcctggattgggcgaagtgggcgttctgggttctgatgatggtgagtggtcctggcttctgttagtaggattcttacgtttacctttcgccatctggcaatctctggagttagttgttatagttgtctttgttaaaagattgttcctctgttgattttgttaccctctatcagcaggcgtgggagacaagctctcttctctgagtttcagtggtcagagcagtctctgtaggcaagctctcctctctcagggaaggtgtacagttatctggtgtttggacctcctcctggctgaaggtgaaggcccaaaacagaatctttcccagaagctgtgttgctttggccaggaaggtggccagttgtctggagtcgaagatgtcgcagcctcagaagctctgtggctcttgccgggaaggtggctggttgtctggagctgaggatggtgccgccccagaatctctgcgactctctcgcccgtcccagaaacggctggcactctgtattccacacggtcacccgtgcagcctgccctccgcggagtcccggagccaagaaggctcccgccggcgcctgtgccacaaacctctcaggccaggcagacccccgtgctctcaccaggaaggtggccggctgtctggagctgaagatggcgccgcccagaagctctgcgactctctcgcccgtcccagaaacagctggcactctgtattccacacggtcacccgtgcagcctgccctccgcggagtcccggagccaagaaggctcccgccggcgcctgtgccacaaacctctcaggccaggtagacccccgtgctctcaccaggaaggtggccggctgtctggagctgaagatggcgccgcccagaagctctgcgactctctcgcccgtcccagaaacagctggcactctgtattccacacggtcacccgtgcagcctgccctccacggagtcccggagccaagaaggctcccgccggcgcctgtgccacaaacctctcaggccaggcagaccccgtgctctcaccaggaaggtggccggctgtctggagctaaagatggcgccgcccagaagctctgcgactctctcgcccgtcccagaaacagctggcactctgtattccacacggtcacccgtgcagcctgccctccgcggagtcccggagccaagaaggctcccgccggcgcctgtgccacaaacctctcaggccaggcagacccccgtgctctcaccaggaaggtggccggctgtctggagctgaagatggcgccgcccagaactagaagagaatttaagtctactcttaactaatcatccatcttgacaactgcaagaacaaacttttaattggcaatctgtgatagatattttgttatatacttaaaatgatgtattttttttaactcttgcggccaccacacatgagatggtcctagtatctgactttatatgtctctttctacacagcctctgaggggtgggacctatatagagaaagatgctctgttttgttttggattacagtagatgcacctaattggactaggctgattttaattctagcataatccactgttttatcttgagagcatgcaaagtatgctcccatgttcctatctccctctgcctttgttcctgtgcataacctcatataattttgagaccatttctgatctaggtttatgcaaaacaatgtctttctcctggtttgccattgaattaggaaattacaacaaggggtgtgctgtgtggctgggagagtcaaagcccagtctctgtagttatttctgtgtgctcttcttatgctctaaactggtcactctcatggcaatttaatgaagtggcaacagagacagtctgagtaacagtaggagttacacaccagtgaaaagtgaaaatacaagatggagcagaggaatggcagtgaacaccaggactttattattgaagtggctcataggtgttgtttttttggctcctggattcttccttggttttccctgcatgccatgtgacttaacagaaccagggagccaacaggtaaaagcttaaatgcttggtttttctgattcccactcttgcactttcaggagcctgaatgtggtgctctgcttttcccagtagcaaactgaatgctctgttcccttgctccagcacaggcactacccagcaactggcagatattttgagaaagaacttcctcccgtccacactcttccaatctaccagctcaagttttccttgctagtaaatcaaaccaatctttagaggaatttaagaagtagacataagttttctagcttaccagacagtgagagaactccttgaacgctgatatggaaagtgagccggaagcaatgaactgtagacatagacaaatctgtgaatggtaggttctctgcttgtgcctgggaatgtctctttgtacaagagggtggtccagttatgtttgcttgtttccgtcacatacagctcagtattttttctttagattaacttttggggatacatctccaattccccaccctcattttcttgaatgtaaagaactcagtgacagatgactccgagtttgtatgtgcgactgagcctcctgctcaacttcatcttattttcagcctcatcctgtcaatggtatatctttgtcatgttcgatcatccctttcaagaccctccagccaacacactggttctgcattagggatgagtttaagttgcagtggaggtaagcctgaattgggagtgatgggccccctttcttcaatcagagccattatttctaaaaaccctctagccattagacacagaacttttcaagaaccttgctgtgaacagcctggggacacccatcctgcacagggagaggtgttctagcaatctactcacaaagactccaccccagaatggatatccaccaataaaagcaacagaggaaaacgcccaagtcatattgtatgaggtgctcagcaacccgagaacaactccaaagccgatgtgcatcaatccaattgtgatttggactccctaaaaaagaaagccaaggggcattttaaaataactgtcacaaccaaagttattcctgtttatttactgtccatgtgatccacgagaattcacctaaacagtgaatattttgatgtatactgaaacagcaggggaggaagggcctcaggtaaaacctttgaggagctagtgagatggttccgtgggtaaggacatatgttgtctagtctgatgaccagtgtgtgatactcagaccccgtatgttggaaagaactgagtctttcaaattgccctctgatctccatgtatgtgtgcatgtatgtatgcatgcatgcatgcatgcacgaactcatgctcacgcgtgtgagtgtgcgcgcacgcacacacacagatacacacagacacacaaacatacacatgtatacacataataaacattttaataaattttgtttgatttctgaatgaactacaaagaagtctttagaaagtatgactacttcagcatctcctggtatccccatgagtacatttgtttgtaaagactgctgcgactgaggtgacaggggctgtcttgtataagtaaaacagttctctgtccaggcaatgctagtcacgagaaaaggaatcgatggaaatgaagtcactcctagaatattagtcacatgcctgataacactctgtcactgttccaccaactagatggagacataaaaccataagaaatcaagtggccaagatacagttcacaggactcaaaaaggccaataaggggaagcgcccaagtgaggatgcccgagtcctgcttgggagggagaagaaagcaaccacaagggggaagggagggagggacctggggtggggacaacctcttggagacaggggggcagggaggagatatgggatgtagaacggtctaggagggtggactgggagaggaataaaatatggaatgtaaaaataaaaaaaaaaaagaaaagaaaagatgtaaataaaaaagaacaagaactaggatggtttgattgtttaactctttaagcaccacagtagtggtagccagctaattcctaatgaaaaacaaaaagaaggtaatcaagtgcccaagggtaaacagttataaaggggcagactcccagaatgcataacagcggactatctccaaaacttacttacaatctgtcctttaggactcagcttggttccacccgttcagagttgtcttgatatactagtcaaatggatttgcttttattctttgtggattcttttcacattttaagatgtaaaacccatggcattacttgcttttctatttcatattttttttatttcaaaaaatatttttttattttttgtgcgtggatatgaatgtctgtgcatcacacgtgtgcctggtggtgctcaaggatgtccaaagggcttgagggttggataccctgagactggagttacatgcagttatgagccaccatgtgggttctgagaatgataatgtcttctgcaagagcagtgaatgttcttaactacagcactgtctctccaatcctagtattccttgttgtttttttttttaattgctggtatgcaactgttatcataccaagtaagaggtattttgtcaatgctaagggataaatcttttgctttgtaactcttatcaaaactttctttgtagagtacacatggatttctgagaaacaacagttactatattggtccaaagctcagaaacatctccatagatcattttgtcccaagtttacgattatattttatctacccaggaagactgtagccacagaaacttctgtgtttatttcctcaatgaataggtaccaaataaatttaaattgaattaaaggaaaaataatttcatgaattatgctaaaacaataatatattgttgagatgcactaaaccttgtgaaagctatgaaccttctctttgaacagttcttgtacatccacagattacatcatcctttagacacagcttctgagaggtgatggacccatttttagccaatgttacatctcagatgggacactcctacatctgacttcagatttgttcctgcaattgttatccatgaacaaaatgtggatataagtttcccatccttgctgtcatcttgatgaggagcagctgcagctttaatccccattggcccctgttttctacccatatagccctggctctatacttaattgacactggacattcattaacattggacattcaacttgttctatattttttggttattgtcctagtttcatttctgttgagttcttctccagtttcctctgtgttgctgtgataaaatatcatagccataaagtaacttagggggtgaagtgttcattttcagctcacgatctcagtttagagtccatcactgtagggaagtcaaggcagaaacttcaaagaactaatcatatcacatgagatagacgtgtatgcacacctgctcacttactcatgctcagcttgatttctccactctcatactgcccagaactccctgcctagggaatggtgccacccatggtgggttggatccccccatatcaatgaacttaattaagataacccctcaaagggaaacataatgcagacagtccctcattgaatatctcttctcaggtgattctaggttgtgccagattgacaattaaagctgattatcacaatggaggggacagataatctaccccaaccatctgtggtccctggagtaccatgacaactagggatgtagcttcacaatcttaatagagaggactcagcttctgccaatcattttttttaaagcagaactttatcttttgtttacgtatattttgatcaaataggtcttttctacaaggcagaatgctccaaatggatccttgttccacacaataaaatccaaagctgtctgctccaggggtttcaccaggtatgctccactcctcctctctggccacattcccactggtccttgctttaagccttctgctgtacttttttaaaaattatttttaaatttttttctctgtcatttattgaccttctcctgttcaacaaatgcatcatacacatttcatttgatgacctcatattggtcattttctcttgttctggtatttgtatggcacactttgaactctatgcatttgaaatgcccatcttgatcaacttcaagttgctgtttactgcctgtttcttctcccccttacactctgtatattacttatttacttaatttttaagttagtatgaaaagcactagggttcattatggcatttacagatgaaattattgttctgctctttctcttttcttctcatttatttcccttcatcctcctcatatccatcccccccccccccagaagccacccttcctcaacatcgttttctgttcttgtgatcttctttccaactttattctttcttttactggtagcctcgctctctcacacccacctacatacacacccaaacagtaaaaggtaggatgtgcatatgagagagaacagagatttttgtctttctaagcctggttcacttcattcagtatctatatatatttttttcaccttccaacatattctctagtttgtgtctttattatgtgtacagcccgattttcccagctgggtcataggctccctgcaggcagagactgtgtctggcttgagcttcaagatattttcagcaactgtgtggggttggctttgtgaactatgagtttgcaggaaatgtactccacttggcaggggaagatccaaggagccaccttcccagtgtagattggttgcttgagtggagggtcagatactgttcatttttacttacttgaaacactgtgacttaactagactacccaaagcactagctggtaagatgggcatctattgtctactgacttttgtagctaagattttggagctatacacagcaaggggcatgacataatttggtgggagtgtgtgaagaggtgtggggaaagcttaagtaacgatggtcagttctgtctaagcatgttgagtctttactacaaatcattcgtgctttacaatgctcagagaaacaagaccatgggtgtccagctcaaatcaacttttgtaaatcaaagcaacaaagacatagcatttccaaggatagtttttacactttacactttgctttcctcagacagtttgctagtagtgccattccctttaaaacagttatcaatgattgttttaaagttaatttgtctttatagaaatgtagattaataactgatccaagacaaaagtaaggtttcctaaaaagactttcagaggcaatgagaccaatcaagaagtaattggctctagtcatgtcaccattcctggatcttcctgttagggagagccttctgtcaactcttagacttgtatctgaatctaaaataaatgaacctagggtgactcatacacagattgaccatttctttctgagagagacacagttaacagaatagtccttacatgtgtttgctcattggttgatatgctatttataactggcagatgcataaaagccttgcaaatgcaacattaaaatcctagtggcaaatacacttaccccaagtgctattgctgcatctttaacattgcttattgctgctcctagagctggatttaccgttggcacattttctcgacccagctgtgtgttagggaagattcctggagatgtaatgaaggaaacttgcccagtctgtacttggtttcttacgtttaaaaaattcagaggttgtggaggatgaggagccatggatcttgttggtgggcaaggatttggaatgccacgcgttccagggtaggtagtctgggaagatgtcattatgtcacctaagcagtacaaaacatacagaaataacacatttaccaggaagagaaattaaaggacatcttgtcatcaatttttatgcaaataggagagagagcaagtgagcacatactggctagtgacaagaaatagatgcagtttctaagactaaatattactccagctatttttagtctccaacttgatacttcacttgagtagctttctcaattaaatttctgttagcctgtatctatgctgtaaaaggatagatgttgccattcaaatggccagaataaaggttgaatgatgacaattttcataaagccattgtaagagttcccagcataggtcaagagcttggtgatggcagtgactattgtgttattagaacccatcttatttcttattatcttatttcaaatagaggatgcgtgtccatttggtgaaatgggttgaacttcaaaaggtcaatgccaagagcaaggagacaggagatgggtgtataaagtcagaacaagaattttcctgggctttaaaaagtatagaattaaatgattgttctatgagaggggaaggagagggagggacacacacacacacacacacacacacacacacacacacagtgtgtattttttgtctctgataactttgctagggaaattttaagacttcttatctgtgatctagtttttgaacatggaagtttcacatggaacacagactattaatacctaactctgtaaaacacatctcaggatggatttgtgcccaaactgctgaagttttagaaaatgattagaaaatgacccagttctacattttttggttcatatgaaaatgacctagtatgtagatgtggaagtgatgccagggaaacaggattaagtgatcctccaatcaaaatgaagatccaaactgatccttcaatcaaaatgaggacccaaacagatcctccagtcaaaatgaggatccacataaagggaagacagtcagctcagtgctgagtctattgtcatagttttgtttcttttcttttcttcttcttttttttttttaaaggagttagcacatttttttctcttagcaaatgataagctatttacaaccagcttttttctgaaaaatgagaactaacaaccattttcaagcacacaaacacataaataaaaacaccaaagttctggtgaattataaagcataaggactatagcaataggagaaaaaccagctggtgaactaatccaagtaaagatgggaaaatatgactgtaatttcttaccacctcctttccacctttgtttgaaaagaaggaaaatgatactattgtttagaatgtattatatagcatataatgaaacatcacagtgactcatagacacttccaaccgaatcatgcaggacatatgtctgaaaatatcatctttcagcaaatattaaaaaatgctgacccagtgaagggtgatttcccagtcttcattttccataaagaagcctctttagtgaatcatattcagaaactgtgtgtttcagtgtctctgttatgcgtggaccctcgatcacgacactgtcaccaagggttcctgcttgccggttactattcatggaatttcatacatgtgtatccactatccttagcattagatttacacacatgggtatgtgtctatagattcgcttgaagtgcctttagtagtaattgtcttgtttctctccgggtttctctttcattcgtcaactgtctcaatacagatttaagaattggcttcacctctcccacccagagagtagaatgtggcagcaaacccacccaaacagatcagccccgttccatacccaccgagaaaggcagggtggtttcagtggacctatgcagcttcccagaacctctgggctctctctttctcagctatatgttctgctctgatcttggatatttatctgggatttataagtgcctttacttccttgcttcaagcgagcctatcctatctttatatagttccaaagtcctttcattaagcactttcaccccatttgtaaatttgagaatgcgttgtagtttgtatttatgcagggaagtgtgttctgactcacttatgctgggaagtgacacttccagacacttcttgttcctttctccagccccttagctttctgaccctcactaaagcagtgccacaccacgttctagtgccttttaaaccagacaagtacaactgtaaaacacagacaatgaagaacagaaagaggaggagtaaaagtgcctgcactctggacacctggacactgctactgaggataattcatcaggattcgcaaactttcgtgtgccaggattcgtgttacatacagatgtacatggtgttgtaaagactcaccaaattaaggtagattgtgtaggttttctatactacacccttttaacttaccattttattaatacctttacaggtcaatcaacccttataattctcaatactgttatgttataattttggaggcagtctaactattcatgttcatttgtgtcttagaggtgcaaacaagtgtcctaagaacagagatccaatgtatattcttgccttcaaaagccccatggctgtcaagtttcacatgtggtgagatccattgagcaagtgggatcagtgtcaattcttttcacacacacacacacacacacacacacacacaccactaccaccaccactaccaccaccaccaccactaccaccaccaccaccaccaccaccaccaccacatgaatggttaggaaagaatggtttttgaaaatattgtttttatttattctttgagaatttcatacaatatatgctcatataatatatatggaaaagaatattttattctttttttcctttcccaaatcctctcaggtccccatcacctccccaaccacccgacttcatgttctttctctctctaaaaatggatagccaaccaaccaactgtggagtccaagtaggtcaactactcctgaacatgtggcctgtcctggagtatggtagataccaagggccattcggttgaggaaaacatatttcccttctcctagcagcatcaatcgtgactagcttcctggctaggagtaggactttttaaaagagtttgcttttaaattatctttgtgtattaatggtggtttcctttctcttttggatttgtatttgtatgtattttttctaaagtagacaacatgatgctggagcatttgtgatgttatggaccttagaatgtgacagtttgagtcaatggtcctgctcaaaggatgggcatcattaaaagaacaagaaatcagaattattttagcaggacaaaggactcagggttgttgtctgagaaggaaccctgtggacaccctgattcatttcagctgggtagtaagggagtgaagtggacaatgagcagtgttctttaagtctcctgtcccccctctcctggcctcgtagacttaccttcaggtagagagtctcttcataaggcagcggccaagtgtaagaatacctgtgtaaaatactgaagcattaaggtgactggtgtcaataaacattaagttttgacataaaatgtgtattttctttctgtaaaaacacacagagaaaacttatttatttatttatttattttgctaaactgttgcatggctcaccatacataattctggaacagtctttaggtcaatcaaggtcctaggaattgttttttctacgttagagtagtatcactaaccagcttggaaaagttaccctggtggcagcgtcctgtcactattgttagcacgcgtgaatgctgccacatagctaatgtcactaggagcagacaggactcactgggagactattccagccttactttcgagaagtgagtcacaggaagttcactttctcaggggactacagttagtaagtgctgaagaataaggtctcaggagtacttcctccacatatgtggttagtgtttcattccttacatgggctgctttctgactggagtaatttctgtggaaaagcaagaagctagcctgtaagtgtgcacatacttttggtattttgacacaaacctgtagtagcctgggaagagggaaccctcagctggagaattacctcgatccgattggcctacagccatgtctatgggcctttactttacttttttttttttaattttcaattttagctttatgggtgttttgcatgcatgtgcttgcacattatgagcacgagtgcttgcaggggtcagaagagggcatcatatcccctagggctggagttacagatggttttgagttgtattgtgggtgctgggaattgaacccatatccttcggaagaacagccagtgctcttaacctgtggggcattcttgatttgctaattgatatacaagggctcaacccactatgggcagcaccatccctaggcaggtaggcctggggtgaatgagaaagggagccagggagcaagccagaaagcaatgtttctttatagtctctgctttagtgctcgcctacaggattcttcactgagtttctgccctgactttactcagtaatggactgtaacctaaaaagcaaatatgtactttcctctgctagttggtttcggttagtgttttattacagcaataaagagcaaacagatggccatctcttaacaaggtccataacttacttagtgaaataaggaaactataatacaagtttctgtttcatacatgcatataatgtgttttgattaactctaccccatttcctcctgcccattcccctctcctacagctgtcccttcccaagtccttgaactctttttcaaaccccactgagctcacctagggttgccagtactaatctactggagcagggcagcctctcaggggctgcatacttgaagaagttaggttcttccttttctgcagtcaccaataactaagaacgccttagccaggggtggagatttcctcccctgtccatcctgggattttttaaaaagctggcttgatcttacacacatctgcaggtagccacagctgctgtgagttctgtgcaaagatcctgccacgtgcagaaacaatgttttattggtgactctgccaccaggtgttgccctttatgcttagtcccccctaccacccaaccccacttgttttggatagttatacttcgattgttttctttccttttgcactatcaggaaagttagcttggaatcttggagaggcatggaaatgtttcctcgctgaaaccatgcaacttcagagtgtgacaggtgattgagaactccataataataatatttgtctaatgtgtctaatgtgtctctgtgggataaaaattttggccttaaagtatgagcctgatgaagagtgtgaattccaacacttaaggattagtcatgtgtctagcactggtattaaagagcagagcatatatgcatactcactaaatgtttgctgagttccagctctgtggaggccaaagtccagactttggtaattgaacatagaagaatgtgcctgctacccttctaggctgttttctttaggtccttctcctccccctcttgtctgtctgacaggtttaactatgcagaggacctacctgtccagccttagaatctcatcatcagagtcctctcagttcactagtgatctggcatggaagggtaacagtggcagatgcttttgtgtacattgtgtttatattaggatgagaaatatttctaacatggtaatgactttcattttacttgtaatgtggttgagcttcaaagaagaaaaacctcataactatttaagtacaaaggagtctgatactgctcagcaccaatagcctctagagaatgtgtttcatgaccagatggttgtttcaccatctccattcctgatcaaaatggtagctagtcagaaagtaattaacatcagcactgtgtacatttaaacacttcaactgcagatttttttttccattttttattaggtatttagctcatttacatttccaatgctatactaaaagtcccccatacccacccacccccactcccctacccacccactccccctttttggccctggcgttcccctgtactggggcatacaaagtttacgtgtccaatgggcctctctttccagtgatggccgattaggccatcttttgttacatatgcagctagagtcaagagatccggggtactggttagttcataatgttgttccacctatagggttgcagatccctttagctccttgggttctttctctagctcctccattgggagccctgtgatccatccattagctgactgtgagcatccacttctgtgtttgctaggccctggcataggctcacaagagacagctacatctgggtcctttcaataaaatcttgctagggtatgcaatggtgtcagcgtttggatgctgattatggggtggatccctggatatggcagtctctacatggtccatcctttcatctcagctccaaactttgtctctgtaactccttccatgggtgttttgttcccaattctaaggaggggcatagtgtcgacacttcagtcttcattcttcttgagtttcatgtgtttagcaaattgtaccttatatcttgggaatcctaggtttggggctaatatccacttatcagtgagtacatattgtgtgagttcctttgtgaatgtgttacctcactcaggatgatgccctccaggtccatccatttgcctaggaatttcataaattcattctttttaatagctgagtagtactccattgtgtagatgtaccacattttctgtatccattcctctgttgaggggcatctgggttctttccagcttctggctattataaataaggctgctatgaacatagtggagcatgtgtccttcttaccagttggggcatcttctggataaatgcccaggagaggtattgctggatcctccggtagtactatgtccaattttctgaggaaccgccagactgatttccagagtggttgtacaagcctgcaatcccaccaacaatggaggagtgttcctctttctccacatcctcgccagcttctgctgtcacctgaatttttgatcttagccattctgactggtgtgaggtggaatctcagggttgttttgatttgcatttccctgatgattaaggatgttgaacattttttcaggtgcttctctgccattcggtattcttcaggtgagaattctttgttcagttctgagccccattttttaatggggttgttcaattttctgaagtccaccttcttgagttctttatatatgttggatattagtcccctatctgatttaggataggtaaagatcctttcccaatctgttggtggtctttttgtcttgttgacggtgtcttttgccttgcagaaactttggagtttcattaggtcccatttgtcaattctcgatcttacagcacttattgctgttctgttcaggaatttttcccctgtgcccatatcttcaaggcttttccccactttctcctctataagtttcagtgtctctggttttatgtgaagttctttgatccacttagatttgaccttagtacaaggagataagtatggatcgattcgcattcttctacatgataacaaccagttgtgccagcaccaattgttgaaaatgctgtctttcttccactggatggttttagctcccttgtcgaagatcaagtgaccataggtgtgtgggttcatttctgggtcttcaattctattccattggtctacttgtctgtttctataccagtaccatgcagtttttatcacaattgctctgtagtaaagctttaggtctggcatggtgattccaccagaggttcttttatccttgagaagactttttgctatcctaggttttttgttattccagatgaatttgcaaattgctccttctaattcgttgaagaattgagttggaattttgatggggattgcattgaatctgtagattgcttttggcaagatagccatttttacaatgttgatcctgccaatccatgagcatgggagatctttccatcttctgagatcttctttaatttctttcttcagagatttgaagtttttatcatacagatctttcacctccttagttagagttacgccaagatattttatactatttgtgactattgagaagggtgttgtttccctaatttctttctcagcctgtttattctttgtatagagaaaggccattgacttgtttgagtttattttatatccagctacttcaccgaagctgcttatcaggtttaggagttctctggtagaatttttagggtcacttatatatactatcatatcatctgcaaaaagtgatattttgacttcctcttttccaatttgtatccccttgatcttcttttgttgtcgaattgctctggctaatacttcaagtactatgttgaaaaggtagggagaaagtgggcagccttgtctagtccctgattttagtgggattgcttccagcttctctccatttactttgatgttggctactggtttgctgtagattgcttttatcatgtttaggtattggccttgaattcctgatctttccagaacttttatcatgaatgggtgttggatcttgtcaaatgctttttctgcatctaacgagatgatcatgtggtttttgtctttgagtttgtttatataatggattacattgatggattttcgtatattaaaccatccctgcattcctggaataaaacctacttggtcaggatggatgattgctttaatatgttcttggattcggttagcaagaattttattgaggatttttgcatcgatattcataagagaaattggtctgaagttttctatctttgttgaatctttctgtggtttaggtatcagagtaatagtggcttcataaaatgagttgggtagagtaccttctacttctattttgtgaaatagtttgtgcagaactggaattagatcttctttgaaggtctgatagaactctgcactaaacccgtctggtcctgggctttttttggctgggagactattaataactgcttctatttctttaggtgatatgggactgtttagatggtcaacttgatcctgactcaactttggtacctggtatctgtccagaaatttgtccatttcgtccaggttttccagttttgttgagtataaccttttgtagaaggatctaatggtgttttggatttcttcaggatctgttgttatgtctcccttttcatttctgattttgttaattaggattttgtccctgtgccctttagtaagtctagctaagggtttatctatcttgttgattttcaactgcagattttcttaacaccagtcttcatgtacctgttcagattaaatggatccaaaatgagattttaaatttcatttctagttgaaggaaagcatcttgcattttcagaatcactagattattctgacagataaagcataggagagtagaagtctgtgagtaaaaaatcaaaaacaagtctgtgagtagcatccaggcaaattccacagctattcaatagagctactgaaataacagagtaatacactttatctatacacttctgcatgatctttgtacacagtattgggtttcctaaggataatttattttaaacagatcacttacttagaccatatatacccctactccctccctaattcttctctcccctaccactttccactagacagtctctctctctccctctctctctctctctctctctctctctctctctctctctctctctctcggtgtatgaatgaatggttttgtgtatctatgtaaaatatagggtttacaaatgagaaaaagacagcgtttttctttctgaatctgagttacctgacttatccatttatttgctgataaacacccaagttaaactctaacttggttcctatgaacgctgcttccctgaacctggggaaagcagaagagtgtccaggagcttcttgtattgttttaaatggcaatacatgaacttaaatttatttccataaaataaaatcaaaagcagtggaaaatccagacagatatgaggtcatacattagaggattaaaaagaggagaccacatgaagctcaagaagaaggaagaacaaaacgtgagtgcttcagttcttcttagaaagaggaacaaaataaccatgggagcaaatatggagacaaagtgtggagcagagactgaaggaaaggccatccaaatactgccccacttggggatccatcccatatacagtcatcaaacccagacactattgtggatgtcaagaagtgcatgctgacaggagcctgatatagctgtcacctgagaggctctgccagagcctgacaaatacagagttggatgctcacagccaaccattggactgagctcgggtccccaatggggtccccaatggaggagttagaaaaaggactgaagtagctgaaggggtttgcaaccctatagaaagaaaaataatattaaccaaccagaccccctcgcgccccccaccccctgcagagctcccagggaataaccatcaaccaaggagtacacatggagggacccatggctccagctgcgtatgtaacagagcatgaccttgtgggtatcagtgggaggaaaggcccttggtcctgtgaaggctcaatgccccagtgtaggggaattcaagggcagggaggcgggagtgggtgggtgggggaataccctcatagaaacaggggaaggggggatgggataggggattcctggggtgggggaccgggaaaggggacaacatttgaaatgtagataaagaaaatatccaataaaaaactagtgtttgaaaagagaagtacccatgaaggtgaagaatattatagaatctaatgcagacattttgtttctgattcctgattctcctccgcttccttgcaccccagagccaactggctaacctccaggaaatagagaaatatcaatatcttcctcaaagagtggttgtaagggtgaaatggggtgagtgtataatacactcagtgtgcttgctgcctagagaggatgccaagatgctgcattattgcaggagaaaacaatcttctatttttaaaacaaatctcaatcatttggttttatcaatgaaaactcatgagatggggtgaaatcctgctagctcagagagacagagaaagctcccagctgaccattctgctctgcattcccagaagaaatgcccctttcgcacagagtctcaaaaaaacttcctacatactgaatatctctcccttccccatcttgtgggtctctctatccatcctcctggttccctcttactctctatgctttttttcttaataatcctatagacacgtcctattgactggttgcttgctctgcctcttgacttatggttgactttatttaatcctgaatcacaccacaactaaaaacatctttttctagtaaataacaaaacctccgggttcacactgatgaaatatcctgcaacaaccttcaaagcctgagttgaaatggatgtggggagcaagggtagtgggcaaccatagaggagaagtgacagacttgtcacaatggacacagatgttaggggaacagcctgctgtgaggagtgtgtctgtgggacctgtatatttgatttaggtcacagggcattatgattaagaggttcacatacatatgatttgaaatattttcctctcaaaatgtttggcctagaagaaacccaatgtgcttagagttgatatctgaattaatttattaattattttaattggtgaatgaaaaattgcatatgctcatggtatgcaatatgatgcttttatatatgcttaccttgtggagagatcaagtcaagttcattaacacatctattccttcacatatctctcctttgcagggaagtttgcatagtctttgcatttgaatttggtgagttagtgttgctgcagaaaattgtaatgagatgattcccccaggttcttgaagaatggaatctgatgtagatatttgaagattattggctgagcaggtactcaggaggccgaggttagcactcaagaaaattacttcttaatgaggggaactgatcccagtatggtggtttgaataagaacggctctcttgggctcatatatttgaatgcttagttatcagggagcggtgctgcttgaaaggattagggggtgtgtccttgttggagaaagtgtgtcactgggggtagggtttgagctttcagaagcctcacaggccagccccctgcaaccccgcagccagtggatgaggatgtagctctcaactactgctctagtgtaatacgtgccaccctgctcccttgccatgacagtaatggactaatgcttcaaaactgtaagcaaagccctaattattttccattataagagttgctttgatcatggtgtctcttcacaacaacagagcagtgtctaagatttcagggcaatgcacagtcctgcaatctagcctcttcaccagaaaagcatattgggtctgcagggaggcagggaggcagttagcctggaacatacatgggcactgaccttgttgtaagatgcagggcctggactctctatggcataggagcaatccttggtttaaagcagaatttagttttgtttcacacactcctggccatgaatgtcctccttgtactctcttcctatcttagttatgtttttatttctgtgacaagacaccatgaccaacacaacagttcattggggcttaaactttcagagggtgagtctgtggccgtcatggtagagagcatggcagcaggcaggcaggcatggcactggagcagtagcagctcacatcttgagacacaacaatgaggatgagacctaattgggaatggtgtgggcttttgaaacctaaaagcttgtttccagtggcacacctcttccaagaaggccatacgtcctgatttttccaagcagttctatcaatggtggatcaaacattcaaaatataagcctttgggggtcattctcactgaaacccccacactcatcgattcttctccaggtctaagccccacttatcaaaaggaatgagagcccagagtcctggtagtcattttttaaaattcttccttggaactggcaggaaaggaatggagtcctgtcctatctttctatcagagaatagaagtgaggaattagacacaagggtgtccctgacctgcatcatcaaacacccttctcacttcccacagcaatgcattgttctctgcagaagaggtgaagatggcacatctcctcttaggaagtttttctgctatggcctttcaccaaagtgaatatctggctttagttattattattattattatcattgacatcataacttaaatatcctttctagcactttttcaagtgttagtcatgtacctaaatacttcactgaacctttcatataggtttgttaagacatgtcattattttgcttaactctaagatagaaaaatttcacctacaatatagtaaaaatttaaacatgttacagtgtaagaaaaagtaaggaattaatgcaggtatagtgagtgcatctaagaaaaagatgttcaaattactctctagcagttctttgtggtgaagggtctataaatacatcctagagtgagctttacttattatttttgacaagcataagaattgaatttatttaaaagaatttctgtgttggttggttgaagaagtttcaataaagttttctaacatattgcaacacacacacttttcctgtcatatgctgagattcattgcagctgtttcctgtaaaatgaaaaagccaattttatcaagtttcatttcctccaaagatgagggcagagcttctctggctagctgtgggtggccccatactgtgggagctattgaagagtcatgtctgagctgttccctgtctgagctggtccatgacaagagcttttgaaccttttgtacccatttacctctcagctgctccctggagctgtgtccttgttcttgatactacagcctgaaattttattttgactgtgtagccatagtgattattcctgtcaaagctgaggatcaagcacaccgtgaatgccacacactactgtcaacacgccagtgggacatcaacaaaccaggagtgacatgactgatctttagtgccacgtatgcattacataccttgctttaaccactgccaagaagatgcagactgacacatctgaattctgtagacccaatggagtctctcaacgctattcacatctcgtctctgcccttagaatggcactacatggtagcaggcaatacatttcacttattttgctaaaagaggtagccttctgggcaatttcttgcccagattcttatgcaaaccattgcccatcactctcctttaaagtaaagacatctgaaaggcagagtcagctctcagtgtgaatttttcatagcatattactttccacaaactgtactgtcttttcttattaatgctttcccaaagttgcttcccctaaccccggatccagtggcctctgctcggctctaattctagagagtttctctgcagccgtgttctgcttcttccttttcccctgaggctttttctcctcagcttcttgtgctggtttgaatagaatggccaccatagactcatatgtttgagtactggcatatggcatagtggaattctttgggaaggattaggaggcatggctttggccaagtcactggggtcagggctttgaagtttcaaaagaccctagccactcccattgtgctctctgccttctgcttgtaggtgagttgtgagctgtcagctgctgctccagcttccttcaatccaccatcataaactctctctgggatcataagtccacttagactacttcttttataagttactttgtttatgatgttttatcatagcagcagataagtaactaagacatttccaagtccttgctttaccttcttaggtgacctccgttgctcctttataaattgtttataaatttataaattgttcttttgctgacaggtaaatgcaggcgttcctaaggaaatatcactatcctgggggactctcatccaccccatcatatcaagtgactaattcatgtactttcatttttttttatgtatgatagttttttttttctttttctctttacatttatttaaacctattttctaagattcaattcaaatttgaatcgaatactgatggaagccatctaggaaagtctatggcaagcaagtgagtttcgtggaaatggcccaccattttgcatggctgtgatgggtgtacttgggaaaggcacaaccctagagacttcatcccaggactgcttctcactgctgatattcttttttctgtcattgttacatagcctagtgtttcttgggtgtcagtccaccctattgggcaaatttcctgaagatcagcatgaagatgaactttcatgaattaatgtttagatgaattgatgactttgtatcattcttgatttgattaaaatgattttaggaaaaaaggattaaggagatggttttagttgttttacgagaatgatgtaataaagttagaatcaagaatagaatgtggcccctccctatagaacagtaagtaaaggctgtataataaggaatacaatgaatttcataaattccactaaatagaagagtaggcttgggacaaatttgtgatcaaagaaaaacattcattctaggtcaggcctaaggataaattgcctggctttcttccttcctttttaaattaaaaaaaatttttttttatctctggctcattaagagttaactaaccctgagcctctagcttagccaggatccagagagaaaagaactaaagtaacttaattttttttttaaatcccctgatgctatcagcaggagttacattgccagaagccagtagcttttggccccatcatcattgatcatcacatgcccactttctctgccttcctctggatgctggatgctggatgctggatgctggatgctggatgctggatgctggatgctggatgctggatcaccaccccctcccccaccccaaacagaatgcttgctgtttcgtgaagttttcttgtcagattccaccttcactgagttccctcctatgctatatcatccaacaattatttgatgcttagcaatggggcttgttaagtctgttagtcattcctgactgtctctcatatcacgataccttgtaaaggcacctttatcaatggaagattcaaataccataaaattaactcttttaggaattttttttgaaaaattgatgtacaggattgaggaaacatcagcattctataattcctcaattattatcccctcatggctttcctctacttttggtctcaggaaaccattgtgggcatgccatgtaaatggaatcaaacaacatatgaacttttaaaatggctacttgttccttaacatgaggagtgccttaatgaggagtgccttcttttggtagatgaaaatttcataatttttcctgttcacccattagttggtagacatttgagttgtttccaattttttagttatttttgtctatggacaattgtactcaagtttgtgtgttcatagttctatccttgggcatctatctgcctggtagtgaactcttgggtcaaatggaaactttacatttagtatttttagtaattggaaaataattttccaaagagactacataaatatatgtatcagtattctatgggtattttaattccattagctcctcagcatcactttcttgcttcttgctgttgatagccaatctcatgaatgtgaggctgtctcacactgaggtttttattcacattttcctagtgaataattatagtgaatggtttatttgcttattgaccatttatacaatttgtttggagaagaatatgttcaaatcattttctaatttaaaattttagactactctccatcaccccacgttaaattaatttaagctttctttctaaattctggtgacagcatctttgttagattcagggtctgtaaatgttttccccttatgtgagttgtatttacacttttaaagtttgtgtcctttaagtcataaattctcagggcctaggagatggctcaatggaccctgatatagctgtctcttgtgagactatgccagggcctagcaaacacagaagtggatgctcacagtcagctattggatggatcacagggcctccaatggaggagctagggaaagtacccaaggagctaaagggatatgcaaccctataggtggaaccacattatgaactaaccagtacccccccccccccccggagctcttgtctctagctgcatatgtatcagaagatggcctagtcagccatcagtggaaagagaggcccattggtcgtgcaaactttatatgccccagtacaagggaaagccagggccaaaaagtgtgagtggagggagggggagagggtttgggggacttttggggtagcactggaaatgtaaatgaagaaaatacctaattaaaaaaaataaatctttgggctggagtgagcagggagtgaacgagcggggttgaccagagcgagtgagtccaccaagtgccagcagaggtcctaaaattcaattcccaacaaccacatgcagggctcacaaccatctgtacagctacagtgtactcacatatgtaaaataaaataaaaacataaatattaaaataaataaataaataaatcttaaaaaaaaagagtgtttactgttcttgcagaggacctgggtttagttcctagcaccacacggcagctcaaaagccacttttatctttagttccaggagatttggcaccccttcctctggcctctgcaggctccagcacacatatggtacaactaaactcacacaagctcacataggtgcacataagtaaaatagttttaaaatctttttaaaaattataaaattttaaagttttgatggcatttaatctttgttagttgcttattcttttgcttatttaagaagctattgtcaaagtacctagggactaaaccaccaaccaaagagtacacatggagggattcatggctctagccacatatatagcagaggatggccttgttgggcatcaatgggaggagaggcccttggtcctgtgaaggctcaatgccccagtgtaggggaatgccaggaccaggaagcaggagtgggtgggttggtgagcagcgagaggagggaggggatgggagtttctcagagggaaaaatgaggaaaggggataacatttgaaatgtaaaaaaagaaaatatctaataaaaaataaactattgtctaattcagggtcacagattttaagtgtttagttttcttttaggtatttttttaatggtagcttgtacatttatgcttctgatcaaattttgagctagggttttttttttttatactgtgtgaagtaaacttccagtttatttatttaattttgtgtggctatcatgagtctcatgagcaattgttgaaatggttattccttacttggagtccaactaattatctttgaacacatttttattttcttcattcaggcactaacatttttgaagttgcagatctctgtcttgtctttataacattcttaacagtattccttatcatatgttgtgatttggatcttaaataccctctaaatatctactgcctaagctcaaaatgcccttgaagggctattgggacccaaacatttgcagccatcgttttgcttccgagctgtcacaaggtgggcagttttgtaccaccacatgcctccttgcttggtattcttctgtctcattattggtccccaaaccatggagccaaacagtctcttcaatggtggggtaggtgtctagccagtgggtgaaagtgattttttttaaagcttttgttctttatggttacaaaattgtttttataagaataaaaattaagaggaaaacctaacttgaagctagagaaataccttctgctttgataaacatgtctgccattaggtaatgagatttgattctacaatgatggaagattcttgggggaggctcacaagaacttttattctttttaaatagacactaaaattatctcctagtcatgagaaattggtaaagactaattatttgagaatctgacgatgactaatgtaaaatcattaaggaaatgaatttcagagaggggaaacttttcaaattgaatactgcatttaaaacttttcagcttgacactcctcctcccacctccccatcctctccaggcatagcggtatcttctttagcttagggtaccttctatggagaagaatggatatggagaatcgtgctgtggcttgtaagtgggcagaacttagtaaagacctactggatgagtaaactccttgggagcatgtgtcagataggtaggaatagctcaatatgactggatgtgccactattcaaacacaggttagtattatgtggcagaagcatcccattgtttgatgttatggagaagaaagaaacatccaaggtggagtatccattgcaggcactgacacaaagttttatttacttagagcttgttttgaagaccacacagggaaaaggtgctacttccagtttctttgtaataacaggaaataactcccaccggtagcctctaataaaatagaaatattccaaggagtgaaacttaagctgttcatatacccataatgcctagaagcagacttgtcatggtatctgaatgataggctatggtgagatctttttaggctaacagtgtttctaggtcaggtgctagcatccctgctcaggaacaggggtgggaaagtatggtggcctgagatttaggattttaactgtgttgtttttaagcatgatctttgtgtggtaatttatagtgcatataagatgtgtttgtggtgcatcttataactttccagctaattgcatattaatgtcacgactagttttccaaatgatgtaagattctgggtgtctttattcatatggtgtcaaatccaattctgactcttttgtgattcagcacattgctcacaaagtatatactttgatatagcttatacaggcatatgggcatagataatttggttatttcaaacatttctagaatttgaagagctgggtttgactcaagtccccacaactattattgaatatcttggcttgcttcttacattcaactaaattacaaaatagtgataggttttttgttttttgtttttttgttttttttctgtgaatcatgaaagaccaaataaactactctgccatttggaaagaatctcaaagcacagctgttgcttaggatttgagatctgggaacccattacatttctgtctcaccattcttttttctcttgactaaagaatacaaatacataaacgatgtgaccagaagccaagaaactggagatgggcaaagttaagacatgaaacttgcttatgtgtaagctatgctttttgtacagagacagacttaggactaggcctttcacagcttcccaagtgggacacagaagcttgaagaacatgccatattttgtgccttccccacaggcatataggtgtctcattttctctcattattaaaacaattctcattaaacaatttctctcatattctttaagacaatcatgcaaaagggactccaccaaacatgaagaaggagtcagagagttcagagatgaacagaacagtcatgtgtcttttccctctgctgtaactgctgatggaggaaatgcggaaaaaccattaccactactgagacacacatccaaggaaaaggtgaatgagaattggattcttcagcgtttctgccagtgtaagactccctaagcaaggcaaaagacaatcttttataatcactgcattcttcaaatgtgaaggagagctagatgtggcttctctatgcaaagttaagctgtgaaaatatggagaatagattgtggaaggccacaagagatgagggtaactatgtgtcttggaagctctctaaacaataatgcttagaaaagaaaagagtttaaggagcgatctcattttccactggcaaggattcctgctcttggggaggtgctggaaaatttatttctgcttcttcttcttcttcctcctgcactggaataatttcaatttcctcttcattctttggttgggaagatactccacttagctcaatgatttcttctttcattttaatcgtctgctcatttttttctccagctgacagcagaaccacattctagaacataaacaaatgcttcttgacttttacccttgacacaccttccaacaatctacgtatatccaaatgtcaaattattctcaggcttcttgtttagttaaccatatactgtagataccaggattggcaatgcggatgctcaaattcttatcaaatcacttacttgttaaatctcaagtctgagtaaattgttaagggcttcaggcatttgccactttgcctggaataataataccacatgaaaaaacaaaatgtcaaaaatagaggagtttagattctagaactgatttgcctttagtggttataacccagggaagatattctcattccatcttcttcccagatttgtaatgaaagaatcagtgatgactacaaggttataagctaaatcttatagtctgtcactttgaggtagtttatagtagaggtactactggaacattcacatttcccagttttggagactctttgaaatactattgttttggaagtggaatgaggtgagaggagaaagctgagaaggcaacactaaaaaatccaagaaccagtcactttatcagccttcagccttcactgtcttatgttccacattaagatgggagagggcatgtaatcaaggtgtgaataagaatgtctaccataggctcaaaactttcaatacttgttctgcagttggcagaactgtttgggaatgattagaagtacggccttgtgggaggagatgtgtcattggtggtaggctttggggttccaaaagtcgaagccatttctagttagttctccctatatgatgcttgtggatcagaagtaagggctcatctacttctccagggccatggctgactgcccactgccatgctcctccctatgatggttatggactctaactaatcttctggaactgtaaacaccaaataaatgctttcttttataagtcaccttggccatgctgtctcattactgcactgcagtagaacagtaagacgaagtgggagtaggagtctgaagtcaagtagagggaaaagctggttggcaggaacacttgtggacatgtggaaggaattgtagcatctgtctaaccctagactcagttactcttcaaaatatttgctgccactgctggtgttttctggtttccaaaaaacaaaacaaaacaaaacaaaacaccccaacaaaaccatttttcccaatgaaacccctagtatcagaatttcaccagatcatattctatataaacaattttttgtagatatcagttttctaggttgtgtggataggtaactccaacttacagatttggatctggtacacattcttttccactcattctccacaataccagctgtcacaagtttctggaagaaggcagagatcagcatcgccgacagaatgccctggaaaccaacgacacagaggcaaggtgagataacatcagacggacgtgcacagtgcacagtgatgacaaacgactggaactcagagagcaacagttcagttcagtgctttaggtgagcaaactgagctcctgtggggagtgcttgctatgagacagtatcttcaggcacaagaaagtaaggtgggaataggaaactgagaaatcaattcttttaaagaaagagtctcacattaaattcttttagcatcgggctgtggtggcgcacacttttaatcccagcacttgggaggcagaggcaggcagatttctgagttcgaggccagcctggtctacagagtaagttccaggacagccagggctacacagagaaaccctgtcttgaaaaacaaacaaacaaacaaacaaacaaacaaacaaacaaggcatattggcacatccctgtaaaagcccagaacttttacagggagtcagggagatcagaagtttagggccatccttgactatacagaacagtgaaggccagcctggactacatgagaccctgtaccaaagaaatagcatcatctttagggggatgtgatatcacattgaggaaactccacaacacttgagagatgtatttcctttcccttttaaactctgcattcacaattcaatgatgactaacatgtcaataacattttaggaatttctttcatctttttattaataacagtaattgttaacatcatcagtgatattaacaccgatgaacacataaagcttggtgtgctggcatgtgccagtaagcccagcattcaggaagtagaagcaggattgttgtgaaattgaaggtagtctaggatgaatagacagcattagaccacccaggactacacaagaacattcctcagaagaaatgataaagtcacaaatagaatcttatacaaatgacactgttctaagggtgttgcctatggcaactaatttgtttatcaaatcaacccaaggagatacagagcatcactctctcaattttacagctaatgaaatggaggcagtatatgagggggggttcggatctaaagtcacatacagaaaaaatagcagacacagagtacctgtctggagttgatgttcataataaagcacagcacatttcttctctgaagactcactgcttttatacttaccaagaacacagactgaatgctgttacagtactgtgtagatggggagtttttctctgaggaattagatggttcacagtcgtagatatcaacatacggcttggaagtttgaataagctccagtcttctcatttttaaaaaatgagaaagtgtcatgttaagtatgtccatgattgaaagaattattccagaaatggcagcaaagaggcttagagagctcattatcacttttgctttgacctgaaacagaggcagggttgttcattagatttgattcctgtttggaaaacataaagctggatatgggatttcagttgtcattcccctgattcatgaaaactccacctctgagttctagttcagctcttgctatgggttttagcctctttgacaccgtgtttagcctcattctgcccccccccccttttccaatctccttgtcttaagccatcaccatcccattcgatttatgaaaacaaaattccagtcatcctttgcccacattttgtatctctgaacttttcattgccaccaacttcctttccagacatgcagtaaacactgaagggagtgaggatcagtggtgtctgggccattacctccttgcataataagagagtgggcagagagataagagggcttttacatcatgactaaataccattgaagtaaatatagatagaaccttcttggtttgtcttattgtattggctagtcttgtgttagcttctcatacaaactagagttatcagaaaggagggaaatttaattgagaaaatgcctccataagatctggctataaagtattttcttaattagtgactgaaaggagagggcccagcccattgtgggtggtgccatccctggactagtggtactgggttttataaaaagcaggccgaacaagccaggcgaagcaaaacagtaagcagcacccctccatggcctggctttgtatcagctcctgcctccgggtttctgccccggtttagttcctatcctgacttcttttgctgatgaacagcagtgtggaaatgtaagctgaacaaacccgttcctcctcaacttgatttttggtcatggaattttgtcacagcaatagaaaccctgactaagacaactaccaaataaaatgtatcagccataacagtcacaccagtgctccctactgatgtcatccattggggcaaatttcccttggtagcacagtctgtgcatggagggcatggctgtgactgctcggacctgtgtgggtgataaaagcttgatatgtcgtatgccatatggtgagacattactggtgtgtttcactaacatttcacttctggctatgtgacttatttatggaaatttggtaattttggttgtatttggtatttgtaaattcccctaaattgatttttttcagataatttataaataataaccatctcaatccactcaggtctttgccaactcaaagtgacttactaagtataggtaatgttagaggattttctagagagaaatttggtggtgagctctagccacccatctagatccaggaattctgtaggttagttattttaagaggatataaataaatctttatggatgagccactgtaggctttatggctacactattacacaaaatgctccatctcatctttatattgattttctgtgtcaagactagcacttctgttcatggggggagcaggtagggggctctagggcactcctgtactcacttggggttctgagtctaattctaagtctacaataaggctgggatgcaacccaagcatctggaccattttcctaaacggtgtgtcatttcctatataacattctttcaaaatatgccatgtctgccatctccacagggaacttagcattgaaagagtactaagtccagccttctgaccctgtccttgattcccttgccatggacagacttaaggcagtgctatttttgagtttctcgtgaagaaaatcccatcacaaccagaatgatatatgatccattgctcagagaagagtctgtgactgcaaagctctttttaggtccctgtgcttgttttctactgagaaagtggctgtatgtctcgtgtgtgagaaaggacatatgattacttgccaaactcttcctggaggttttttctgctgcagctgccaggagtgatcctgaaataatgtactgcaaagagagaggtgggaaggaaggggagaggggcagaaggggggagacagaaagggtgactgttattcactgataactggttgggaaggaaccatctacatttgttgttgttattgttgttcttgttgtgtgtgtgtgcgcctttcattaaactatgcattgaatttttatcacattaagtgatttcttggcagctatatttctttgttctttaggttcatacatgcagtctatgaacctttgggaccattatctaggaatagaataagaaaagagagacagaattcacacttttccttgtcagtgagaaccctctgggaccataccatcaaacagaaacataagaaatcacccccaataaggtgagggtgatttcccccatctacaagtattccttatctacacaggctataattagattgtgtctctagttttaaaaacattattaggctgggtgcctaggaagcacaggtaggagagaagatgtagataaagacatttcccctctcctttttattaaaaaaaaaatgaagtttatttatttatttatttttatgtgtgtggctgttttgtctgcatgtttgtttgccaagagcattcctggccaaggaggccagaagaaagtgttgaattcgtctggaactggcattacagatagctgtgagctgccatgtgggtgctagagattgaacctgggtcctctggaagagcagctggtgttaaccactgagccatctttctagcccatctctctcattgtgattagtgaaaatgttcatgtagggggcacagtgacataatagccttgatgccactgagtgatcgtgtggaaggcaggacttgactatgataaacttcaccacgtcattggttgctacaggaagcaacagcgattatttcttgtttcctttcccaaagttcaagcaataaagtgcagaaaagtcttacggctaatctgccttggttcactgaagcttcagttcgggactcaatcttagcgggacacagtcattacaagtgtcctagcaaaataaacactacctagcctcgtgttgcccaaaagagtgttgctgaacttgtaaatacaaaagattatttgagatgaaaataatttcatcaggtgccttagtagttaacaaacttgtagcgacatgggagaacttaggatgtttccatgtctcctttccttccaaagtgccaaataccagcatctcataccctgctctatcccactatgcagagaccctgctttgcccagtgttccttccccgagaacagctggcaaagctcctttctgtgaatccacacagagcatggccagctccaaccacaggagcctcgtagtgtagtctacccttcttcctacttaactatgccaaccccacaggattcttcctgcccatgttactttcctcaacacagaacaacttagatcttttgggcttttttttttctccttcaacgtctcaaaagttgtttttgtttattgtaactcaccataatgcctccccagagagggtaccatacactcaaacagatgggtgcgaagacccctgtggggatcatcagcagtccccccagggtaatatggaagaggccattcatgatttggacagcctggggagagaagaaaggtacaggtggtgaactgaactcactggtggaggtcaaaggcaacatgggaaaactgagacccacgttgaaaccatgcaaaggtcctaaaaggagtgctagtgctgctcagaattttgcctccttgttcagatctctctctcccaccacagagggcattttccaagaaccgatacgtatggaatctgaacagtggaccagcctggtcctccaaaccaagaggtgattatataagatcattctgcagtaatccaggtgctaactggtgccctctggcatcacccagtgagaaacataaagaacacagccacttaaacctgcctgtagaaggcagactgaattctatctacagcctgaagcatcaatgtctgcaggccagagcatctcccaagtgtggaatggaggaaaagtcttacccccaaagcctttgattccctcatgaagaagctttgtgtggggcccaccagtgaagatgtccttttgaggttcacttttggagcaggttgcatggcgaggggaccttttgtaggctctgctgggaaaggtccactcattgagttttcaaacgcctgaaaataagacagtgaggtgagatcagagtctttggcaatctttaccttctggcaccatctaatacttctcttagtagtcccttgatggtgccactgagtcatgtccacttcctagtaacttcagatgtaaggcaaggtctactaccgtggtataggaaaggatctggaggggctatctcaggcaagggcacatgggcccaggaatctgagctaggatgataatcatgtttggacacatgctaatgttcaagaaatcacaatgtagtcaattagtttaccagtgagctatactcttagaacatagccataccataaatttatgtccatatgcagtttttctctggtggggcttggactctctttgtgaatgctaagaaaataccaccgcgcttcatctctgctctatgcatttgtctagctggtccctccttggatgttcttatgatttaatattccaaagcatatttttattggcttgttcatatgttcagaaggacagtgtagtagcccagacatgtcattcttgattatggctaggactgtcctgaaattcaggagggatggtctagacctctctctccctctgactctgacgttgtgcaggtcacttcaagaatattctctgatatcacatgtacaatcacagcctgtgagtcagactgtctggttttaaacagtaattctaattactctgaggtgttggccaagttacctgggcctcagattcttcagctctagactgaaaatagtaagaatccttgtctcacaacgtggtacaggaggttgatgatgacggttcatgttggtgtgggttttttttcacccaggtgtagcttaaaccccagctatccgcagaggccttctgtaaaccctcaacctatgcgccctgtgtatgcgccctgcctcaacacatcctgtgctagttacctcatttcagtcatgactgtggtaaattaccttatatgcgagtttattgcagttctctcttgacagaaacaaatgatgttgtgctacatccacttcagtagtgacacgcatgacaggccaaaagcctggatgcagtcctgaggcgaagagtttcacggaaacttagtctcctggaagtgtggcattccatagcacgtatgctccaattttgtccttgtgaatggatctgtgtgcttcctttcagtgttgttttattataggtgcctccaagcaatgatttgccaaatacctaagcaaaatcgaactttgctttctggctttcaccaatgccctcggtagtccttgagccaaccctgggcttggaattcagtaagaatgttgcctattcagtgacattcagaattacttctagtattgtaagagagatagtgaaagaaatcgggcattactatctcctgcatagagttagaaatctatagatttctaaatctatagagggcaagcttagcaatgtaagtttagaattcttattatagttatgtatggcagactacattacttattagtagaagtccccccacactatcacttagaataaaagccaagtcgctcccatatacaggaatttacaatggtttaggaagtagattgagcggtggttttagagtattgcattattcatgagatggttagctagagctgaactccctaattagaaccatgacttgggtgtgaaagcccttaccctaggagtgtaaagacctcacacctggcttctaagactatagctgaccttagatagggctgactttgtctcagttgttttattgcccagttcctgccagtctttgtgtttacattcctgttttgtgtaagagccattaagcatccggtaacctaatttgtaccttgctgatgtgtcacctaacttccctattttcttctgtataaaaggtttgatgttcaatttgacattacattcagatccaaactcccttgtgttgagtctgtttgtcaccccattcccgccgactctatgcccatttgtccgagaccctgattcacacggattgaggggggtcgactaggcccggtccgtggcaatgttgttgctttttgacgagtatctaaaacaatgctcacgtgttatagcttcttaacatcaaagggatgctagatttatgaaaagcacccatatctgaataaatattagctgctttgttgaaattcttgttatacacttctaagctgtagtttttactttatgcatctattaaatgagaacagtgtcctacccatagaattatcataagaagtgaatggacatatgtacccaggacagggtagagggtagagagtatcatctgccagtgatcatgagctgcttctgaagtgatgagacaatgagtcacattcatttcagctctgacaggctaaggctatttagctttctttatgtgtcttgtgttgggaatatccatccactgattatgtcagccacgtctttgaatttcattgctattttctgcaccctggatatccctctgtagggccacacatctggctaattgtaagctgtggaattaagagtgtctacccaggttgctgaatcttactaagacatggagggctgggtgggtgcatctcttacacttcgtcctattttatacgtacaaagaaattcctcctgggacatctcttctgagcccagcagaggagacaagaggtgaatcattgcctctgttttacagaggagtggacaagggcagacaggttaggtagctcacttgaagttatgtaattactaatgatctgaaaagaagaccctaacttgtcaactgaagggcagactcactgctctgactcaagtggggaacagtttcatttctcttcctttcccttcaaaatatgcacactccgaatgacttaaagcaacacagaatgtgacctgtctgcaacatcatgggctttagggaagcatttcttacttcatttccctcctgtcctaaattagcagctgtcacttggcccgggggactgtttcataccacaaaccatcccatgagaccactaaccaaaaaaaaaaaaaaatatatatatatatatatacatatacatatatatatatatatatatatatatatatatatatatatatatatacatatatatatcccaccaaggagtttgcaaatgaatactggtttagaagtagaaaaatctccagaaaccagtttgttcatatcacaaatatggatccttcccctagacacgggacatccttttgcaaagaccttatacctcactctgtagacctccaggctagattgtatgaccacagttgtttacttgaacatgtactgtgtcccagggttattagttgttctagttccagtttttctcatacctccctcccaggaggcattgtatcacctttttagtggatgtgtcaatagaagttcacataagttattttcccaagatcttttggcaactatggaatgagatagaagtcatttcactccattctagggaactaattttagtgatggtggcttacaaatgcaaggtcattaattgttcagggtgaaggaaatgattggaccaccattaatataattccacctgagttatcagctgctcactaagtcttgggtctgtgttgttactgagataaaccttttatttaggcaaagcccagtgggggtgtccgtatggcctagtggcagtagtaatatgaagagaagaacatcactcttgtagaacatatctttgtagtaactgtatatctacaaagtgttgaatagctattactacaaaataatattttgtagtcaaaataataacttttatatgccatcttatactaacgatctccctcttctccctccctttctcacacacgtgagagcactacaggttggtgcaataaaattacatttagtggcaacggaagctagagctggtccatatattcccacaaatgtaggtttttgcatcattgccttatttttaaaaaaatcatacaaaattgctccaatagactccagctcacagcaaagattgtttggtagattactaggggtatggaccacattggtctaatatgacagtataggctttagcttcacaatactgatactgaattgatgatttaatttgctcacccaccgttccatcttatcacccactgcagctcccacaaacccacaaacccctttgacttctaaaagcatgacttttttttttttttttttgtctatcccctgaagatctcacagtatcttctctggtttgggcttaaataatgactcttaggtccaataattccatcatcttctgagacacttgaggcttcctccaacctcaacttccccctttgccactcaaaagagttttgcatttatgctccttgccccatgttttttttttttttttttttttttttttttttttttttttttttttttttttccgagacagggtttctctgtgtatccctggctgtcctggaactcactctgtagaccaggctggcctcgaactcagaaatccgtctgcctctgcctcctgagtgctgggattaaaggtgtgtgccaccactgcccccccaaaccccatgcttttgactgtgatgaatcttacattcttcttaactctttcagtccatttccttccaccagatgtttgttctttacagaaattccttcttcctgggacctactctctccttgtgtggcattatgtagtagaaagagctgtctatatttgtgatctctgcaaattaggattgaagttgtcctgtgattgatatgataataaatattcaaggaataattattactactggttcttattacgctaccttgtttcccagtccccaaactttcattttaaaatacagcaacatcccctatcactaccccgtttcccctttcttcacttcagcttttaaaatatttgctttttaccctttcccccaacttcctcctcacacagtccctgatactcttcaactagagtctgccattcaactgaaacttctctgtacaaaggttgtgctgtagcctgttgccttttctgcacagtgcctcaggtcagtttatttttgccaactgctcagacttaagacgttggaaccagggagtatgtgagatggtttggtcatgtttcacaagcatgaagatctgagtatggatttcagcatcttcataaaacacccactgtggtagcatacacttgtaacttcagtgcctatgaaatatagatgggcagaacccttaggcttgctggccagctcgtctagccagatatgtatgtttcaagttggggagagaccttgttttgtgactgaagaaggtatctaacattaatctgacttccacatgtgtgtgcatggatgagtgtgtgtgtgtgtgtgtgtgtgtgtgtgtgtgtgtgtgtgcatgtgcgtgtttttgtgcacacacaaacataggcttgaaggcagattttactcctgctccttcagctcccttacatattcaggcaatagcaacatcatgccatttccacctctgtaatacctcttacccatggacctttcccctacatagtatcacccatatattgttcctgatttcctttcctggtatagcataagaaaaaaaatcttgtgggtcaggccagccagatggcttactgctaaggctgatgacccaaactccatccctaggactcacatgataggaggagagaactgattcctgcagattgtcctcagacttccacatatgtgcacatgtgtgcatacatactaaataataagcaaataactgtaagaactgttagaaatgctgtggctattgttttgcttcaatacgttttctaatatttgccccacaaagcaaccatgacacatcaccttaaatctctaagtcgtgctctacctgggctcccctctcaccaacccgccccactgtctccaactctcctttgctttcttgagacacccttctggctcttcattgcagtccagctctggatgactttcagagcccgtgttctcagcagtcatgcttggacacgtctcctgtctgctttgctgaatctgcaaaacctttgagctagtccttcccgtttctctccacgttctgtcaacctccacaaaaggaccatcatgttacctcaggctgttccttggctgatggtaaggatttcttcaaagtcaatagccgttcatgtttatcacttttctacaactacttttattgtagtgtgccatgtaactcctgaaacccagtgccaatccagtaagggaactgtgcaggggttatctggtaaacctgcctcttgtgatgctgatgctgtgagctctgtcttacacagaccgttaagctcagcttcctcctttggcaggtaaatgctcaggatgctttctattcacaaaatgataacctccacttcatctgaccatcagtgagacaaaaccattataaggaaaacagggaaagtctctctgtctctgtgtctgtctctctgctgtctctctctctctctctccctctctctccacctcacctctacatacatacatacatgcatacttattttactgtttagttttaggagcacattagcacctggttaaagtcaatccctctatcctgtctctagcacccactctcacccttggcttcttcgatcatagacagaaaacaggatttgtgctcagtattccaatgccacaccgaaaatgctagatagtaagattaaaaccatctatgatggtgcttacattgaagttttatctttggagacaaaactcatcgggaggaagaggaatggggctagattcttgtggccaggattattttctaatttggttttaggcagtcctaaaaagattctgtgttctaggtttaatcttcatggtgcagaggacctcaatattgctcccattttatgggtgaggaaattgaggcatggagaagtttagtaactcacccaaggttatgcagcttctctgtggtagtgccccaggttgaagacaacattctagagaccttttctccttgttagaatccactcaccacccattgcccagagtcatttttgagagggggagcagttaggttaggggtagcccatccagccttgaaatcaccacacttcagatcatgctgccacttgccagggacaccccagactgagagctgactctctagtccctaaaaccactccttttcatctggcctttccttttattagagtcactaaaacagagcagacctaacccttacctgggtctccaaggctccaaggctccaaggcttaagggccaaattagccactcacagctgagatcagttggcctcttctatctcaagtacttgaagatgagtgcgatagaccagacctggagtggtacctctgattgacaccacgtgacaggaaattagcagcttctgctaccttgagaatcgctccaatcaccttgctttgccttaccaggtttcacttcttaaaaattaccctggggactgcctggtatgcttcatgctaccttaattagaagaacttctgcagcccccaccctgtaagcaggtgtggatggtgggtccctaagggctggaaaagggctagaaattctccagagatgggctgttagagcttcacttttggggctgagtaggtggtggtggggcacccatgcaaaaagtcggaatccctgagaaggtacacttgggagcactgtatctgttggtttttaaacagtcccgtcatctgctcatactcaaagctctagagggccatgtaaatctcacgtcaaatttagcagaaatggcctgaaatctaatttgtctccatagaacaatgcacccagaagtgttaggcaagactcagctcccatttcgggtgctgtgaaccgagacagcacttttacatatgagcccacccttctccttcctgcttccctttctttgcagtattgcttagagctgtagtggctgactttagtgttagagcaagcagcaaagtggaagaagttggtgatgtgggggaaagtctataaacatttaagaggcaaatattagattttctcaagacatatcctcttttccatatacaacctcatgcatgttagactttttattaatttttttgtttaaagctgtttttgttttgttttattattattatttttatagtccagtcattactccctccctgtccacactcccacagttcaacatcccattcctcccgcttgtcttcaagagtatgttccctccaacccccaccaggcctccccactccctggggcctcaagtctcttgagggttagacgagtcttctctcactgaggccagaccaggcagttctctgctgtatatgtgtcaggggccttagattagctagtgtatgcggcctggttggtgactcagtgtttgagtgacctcagagactgctggtctttctatgaggtcaccctctttaacttcttccagcctttccctaattcaaccacagggacccccgacttcagtccattggttgggtataagtatctgcttctgtctcagtcagctgcttgttgggactctcagagggcaagcaagctaggctcctatctgtaagcacatcatagcatcaataatagtgtcaagccttggagcctccccttgagatggatcctaagttgagctgtcactgaatctcctttccctcagtctcttctccatttttatccctgtggttgttttagacaggaacaattctgggacagaggtttgactgtgggatggcaatctcaatccctccacttgatgccctatttttctactggaggtggattctacgagttccctctccccactgttggtcatttcatctaaggtccctccctttgagtcctgagagtctctcacctcccaggtctctggtgcattctagagggtcccccccacctcccacccaccaaggttgcatattttcattcattctactggccttcagggcttctcttcaccctccccccaatacctgatcatgttccccttccccctcctcctcccacccatatccttccctccttctgctgcccctgcccccatgattgctttcttctctctccaaagtggattgaagcatcctcacttgggccctttggcttgttaaccttcttgagttctgtgaattgtattctgggtatcctgtacatttttggctattatctacttactagtgagtacataccatgcatgtcctttttgggtctaagttacctcacttaaatggacactttctccattttacctaaaggttgaaacacggtaactatagtaatacgaggctatttcacccctctccctcttctttcttctctctttctgccatttaagatggttgagagccatatggtcaggactagtgaacagaagtatttctgggggggctggtttgggtggaacataaacaaaagtgctgaagttgctgaagttattagtggaccaagctgctagttaggtagagaatttattgccattcagaaaactcaggtcacagactttcagtctcctacaagaatgttatagtgaggaggggagtgaaaagggtaggtccacatccattcaagatcccagttgtgattctttgtatctattgcaatgagttggatacaatgacataatgttagagtctgttttggctgcctccgtagacttgtataaatttataagtaacagagacttatttactgaggtttaggagtctgggatgtccagggttttcatgctctgatatcccaggcagagcagcaagagaacacacattcatggaaggggattgggaatgggtgttaggtaattgtcatggtaacggtgttgtattataagggcaaagtcctatggccaatcaccacttaagacccacttctcagcactgtcacactgggaaataacttttctaatctaagatctttaggaatgtatccaaacaagagctctccaggcccaggctgagatgagactcctatccaggcatggtgggtaggttggagatatgtacctgtctgcgtactgcatgtgggagcagggtaaggcctggcaaatgtatggcctttgagaggcctgatccagagatatataacccgatgttcatatccaagtcccattctccagtcttctcctccctccctcccttctagtctttctagccacttgactttggctcaatgcaaatccctccaaaactatctcagatttagttaatatagtcaacttaagctgtctttgctgatgtggactgagtatgctcaaatgccctccacaattaggacttgtcaactgcactgcctttgagtctatgcttttccctgttttatgtttgacattttgttgattctataacacacttgactttttcctttgacctatactcttataattctgtggctccaattttgaaaagatgttgactgacagagttaacaaaagtgtaacaactcttatccaggtagcatttgaagatccacatataccactccatcttcagtactgtttctctcttctgaagaatacattctgcatcatgattatttgtgtcctctccttactcagcctttggtttccagtttttttgatattttctttttttacatttcaaatgttttcccctttctgggtctcccctttgaagcccccccccccatcctccctccccctgcctctatgagggtatttccccacccaaccacccaatcctgtcttcccgctctagcattcccctacactgaggcatcgaacatcctcaggcccaagggcctctcctcccactgatgtccaacaaggccatcctctgccaaatatgtggccagcgccatgggtccctccatgtctattctttcgttggtggtccagtcccctcaagctccgggggaggtgggtctggcctattgacactgttgctccttccatggagcttcaaaccccctcagctccttcagtcccttctccaactccttcatcacccccctcccctcagtccaatggttggatgtgagcatccgccactgtatttgttctttaaaagcaggggtaggcttttctgggtcttgtgctttctgcaatgtaatgggacctaaaagtgctgcttggttctatctcccatggtgatagtgaccagcaggcaactcagaattaggatggaaagggatggcatgttgtcgactcctcagcaaagccctgacactcaggacaatctgcttccagcggcattttgtttcagtgcattgggaaaggagaagcaggcccctcagaactgaggctcagttttgaagtataagagaatctggctacaggcctgaagatacaatgttgtacctataatgtgagtttaaacatctaaaatttgttttttagttctttgtgctctggagaaatatttcatatttttaacaggaataacattcatcaaatgcccatgtatatgtcaagcactgccttcgtagacagtctgataacacatatacagtatcaactgattgttttatgattagagaaaccaatgctttggaaatggagaaactggtcctcaaatgcactgttgaaaatcaagagaataatgttttaaaagcaagaaaaatcctaattaaaagcccctacaccatttatctagtgactttaaattccaagggttgaatgctcacagaactaaattttagcctaagggatttaaagcctgtagtatttaagtatgttcaagttacaggactgtgcatgataaagtgacatttaatatttgctctaaattaccagtccttactgtcatgtgtcaggtttcacctttaaatacttctaaagcctcatatatctggacatcactgactcagttaccaaatattctttcaccagaacctctctccatgggaaagaaaaacttatctcccttgcctatacatacaccttcagcttagagcacacatcagcttcttccagcttagagcagaaatctaagaaaacttgttattcatttggagagggtatatgattctccctatatccaaggcattgtaaaatatgagacttgcatgtggtgatcttaattcaaatcctgtttttaaatgagattccctttgtgcacttagaaaagttggctgcctcactcaggatgataccctccagatccatccatttgcctaggaatttcataaattcattgtttttaatagctgagtagagtgagttaacccagttacaaaagaactcacatgatttgtactcactgataagtggatattagcccagaaacttagaatacccaagatacaatttgcaaaacacatgaaactcaagaagaaagaagaccaaagtgtggacacttcaccccttcttagaattgggaacaaaacacccatggaaggagttacagagacaaagtttggagctgagatgaaagaatggaccatccagagactgctccacccggggatccatcccataatcagccaccaaacgcagacaccattgcatatgccagcaagattttgctgaaaggaccctgatatagctgtctcttgtgaggctatgccagtgcctggcaaatacagaactggatgatcacagacatctataggatggaacacagggcccctattgaaggagctagagaaagtacccaaggagctgaagtggtctgcaaccctataggtggaacaacaatatgaactaaccagtaccccccagagctcatgtctctagctgcatatgtagcagaagatggcctagtcggccatcattgggaagagaggccccttggtcttgcaaactttatatgccccagtacaagtaaacagcagggccaagaagtgggagtgcatggatagggaagcaggggaggggagcgggggagagtataggggactttcaggatagcatttgaaatgtaaatgaagtaaatacctaataaaaaattggaaaaaaaaaaagaaaagttggctgctttgggtttcagtttcatgtctgtgaccgaaggcacacctcccttaatgagcagccatatagttgaaatgacacaggacaggaagtacctcagtgcttagcagtagccagcgcaatgcagtacaatgtagtggttctcagactggaaagcttctgaggtcctcaagaccctttttaggatccatgagtgcagaagtgtattcaaagtgtattcaatacgacacaaggaccctagaaagtgttatattctctctggctctgtgtctctgtgtctctctctctctctctctctctctctctctctgtctctctttctctctctgtttctctctgtctctctgtctctctctctctctctctctcgtgtatgtgtgtgtgtgtgtgtgtgtgtgtgagtgtgagtgtgcttgtgtctgcatgggcatatgtgcaccacaactatgcaggtggtcatgggagcctgaagagggtgttaagagaccctgaaactgaagttagaggtagttgtgttctgctcaatgtgaatgcagggaaataaactatggaaaaacaggaaataatcttgagccatctttccagctccttcactaagattttatttagctctctcatcaggtcatactggtatattctacaggttacagagcatgagacatgacagaccgactacaggcaagagtcttccaaagtatctagttgtccccatttcccatgatgctgccttaaaccagtctctcccagatatcctatgcaatggaatcattccccatggatctctctctgaatactgatcaagttcccaccacactctgatgtaattgatatgtgcctggggtgcactggggatcctgaaagttccttagattatgtgaaccaagtgtgtgacccatttcattaagtgattttggaaataaaacgagtgcctttctgcatgctactctaaaaaaatatagttgttttgggggtaaacattatttctgtcaacgtgtaatgaccattaattttgaacggaataaaggagttagttcagagactcaaaaagagcttgggagatagatattgctagataaggagcgagaccgctcaggttgtggaaccagatggcctgttgctatggaccctgtgaccttgaacaaatcttatcccttttgcatatcaacttccttgtttggttatgacaataaaatttgccccaggatttttgtgaggtcaaataggcagaagccgtatcatttggcacaaagtctgagatatagggacttcaccaatatttgtcatcattgattattgatttgagtatttaccctagtttgcttctctgttgctatgataaatactacggccaaaagaaatttaggggacaaaaggagttatttgctttatattttcagataagagttcatcactaaggaaagtcagggcagagactcaaagcaggaatctggaacagaaaccatgaagggatgctgcttactctgttctgttacccattattaatttgaataaaaatggtgcccataggcccatacagagtgacacttttaggatgtggagccttgttggaggaagtatgtctcagtcttccttcttgctgcctatgattccagagtaaagctctcagttcatgctgccatgcttcctaccatgacaatggactattaaacctctgtaactataagccagccccagtgaaatggttttctttataagagttgccatggtcatggtgtttctacacagcaattgaaaccaaactaaagcatccatagagccagctagttttttaaatatagcatccccccacctgcttggggatgataccacccacagtgacatgggccctcccacatcaagcatcacagtgtcccacaaatgtgatcacaggtcattttatatgggcagttcctcttcccaggtaactctagttagtgtcgagttaataaaaactaaccagcaatagcacagttaattttgtagatgtctggctcataacatttgatgatcttgtgacttcaaggcacaatttgctgaccaacccatttttctttccaatccatctttttgcttcatagagcaggagcccttgtgtggagtctcttaggggatttatcaggagactgtcacaagtagcaaagtcgtatgatttggtcacccctgagtctgagctctggctttgctcatgtagagtagccatgccacaatgagcacagggtgtgtgtgtgtgtgtgtgtgtgtgattacaccaaggtgatcactctattggaggaggaaatgccattatcagggagaagaatgtgtttaaccagccaaaaaggtcccctatgagtcattcccaacccattttccctcaaataattgtgaactttaagtgtgtaagtgtgttggctctttctcacaagcaggactggcatctgagttttatcattttgcgtttttacttgtacagtactattcaacagcatccccttccttctgtgtagcatcccagaactgaggaaaagagggaaatgaagagttcaacaatgctgaagatcatcaacataaccaaaatcccctgaaacagagagaaacaacagagtcgttatattaggacagtgatggattttctgatcaccacaaagtcacacaccattaccacataataaaccaccacctttcaaattagtgaaagataatgggaatataatgagtaccagcataggatagcatagcatagcatagcatagcatagcatagcatagcatagcatagcatgggatagcatagcatagcatagcatagcatagcatagcatagcatagcataggatagcataggatagcatagcataacataggatagcatagcatagcataacatagcataacataggatatcatagaatacgataacatagcataagatagcatagcatagcatagcatagcatagcatagcatagcatagcatagcatagcaaaagatagcatagcataacacagcacagcataggatagcatagcttaacacagcaaattgtttaagaaaaatgaaataagatatttactaagttatatacaaggaattctccatttcataggtatagcctgcatagaatgcacatcagaaaaatggtctcttgaagaacaaaagaatttcaagagataggaaaatggtaaagacaaaaaataggaaagggaagaaaaatcagggaagagagaaaaccgctactccagaaaaagagtaactcggagaacaagagacgtgaagagaagctgagactaaaggcaccacttggttctttctaattggtgcagaagacttttaaagtaggttgtaccatggtcgctaagagcacacatagccagccatacacaactggccaggagtccacatgccagtcaaagcttgccctcttctaagaacagatccttctgttgccattgcaaatgtttgtgtggctaacagtctgttctcagctatatttgtaccttttgaataactattggagattacttttttttttttaacagtgacatatgtcatggtgtaaagtatttccatacactgcacttgtgccacaggagctgattgatttccttcatttttctgtggttttctttcctgtttttgttttgctttgaataatgctgcagcagagttctcataatacatgtgtgatttaagtgtggtggcgataaatactggattgggagctctgtgtgccttttatgtgcgtgaatgttgtctcattgctgagtcctctcaggtaatgatttctcaccatgcccctgcctgccatcctacttcctcattaatcctggaatgcagcctggaagcttctgactgaatcctagtggatgctgatcacattgatcaataaatttccagactcttgagagagagagaaagcaaattgagttttttcttttggggggggggtgagaattcattttaaaaaattgattaattaatttgtatcccaaatgttgcccctgggctctctcccagaattcttcccgcatccccccaccccgaccccttcacctctgagacagtgcccttgtcccgggcatccccccttctctggggcatctcatctctacaggattaggtgcaccctctcctactgaggccagacaaggccgtcctctgtgacatgtgtgccagggacttcagaccagcccgtgtgtgctctttggttggtggcttagtctctgggagctcccaggagtccaggttagttgacactgttggtcttcttatggggttgccagccccttcagctccctcagtccttcccctaactcttacataggggtcccagacctcagtccaaagtctgaatgtaagtatctgcatctgtatgttatcaatctttaatatacctactggactctcattttttttatttatagatttattcataccatcttacattattttacaccagttatcacagtactttggacagagcagaaatgcctattttcaatttgccataccttatatagacaatttaccacacgttgttagaaatctaacctaaatattaaaaccaaataaaaaccatagacactcacagttataatatatactgagaactatgaaccatgaggacattgctaagcctctgccttttagaatctttttatatttgtattatccttagttacttgcacgttttataccttttataagttatgagcatttattgtcctattccacaatgcgtggtctaatgctgatctgatacaacaggcttctgaatgagaaaaaggaaatacacatgtgtctataatactatctggatggtgctgaccgggtgataacctttttgtttacaccatctgcttctccctctagaaacggcacaggatacttacaatgaatagaatggtaataacaccacactgcataccatctggagaatagccacagatgaattccccatctagaaggaagccaaatatgaggagaatgattccagctgctgctcccagagcactaagtaaattcattgcccggctcatttttatctgcaacagaatcagaaaataaaagacttaggcctgccttgtttcacagacagggcagtgcgggtggaagactggagagatggattttcacagtgccaagaaaccacatatacatatatacttaccacacatacaacttaatctgtgcctggttaacttccattcaaatagagatagctatgacctatttaaatgttcatttaaagactgtgtttaactaaacactgcatttctccatcacttttacatctccctaaaaattacaaactttagggctggtgagatggcttagcagataaaggtacctgccacctgacaacctgagttctatccttaggacccacatggtatgagagaacaaagtcctaaaaactatcttctgatcttcacagacacactgtgcatggaaatgtatccttcccacccccacatacacatagctaataaataaaggcaaacacattttaaaattacaaaattttaggacgttctttgatgcaaataatttactgagttattactatctaatgtctttgtttatttgagtgagatagaatactatcagcaaacctttggagtgtgcttgtgatttaattaggttgtgtgcactgtgcttttcctgtgagtcaagcaatagcctgttacagtatctggcatccagtaggcaccaaaaatactcatcaaaaggacaaatgaataaatgactagattactgaggtctactctgcattaacatctggggaccaaggacggagccactcaacggttctgtgcctcagtatcttcatgtaaagcatgagactctgacatgacaatctggaaaagtgtcccaatatgaatgacttctgattctatgatgatttttgaagccagcaaaatcactcaacaattataatttttaataaagtagacatagaactcaccagagtgtccgtagttttccttttcagagcaatcaggaaggccccagagttaatgaactacaagaaagaaaaataaaggataaatatcctagtgatggacatgataagaggatgctgaaggtctctcaggtcaggtctctgaacacttctatgtcttccttctaagcttacagaaaccccagggaaatgaggagggtaaaccacctcacagagcaaagctaaaaaggctggatctttagtctgtgccacctctttgaacaaaaggatgtttctaccttactgggctttcatatctttatccattttcctgttgttgatctgttattggtatcatgactcggtgtcaaatgcccagtgtcatcagtttatgagcactaaggccatatagttatcatagtccaaccagtttattctgttggatggaaacataaggcacaatttcagccagcagacacagactgatagttgaaaaaaagaaaaggaaagaaactgcccccccccacacacacacactaattttcatggaggtgggtcagatatggcagcctcattgtctagcagaaacttaaaatctgagttcagcccagctgtgtttaaattcttgcctcttcctccagacccattattagagaatgctctcccagaccttctgacagacaaggaaacctttttcccttttcacccagacaccccctgttcccatcctttgtagatgctttccacctaattagacaactcctcacttgttaagacttggtccagctggaaatgactctggacagtgccctttcctctggaagtggcttctgtgttccatgtcagtatttctcacaccctacgaggaattgctactagggactggcttctactaaattctcacaccctgcccattctctgaagctaagtaggtactaagctaatagagatagcatacaattaaataagcatctctgtgctcagccacttgggagctgtccctgctccttcactttctgcagagtaaagtgctcatcagcatcagaagcaacactacatatatataaggagtttactgatctcatgacatgatttctttcttattagactaatgcctactggagaataatcactgtactaaaatttggatcttcattgtcttgctctgtgaatacagtttgtcatatgttgcaaataattttggatggattaatggactataaaaccaccataaaacctaaaggaatatcccctccaaatttcaagaccccaaaatgggctactgtcaactttggtgattcaacagagcagagagcttgctttaattcccatgaggttaatgtcttagttgcatttttctgtagattcacatacccaagtctatcttgtttcataactaagaatccaatcgctaacacctcccctgattgacatacttttttttccattttttattaggtatttagctcatttacatttccagtgctataccaaaagtcccccatacccacccacccccactcccctacccacccactccccctttttggccctggggttttaattgaactaaatacattatactcaccaaaacagagccccagaaaggatatcctgagataaatataaaaggaaaccttgggtatgggtttaccaaggtgaaaaggaaaatgactccaaatgaaaagttcatgattccaaacaggatctgggtggtctacaaatagagaggaaagtcagcacacatggggatggggctagtcccatttaaatcgttagttcaaggattcggcagttaccctttttatagccaagggaaggaggatggatgctcctttacgatatccctacatggttccttacccacactcccatctgataattactaagaggaaaatgaatctaacccagtgctcccaacctcagggtcagctgcgccatgagtggatgcttccaggtcctattcttgtctgactgaaatcgccagctcaccagcacatatgtgtgaatgctgacttttaaattactgaatcaggttgacctcaactggacacccagggaaatcctctgtgtagggggaggagctgatactaaaatctgattccctaattggttcttgattgcgtcaataaagaaggcagaaaggatttgctgggtgaaaggaaaaaggtaggatccgggtccaagaggaagagaatggacacagggaaggaggctttttggctacgctttggaatgagaaagtgcagcagccatgtaaggtcttagggcaaccagaaccagcagcctctgccatctgagttggctgaaacaggttagctgataagagcccagcaattgtgccagctggctagttttaaaataataaaactgtctagtttttttgtttttgtttgtttttcctctgagctaaggttgcaggggaaagagagaagatggcgtgatagctggtgctttagtgaagctagttgagaggggcctgtggaatgtggacagcagctgctggatttcccggatggttacaatcgagttggagcaaggagaactgaaagaagttagagtgtggccagggcaccgggcaaggaaatagtatgtttttaaaatcacatgttacactcttgaatgtgaatgattctctgagcctttggaagtagtgctgcattgccacgagcagtgcatccttcccgggctgttctttctgctccctgtcctatgcttgtgagacacatcctcaacatgctgttaatgttaggcagggggttgatgggtgctagagaagtctggaaagaatgacaaaaagagctgaaggcttatggtcaggggttatgtcttctgtgaccttttcagtgcacttccttggtgagctcttttgttactgtactaacatttagtggctgagtcataagaggtattgtgtacatttttatcacatctgcatgactagtcctcttcaaagtaccactaccaacttatattccatgtcttaaaatgggttcactttctccctttaagcctgatttcctgacttctatttctctgttgttgatgctgtcatctttctaggcctaggacctttgggtcatctcaagtttcttgatggcaacaatcccagagtggctaacttttctattatctctactcatggaatcatacatacttcagccagcaagatggttcagcaagccttgccaccaagcctgacaatcttgagttcaatccctggaacccacatgggtggaaggtgagaatatactcctgcaagttcttctctgtctccacacatgtgctgtggcatgtgcatgaccatgtatacacacacaaatgaataaatacatgttaaaaatataagtagcaatctggcagaagagttaaaacaagttcatattgacttttatcccattttcctgttgtagacagcactgggatgtgcatttcatagctctcctgtttctcctacatgtcggtggatatatagatgccacaccaactccagtagtgacttgcatgacaggcccaaaagcttggacacagtcccaaggcgaaaagttcatggaaacttggtctcctggaaccatggcatcctgtaaaatgaatgctccaaatctgtccttgctttagtcggtgaatggatctgtgtgatttccttcaatattgttttattctaagtgactctaaggattgattttgacatatagctaagttagattagccttcatcagtgttccaatatcctaggaaattgttgagccaaccttgggctttgatcgttgtaagaatgttactcattcagatgaaatgcctccagtgttgatagtgatagaaatcaggcattacattctactagaatagagctagtaatctcagggctagtctacgtagtatacttagaacaatagatagctgagtgactcccatacacaggaacttacaatggcctagggggaaggtggattataaaatagactagaattggaactatggcaagggcatgaagcccttgtccctggcttctaagattaagctgaccttaggtggggctgcttttgatcccagttgttaacattgatttttatcccagtttgttcctgttagcttttatgtatgcattcctctgttttgttgtaagagtcattttgatcagataacttcagtgtaccttggatgaccttaatgtatcacttaacttccttgtttccttctgtaatataagcctgatgctcactttgagaaactacattcataacactcccttgtgtttgtgtctgtcactttttcgctgactccctgcccacctgtaccgggaccctgatcctcctgcagaatgagggccgactgagtccagtctgcagcacatagatattcctccatcactcatcgtcacctagagcactcactgattctttcatgttacaatatgaaaacgagactcttcacgcttcctcttggcttgttagctaatttcttgtactacagaatactattctattatatgggtatgatgggactaatttgtcaagcttcttttattagtcttcttaaatcctttaagcctagattgacctctcccagcctcctccactgcttccccgatgcttcctgctctttggcttcaagagcttactgcatcttttgtgcttctgtgtcctcattttagttctactcgttgagattccatgatttcttcacggtccatatgaaatacccaattcattgcagaatgtgctcatttcttttaactggaacaactgttctaactctgggcattcccacatcactgtcaccatttatgatccttctagatactctattgaaatataattcttaatattttcatagtattattattttcacatgaaacctttattttcttaagtgaggaaaaactagcttatatttttttcctgtgaaaacagcatccaacatagttgtttgcacctagtgcagtttctgttaaagcaaactatttcattcaagcttgaagtccatcatacttgacgagatgctgaagcagattacattagtgttttttttcccccaagtgccacagaatgatatttattttttgtcttgttttattttattttttgttctgaaaaggattactttgtactttccattacgagaggccagtgttcaaaaggcaaaatattctccaagatatgtgtaacattactacctcaaacatatctgactgcttcctacctgtccattatcctaagaaaggtttggtaaatgaaattaacttctgtggaatgacaggttgatggatggagaaatgaatgtttgccaaggtccatctaagcctagacaaagaacttcaggcaactaaggatttctgagaaagagagaattgatcttttctagagataacccccacccccaatagattatccaagtatcagccagcaacactaataaaactctgaaagttgtatttatatgtttgcgcatttatatacatatgtaaacaataacaaagaaaaagagaccataaatttgagagggaacaatgggggaggagccatgaatgaggttggagggagatgatgtacttatattattaatttaaaaattaaagaggccattctaaaaaaatctttatacttatatgcataaacaaacatatatatctgaatactatgtaaaactatgagttctgaggtctgcttgggaagctgtaaaagtgtgtgttgcagtttgctaagagaagaaatctgagctaacttatactcagttgtccttttttcttttgctccttaagattgactagaaagataattagtttggaggctgtgatttttaagagttcaggaacattgaatttactcatcttgtattttcctattcacagaatcttgttcataattcatgtagaagcacaatccatacttcctgaattgattggcaatgacatatggagctgattccttggacattgtgtgctaccagatcttatacatagggacacattttacttacccctaagatctccaattttctaataatgatcttctgcactcggttttggggattataggctgtggctgtaagttctgttgtttggtattcttgagtggtgacctctggagggaacaccaggaacaagggactatgtacattttttgaatccatgatggtatagttggttttttcaagtggaagggaaggatagagctggcactcccatttagaccatgttcgtttcctgtactgaagctgtttagagcactggcattgttgtactctgatttagaattatagaaccataaagtcacagagtcatagaatttcagggatgggcaagagcctaaagaattaaagtgccattgcttgtgtattggtttggagaatatgactagtagtcttggtttgatcagaaaatacggtgtccttgggcaagtcatatactactttgctcttacaactacctcattcacatatgtattaacctgtcaaatcttttagttcccaagtttctaattcttccatttcaagtgtagagagagaggacaaaacctctcaggccttaaaactaatcagtcatattattcgtgttgcctgtcacttaaaaggttcttttcttgttttgtgtcaacgtcattttagcagacttgtgttatataccaccctaaagcagagtggctttaaagaactacaattctgttttgtgggaactctgccagttacattgctaatttttttcctggctagtaatgttctatttacccctgtcaagttttctcatacatctatggtcactagtggattgtgcagaattagatagcctcagtcatgcatcttcatcagtggatctggctgccaaattgcaaaaacataaatgagcaaaagaatttattattttttttaagtgtatgtgcatgcgtgtgttggtgtttttgtgaatgtatccaatttgtgtgaagatacatgcagaggccagaagagttcatcagatcccttggagctaactataggcaagtttgaactgcccagtgtgtgttccatgtaagagcagcaagtgctctacagttatctctgtcccaccatgtcttattggtcatatatatatatatgtgtgtgtgtgtgtgtgtgtgtgtgtgtgtatatatatatatggacatgttttgttagtcatatacatacatacatacacacactcacacacccatatatatgcacacattttaagtggattataatgcacttggtctgtaagtcaatgttagtaataatagaaaatgctattagtcagctactttttatatcattctgttctatctattatggtcaaatattttatctcaatttgtttccatagttcatttaagctgtttctttatcagtttaatatgtatctatgagcttaaccataagaacttgacagtatcacaatgagttacggcaagtgttactgatctgtggttctctattgcaggtggttgtgaaaggaaataaaacttgagacctgtgattcatgtaatgtgtgtcaaatagtccaaagagttgtttgtgagctttgaaacctggggctgagaacatagcagaacaggccaggatatgcccgggcaggcctgtctttaagacattcctgaggctgcttggccataaagatagagataaagagaatgacatgctggactggcccggcgcctccctatctcccgcccttctgacctaagttaaatgttaacaggctgctgatgtttaaatggaccaatcatgtgaaactgagccaattcctcccccagccccaccccttttctataaaaacccccagcttccaagcctcggggtcgaatccactgtcttctgtgtaagatacggttcgacccggagctctgccattaaacagttgaaaccactgtctcctgcatgagatacgtgttggcccggggctccgtcattaaactacctcatgcttttacatcaagatggtcgtctgttcatgattcttgggtgcacaccaaatcgggaattgagtggggggtttccccactaggttctttcagttgcttgctaatagacatctcaggtgtgttcattttgacatggatggtgtatctgagctcagttttggaaagcttcataaatccttatgtatcttattttccagcattacaaaatctcccttcacgggaggtcctctaattttaaagtggtttatgaatgactgaatattatatattttttattaggtcttaatgttccctaatcaaaccttcatcttgttgttacctgttcttgggaagttatgatgatgcaagtggtcagactgagttcaaggcttcatctctgatttccttgctgtgtggttgtaagaaggtttcccatgttccttcatttatgtcatactctagatgaagcttacttttccttgtttttaaatttcttgtcttcctattaaaaaaatgctctccttccaaagacctatatccaatccctagagaataggacagtggcaagtgttctctgcctggaggtctccaaatcctctgggtgtcattgtcattttaagtcacaaacagtgagtctagatcttattccacaaaggattgtgaaaaatccattatttctcccgatgtattcagctatgttgggagagctacaaggagacatgagagggggaaagtggctggggtttctgtttatcctgggctgctgctttagggctgacttcacgctgtgctgtcctgctggtcattattactttcaagtagaaatgctgcagcatttcaagctgcaaagattgttttaaaataaaagtggcaacattttttttaatagaacctctaagagcaagcactagggacttcccactagctgtgtcttctgacacacactttctaatccctagtcactcactggtcagtatatccatacaaatgttctctgtatagtactccccttgtgactaccagggattttgctgtaaaaaacaaattggtatttgatttatgatgattgatttttgttgtttttatgcccttgtgcgttctaccatctaagaaaaggtttgtgttagtatttttgggccaccataaccaagtacctaagaatgggtgatttaaacaacacaattttatttgtaatttcagacaacagaaaatacaaaatatgggtgccagcaaacttatatttttaatttttttagattataatacaatcacattgtgtctcccccctctttgttccctctgatttctcctatatatccatccttgatctccttcaaattcatggcctctttttttcactaattgtgagtatatttctaaatataacctgttcattctgtataatgttacttgtatgaatgttttcagggatgactgtttgccactggacaatcatttggtgtgctctttgtctgggaaagactttactccattcccagcttttctcagttgcctaaaggttgaggaatcatgggttttctaattcatccaccttggcatgccaattggtaccatcctcgttcagttcatgtttgggcaatcatattgctaagactttgtgaatataacttgtgatgttaatatatgacacaggctcatagcaaactccttgattattgtggattttcacacttttttttttccactctttcatagtattctctgagccttacatggctttgttttgtatatgtttcccttgagacttgtgctccacaaatctgcattttgggtcattatggttttctgtggacagagacttgtgtgtaagctggaactgacttgaatatcccttccctgaagacttgctttcatggcaccagaaggcaccatgtaaatttccaaaagagggagataatcaacagtcctatgatgccaacgaagcacatcaacaatcagtatgacacagtaatcctaaaagcacagtagtagcacacaaatctcggtggaaaccaaaagctaattatatataagttcagttcaacaagagggaaatcattcttagtactagaaatctagttttcagactggtgaaatcacagctattgggagataatctacaacctctaacttactaaattagcataatccttaacaacaatctataaataattgttcttatacctgcaaacttatgtttttatggtggttctcttcttggctgatttctttctttctttctttcttttttaattaggtattttcctcatttacatttccaatgctatcccaaaggtcccccatacccacccccccaatcccctacccacccactccccctttttggccctggtgttcccctgtactggggcatataaagtttgcaagtccaatgggcctctctttgcagtgatggccgactaggccatcttttgatacatatgcagctaaagacaagagctcccgggtactggttagttcatattgttgttccacctatagggttgcagttccctatagctccttgggtactttctctagctcctccattgggggccctgtggtccatccaatagctgactgtgatcatccacttctgtgtttgctaggccccggcatagtctcacaaaagagagctataactgggtcctttcagagaaatcttgctagtgtatgcaatggtgtcagcatttggaagctgattatgggatggatccctgcatatggcagtcactagatggtccatcctttcgtcacagctccaaattttgtctctgtaacgccttctatgggtgttttgttcccatttctaagaaagggtaaagtgtccacactttggtcttcgttcttcttgaatttcatgcgtttggcaagttgtatcttatatcttgggtatcctaagtttctgggctattatccacttatcagtgagtacatattgtgcgagttcctttgtgattgggttacttcactcaggatgataccctccaggtccatccatttgcctaggaatttcataaattcatttttttaatagctgagtagtattccattgtgtaaatgtaccacattttcttttgatgcctttgtatgacatttcctcagctctctgggtgtctttatgcatagtctcagtctctccctctcccaccctctcccaacctctctttctgtcgtgtgtgtgtgtgtgtgtgtgtgtttgacaaaatgtagtccaacttatcttcaagcttactggtccaggctgcctttgaactcacaattcttcagattctagagtgctaaaattataggcatgtgccactgtagtaggacactactgccatcacaagggtccctctcttgtattttcattggaacctagaatcttcaaagctctatttccagtgttataatattaggaattaggacttctgcattagaatttggaggtgggatatttctgtccaaagcaaagagataattaacttgattagtgctatgaagcagcacctaccatatctatctatctatctatctatctatctatctatctatctatctatctatcatccatctatctaactatctaatttatctatcacgtatccacccatctaataattatttgtccatccagatatctatgcctaatatatttgatctaagaaaagcttctgtggaacagaataaactccctttcctgatgtggctcttatacatttgttctggagttttctaaataagctcttcaatcccatcaaatataaagatgctaatgagtctgtcttcagacatcactagagcactattagtccatggcttgacctggctttagaatcttacaaaatttccgtacctactgcttctaattaagcatttattgacaagagtctgggtgacagtgctcatgatacttgaaaatgtttttcagagtgcataaatatgaggttgattgctgccactttgtgtgtgtgtgtgtgtgtgtgtgtgtgtgtgtgtgtgtgtgaagagtagggggggtgaggagatcagggattttaattcccaaatcaagtataatagaaatgacccactactgtgtgttctgaagaatcctcttcttttctgtagtacagagttaatgttacagaaaactaagtgcaagatctcatttagcaactggctggattacaatgcaaattgaattcactgttctttgagtcactgctattaaagtgggatccttggtaaggacaaatagcattctaaagttggaatggctaagtatggtaagatattgcaaatctgaaaacattgaacactgaattctaatgagactactatctatattcaggggaagaagtctctctgtgccatcaggtcctgactatctgtgaataaaccctgttgcctgaagagacttcaatggcctcatctgaaggagttgctatgtcagatgatactccttcatgtcaaagcacattactttttcttttcttctttttatggttttgtatgatttttttagtgtttcttttttttaattagatattttcttcattcacatttcaaatgctatcccctttcctagtttcctctccaaaagtcccctataccctcaccaatccctgctccctaacctactcactcctgcttcctagccctggcattcccctatactggggcatataagcttcacaagggcctctcctactattcatggcatactaggccatcatatgttacatatgcagctagagacatgagccctctgggggtactggttagttcatattgttgttcctcctatagggttgcagaccacttcagctccttgggtactttctctagctccttcattgggggcactgtgttccatccaatagatgaccgagagcctccacttctgtatttgccaggcactggcatagcctcacaagagacagctctatcagggtcctgtcagcaaaatcttgttggcatatgcaatagtgtttgggtttggtggttatttatgggatggatccctgggtgaggcagtctctggatggtccttccttcatctcagctccgaactctgtaactccttccatgggtattttgttcccattctaagaaagaacaaagtatctacactttggtcttccttcttcttgagtttcatgtgttttgcaaattgtatatggggtattctaagtttttgggctaatatccacttatcagtgagtgcatatcatgtgtgttcttttgtgattgggttacttcactcaagatgatatcctcgagatccatccatttgcctaagaatttcaaaaattcattgtttttaatagctgagtagtactccattgtgtaaatgttccacattttctgtatccattcttctgttgagggacatctgggttttttccagcttctggctattataaataaggctgctatgaacatagtggagcatgtgtccttattacaacttggaacaccttctgggtatatgcccaggagaggtatttctggatcttcccatagttctttgtccaattttttaggaattgccaaactgatttccagaatggttgtacaagcttgcaatcccaccagcaatggaggagtgttcctctttctctacattcttgccagcatctgctgtcacctgaatttttgatcttagccaattctgactggtgtgaggtagaatcacagggttgttttgatttgcatttccctgatgattaaagatgttgaacattttttcaggtgcttctcagccattcggtatttctcagttgagaattctttagcgctataccccatttttaatagggttatttggttttctggagtccaacttcttgagttctttatatatattggatattagttccctatctgatttagaattggtaaagatcttttcctaatctgttggtggcctttttgtcttattgacagtgttctttgccttacagaagctttgcaattttatgaggtcccatttgtggattcttgatcttacagcataagccattgatgttctgttcaggaatttcccccctgtgcccatatcttcgaggcttgtcccaactttttgtctataagtttcagtgtctctggttttatgtggagttccttgatccactcagacttgagctttgtacaaggagataagaatggatcaattcacattattctacacgatgataactgccaattgagccagcaccatttgttgaaaatgctgtcttttttccactggatggttttagctcctttgtcaaagatcaagtgaccataggtgcgtgggctcatttctgggtcttcaattccattccattgatctacctgtctgttgctgtaccagtaccatgcagtttctatcacaattgctctgtagtacagcttgaggtcagggatggtgattccaccagaggttcttttattgttgagaatagtttttgctatcctaggttttatgttattccagatgaatttgcaaattgccctttctaactcagtgaagaattgagttggaattttgattggggtttgcattgaatctgtagattgagtttggcaagatagccatttttactatattaatcctgccaatccatgagcatgggagatctttccatcttctgagatctttttccatttctttcttcagagtcaaggcatatttctacccattcttgctgtttctgtacttttattggacttaattgactgcagaccacaatttatggcagaaaatgtggctcaggagacttgctagactgcttcaaagtacccgagccttttctcttcagcctcccacaagcctgaagcaggctgagccagaagttgaccttgctgccactaaggagattatctaggttggagccttcctccttggatcactctatttttctgccattgctgctgccgctacctgctgggagtcagcctagctgttccggagcctacatgtggtcacctgcagctgggctccaaggatgatttggtgggaatgggttttctcctctcctttataaagtgttaattaaaatttgaaccttgagcaaactagttgtcttggttccattatttctcaacccatctaggctcccccttctcttccagttccaagatgccttccggactcgaacccagacatgagagccgcaggccagccccaacaatttggtgaaccaatgcagaacctgggaatggcagaggacatttggaagaagcactgctggtttgtagctccacggaagaagaaaagaattaaagaaaattcgttcctggaaaaggttggtacaggctaagctggatcagtactaaacccgcatgctggattcacttaggttcagcagtgagttatcgggaactaggaactcaacttccagaagctgcctttttttttttaggcgagagaaataaaagggtttaataaaagagattttataatcaggcggatggccgcagttggaaactgcatcaggaaagtagattttgaaactctcccaaggacagacagaaaaatcggggaatcccctcttgtgtgcatgctggccagtgtctttgttctgagtgtctgtcttatgctaccggaaacgaacatgtgctcgttgtgttggtttgttgtctgtgtttcgtcccatgtctctgaaaacatggcgcagtctgagtttagatccgcctgagtttggtttctctggtgtttatagatgatggggttttctgaaatgcgcacttggtaattgcagtgtccctttgggctgtaagcaccggaggactgtggtcagcagatgtgctaggaagaccactacctcaccaggggacgccctggggagtagggagagccagagacgtctggcaatctccggagatcggtcagatgaaccaagttttgtttatgaaatggaagcttacccttctaattcttttgcctgctcgtggaagatgagaaagggttgcatgtgtctggatctgttggtttctgttttgtgtgttctgtgtatgtgtttagagctatgtgaaaatttagaaaagtgctagtgtaactggaaaagccctactgggagctgattgcaaatgcagctcttaaaggggcaggcagccttttgcctgtaacagaaagttagcttaaaattggtaactcagagttagagtcattctaaacaacatgtggcaggagcgaacccaggaaaacaggtctttaaggatccttcgaaataggataatctttgggccaggactctggcagagtgttcagattgagaaaagtttgtgcttgggtagctgcggagctcagctctgagcagcctcagggaggtttgtgtggcatttcaggagatgttaattggctaagacctcaccttaaactcaccacaggagaacttaagcctttgtcaggtgctattaagtgagacacaaattaactggcaaagaacaagaggccttgcagaaattaaaggaagcttttatagttgttatcaattataatcaatggtaattaaatattagctgcttattttagttattggttgttaaatgtgcccacagcaattccttggctagaaaaaacattgttgtaaaatcatccttcttcatctcaaagtaaagtttcagcatcctattaaggccgccatggtgctaacaaagaattgtaagataaattcatagatttttagaataactataacaaaaattgtgtcttaaaaacctgtgtctgttccttgttctaaacagcaattaatttggttattacagaatattaatatttgatttattgcataccatcattttaaataataatagataagttaataaattgtttttatgcgtgcttttgtatcttctataaattcatgcatgcatgcatcccaattactgtgtttaaaaacagccctcttatgggagaaaagtatatgtgaattggatcacatgctttttcttttgagcttccccctgcttcaacaaagataattaaattgtgtgttgtagatggtattttaaaatgttgaataatcaagcttaatttgtatctttattaatatatatatctcagagctttcaattgcttaaaattgttcatccctcaaatgctattaattctcaagcttgcaattgcttatgctattcataagaaaaaaatactgttcctttaaaaagactgtttgtggacagttaaaatattgtcctgggttgcctggaaaagactcccaggatttgcttttctgttatagagatttacaaaaagctttagctgaaaaaggattatagatagctactgaaaatatacaaacttaggatctttataattatttgggctttagacttactgatcaagctgtttttccccagaagatagttattcgcagagacaacgtaaggactttgaatgattttcaaaaattgtttggtgatattaattggcttcacccctatttaaagatcactacataagagttgaaacctttatttgatagtcttaaagggagttctgatcctacctcccctaaagcactaacctcagaaggattgctggccgtacaacaagtggaaaaagctattgaaaagcaactgtcacttatatagattactctttgccgttacacctgttaattttttaaaaaaattttattaggtattttccccatttacatttccaatgctatcccaaaagtcctccatacccacctccacccccactcccagacccacccactccccctttttggccctggcgttaccctgtactgggccatataaagtttgcatgtccaatgggcctctctttccagtgatggccgactaggccatcttttgatacatatgcagctagagtcaagagctccagggtactggttagttcataatgttgttccacctatagggttgcagatccctttagctccttgggtactttctctagctcctctattgggggccctgtgatcaatccaatagctgactgtgagcatccacttctgtgtttgctaggccccagcatagtctcacaagagacagctatatgtgggtccttacagcaaaatcttcctagtgtatacaatggtgtcactgtttggaagctgattatgggatggatccccggatatggcaatcactagatggtccatcctttcatcacagctccaagttttgtctctgtaactccttccatgggtattttgttcccaattctaagaaggggcaaagtgtccacactttggtctttgaccttcttgagtttcatgaatttagcaaattgtatcttatatcttgggtatcctaagtttctgggctaatatccacttatcagtgagtacatattgtgtgagttcctttctgattgggttacctcactcaggatgatgccctccaggtccatctatttgcctaggaatttcataaattcattctttttaatagctgagtagtactatattgtgtaaatgtaccacattttctgcatccattcctctgttgaggggcatctgggttctttccagcttctggctattataaataaggctgctatgaacatagtggagcatgtgtccttcttaccagttgggacatcttctggatatatgctcaggagaggcatagctggatcctccggtagtactatgtccaattttctgaggaacctccagactgatttccagagtggttgtacaagcttgcaatcccaccaacaatggaggagtgttcctctttctccacatcctcaccagcatctgctgtcacctgaatttttgatcttagccattctgactggtgtgaggtggaatctcagggttgatttgatttgcatttccctcatgattaaggatgtttaacattttttcaggtgcttctctgccattcgatattcctcaggtgagaattctttgttcagttctgagccccatttttttaaatggggttatttgattttctggagtctaccttcttgagttctttatatatattggatattagtcccctatccgatttgggataggtaaagatcctttcccaatctgttggtggtctttttgtcttattgacggagtcttttgccttgcagaagctttgcaactttatgaggtcccatttattgattctcgattttacagcacaagccattgctgttctattcaggaatttttcccctgtatccatatcttcgagacttttccctactttctcctctataagtttcagtgtctctggttttatgtggagttccttaatccacttagatttgaccttagtacaaggagataggaatggatcaattttcattcttctacatgataaccaccagttgtgccagcaccatttgctgaaaatgctgtctttttaccactggatggttttagctcccttgtcaaagatcaagtggccataggtgtgtgggttcatctcagggtcttcaattatgttccattagtctacttgtctgtcactataccagtaccatgcagtttttatcacaattgctctgtagtacaggtttaggtcaggcatggtgattccacctgaggttcttttatccttgagaagagtttttgctatcctaggtttttttgttattccagatgaatctgccgattgccctttctaattcgttgaagaattgagttggaattttgatggggattgcattgaatctgtaggttgcctttggcaagatagccatttttactatattgatcctgccaatccatgagcatgggagatctttccatcttctgagatcttctttaatttctttcttcagagacttgaagttcttatcatagagatctttcacttccttagttagagtcatgccaatgtattttatattatttgtgactattgagaagggtgttgtttccctaatttctttctcagcctgtttatcctttgtgtagagaaaggccattgacttgtttgagttaattttatatccagctacttcattgaagctgtttatcaggcttaggagttctctggtggaatttttagggtcacgtatatatactatcatatcatctgcaaaaagtgatattttgacttcttcctttccaatttgtatccccttgatctccttttgttgttgaatttctttggctaggacttcaagtacaatgttgaataggtagggagagagtggacagccttgtctagtccctgattttagtaggattgcttccagcttctcaccatttactttgatgttggctactggtttgctgtagattgcttttatcatggttagggatgggccttgaattcctgatttttccaagacttttatcatgaatgggtgttggattttgtcaaatgctttctcagcatctaacgaaatgatcatgtggtttttgtctttgagtttgtttatatactggattacgttgatggatttccgtatattgaaccatccctgcatccctgggatgaaacctacttggtcaggatggatgactgttttgatgtgttcttggattcagttagcaagaactttattgagtatttttgcatcgatattcataagggagattgttctgaagttctctatctttgttgggtgtttttgtggtttaggtatcagagtaattgtggcttcatagaatgagttgggtagagtaccttctgtttctattttgtggaatagtttgtgaagaaccgggattagatcttctttgaaggtctgatagaactctgcactaaacccatctggtcctgggctttttttgcttgggagactattaatgactgcttctatttctttaggggatacaggactgttagcatccacttctgtgtttgctaggccccagcatagtctcacaagagacagctatatgtaggtcctttcagcaaaatattcctagtgtatgcaatggtgtcagtgtttggaataataattgatcattgcctacaagccttaaatgccatgggattgcctaaacttattaagacagataatgggccatcctattctagcaaaaaatttacttcattttgtaaagaatttggcatcaaacataaaactggaattccttataaccccatgggacaaggaatagttgaatgtgctcatcgcactttaataaattggcttttaaaaacaaaacaggggcagttatattccccaaggccaccaaatacacatcttgcttttgctttatttgttcaaaattttcagtggattgccactggcatccagttatttctagttcttatgccatggtaaagtggcgggagtaatgaatggaagggtccagacctggtcctaatctgggaaaggggctcagtctggttttttttgtttgtttgtttgttttgttttttttgtttgttttttgtttttttttgtttttttcacaaaaagaatatggagcacaatggctgcctgagagattagtttgacaactagacacagatcctgaatcttctagtatgactctaaccttgattatggctaaaaatcctctttagccaaaaagttaaattaagagcacaacctccactcccagggaaactgtaagcctttctgcaagtctcaaagtcacctcccccaggtggggagctctaagtctagcctgattgttgctaacttgcaattgaatggagtacctggacttcactgaaagaagcttttgtactgtgcctttcactgtctccactttgtttttcaagcaggtcagtcaacgtccttcatcctgactgcagtgggtgtacatccccgcccccaacactgggcaggtggcagttaattttcatcaagaagaattctaagtacatattgtagctttgatctgaattgagagtaaggtgtgctaatgagggcctgacagtcaatgacgggcacccagatctcggaatcataccaatctaagacaggggtacatgccaagatgccgtggctgttaatacacctcagagccatgttttgtgtaaaataatacaaactagctgcatgtaactttctatgatggataagggtgattcaggaagatctaagatttcctaagacagatggggcagccagccaccataactcctgggcgggactatggagcataaataaattttatgcctcagtccagctttttaaaaacattaataatagggaggagatgtagcctcccacaagcctgaagcaggctgagccagaagttgaccttgctgccactgaggagattatctagggtggagccttcccccctggatcactctattgttctgccactgctgctgctgctacctgctgggagtctgattagctgttccggagcctacacgtggtcacctgcagctgggctccaaggatgatttggtgggaatgggttttcccctctcctttataaagcatgtccgccattaaaatttgaaccttgagc

SEQ ID NO: 15 - DNA, 22105 bp, Mus musculus
gactggcagtgtagttttctctcatgaacctgaattttcttggccttggagcctatgagtttatgtccactgagtaggtactaagtggtccaaggtagagtgtcctagagcatggggtgtgagggattgagcaggaaagtagctgagtacagaacagctattttgtggtagatgtgatcctcactttcagactcctgttccagggagttatgggtagtgtcatccctgtagtaggagctgggcagaaaagtggggttcattgccttcttcacagttgctgaagtggtgctgcaggtgagcagaggtagagcagaggtcttgaagggtagaagcccaacacctggagctaggggttggtgatgatgtaacgatgatatctgcatgtctgcctggagcctgttcctttgtaactatagctctgcttcttttcctcgcagtcagccatacattgtctgcagacagtgtcctgaatacagaaggcaagcggtgcagtctcttccttgcccagtcccagagagtgagctgggagctacactggcccttggtggggaggcaccttcaacatctgccagcttgccaacaggtaagacagtgatatctaaccatgatctcttccatccactatgtcacatccttgtgattgttgttctattttcctatggtgtgattcctctatgatgtctttcttgtcctctattcctttgcttcagctatccttttgcctctcgtagcctcttgcttggcatagccattaatggaaagaaattaggggagccaggtagagataggaggatctctgtgagttcgaggcttccctggtctttatattgagttctgtctcagaaaaaaaagacacagagagaggagagagaattaattaattaggtgaacattgtttatttgagggtctccccttttggacatacctaataattgacagttctggttttaactttggtctttctctagcctactgcttcagggagtttgcttagtggggttttccaaagccaaaatgatcgttctgtatctgttacccaaatttaagagactggcttgcttgcttgcttccttccttactctctctctctctctctcttttcccttctcttaattattattttctttatttacattttaaatgttataccctttcttggtttcccctccaaaaaccccctatcccctaccccctcctcctgctcaccaacccactcactcccacttcctggccctggcattctcctacactggggaatccagccttcacaggaccaagggcctctcctcccattgatgaccaaaaggccatcctctgctacatatgtggctggagccatgggtccctccatgtgtgctctttggttggtggtttagtccctgggagctctgggggtactggttggttcatattgttgttcctcctatagggctgcaaaccccttcagctccttgggtcctttctctagctcctatattgggagggagtaatcatccatctgttggatgcatccatctgatggagtatcagtctactggttggctgagagcatccacctctgtatttgtcaggcagacactggtagagcctctcaggagacagctatatcaggctcctatcagtgagcacttcttggcatccacaatagtgtctaggtttggtgactgtatatgggatagatccccaggtggggcagtctctggatggcctttctttccttcagtctctgctccacactttgtctctgtatttcctcccatggatattttgttcccccttcttcttcttttttgttttgttttgggacaggatttctctgtgtagccctgactgtcctggaactcactctgtagaccaggctggcctcaaactcagaaatctgcttgcctctgcctcccaagtgctgggattaaaggcacgtaccattattgcccggcttgttcccccttctaagaaggaccgaagtatccacactttggtcttctttcttcttgagcttcatgtggtctgtgaattgtatcttgggtattccgagcatctgggctaatttcgacttatcagtgagtgcataccatgtgtattattttgtgattgcattaccttgctcaggatgatatttagttccatccatttgcctaagaacttcataaattcattaatagctgagtagtactctattgtgtaaatgtaccacattttctgtatccattcctctgttgagggacatctgggttctttccagcttctagctgttataagtatggttgttatgaacatagtagagcgtgtgtctttattacatgttggagcatcttctgggtatatgcccagaaatggtatatctgggccctcaggtaatactatgtccaattttctgaggtaacaccaaactgatttctggagtggttatactagcttgcaataccaccaacaatggaggagtgttctttctctacatcttcactagcatctgctgtcacctgagtttttgatcttagccattctgactggtgtgaggtggaatctcagggttattttgatttgcatttccctgatgactaaggatgttgaacatttctttaggtgcttctcagccattcggtattcctcagtcgagaaactttgtttagcttgtaccccattttttaatagggttatttggttctctggaatctaacttcttgagttctttgtatatattgtatatatattatatattggatattagccctctatcagatgtaggattggtaaagatcttttcccaatctgttggttgcctttttgtcctattgacagtgtcctttgccttataggagctttgcaattttatgaggtcccatttgtcaattcttgatcttagagcataagctactggtgttctgttcaggaaattttcccttgtgcccatgtgctcgaggcttttctttcttcgctgttagtttcagtgtctctggttttatgtggaggtccttgatctacttggacttgagctttgtacaaggagataagaatggctcgatttgcattcttctacatgctaaccgccagttgaaccagcaccatttgttgaaatgctgtcttttctctactggatggttttagcttctttgtcaaagatcaagtgaccacaggtgtgtgggttcatttctgggtcttcagttctattccattattctacctgcctgtcactgtaccagtaccatgcagttttcatcacaattggtctgtagtgcagcttgaagtcagggattgtgattccaccagaagttcttttattgttgagaatagtttttgctatcctaggttttttgttattccagatgaatttgcaaattgctctttctaactctgtaaagaattgagttggaagtttgatggggattgcattgaatgactggcttctttctacagtatgctgaattcccattggctgtcttgcatgcccatagagtatttccagtagataggcatctagatgcactgggaaatgcaaaagacagactgagatgtagctcaccaatagagggcatgctgagcatttatttgtaaggcattgggttctactccaacttaaaaggaaaacagaaaagatgaagggaagggaaaagagagctgactacttgcttgtagcatgctgttcttagctctaagggttgaactggctacaggtagcattccagtgcttcctgcctgaggctggccactctagttctagctcttcctgttcttagtactgtcaacactgtaatcattatcaaactgaagatagccttaggagccctgccccttagctgttatttagcctgagtgtgttagaaggccgctaacctaggattgtagttaggaggcacattcttggctaacctactctcttttggttctctgggtcacttgtagaacccatagttggaaaagcaaagcagtgctcagcaactggaggtagatacttgaccacagcccaggacagcctttttgctcttttgaaacagggtcttaatttataactcaggctagccttgaacttgatcttctgcctcaagctagcattataggtgtatccacccaggcctgacttgaactaccttagtccatttactttttttcttcaattttatttgtatatatgttaatgtatgcatgcatgcattgtgtatttttggtgctgtggattctcaaatgctagacaaatatactcactgagctatagctggcctgaattcttgtgtttcaaatagcagaatatcatttggccacttaggaagtagtttgaattcctcctgggttctgacgctcttcccatgtacttcatagttgcctctctcattgtaaatttttgtctgctgtctttcacctgatatctagacatactctgacctccatatgtctgtacttcagcagccccggattacatgtgccctcttcaaggaagccatgccatatgcacctgctgcttccagcctatgcctgaccggagagctgaacgggagcaggatccccgcgtcgcccctcagcagtgtgagtaatgtgttatttataaatccaataggtgaaatatcttgttttaacttatatttcttaccattaaaagaggtctttggatagagacgtagctgagtggtacaagagttgtttggatgtataagctcctgggtttcattcctagtgctgcaaaacatcagcaacacacatggagctcttctttacttaatggctgtttgaatttacttttgcttgaaatgcttgtttgtatctattgccttttaaaaatctttctcaacttgagagttccttgaatattactgctgttaaatgaagaaaggcataaactcatgtggccatatcaacaagtcgctacagtacctgagcccctctactggatatcaagggcacagtgtctgatacagtacaagctctccacttgagtgatgtagatgtagtgtgttctgtgtgctcaagagactgcttctggggagatcgctctcctatcttgcacttagtgcagcacagaagaaacagtagctcagcaggggtgtgcatcctgggataggcagctaacaagtcccaggcataccagggtgacttctaggcatgttgaaaagaatccatggaagagtcctggaaataccttatatctgagaaatacagatcagcaagtggcagctgaggttatgttcttaaatttttgctaagagggcagtctttacttttggctaattctgtagagattgcttttatagatacaagcttttacaaaatgatcactccctttaaaagatttatttactcagtcctgtaagaatttcagctagggtttagttagtaccataatcaatgaaactgcattgtagagaatattaaacattaaaaaccttttctacaaaggcaagcacagtaacaatgtaaaaacagtatttatgggtcggtggaaaagttctctgcagacatgaatgtgcagttacttcaagtgtatcacatatccagattggggagacaatgaactagggctgtttgggtgctggggtcagagagcaagctgtttttaagatcacaattttaagataactctgaattttcataataattttatttcagatgttacttgacatgttgtctctgctccctagttccacgaaaacacctcagaaatactgttttcaaagagagttgcgctcttgagtctggtgctaaatgtcctcaggtatgagaacagccagagttctaggtctcagttgaccaactgtcctctacccacaggtgcggtgtgcctgcagcccttctgccacctgtactggggctgcacgaggactggctgctttggctgcttggccccattctgtggtaatgtcaactcttcagcccttagttgctttgacatttgtgtgttctcttagtaaatttggggccggtggtgttggattgtgttaagagaaaagaggcttctatgagccatcaagtgattacctaccccttttctgctacattgcagaggtttctcaccttgaaattctcaaacccacattgctttaaaagcaagcagtaacaaaataagaaaaatcctggttttcctatactggagaaatacttattcacataaaccacttctgctataatcccagccctccagaggcttaggcaggaggataacaggtgtgtggtattgcataatttaatccctacactcagggagggaggcagagacaggtggatctctggaagttctaggccaccctagtctagaaagagttccaggccagtcaggtctatatagtgagatcctgcctcaaagaaaaaaagttcaagtttagtctacagtcgatgcagaccccgtttcattcagtagtgcgatggagatcaattttacctgttctctatttaagattgcattttagtttgagtatgatggtgctctgtgtgtgtgtgtgtgtgtgtgtgtatgtatgtatgtgtagcatagatgtatatttgagtttttctgtgtgtgtgaacatgtgtgcagatagaggacaaaagtcaacattaagtgttctctactgatttctgccttacttttaaagaattactcacttattttgtatgcgcacacacgtgccatgacacatacatagtcagaggagtttgtgggagtcaattctctcttctcaccacatgcatctcagattgtcagatttagaggcaaatgcttttacatcgccatggctctccactttaaaatttttatttttttttttatttgcttgtttttgtcagtgatactgttttttaaattttcttgattttaaaatttttttcatgtaatgtaggttgatcttattctttcccctcttccaactcccagatctcccactaccaaccccatttcatattaatcctctctgtgtgtcaagaaacaaaacaaaaagacaaaaacaacccatggaatccgttctgaattagccatctactcttgagtaagaaatctgcccctctagtgtggctgatagacccactatccttccattgaagagaagtgattccctttcccggcagctgtcacttgcaaatagcttcttgattagaaatgagactttgtgccttcttagtgctgggaatttgtgtggcttgaacttgttcaggtcttatgcatgctgtcacagtctttgtgagttcacatgtgcatcagctctgttgtgtctgaaaagtcttccatcttagaggcttccactgcgtttgtgctcttacaatctctgtgcctccttgatgctcctagccttgagggagagtgtgacaatgacatcccatttagagctgagtactcaaaagtccagttgagggtctgtctctatgttaatttagcagctactgtagcaagaagcttctctgaagagggttgagcagtgcactgagcgatgggaacaataatgtgtcgtgagcaagcattttattgctatgctcctgtagtagaatattttcttgtgcaggttcttgacctccttaacagttcgggtatgtgctccatctcatggagagagcctgaaagctaatttctaaaagtgtttggttactttcattacatttgtaccactactgcaccagtgggtatatcttgcagacaggtcactattacagcacacagggttctgagctgggtggggctggtgattactttctgcctctggaagcatttaagcacttggaatgctgcttagtacgggtgaagtgtctgcttgaataccaacttgatttttccacgtttggtgacataagtatgtgatgatttcagccgtagtgtcttatctcagattgtggacggtaaccagtaatattggcaataacctgtactgtctgggagtggtctatgggactccttcagctaatgactaaaaaagatgtaactttttcctggtactgtagcttttggtagtttatgatgtctagttgggacattgactccatttattatatttcatccttattttgagtcttcccgttgaaccctaatgcttacttaccacttggctaggactagttgggtcagcagtctccagggatccacttgtctcctctttccccgaccagtgctagtgttgcagacatgccctgctacacttggcttggctcttcttttcttttctatattgatgcaggggctgaaacttgggtctgcttgcttgcatggcaggcattttacagaacgaggcatttcctcaccttgtttgctttttataatctatgatggaaagagatttgattatcctgtcaggcaaacaagtttgataagatgctacgtcatccttataaaacagataatgttcttccttcctctggcagagctcaacctgggggacaagtgcttggatggagtgctgaacaataacaattatgaatcggacatcctgaaggtatcacctccatacttgtcctggggatccgaggaaactgtgaagctttcctataacttgtgtggtttctgttaggacacacgttttctctagcatttgcctgcaaatgtatactgtcaaaaccacacactgtattttctgaccaatacaatcagttccatgattctaatatatcaggttttccatatgttccaaaatgaggagattcctgtttgttcatcatgctgtcagattgtagaaaccggtgaatacatcttacagagatggtttctaaattctggcttgctgtggctcctttttctgaatattttttcccgtgcttgaggaagctagctcagaattgtaatatgttcagttctgcaccctctgcactcctgttgagtactttgcttccctttgagaccattcatttacttgaacacatcaccagacgtacttagctacgcaccactacaccctacttttatgtacattaaaagacctttcagtaacagccttgaactgtgtcaggaaaaatgaaggcctagcattcagctatacttgtcacccttggtggggaggttggagggcaaatgtagaagggagaaacttaataatacttagagatagaaaggagaaattctctttggtgtgtgctactgaaacctctagcttctattcagggagatttagcttctaccagaagtcttccgtagcttatataggccaggcagggtctaagcagacactggagattgtaccttctcaagagcatatgtctgcagtctgccttttcagaaaataaaagaagggggatcctgtctacaaaaagcagatgttggcaatgcaatgatttgatttgaagtatgttagaagcaacactgtgactaacagtctgtttttttatttctctgtcccttttaatagtatttaatgttaaagcttgctattttccttctccccttcagtgtcttatctgtccttgtgctgtgaaggcctttgtggaattttttgagagaatcgtgactcttcttcaggtccagaagcaaaagagcctcttggcaaagagcttgtgaaacatatgagggaactgactgtagtttatccactggctctgtgcaaaagccactcaaggacagctgtgttctggctgtgtctgctctcggagccttgtatgaagtatccctgactagttgagtggttcatctaaactggaatttcttttcaccctttttctcatcacagaattacctggcaaccaggggtctgacatggaaaagtgtgttgacagagagtctcctggctctgcagcgaggtgtatttatgctgtctggtaagcagtgtttcgctagccctgccctgcagattgggcatcaatttttaagggtgtcttagtttcctatgaagtggtaagaacgtggcaggccacacttggcagtatacctatctgttttactatagatctatgtctttgactctgacccttcctaagaagatagaggaaggtctagatttgttttggcagagtcctacagtgtagcctaggctgtccctgaactcctgatccatctatcttcctcactagtgctaggatgacaggtatgagctgccatacctgtcgaatcactttaaaaaaaggtatttattttatgtatatgagtacactgtcactgtcctcagacacactggaagagggcatcagatctcattacagatggttgtgaaccaccatgtggttgctggaagagcagtcagtgctcttaactactaagccatctctccagcccatgcctaatcacttttgatgttttaaaattttgtttttttaaaaacttggtgcacttgaaacctgtatgtcatgttccagcaccttctctccctattagggaaggatgggagcatggctaagggagcctccacaactttgtcacttaacttgttggcactcagttggcagataaagtcaggtattgtgctttctcccacaggagtgcatggtgtgggaggctacagaaatcgtaacagtttttttttttttttccccctaagacttaaatgtttattaagagaaatgtgagcaatttgcttaaaaccccttgagttatttctttctggtgattatgttctggtgtgtcttgtctgtagttgcagcccatccaacttctatgaacaccctggatttcttttttttttttttttttttttttaattttatgtaagtacactgtagctgccttcagacaatccagaagagggagtcagatctcgttacggatggttgtgagccaccatgtggttgctgggatttgaactgcggaccttcggaagagtagtcgggtgctcttacccactgagccatcttaccagcccccaccctggatttcttgattttgtactgtaataggagtagctcatacagaaagtatgagtgacttcctgttctcccagtacactcagacaaatcccagcacccacttactggtgcatagccacctgtcagtccagctgcagagaatttggcatcctctactggcctccatgggttacactctagcacaactataagtaaaataaagaagaaaggaaggaaggaaagaaagaaagaaaaagagagaaagataagactgggtgctgaagagatggcacatttgttaagagcaataactgcgcttacagaggttctgaggtcaactcccagcaagcacatggtggctcacaaccatctatacagggatctgatgccctcttctggtgtgtctaaagacagctacagtgtactcacatgaaagaaaggggttgggggatgggggaaagaaaagaaaaggctgggcatggtagtgtacacctataatctcagcactccagagttagagacaggaagatctctgtgagtttgaggccagatggccagcctagtctacattgcgaggcctttgcagagagaccctgtctcataataaattaattaattaattaattaaaaaaagggaaatagaagtaatatataggatgaagtaagactcacttgaaatcccacagctaaaccactggctgagtgccctggggcagtgcttatatacacactgagtggcatggggtagtgcactgcttactgagcatttgtgatgccctgggttttgtccccaatattggaaatcataagcaaagaataaaacaaatgtggaaatagtgttttcatgtgcatccaagctcttccaaaaggtccctacttgcaggttacattgaagatggtgccctattattgaaggtcctgtttgtgctcagcatctatcacacactcccttctgccaacaaattccaggcattgtttgtgaggtagtggaacctggtcagagctcttgtgtatactctactgctgaactaaattcccagtcttgccttggtttcttattattacatagagagttttgggaggggacaggcttagagaaaatgatcatgaccctgagtaggctcagacttgctgtatatccagggctgaccttgaactcctaattttccctcccagatgctggcagaagccagcctatactactgttcccagttttatatagtgttaagggtcaaacccagggcttcaagcaggcattctataaactaagctacattgccagctctccattaagtttccatctcataacttatttagctacttcattaaatgacatatctttcttgttttccactacattaacaccacagctgttgagcgtgcaatgctgtacacctacaagttttcattttagaataagtagtggggattttgtttaatgactgtggtatgcacagctgagtctgccttgtgaacacacaaccttcccgaggttgtgcaggtcccacttcatgtctgagccatcacctgcctcttggctttgcatttggcattgaattttgtgactatgtgagaagctgacagggacttattctttgaatgcctctgtgtgagtgttaacaaaattgaaggcctttttgcatctatccatgcttatttatgatcctggactttacatatggtttttttggtggtggtggtggtggtggtggtgtggggtcctttagcagcattgatatattatctttgttaaagtatgtagtattgccctttgtgttgtagatatgttcttactgtagcattactatttcacagtttatgttttttgtatttccatttcaaagtttaaattgtaggtagtcaaatgtacaagtcatttcttgtatgtgatttctattctgaacacatgtaggtttagcatcccaaatttgaaaatgccttcagcactgtaactgatagagtgccaaagacaggacaccacaagaaaactcgtatctatgccagacctgtagtgagggtcactgtattaaatcaccttcaggcaatatgtgtgagatgtgtagaaaatgtgaatgattctgtggtgagaatttcatcctccagttctcattacatacaaatcaccagggatggcgccacacatccttaatttcagtactggggaaacaggcaggtagatctatctgagttcaatatcagcctggtcctatctcaaaaacgatgtagggaagctggagagatgacccagcaattaagagtactggctgttcttacaaaggatccaagtttggttcctcaaacccacataatggtttacagctatccataattccatttcaatggaattcaatgccttctgacttctgcaagtactgactacacatgtggtacatacaggcaaaacacttatacacacaatttattttaatccttgggaacataaacgcaaatatgttcaaatctgaaaaatcaatctaagccagaataccagtgacctacatgttctagataaggaataattaaccatattaaatacctctgacccatgtatttcagataaggaattactaatttaatttactttagcacaagagaatactctctccaatcttaaaacttttggggggatttttaaatatttaaaattttaatccacgggtgattattttagtagctgtgagcatgcgttgctcttggagaggaccagggttcccagcgcctacatggtggctcatgactatctgtaactctggtgccagaggatccatctttgcacctactgcacacatatgatgcccagacattaatgcacataaacactgataaaataaaaataaataaaaatccagctaaattggtatttagattggttttgggattattttccaaatgtctaacctattgagttgatgtgttagtttcctactagtttgaagtgtgtctattttggtgttagaaaatgacattgcttgataaatggctgtgtccagatatggctgtgttcccccagattacagaatcactggaaatactgtgctgtgttactgctgtggtctgcgtagcttccgagagctgacctaccagtatcgtcagaacattcctgcttctgagttgccaggtaaggagcccgcgaaccatttctgtctgtattggtgtcaccactcagttctaacaggcacttgggatggcatgatgctccacacttagcagaagtcagacacacagcatggttgagctcgaacttgcttctcagagttggtcaagacaaataaagacattatagataccactggagcagcatcatttccttcacttggttttcagatagatttgtttttcttgtctgacaatcttggcatgggctatgaaaactgatcataagaagagataagatggaagttagcatgagagcttagtaaagggcttgctgtactggtatgaagacctgagttcagtcctcatgttttatttgtaaaaaaagggttatgtgggtcttacagaggtcccaggttcagttccaagaacctacgtggcaacttatctgacaccttttcaaacacatacacagtatacgtatgtatatgcaggcaaagcattagtacacataaaataagtaaacctattttaaaaacaaagaaggctggctggtggtaacacacacctttaatcccagtacttgggaggtataggcaggtgggtctctgagttcaaggctagcatgaactatagggcagaaactgcagcaactgccagaagccaggtgtagcatctcgtgtttgtaattctagaactagggacaaaaccaagcagatccctaggtttgcctaggtggcaagtcccaggcgagtgaaagaccttgtctcaaaaaaatcaagggagatgacgcccaacattgacctctacacatacatttctacccacacatttgcacctgtatgaacatacatgaacacacacacacagattcctttagctacatgaaaggaatatgatgccatctgatgtagacatgcatttctcttttccagtgactgtaacatcccgtcctgactgctactggggccgtaactgtcgcactcaggtgaaggctcaccatgcaatgtgagtgaggctggggaatgtgtgggtcaactgcaagtctttcaggcttagggcttgtgaagacaagagtaatataagttatatgcttaaaagatgcactgatttgggaactttaggtatacttcagtagtagaaatgcaaagttctggcttcagttctcagaatcctactccatcccccaaatacacatacgtatgctaatttaatccttatacttctataaaatcatgcagtatgtaaaatagtgttttcaagtagaaattgtgcttctgttacggtgtttcttaaaccgcttctctgcaagtgtcctcctctgtctttcatctgtgtctttgtggatgagtcacattatgcctcgactgacagcctccagagcccacaggcagattctagtgccagctctctctgggccagcagctgtgggctaagcacatgtctcccaattactggcccaatttgtgtgatagagtaatacctgggtttttcttcatcttgtgtgagtggaggttgtgttgtaacttaaccacacctgtcttaggtttttactgctgtgaagagatgctatgtccaaggcagcatttaattggggctggcttacaggttcagaggttcagtccattatcatgaaggcagtaacaaggcagcatccaagcagacatggtgcaggaggaactgagagttctacatcttcatctgaaggcactcaggtggcagaggtggatctctgtgaattcagaccagcctggtctacagagtgaattccaggacagccagggctgcacagagaaactctgtcctgaaaacacaaaaatacaagcaagcaaacaaacaaaagagtgcatgctgctcttgcagaggatctgagttcagttcccagcacccacactgggcattagtaaccacctattcctctcttgtcagaggattagacattggtagcctcctcaagaacccacatgcaggtgtgcatacctccaaacagacatatacctaccactaaaaataataaaaataaatttagaaaaagggtgggggaacatttgatcacctgttctcctttgttcattgctgtatggatgtgagtagcaaagacagatgccactttctgcatcatctccaatgttgctcctggtctgtggagaggggagagtggcctccgttacctcaggacctgtctccaccttgctggctaaagtgcaggcaaaggaacacactaagggggcacagctcttgttctatgataaattatcatagtgtttttatttttattttaaaatttaaaaagagaaaaagaagaaatacttagtggagctggagagatggcacagtggttaaaagcacttgcagttcttccagacaacttagtttggctcccagcacccatgtcaaatagcacacaaccatctgtaattttagctccgggggatttgattccctcttctggccaccctggtcacctctgcacacatggcatatactcatacaggtacatataaatacacataaatttaaatttttaaagaacacaatctttttttaagcataaacattattgagtgagctcacatgattcacacattctcatggggcaattacagtgtgcagtttcacagtttgaatagtctttgatgttttctctctctgcaggaaattcaatcacatctgtgagcaaacaaggttcaagaactgaatattggaagagacacgtgaaacagttacagagcacaggaggcaatgttttttaaaaggccccatacaaacacttgaagggcatttttacagttttccctacgcagcactgggggttctggtcaggcactggggtgtggattttccctttgtggagcgtcatcgtcagtgacacacacaccacgtgccccagtaacctgggaggcctcctggccacaccagccttctagtcggtgtaagaggatcagtagactgagttctccctccctcccactggaccgctctccctcctgtgtgctgaggcagtgacagtgcaggtttgtacttttgtatcttttctaccttgtaccttgactatggttaaaatgggaagctcataggaaaagttgtcagctgtgtcagacgcattctccggaaggaaaggaagcatacgtttacagcctccaggggtacataggatagtctcctgtctggaaagacacagccttttgtatattttttattttaataagtttggtgcttatcttctaataagatttaaatattaaaaactgtagcacaaatactataatttataatttacaaattgactaaaattaggaatagcctcatatttggaagaatgagcatatgtttctgtttatttaaaaaaaattatcaactgtccgaaactgctaatcctgggaaggaagtcttgagtgtccaggtcctcgacccagggctggctgagcccttagccctccagtccctgagagcaactccctgctgaaactccagatggctccagactgacagggcctttgctttccaagccctcatctggtacattaggtttgccatgtcatctggaataatacttgaaattttgtttttaggttttttaaaacttttttatcttttattgaaatcacctgttatatttgtttgaaaactggtaactttttgcttctcaggaaaaaaattttcaactgttgtcttgctcttgatacagactgagaggcagtactctgtgtttgtgggagatggttctttttttgattctaataaatgagctgtgtttgtttctcttcttgtgttgtactcctgtgcgaggcgccacgtgctacatgcgacatgctaatgcagtcaggcaccactgagtcttcaccgcactaagcgttcactactctcaatagttactttattgcctgctggtcaatctggtggcttcaccagcagataacgtctagagctgagcaaacgggatgtttgagcttacatcctgagcgtctctgaacatggcacaagactgtctttattttcagacctgggcagtgttgaatgtgttaactacaccttaaactctggtgcttggtatttaacccctggccctgtacgcaggtccacaggaaacaaaggaaagcacctggggcagcagcgccagggcatcaagcttttgggaatcacttaatccccagatctttaagaaagcataatgtcagccgggcgtggtggcgcatgcctttattcccagcactccggaggcagaggcaggcggatttctgagttcgaggccagcctggtctataatacaaagtgagttccaggacagccaggactacatagagaaaccctgtctcggaaaaccaaaaaaaaaaaaaaaaaaaaagaaagcataatgtctttgaggccagcctggtctacagagtgagttccaggacagccagagctacacagagaaaccctgtctcaaaaaaaaagaaagaaagaaagaaagaaagaaagaaagaaagaaagaaagaaagaaagaaagaaagaaagaaagaaagaaagaaaaaagcataatgtccaagagtcacctcagaggggctgaagggattccacagaatttctgatgaacacatggcagaaagaacatgtccggctctagcataagggagctttgagccctggcgaacattcctgggtagaatttgagcaggtttgtgggacccaggcagttctttatagcttcctttctctagattccccattagtgacttgttggtatgtgagataagaaagggcttattttggtttctagttggaaagtttagtccatggttgtgggaaaggcatgtgaagctgcaagtgacccgtcacattgactctgcagtcagaaagcagagagaaatgaacgctgtggctcccccttctctgtattctgttcctgttgaggatccagcccaggggtggtgcagcctacactttgggttgttctcctcagttaaacaacctcagacacacccagacctgtgtctcctaggtgacctcaaatccagtcaagccgataatgaagttgaaccactctgcccaaaaaagccaataatctggagttgccttgctgcctgttatcacctgtagggtgtgcagggttcctcacagaattgacacagcctgttttctctgtagctcttgatccttgtggtcagcttggcctgcatctctgccttgccagttgttgtgtcattccttttgctatcagaaggaccccttcctgcccctgtacgattccaagcacaagccagaaaagggtcatgggggtgctcaaggaaccaggctgcccccagtacaacttcattaggccagacacccaatgacaactgagaaaactggcttaaaacaaaggagcccctacttccaattacaaaacgctgattcaatcttcagtcttactcatcttagttacttgatactgtaggtgaggggtgatagggaatggtcagaccagtattgtagcaggcttccctaccctggaactggtgtttgtctcaaagacagctaactcagaggtgtagctgggagttcaaagtgggtttctgctagttgaggggaccctgctgacagcttaccctgcgttggtctggcagcctaagagagagtggtaaccaggatggcctcacatggctctagtggggcccaggtaacagacccataaagttgccaccagaagctcagaagtaggaaactgaaacttagtaaaaagaacaccagccgggcgtggtggcgcatgcctttagtcccagccctccggaggcagaggcaggcgaatttctgagttcgaggccagcctggtctacaaagtgagttccaggacagccagggctacacagagaaaccttgtctcgaaaaatcaaaaaacaaacaaaacaaaacaaaaaaccacagaagtccagtgtggacccaactccaagtgggggttgatggaggaacccctgagggttctctggcttcgtcttttctctggctcccctcaaattttgtatgcacaccagttaatgtttatacactgtcagggctgtataaatgggctgggtttctcctcaagaaatgagaattcctcaagctaggcccataaagtaggagaggccagtcttacagactcaacagatatacttagccacatgaagtaagctcaggtgatctatagcaggactacctcctgctcctgagcactttggaccattaaacagacattagtgtaaatgtcacagaacatatagccccgtagcttatattaaagtcaaagggaataaacactgggacttaaaacacttcctagtctactgttaccacgggccttttcacccggcgctcaagttccccaaaatcacaactgagactgagttatatatgaataaatgcctagaccaaaagcttggacctgttccccaactaactcataacttaacccatttgttctattccaagtcctgtgacatggcttgtttatctctcctcagggttcatgagacaatcatcaagagttccaggaaaatttctcccaagccttagactctcttccagatcctctctctttacaggaacttccacctccctatttcctgcctaagctcataggctatcaatcttttattgacaggtgaagcttccgtacactgcacaaaagattgtcctctctgagagtaacagactccagaagctccctgaagtatgcaatatccttatgcctgtgactggatagtgtatgacttgtctttctgacatctcaaagtttcttgaaactccaaagtagatgctgtcacaccacccacacataccatgaaagcccgccttcatggtcttcagcatctcagaaaattttatgaccttgtgactcgggtcaaaacccaggcatcatccttcttctctcgaagagcaactgcattctacgtgacaagaatgagctctgttcccacagccagagtttgtgcctgagccagtacttaactctgatcactgtagcctttgacatctttgaaagatctgcctttccattgtcacagaccctatgtggccattctctaggctcacaccgatctcccctcctcgtgctactcgtatttaacactctcctagatcttcatcatgctcaaacctctcgggcaggtttgaagcatctttccacagctatgttttctttagaaattgactcagattgatgagatgtctctacattttttttaaaaaattattattgtgtatgtatgtgatatgtgtaaatatatatggtgagtgtattaaagtgcacacgttgagattagaggccaacttgtagagttggttcacttcttccaccactatataagcttcaaattgccagtcttatgctgcaagtgaccttgcttgctgagccactcaccaggttcagagaggtcctttctcaataatccataagattgcagaatgtctacccacctgtctctttattcagctctgacatcatctactctcttgtatgtctgttttttactatttccctccaagaagtaagtttcctgaaagcagacagcatctggcaaagtccttggcacacaacagtcctcagtagatacagcaggttcccccatcaacccctggacatataaagctgggaccctgtcagtccttttgtctacctcaagacccttcaaatttgttcattgactgatgagcagaaacaaaagggaaatatccaaacaataggatattagcaataagaacgaagcactaaaagatgtacaacatggatacaatttgaaaaagaactcaaagctatacagtatatgaaccctattggtatgaaatgtacaggcaaggacactcagaaacagaaataatgataaaatcgtaaacaggagcaaactttacagcatgtaaattatatctttgtaaagctttggtcatttttatttggggttggaaatgtagcttggaggtggggaggttactagacatgttcaaggcccaggatacaatctcgagcactgaaaacaaaatgtatacttagcattttccccatgtagcagtggcaatagtttaatattgtgttgtgagaacttcctctcctttcctatcttcacatactagagactgaacccaagagttctgaactacaccgcagacgtctttttaccttttaagacaagtcccactttatagtccagtcagtcctcgagcttgtgatacttgtcagacttcctcgtggctggcaatgcagtcgcgtggcgcagtgtccggccatgtataacactggcaataatacaaacaagactgacaaacacttaggaacaagttgtcagaactgtggtggaggcggtgtct

SEQ ID NO: 16 - DNA, 2739 bp, Mus musculus
aaaactacagcaatttattttaacgatatctttgtttaagatacagtctctctgtatagccctggctgaacgctccctctccctgcctaccaagtgttggcgtttcagtcatgcacaacagcacgcagcactgtttataaagatcttgactggctctactgtgagtctagaataaggccatgcttcatcccataaaagagagtaagtagtaagtgttctggtgagctcagcagaggccaccggttctgcagacagagacaggctgaggggaacaagactaaaggataaatctgccccccaggctctgcttctcgggagcggagggcaggcaggcaggcagcagcaggatagtccatgttgtcttgcttctatgtgaggatcaaggcagaaggagcttcgccaccctgccagtgtacacggagtcagcacgagtgactcggccgactgttggtgtggcctggcagtccacgaaactttgtaaagtctcaagtccagcagcttagtaacagtggtgtcctgtagtgtttagttcataccagcatgaaccacaatccaggagaaccagaaagccggcctttcccatcagtcctgcagactttacccgtcggctggtagagagcagagccacaataccacgtgctgagagaagatcctggtcgttgtaagcatgcagtacccacaggagtccaaagccagccagggtaggagacagctgcagagtgtgatgctgatgtttatattggaatatttgtaggtagagaacctgttactaaaatctgtcaccccagctgcttttcgcctctcagcgtggctcattgaaagtctactggtgccacggtgactcacgcggtggcccgtgccctgtacctgtcagacagtggtatgcaccggctcttttcttctccttaattaagtcttgcttctgctggctctccaggaaatcactcagagaatcctggaagctgtaggtaccatcgctggctcctccttggaacaaacaagctggctcagcagaaatctggaggtgaaagcccaacctcaggtctctctggaagagtcagatgccgaggacgacgtgcacagtaagtggaggaggggtgggaagaaacgcctgcttcagccaaggctctgaggacgctgtggacaaccgtgcttctattccagtgtgctctaatacacaagtgtaacagagaaaacagtgacccaagggaggttgttggagttcagaaaatcctgtttaaaaaaaaaaaaaccaccagtaagcacatactaaacattaacagagcagccctttcccagaactttctcaaaacatgccagttgacacagttgcctggcacgtgctatagatagattatacctgggtaagcaggagagcagagcagaaggtgataacctgatttagggcacactgaccaggctgggttccatagccacgataggatatccaacatcaataaacacgtcctataaatgggatgtaaatgtttgtcacgggaggcacagaatcccctccaagaacaatccagggaacaaagtgccccttgagggaaagggccctctgccttttctcctggagcctccccatccccaaagctttgttcacgccattcttttgaccatgttcagtattcattcagttgtcctagctcacacaaagggaagaaggctgctaggcagtggtggcgcacacctttaagcccagcactcgggaggtagaggcaggcagatttctgagttcgaggccagcctggtctacagggtgagttccaggacagccagggttacacagagaaaccctgcctcgaaaaaccaaaaagaaaaaaaagggaagaaggctgagtccctgtggggaagggagtggtgttagtgtgcgcctgtctgtgattacccatcagcacatcgccgtttttcagtctcagttatcctcggaagagcatcaggaggcactggaaagtggacacacacttctcagcccgtggacaagcacactgccttttagcctgttcctgggcccaggcgactgcccaccccacctcccatgcttgtaactgactgactgcacctgttcctgaggtttattcttcatggtccccctcccaccttccacctcacccaactccaagatctatttcttttccccttccccttttctttaaaaccatcaggcaagcaaacaagaaaacagaatgacaaaaagaaaaagcacaagaaacacacaagcacacacacatacacaaagaccagaaaaccacaaaattgccagaaaacataatatacaagaaaaggatagtaagacaaacaaaaatgcccaaagaaagcctccaccaagacagagacctacaaaaatactaccgagtacattttgtattgaccacatgctgcggggcctggggagactccactggagaaaacaaaccttcacatgggagtgtggatcagctggaaagcctgtgtttgggtgggcagggaggctgtgttcagttcctcctcggtgctgagaccccatcttgcttgggcctgtgctgcccgtctctgatgtgcgtggttcctgttgtctctgaagatgtcgatgaagacgccaccatttaggatggagtgttccagagtcactgctcagctgtgggtcccctgagtagttcccttctaccgcaagaagcagcttccctgaggatggctaagcaagacactgatctgagtcccaacccgtgtggtcctagggacccagctagacagact

SEQ ID NO: 17 - DNA, 8551 bp, Mus musculus
gcaacattgagaaagggtttatttcatctttttcttctgtatcacagttcatcatccaaagaagtcagggccaggagctcaagacaggaacctggaggcaggaactgaagcagaagccacagagataaattgttcagttgcttggactgctttcgtattcagttaaggaccacctgcctaggggtgtcaccttaccctcaagggctgggcctacccacatcaatctatctttaatttgaagagagacagaggggctggagagatggctcagcagttaagagcactgactgctcttccggaggtcctgagttcaaatcccagcaaccacatggtgcctcacaaccaaccgtaatgagatctgatgccctcttctggtgtgtctgaagacagctacagtgtacttaagatataaaaataaataaatctttgagagagagagtgtctgtctgttctacagataatctgatggagtcccttttctcgattcagttcctcctcccagatagttcctgaatgtaccaacttgtcaaaaatctaacccgcactgacccttcttgggcatgatggaacccaaaggtttagtttccagatattattttctcacttgtgcctagagaactgataaaagaatatttcctttgttcttcctccaggtttgcccagagttcaaaaggttctcctcagccatcaacgtatcttactattctaaatgaacttttcaagtcagagaggctgacagaattagagaaggaggtaaaaagcaagacaatggaggcactggagagcctgagcagaaaaatagaagaggccaggctccagcaggagcacctgctgcaagacagcaggctgctgcagcgtgacactctctgtgtggacgctgagaagaactgctttttgagagtcttaaggaagcaaagtgagcagtgtaaaaagaaacacgggcaactgtggaatcagtatgttcaggaccttggggagattattcgaaggaaacaagaactgacactcaggttcgccaagcaaactgaggagcttcaaacacaactcttccagggaaaaatcaagcagtcccagttggagcagcagtttcagtcaatggagcacatttcctccatacagaagagccaggagatgaaaatccagatgttagagaaggaactggaggatgtgaaagctgagacggctcggaaggaccaccaggcacacttgcagttcttgcagcgaaagacacacctaatgagacagatacaggagctgcggtcactgcaggcaggagaccataacaccccagaggttaggcagaaggcccagctcttcaagtccacagccaagaaagtgaattcggaatattgccggagtgtctgcagagagaaccaggagttacaggaggacctattgaagctaatccaggagtactacaaactagagtctataaagaggaagcttgagatgtgtaaagagcggctgaaagaggaacagtgctatcaagaagccttagttagggggagaggacagcttaaggcaaagagggagaaaagtcatacttgtgacccttgcccccccaaccagggtgtcctgagaccacattgaaccatccttcctgcaccaaatcaagaataaatccaatgaagtttatttattagccagaaaatgaagattcagaactactaggccccaacactgtcttagtctactggggaggctgttggatggccagtaactctgggccagcttagaaagctcactgagatcgttcatgactcttacatgtccccatggaggaccactggacaacatggggtcattgttataaaccagtactcaataaacaccagtgcagtaaaagcactcttctgcctcagtctgctgcaatgctaaacacagagatacctcctcattcatggaggaaacgaaactgggtggtgttcaaaagtttagccgggagtgatggcgcacgcctttagtcccagcattcaggaggcagaggcaggtggatttctgagttcgaggccagcctggtctacaaagtgagttccaggacagccagggctattcagagaaaccctgtctcgaaaaacaaaaaacaaacaaaaaaaaaaaaagcgagtgtaatagcaggaagctagacttggatattaaagccgattgagcaaactgaggaagaaaacatcccctgaagagacgaatacggagcacaggggccttaaagtcagagtaaaggaagtcattaaacaaatgaacaaactgcatataacaaaagtagagccagcaagatggctccggtggtaaagatgcttgcagccaaccccagtgatgttgcagtaaatctcctcccaaatatgccgggcaatgaaaacacaacacagttactatgaatacatgttgtgcgcctagattgggcagatctaccactacactaccatcttccacatctatgagaccccttataacttacggattctccaggccgtgtgcttctgctccacttttgtcttcctcctcctctgaatccttcttctcccttccaccttccgctccaccttccctttatctgcccaatcatcagctctcctttattttacaaattaaggtgggaagcaggtttacaggaaatcacctaagtgctgactcagtccttgttcacaacccctcacaggagaaaggaattaacatcaaacatagccccagggctatctatccacaacacagtgaactcctcccagtggtcctctccactccacgtgagcaccagggtacacacgtccacatgcatatttactaaacgtgaaatcacattttaaagaagtatgctgatgagtgatcagagaatttggggaaaggaggggaaggtgaagctggtaagagatacagagaggcagaagccagagaaaccatgaaaatgatgctgctgactccacgtctgaacacacagtgggaccatttacatctgagcacacagtgggtccgcttgctccagagaggaagaaatgtctagggatgagagagagttaggaggtttgcagcgaggtaaatatctgaagtactgcctttaaggaggtgggagagatacataattctttcttttgtaaattttttctttttctttttaagacagggtctcacttgatagctgaggctgtcttggaattcattctgtagccatcatgtggcctgggactcatggcaagtccacctgcattagccttccacatgctacaattacagccacgagccactgcacccagctgccagggactttaaaagttattttctgaagtgtaagaagttacaacttcttatccttgctcagagataaaatgtgcattgtgcgcagcatggtatctgccaccctcgaggctaaagcaggaggactgcaagctccagagtgacatcatggccactttggcaacattataagcaatctcaaaaataatgagggatacaaagtaatggtagagtgtttgtgtagccaggggaaagcccctaggtacagtcctcagtactaaaaaattaatatgaaaattcagtctcaattcctctagattgtatgtttgacatttcttattcctgtccacaaacatatattagatatacacacatacacattatataactggaacacttgatgtgctccataaattgatttccccagatacccagtatagtttaggtttattcataattattaggagaagcccttattaaatatatagcttatataacccagtgtgtgaacacattactttttattctttattccggacagacaaggttgtgtaccacagtgtctaaaacaagacactggttttaagaaacaagagggtgtgggcctggcttggtggcacacgcctttagtcccagcacttgggaggcagaggcaggtagatttctgagttcgaggccaacctggtctacagagtgagttccaggacagccagggctacaaagagaaaccctgtctcgaaaaatcaaaagagaaaagaaaaagaaagaaacaagagtgtgtaataacataacagacacatttcttgctcattaatgacttcagataggtgctcctggttaccaggtgggtttccttcacaagaccacacagggaagcaactgtctgccttctgtgtgcacgcttctactatagggtcctataggatcatctgatgtagctgggaaagggggtttgcagggaggaaatgcagtatacagttccaaggctagaagcagcatgtcacctttactaacattctacagggaagagtgctgctggccacccatttgctgcttggagaaaggtgacaggtggcgagtgggacacacgcatttgtcatatgagtctataatttaggaagattggaaaggttttggaggacagtggtcttctctgatgagtgttcccagcatgcactgtaacttctgccactcttgtgaatctcccttggcacagcaaagcgaggggtatttctccacatatacccacacaacccagtcttgtggtacaggttcaacttcagcaattacttaagaatcatttttaaatgactatgattaaatctgagtatgctaggagaaagaccaaatccaagactgtctgattaagagaggctttatgtgccaggcagtggtggcacacgcctttaatcccagcactcgggaggcaaaggcaggcagatttctgagttcgaggccagcctggtctacagagtgagttccaggacagccctggctacacagagaaaccttgtctcaaaaaaccaaaagagagagaaagagagagaaagagagagaaagagagagaaagagagaaagagagagagagagagagagagagaaagagagaggctttattttagagatgtactgggactggtggctaacacagctatctcaccttatgcagggaatttttggagagcagcctttttgaggtaccttttatggggaaaagttaaggttaatagaaaatagctgtaatgtgtaacagagataattggctgttagaaaacagtacaacaaaaggaaagactaaaacaagaatatatatattctgtgaaatgggagtaagtgattacagaatagattgagatttcttgaaaacattttgtaaggcagtagtcagtcatacatcttggggtcatgagttcagtgcaggttggaaatcatgttttgttgggcgcattaggtttaggaaacagaaacttatccttgtaaggtgtggagacttaacaatgtggctcctgtcctggcttcacctacttaaatttcagagctgtgctcctctgctctctgttgtgataaacaccaaggccaaaagcaacatagggaggaaagggtttatttcaccttccatcatggagggaagctgtcctattgctgtgacaagacatcatgaccaaggcaactcttataaaagaaagcttttaactgagggcttgtgtacagtttcagaggtttagtccactgtcatcatgacagcttgcatagcattggagcagtaccacaacctgactcagagagagagacagagagagcctgctgtgagcttttgaaaacctcaaccacctgtgacactctctctccaacaaagccacacctcctaatccttctaatcctttcaaagagttccattcccttgactaaagattcaaataaaggagtcatggggtgtgcagggagggaggacagatgggggaggattcttattcaaaccagcccagaagtcaatgcaggaacctggagcagaaattacaaagggatgctctttgctagttccttttccatcctcctccatcgattcaaattcaagataatcgcccacaaaccagtctaacctggggaatctctcagttgagactctgtctccacaggtgactcttccttgtatcatgttgatactaaaagctaaccaagacagaaccatacttgagagttcctgttaatatcaacaatctatgtgcatccagcatggcatccttgttgtagtgttctattgaatttttagaagactaaacagtgtggtcaagatctattgtgtccttagatcactattcttggggaggaaaatagaaaggagttgtgaaaagtcaggaggcagaatatggttcaggtacaacgcacgtctctctcacatcaaactactcaggacctgcaggtctctggagcaaatctgctgtggacagaactgccttgggacttagttcaatctctcatcaccttttgtttttcagactgaccttgatttggctatcttactgctttagctttctgagtgctgagattacaggtgttatataaaacaaattagccacaggtttgagcttctcctgctactccaatccattaaaaacaacaacaacaaacagcaatgggcctgcttttatttccaacataatgggtggaatttctcttgtacttggaaaatgattgatagtcatttatacagtagcaatttcaaagcttgcttttctttttctcctcctcctcctcttcctcctcttctgcttttgtagaaaagtagggaggagatccaaggtcatcggagaatctccccatacaaagcttcaacttgccaaattgctgatgccacagccaggagttgggtcagtaattacaggtgtttacagccaatctttccaacctgaattccatctctgagactcacatggtggggagtgaactaactgaactgtatgggtactgccagaaaaataatgttacctgaatccctgccagaaagtaacacaagccagacagtggtgcccagagagggcctgagtcaggaaaggagaatcactatccatttggtatggtacgttgctcactgatcctggagctcattaatttggctaagctagctggccactgagctccagggattctcccatctctagctccctagcactgggattataggcacaatccacaatgcctgggcttttatgtgagggcaggggtctgaattctggcccttaagtttgtgcagcaagcaccttactaactgagccctctccacagcctgcacatgtcataataaaatgagatatctatgtatagatatatacaaactttttgttctttaagagttttatccacgggggctggtgagatggctcagcgggtaaaagcacccgactactcttccgaaagtccggagttcaaatcccagcaaccacatggtggctcacaaccacccataatgagatctgactccctcttctggagtgtcggaagacagctacagtgtacttacatataataaataaataaatcttaaaaaaaaaaaaaagagttttatccactttccaagaatgtcaacaaaacccagggccacccttgactcctagccctttacctcactcttaaaggggactttttaggagttttctggttcccttgagcctttggttcaccatcttttcttcttcccttggacaaatagccatacagatgagcaaataagacattggtcacagtctctgtcatacagggctttccctcatgaggttcgtctcccttcctctacccatatcttccggtattaattattcagccacacttcagccacaaacgctgtaaggttctttagtcccctttgcattaggcaatgattgccagaaaatgtatcttcctctgttaaagtacagtattcatgctatctttcaagtgttacgctaatttttacctaatattttctagaacataatgacgtttaatttttttcttcttcttcttagacaataaaataaaaggtagagcaacacctttgttataggatcctgacagatcctggcttgggaatcccacctcattactcccttggggacacgagcttaaccctttccgggtcctatctcactcctgtcaacccttcctggttccctacactacccctcacttgtgcaaagccactatagcatcaaagtgacccctgcaagtcagatgccaaaagccggtcaggcacccactgcagtaggttcgagcggtttggatagtctggccaatcgcaaccctaaactcagagaggccggatcgttcgaccaatcgtagccctgtacgcaagaggacggattttcctaccaatcgcagcccggaattcagagagcccgcaggccgccgggcgatccctgagtggtgggcgtggctgaggaaagatggcggcgcccgtggctccatccgaaccccaggcttcccgggctcctcagccccccgtgtgtctgttggtgttgggaatggcgggatccgggaaaactacctttgtacaggtgacgtgcaccgtgcagaagcggtagtggcgcctcaggcccgggaagaagggaggaagttgtctggggaatctgcgggtccgggcgcgtggttttctcgagctgtcctctgactcctttccttcccgaagcctcgaaccctagcctgggtcacttgaggccggctcctgggcaaccttaatgcacacttggtacagctgaacttgtcttgctgcgaattggcagctttccgaaggcccgggcctaaagagtaggggagtgtaacgtctactactctggtttgcgtgaagagttgt

SEQ ID NO: 18 - DNA, 30726 bp, Mus musculus
agaagacgaagagctggaatagagctcgcctcggctctgctggccttggctgcagctcttccagaaacccggggcgcccacagaagaatctcttacctggtgagtggttagccatcctttgcctgaaaggatgtgcaaaaatgaagacgacatcactatctggcttcggctccgtcctcctggacatgccgaaaggccagtgctggggaccttctcccaaagccagccccttagcctggtccccagcatccaacacgaaattctgcaaggaaaagaatcctcaggcacatttttctcgcgggtgtgggggggtccggtccactagggctttttttctcactagtgtgggcagcgcggtagagaccctgattaagaaaagcagcaataatgagatattccgcccccaaatccagtgtatttttgtttctggggtctaaaaacctggttttggtggctgaaagccccccttagaatcgcattaatggtgagagacatggcggcgatgcatcatcccgcaagccccataaaatggggggggggtacctgaaaaggggggtctcgagccatctttttctcctagccaggttctcggcggaacgtgggcgtaagatttagaggttcatgttgaccagcaattctgaatccagatactcgggtttagtatagacctaacctcgggcaaaatatagtgggaaaaaaaatgtaaccattactagccgtttcctgacgcagctactttaacagcggaaagagagggcgtcaaaggcaaatctagccggagacccccagatcacagagaaggctgcggaaccggggggcaaaggcagaatagatgtggggggtgggctagggtagaaaaaaccccacgtccttgcgtctcataggaaggaaaagataaaatgcagaaaagggggtgtgtggaggtgtggggggtgatctgagtgctggaaatttggaggcagggttctttttggcattgcgcatgatggctgcggctagattctgacgtgttgaaggcttttgacttttggtaaatcaccttttgccgtttcctttgtccccgtgaagccccccctggccgccccctcctcattctgggctggctggctgagggggggggcagcctgagggctgcgacgtggcaggtttctagaatgttctattgatggccgcaagagggcgctggtggcactgcggaattttggggggcggggtggggagggaagaggaggtggcctttgttctcctgcaggagggggtcgggagcgagatgggttgcgggaccatgggttcatttacctatggggaaatgttagtagatacctggattcactaaggtgcgcttgcaggacttacaataggtcagagatggcgtcatctgcagtggctgtgtgatttagggtgtcatggacgcagattaatttattttcagtgatttgtgttttctggggtcttagaaaggtgtggctttttgaggaagaattgcaaaaaatattaattaattaggcgtcatccataagggtcttgagagttgacgtggcaaagggggggcaaggttttgaggagaagggtgttaattgggtggggggaggcagggtggtctgcctttattttgtcatatagctgaagacctcaaaaatgagtgttctgtattaagaattgagtctttaaattttaattatgcttaattggatttactaatggtgggtgggggcagcgtcctgcttttacttatcaggagtagaattgtggtctgggggcagccccttactgcagggtctctttggtgcaaggcggctcctggatgcctgtgtgtgtgctgcgtcatgtctggaaaatggctcaggcagaggcgatgggggtgcatagcgacccttaaagatggctgatgtgggctctgccccccccccccaagcctgaaacctgttgggcgccctcccccctcctacgtcagtctagctctagcagctgcgtcctggcgcctgtgggggtgcctcaggtggttgggctattggagtcttagtgagtgcgggccgcgcgccccctagcggtctctatgtgcaaatggttcttggcctgccagactagcgctagagttgcgcatgcgcacacagctaacacttgtgacctgtcaatcaattcatctgtacccctcccattgctgtcctcccctcccatttctcctcctacttctcctcccatttctactttccctcttccccctcccatttctgttttccctcctcccccctcccatttcttctccctcctccccctcccatttcttctccctcctccccctcccatttctcctctccctctttcccctcccacttttctcccctatcttccccctcccatttttcctcacttcttccctcctcccacttctcctccctcctccctcctcctttctcccccccacccacttccctcattcctcttacccctcccttcctcctcctttctcctcccgcccctacccatttccctcattcctcttacccctcccttctcttccttccctccaccccatccctgcttctcttccctgatccctcccacccctccctctttccccccaagccttcccctcccttctctcctctttcacttgccccctccctctctatgctgttcctgggctggccgttagaggtcatcaaggtggtttctaacaaccccctcccatatcctaggctctctcttcagggatgacatcatcggctcacaccagtcttccaggaccaccttctggatgccaaggctgctgctcgagtacctgctgtgcacctctacctcctggtaccccagccactccctcaagttgcctgcatgttatatggcctgtgagctctcctgcccattgcacattcatcacccccagacccattagccattaaagacaacttaaaatgttaaataattagctgaaattataattagttataattaattagcttacattgtaattaatacctatacctgggcatttaataaattctctaacctttggttatttgtagagccaaggagcacggattccaggaacccactaccatacagagcaactccttgtggacccccctgggatcaggacagcgagggacaagcgacaaagaggatcatcagtggccagctagtttctctggggttcaaaccttgaaccagtgccctagtgagggggcactggccatggcccttgacctttgctctgcttgtgtcttgagtctgagccctttcctgtacatctgtgctcgtgttcatctgctagtgaactggagtgctgccctccccgaggagggtcgtcccttgtgactgatcatgctgtcctaacaatgtcctgagcaaaagggtccctttgggaacctctcaggagggggacccgggtcaggggcgaccagcatcttgctggcaactccgtgggtggggtggggtggggtgcttccttctggaatgagcacgtggctgaccccccaaggcatgtcccctccccctcctccacccaccttctcggagatgtcccttttggggtagtggggacattaggagcaacctcctagggttgttgtgagaattaaatgaactgcagcagcctgaggcagggctgggcagagacctcagcacatgtttgttgaaaggtttgcaggtggatctagtcctcccgttcatggctcatgtgtctcaaccattctctcgcagactcctgcagcccctatgcccagggctctccttgcgccaggtaggggctctttagacaacaggatgtccgggagactttgagtaaggacacgagtgtgcggtcatttccagggcactttctacataatgtgaccatgttattcctgtcattcatgtgtcaaagggggtagcctagtgtctagagaggaggggtgaattggcattgatttttatttttattttttattttttcatgatttttaaagaggtaggtgggaaagagaactgggagagcccggactcactcatgagattgaacttaaattcacacggaggacacttggactcttgccacattaggtaagagaaggggtcaaagttggacacgggtgccattgtggcgacccctgatggtccagtcccctgtcctccacctaaagttcttcgatccataccaaacatttcacaatgggaaatcctagcttcccaagggtggtcttggggagctgctgggggtgggggtggggtggcccaagtctggtagcatgtgctgagatcacctcttagggatggtgtgaccttaaacaagtcatttagcttccaggtttcagttcctttcacacctaaataggcatttcaaaaaaaaaaaaaaaaaaaaggagaaataaagagagaaaaagtggagggtggggggaggtggggggtggggggtggggggaaagccaggttgtctaccccacagagcgcttctgaagaccaaactacataactcacaagaaagtgccttgtaaatcgcccggaaattgcaaaaaaaaaatccttaattagccaatgaggctgtccctactgcccagcggccagccctagtctctcacaacagtgagcacccagtaggtgctgggtgtctttgtgttcaacaaataatttccagaattcaaacaaacaaacaaacaaacaaacaacattcattcaacaaacattttctgagacactgaccatgtgcccagtgcaccaggctatggctgaggtacaaagacaatgagaacagtctctttttggaggctaattagtactctcatttctaccagcactttctttggccttttaaaccaaccatttttgtccagacaagaccaaaaaaaaaaaaaaaacaaaaacaaaaaacaaaacaaaacaaaaaacccaaaaaaacaaaaaacaaaacaactgggttgctttagggaagcccggcttggagtggacaatggtgtccaggcccctgaaaggggctgattggattatgaggcaaatggaggcagaaggagcacgcaggagacaaatgcagtgggcggagacccgctctgagttaatcaggctgattgaagggaccttttctgtcttgccgagtggcccgggggggctctcactagtgcactgctgtgtgcacatggagactggagctaccctggtccctctctggcaactgttcattcatttgatgctcacaactccctgtcctgacccagggccggcctgccatcacgcagggaagcagaggtcgccaagcggtttccgacggggcccccccacataacgttagcctcgcggtctcttcggttttagcagcagtggacatgaacctgtttccagcctgcatcctccagttcctctcgggactcctggctccactgtgctcacctggagccccgccagcccgcctccccctgtcctccttcctcgccactccagtgtctgtctttccttcacagccccggcttctcgaggcctgtctacactcgctgctttccttcctcacctccaatttcccctccaacccactgcttcctgactcgctcttctccatcgaacggctctcgctcaggtaaagacttttctgtagcttgacccttggcacaatgccagctctggctggacacaaggacacacgcatctcctccattcctgctgctccattggtttcacggctctggttcccttctatttccaacattactggcttcacggacacagctcttcttactttccctgggagcttacattcctagcccctctcagtttcccaaacctgccttgtgccacccagctgccaaggccacctagagcactctgggccgggtggtctgggttcaggtcttagggaaagctcttaaagctgggaccacggtgtaggtcagctcttccaggataccttggctaagacagggttaataggcttcacttggaaggccaggtgagcttccatcaggtaagacactgactccttagctgagggactggaagagaaattaattagatattcctgagcaaatgcaatttgggacacaagttttctcaaagttaggttcccacagagaagaccaaagagcaggggcagggggtgggggtggggctgaaggggtgtacaagcatgacagacagtaaaggcaaagaaaggggattaggaaccactaagacctccccagacctcacctagcaaaagctttccttctaggctagcctgtgagaagaaccagaaggaagcttttaagttgattacccagtgacacatcccaggaagtctccgtatcacatagccccattgaagggttttgagttcctctcctgaggtttaacctctgcaccccttgccccttccctaatgcctccccagactggtgattaagtcccgatggtacaggaggggtcagaagggtcttaaggaatgattggctcactggacagagccacccctaccccccccccagctatgtttttttttttcttttttccaattctattctactttttgccctttctccttaatgaacacagggctaatcttgggccttgtggaaggaggaggctgcagcactagttaatgaggaagctgctgagctccaatcgtcatctcataaggagccctctttgtctgcgaaggaaaaacactgattatcataatgagctgagctggtggctgaggggtagggggccttgggttcttaaggcacactttaatgtcagtgttgtagatttccctccccccattgaatggggttgcatgttgaaggtagctttgcttcaaggaactttaagagctccacactgcccagccattccttgtcacctagactcctgccaagttccccagtctcaccccagcaatcaacaagcccggtgaaggggactccctcctcccaccccctttcctcagtgggtccactacagcaccacccctgtgctggacttgaaggtagggtactaggatagagcgaaggtctaggagagtagaagccacacacaaggctccctgcccacagtgcagtcagttatagagacttcactgtctgcagggtcccttgtctcaagtatctatcaataatatttatattgagataataggtccctgaagccacttctgatattcacaagtcctaggtcaccggttctccaaacttagcagcagccttgagcaattcaaacaagatccccccccagccccccaccccttctgccaccagctcagctgcccttgatggcaggaagcttctaagtaggattccaggtaactacttcctgaagcacagtttgctctccccccccccaccccaccccccagtccacttcccgggactctcaagggtgcttgtgtgcatccgagggtataaaagtccccttcccctttccgtccaggcatccagggtggcttcagagtagttggcccacaggcccagagcattctgggtactcaacatctatgggatcaatcaggacatattggggagttacagagatgaagccaaggagggggagggaggaggcaggaaaagcactgcccccccccaactcttctgagaacaaccttttctgcctttactgcccattcccctccattctctgtctcagcctccctctgtttgtctccctccctctcccaattggatctggcccctgttggggtgcccctaggccaccccttcctcttctgggtgtcccagcaccaacccggtaaatagtggggctcagtaagagtatgtgggatgatgtacggtgggacaggcggacgaatggacgggctcaactgccacatctgggcagctaagggtcagggggtgtggggggctcaagggatgtgggatcagtagcaacctgccctaggctcagccccctttgaggggtcctatggttgcgccctgcattcgtccgcgcgtttactctgtcatccacagttgatcctaactgagcgtgcccatggtcctggccctgggcttggcacctgccacctagcttgtcccttgatggcctctgcttcccagggagggcaagctggggggttgtctgggagccagagcactggtctctggctccatagagggcattcagagggcatggggtgggcctggtttgcctgccctgccttcacgcagacctgcccacccccagggccttgcccccctctctgcctccctccccattcatggctgagtacgggctacttgccccccccccccgcctccccaaactcacctcagttgccaacagcctcctggtgcctgttggaccatcccttgctggttcttcatttcctgtgggcctagtttccaggggctgagtgaccagggtcttaaaacaggtttaaggcttggcttgctggccctggagatcccgtcgccgtcttcgtcgaactcgaaatcctagccatcgtccttccctggtgggtgtttaccacacttcccaccaccttgtccttgagagtccatggccccgccctcctaggccccttgctgaccatttggtgttgttttgggggctactatccaggcctgtcgcgtcttcctgtgccatttgctgttgtgctcaggttccacgagctgcccatctccacagaagagcaggtgaggccgctgcctgtcttcatgcgtgtgagtacaggtggcttttctttttagggtgttctgctttgtaggaattctaattttttgcctttcctcaaagctggcattgcccaccggccatgccggctgaagaaaagaagactgaggaccccaggatgcccagcgcgaggaccccaggaagcccagcgcgaggactccacccacgacgcccagcgcgaggacttcacgcacaacacgttgcaaccctcctggattagggtgagtcacttgcgccggtaaacacaactttgttagaatccactaacattacatcttcactttagaagttgtacagggggagggtgcaccttaccaagcgccgcacactcgcctggacgctgcctggagctgagagaaagactgttgccacgagacagcacgcgtgggagtccctcctggaccctgtctagcagggaccagagacggtaggtgggggtagggcacatgtacactcccagaaatagccagggcaagaaacacagtaggcacacaacatagtcaacccgactgactatgttcgtgatatgaagaatccacaggcccttggctttgtcccatgcagagatgtggacatgggtggttatccatccacccttggtggggagacatttctccccaccagccatggtggcgctgtttactcagaatttcagccttgcctacgtggggctttgactaatgagatgctgtttgttttttttatgtgagcttgtctttgctttccttactcctgacattgctttgagacagggaatatgctggagaagacacagaagactccatcacacttccatcgcttgtttttgaaccacaaagaatggttcacttactcaagacatatttgtagagccactgaagggttgtgtgttgtgttggggtgggtaggaccgaaacatagggttgaagggtcaggtgaggagggcagctagccatcaaggtggcttaaagaggagggtcctcctgctttgccccacatggggtggtgggagacattggagcaatttgactgggtccaggtctgaccttggcctagttgctatcctttttaacaccttgacctccatgcccctgtctcaagattcctcccaacttgtcaccctgcttggaggaggccttgcctttcccatggagcagcttccatgatattctcattaaatgagattttgtagatgctcctatagcgctcagcctttctccctctggagtggaaatgggatgggatcctattactaaacaacctaattcacaaaggggccatgcacctaggcctggcgtttgcctgcctgtttttttgttttttgtttttttttttttttttcctctctagagggcccagtaggctgtagagaggaggggtgtgtgcctagggcaccagaaggctctgtcttgtgacatttactccgtagctggcatttactgagcaacctgcaaacacagtgacgtggctagcgaggagggctggggggtggggggggaagctttgctcagggcaggatacaggctcccaggggcatcgaatcccgagcttagacaaagccactgcctgggtagtctgagtcgagtgagccaagggcttgcagctctgagcttgttcattagggtcaagcccagaacttgggaggtaggctgagccaagtggttaggctaggttaagatgatgcgaacagacccaaccatgagacaatatgcccacttatcctagagtactcctacactctgcagccggccccacctaccttcccaggattcaaggacaggctttacatgaaggtacattttgagtgactgacatttcagggactgtggaagctaaatctcgggcagatagatttggtagattttgtgtgacattagtttaaagaacaaggaagcatactaggttctcaattaatatacaatccaccaacctctcggactgggtttaggaactgcagaggggatactactcctgagaatcaatagaaatgatagctttctggaaaattctttttgatgctttggagactgccagagggtgataaaaagggtggaaatgaggcctggaatgtcaagagaacaggcacagggaccttgccacctggtgggaagatgggaggtcatttgccatggtaataggcacttagctccccaaagttctttccacttggttcttcatgaggagggcagactgggggacaagatagtggcttcttgtgggagagagcctgtccatctatctcaggagtgggcaggcaagggaggccagagctaagctgaggttactcatggagggggctgcctttgcttctacattccctcctgcaagctgctggctgcagttttcagggcccctgatttgtgtgattcaaaccccaaatgtattcaaaagtacatttctctaaatgatgtcaaaacctggcaagactttggggcagcaggacgcatatgtttcttattccttcatttacatgaagtaacttacatttttttttttcctttatgagcaatctgacttcttagaatgaaaaaaaaattctaccgatcttttaacaagctggttagtgaagagtaaggggtgtcacacaaagggggtgtggagggaggtaaattaaggccctcaaaggttacagagcagtggacagtgaagggcaataaagaagccatgctggaggaactgggtgggggcagctgtctggggagccctttcttctctagggactggaatttaacaggctggaaacgagtcccaagagctaccccctcttctgcagccttgagcccccatccctctcagagaaaaggaggaaaggaagattcaggccgccattcctagttagagaagatggaaatttctatgagagctgggtctttctgagtgagactccataaggcacaggggtctctgaaagagagaggcactgggtgggtggtggggacccctgaataaagcctagctgctcgtggacaccttggtctctagaaggtttctgaggaaaggggtatttcagggtgaagttgcctttgtggcatagaaaaattagtccagtaggagttagggacactttaggaaggagtctctgatggtgtttccttctgggtacctagaaacacagcaacagggctacagagcagagcagcattaggagaggggacctgggtctccatctctgatgcaagtatctggtgtgtcctggttttgtctggccctggggccagtgtctggggccccgcctcttcctttgggacctggtggctttagccaggcttctcaggcattgtccatgtttgttttctcatcttccttcatccccaagtccagggtgtgtgtgtgcgtgcgtgcgtgcgtctgtgcgtgcatgcatgtgtgtgtgtggtgtgtgggtgtgtgcgtgtgtgtgcgcgagcatgtgtgtgaagggcaggtgtcaagtgacggaggccagtagtccccatccctccagctcaagcaggatgtgtgtgggagaggaattaattaaggtgagagcaggggtggagggtacggtacaatcttgactttcttaattgctctctagtttctttgggcttaagagaaaattgcagatggtgaggtcttccctccccgagcctgggagtggggccccagagcctggctccccaccaccttgacttggccttctcttctctcagtgaatagggtctttggctagggcttaaggaggagactcttagcctgggagctccgaggcccgctgcagctggaaacaaaggctcaagcagaaaggaatgtgggggagccccgcggagcacagccacctggggataattgggagagctagcttcgatgagtttcccaggtcctgtgaatggctcctgtcaatggaaggtgccctttcttcagatgaaaggaagaaaactcaattacctactcgacatggtgtgtgtgtgttcccagggtgctgtgtggggctcctgcctctgtgtgtgtgtgtgtgtgtgtgtgtgtgtgtgtgtgtgtgtgtgtgttgcacctaggagcagacccctttggtataatccccaatgttgtcactgtctgaccctggggactcttcagcttgtccttcccagggcttagatttgtgtaagtctcttgggatagagcgataggattaactataggcaagaatgtgatcacattgggcccaaagcccaaaagatgctttagagacagaatggggccaagggatagtccagaatgaagagttaggggaaagaggactgtgggaggggccaaagagtgagcacatgtcttttctggccaccagggaccacagctgtgtggcttttttttttttttttttttttttttttgccttccagcatgttctctgggtcattctgtatgtggctaggtagctggtcctccagggttaggaaactgggggtgggagggctggtggtgatggcaggggtctgaaattaaagtagggtatgacaagtatgtaaggttagggacatagagcagaaaaagcagagtgaccccccccccccaccccgaccaggggttatcccactactgccctagactgtcccaaggcaaaaagtccctgctaggagaaaaagtcctggttatcagtcaaagttggtgtttttgtgactgtttctgagcctcagtttacctgtctgtaaatcggcctaatcagaccagagcctttctgtaatcagacacagtccttgtttaaccagagaagggcacgcagaggtccataactggacactgtggacctccactagctttctggtaggtcaccctattgctccttagaaactgtcaggtagtcagcggacagagcccagaatgggtacttaggtccaggatagacagctgtctggagctgccttccactgtctgaacccagccctgcctatggatgtgacctcagcctctgcctgcagccctcggggtcatcctttctccatccttaagatgaggagtacaaatttgtagtcatctgagacctctggaatttgagtctgtaagtgctgggtctttggcacaccaggcgccttggcagccttgtttctattgctattgtccctctgctttggaggtgagggggctggagattccagagggtcagagtgtccagctggtgcagccctgggtgagggctgctgattgtaggttcctgagtgacaagtgtggtcagggggtctcagagctcagctagttcatcactgacagcttttagaaatcacaggtcttcgtggaagccgttgctgccccttgtgctatggcaaaggtattacttattacagggaattattcaaacatcccataggccaggctggaaaaccctttttgggccagagagcatcccttgtgtaaaaaaactagacccatattttccctgccaggaggatgtgtcccaggggtgctatccagaaggggtcattgtgcacccattggtcaagaggcatcctgacccactcagggaagaatttctagttgaagccaccaaggtagcaacttgtaaaaacagtgagtggtacccactcaccgccacccccttgtgtactcttccctgggcctcagcatggtaatcaggaacgcacagaccttttctgtcagtctgtgcccgtcattaccgtggtggaccgcagcttttgttttgtgaccttggttgctacaatacctacgagctgaaatgaggaatcaaaaaattgccagcttcaattagactggcagactgtgttcttaaggctgcttcagcctttctatccattaagggtaaacatgtaccaaataggtcctaattctctctaattgcctactcctgaagcaaagaggtgaaattccaggaagaggcatatataaacatcctctgaaacccgaccaacgaaaattagagggctgatgggggcccggtgcatagaaggggacatggtttcaaaagatgtcccaattaccgctcccattttcataaatgggcccgtaatgtccagggcctgggtctcaacaaaggtacaggaaatgagctctgcaaagagcttccatttgtcaggggaacttgcaagagggtagtattttctcaacaggtaggaagtgggaaaggctgatcatttgcgtaactgcagactcgatttcttgaaatcaacattttagtaaaaatagtcctttgacgtttttttcctctgttggaaacatcagtgagatatttgtacccaaaacaagatcagttaggtcctgtgtgcctccggaagagagaaacttttaaaaagattatctcaggatgcagagttagatgttcttatcctggtgagctgtgggggctgcattgactacgcccacccttgttttgtattcgtagcatgagctcaggacatggatttacaaggtcttccatcaaacgtttgtgacagtggttcctgcggactctataaaatcttgttttttcctttggctgcagtgagtcatctctgcagcttttctgacatttgttaagattccaaccccgcactgcgttattaatacatcacgcagatctggagctggtacatgcagcttttaaaccaaggcacgactttgccagggttacgtgctagcgtagcagcctggggtctgcatgccgagttcattaaggacagtcaggcgcgcctagggtccacaggggcctggaggagaggcaggaaaaaacccagatgccctgggctgcttctgattacctccctgccattaaaaacaaaataggggaaaacaggagtggacgagtgaaagcccccagctcaggttcctgcaaagaaacagcagcgtctttggtcttgctgtgtgttcttggtctggagtcacccagagaccatggttgtgatgagtggccaccatagccttcaggggtcatggggagaggggtattcactatgcagttaggtagttctgagctataagatgaccgagtgcttgggtcacccacatcttctggttgtcctgtgaacacttatttttaagatacagaatcaagcagttgggtttgggaacacaggccagagaagggatttgcaggaggcttggaaataagaggtgtgtcctaactgtgacctggaagggtttgggggtacctcagtcagagagctacctggcaatggagggtataggtggagaaacctgtctgtagaggatgaagtaaggatagggtagagagtctctggagagccagcagggcaggtatctggcagcctgcgctaggtgtttttcaggtcccgtggttctgtgcatcccagtctataacatcctagagcccatcacactaaagtccccctcattgtctatctctcaggagtgtccccagcctcccattaattcctctgggtctcctgtttccctgcatgtcacttaaaggggtttattctcctgctcccatcctgaccctcacttccagacacagcagactctcctctttgccacctagtttgaccataaccagatgctaataacacattttaaaaatcaactcatttaaaacatgtttttgaacagtcattttattttattttcttctcaagcagtttgagtttgtagaacaatcagggcagtgactatgggggttggggatgtagctccatgcttgcctagcaggtaagaagccttagggtccagtccccagcaccaaaatcaaactcataggcagtggtgcatgtatgcctgtcatcacagcacttgggaggtaaggcaagagggccagaagctcagctttagtctctatgacatagcagatttgaggccagtccgggctacagaagagcctatttcaaaagtaaaattaaaataaaaaagtatacagaaacgcccttgccccttcattggcacgtcgtatacacatagctcatttattgtcctgccatagtacgatcctgacgcatggttagtagaatggagtccatgctaggaggctgccactacattgtactttttgtgggccttggtagttgtctagtgatgtgagtctcacagttttacctcatgtttgagataaaccctggacttgtaaagacttggtatactggtgttctgttgggtctgttacactcctgtgatatggttagcacagaagtgactgcacgggtaccgtagggagtcacctgtcatcctttgtgtgggtatgtatgtgtgtgtgtgtgttcaatggttatttaagacactgcccactgaaaaccctatggttgtagcatagcccacatcctggaatcctgacctctgttgtgtggccctctggccagcttggcccatgctgagtcttgctggcccactgacttgtccagggcacaacctgtgccctaccttcaggatgttctcagagctcttgttctcagggctacccacataggtatcagtttgcattttatagttacagaatctctaaagcttagcttacacttagcagcccttagcccaccatgcaggctaataccaaggcttttggtacatgccccatcccctcttaggtagctggtaggggtgagcatggaatgagtgcgttatctccgtggatttcaaatttgttgaacttgagagtccctgctttaagccatacttgtgactttcataggtgcttttagccatacttgctgccttctttgccagccccctcctggtacttgctttcctgggtgggattctatcccgtgactgcaagctttctgatttttagccaaagccatcatctggaatcctgcgtgggaccctggacacacggacacagacacctgcccccaggaccctccaactgtaaatcgtaagtggctagagaacagagagcatacgtaatggctgattgggtgggggttccaagtaccctgtcaggcgagctgcagtctgtgcagatggaggcgggcaggggggtggggggtgttgcccagtgagccaagtcgagggttgacccggtgcttgtgttgtaagatgggagcctccatccgcctagtgttgtctctgtctcaaaagaattctataggctgcttcaagtgtgggaccccaaaagaatttcttctttttcacttttccaaatgaatgggcctttcattgcggactctccctctggctcttgtactgactaggattggaagcgcccttgtgagctggggccttcaaagggctgaggagaaaatgcaggccgagagaccagcttctcaaataggcttcaagcctccatgacctgagctcaccccctggaaatgtctggaaaacataatgggcaggttttctgtcttcaaagtttccatcaaaacctcttcaagttctttattgtttaggactgagacacttggggacagtaatggggactttcttttgtatctgtcttgaaaggccaaaatatttttatattgctgtagacaaagccacctatttacaaatggactcttgttccgtcgtttcccaccaggaagaccgtactatgtttgtgtctctatgtattctggggtcttgaaacaggtttctcatggggatggccattcactagagcccagaggggcagaaggggaagtgtctaccctgccaagggggtctggggaaggaggggggctagtctcagatttgctccttgtatgtctagggtaaaccctgggagaatctggtggtaaaagaacatatgctgtgtttgccccacatctgccatttgtgtgtgtttctgggctacgggtttgcacactttggtggttaacatggtgggaggaagtaagaagggccaagagggcacgggtgctctggttttcctgctgggaggctgtttcactggtgtgtgttacatcacataatgcatgtttagctgggtgagtgacaacagtatgaagggacagagaaacaaataggtgtagaaagagagtcacagagcacacagtcaccattctgtgcccaggcgttcattaaatgttcaatagaatgctgagctctgatagacagagcgggccatggacacactggtattgggtcatcatggacctaaggagtttttttaattgaagaaggaatcttacataacagaagaaagaataagaagagctgtcaaaacgagctctgaggtttttgaagccccttaatataaacagacagacaatggcgtgatcaggaaagggagaaaacaaacaaacaaacaaacaagatgcttacagaaatacgagaggacgtgtgagcatgcaaagagaacccagctaggttagtatcggggtgctggtggatcgttaatcctgtctgggtaccccagctccaaggggatgagaggcagcaagtgagaggacacataggaaactgtaacaagacagaggcgagcagatggggagcttcagcggagtgttaagctaggcttcgcaatctgaccacttaactctcccagcaaagaaaagaaaggcttaaatactaaaaagaaggaaagctggaagaaaggatggtagatgtgaaaggcatagaggatagaaagcaatagggagtggagtgcaggtgctgtggagagacgcttgcaggtgactcaattcaccagcctgtgcagctgagaaagacagccagtgacaaaggagaagaagaaaggtaacaatacactcacaaataggtagatgaatgtagctggaagacggggcctggctagggacgggatgagaggctgtgtcagcagactggttaattcccatctgtgcttctgagatggacaatgacccacccgaccaagagacctttcaggcatcaatatgtcagggagggcttcaatggggcaatggaggcgaggcccattaatagcagattatgatgtatccaattaggtgcacctgccctctggaagtgcagaaaccagtattgaaatggaaagaaagactgaatggaagtccgagagtacaaatgaatggatgggaaaaaagatttgcattcgctcttagggggagggtgctgctgagccccagggtcatctgatctcccggagaataaaagggcgagggagtgatagagagtaacaataagatggagaagaaatgaaaaggagtacagagagaataagtggggacaatgaagtctaggagcgcggcttgtttaacacaagtcatccatattaattcaaaattgaggccctgggatgggatgggctgtgtccaagggatgaagctgttgcctagcatgtgccaagttctgggttccatctccgcctggcaagacaaacacaggaaacaaaattatagcccagaggttgtaaatgttgtttttgatggttttgggacaaagagctagatcggttggaagatagagaaataggaagaggtgggaaagagttagatgagcacaagaggaagcagcagttcttaagataagtgtttaaatatggtgaatgcgtagctcttgggtgtgtcaagatgaaaataacgaaaagaaacaagtttagggatgacggcacagggatgagcggaagcggtgactttagttaatcaccgtggccaactcaagccctgtcagggatttaaaaaaaggtacaaaggcgataaaggaagacacatgcaatacggaagagagagacaggacagacagacacagcgaaaaggctgaggacatgcctgagagggtcgcgaagggatgagagagagaacagcgagaattctgcttaattcaaaaccgggctcctgagatagctaaatatctcctgagcccaaacaccagcacaggagattaaataacaaaagagctgcaggcagacccaagtggagaaggcttgggaccctcagatcaggcttcaactaaatctgtgcacctgaggtccataaataaaagaataaatattgaaataaaggagtgacagaaaggatgaatgagcacacatgactgaattagaaatggaaatggctagagcagccagtaaggagtggcccatgggacttctgctcatcttattctgggcacctgaggtcccttcgtgagaagatgcagggagaagaggggaagggaaaggcatgagagcaaatgaaagagaggcgaggagaggaaatgagaaagtggcagagaggggaagcgatcggtgggtgcctcggaagaggaatgtccacgaggattaataacgaggctctcattaatcctaaagatcgatgaggtaatccagacccaggttcttaaggggaaggagaatggagagaattaaaaaaaaaagacgcaaaaaaaggagagaaagataataaaacaagcaacatgatgaatgggtaattaagagaggctgtctggacagaaatagtaatgagttcccatgcatagtccttaaatagataaatacattatacctttcaaagaatgcgtgaaaaatcgaagaacaccatggcccccaaacaaggctgcaccttccattgctgtaataaaatacatgcagcggagagccataaataacggaaaatacttaaatgtaaaaggtgaccagacagagggagaagattgcaagcccagatacacgagggagggaggcgatgtttgctttgcatgtgtaatacaattatgttcacaggaaattaatagatttaaaaaaaaaatccaaactaagactgggagaaaaaacaaggaagagagggaagcgagatctgagagatggggctgagactcccggggtaggctcagcatggttttgactattctgcacatccggacttagaaaagtgagtttgtcagggcaggaagagaaaggtgaaatctggagcgggcagagctgggcagatggatagaaaaggaatggaaactacacaggttgtgtgtgtgtgtgggggggggaagtgggggctctaagatctgaggttaggcttgtttaaagctgagccattgttgtccccagaggaatcaaatcttactgcttttgtgaaggaagagaggatggcaacgatattgcaggaaaagagggaagggggtaggcaaggaggcagggaggaactttcatgtgctattcgctgactgggattggtaatagatagctcttggcccaccacaagctgcttccacacagcctaactgactgggagcagctatggatcaccatggccatgttttgcttgcagggggccatttcactgtctgtcacatcttcagtccatagacacatccctgcacagtgccctttccatagacgtggataggagggaagggctcaggcctggggctgtggagatgattgcatgaatagggggcgctatgcccagtgggtaccttgtctcctctctgggaaaggatctcttctgatcctgatgggaaggggcttagccagccaaagggcagggataggaggctttgtctgctgcctgctggctaccatcttgagtgtgacttacaccagggtgcagacaaagtgagcttgacctggaagcctagaggcccaagaggcccgggtgaagcaagtatctctgagatcaagcctacccttcagctcagagagtggacccctgcctaggctcccacacatgatcctaggtcccagatatgccacccctggagcccgtttcaaggcccatcttccagaatgtttaaacctgtgtatgtaaccagtaaaatgggagtttgtactgtgtattgaatctgtcttcttattggcctctgtgggctgctgggggagacctggagagttgtttattctagtgtcccccaccccctgggactctttgcttttgcccagttttctttctctgttgtggataagattttgtagagttgtgtgttgtatgcttgtgtttgaccattaaaaaaaaaaaaaaagtcacagccctccttgatttctcaattcctattgggggtgctaaattccaaaccaaaccaatccaaaccagattcatgtcaagtgcccaacaggaggataatagcttggctggatcaagggagcatgtgcagacccaagaacagagtggacagatgggctataccgcaagggggctttgagagctgagtgcaggctaagtagagagaaggtatggaaggttggggagggtggggctgctgctacctgagttgctgagggtctgagacaccagcaaggaggaggggcccctggaagaagcgttttgagatgactgaagatggaagatgggcgctccctacgcttctagcttcaaggtttttagtgtacgccagccgcctccgatcgtggaagacacagcctaaccttgtcagaagccaccttctgtgcccccagcaccacgtgtctgggccacgtgagcaacgccacgtgggcctgacgtggagctggggccgcaggggtctgatggcctcctgtttcagaatctggggcgtttatcatccttgggacaactgctgacctggctccggaagattgtccacacaagtctgagtgacggagtgagatgagggggcgggtggagatgctcagaagaaaacagcctttgcatggggttcatttccagctgtttagagagtcagccaaggtgacaaggtggggttggatgcggagaagaatgctgggactacatgtgggctacagctgtgaagtcagtgacatggggcagcatggggatgggtctctaggtgggccttgtctcaacattcatgccagaagattggaaggggtaccatgggttactgtgggtcagtgggaccttggaaggaacaagggcttgggtaggtgactttgccatgtcaccttgggatctagttgttttgagtctttgactcttaatctgatcttgaataacaaatgtctctagttctggggttctgagagtctgtggtaggattccctaggattcgtgtggggagggcggtctgcatgtgctcccaagttggtgtcccagcccttctgcctgctcagggctgtcttagacatatttgcttttcctttcaacatcataaaagaaggcaaattttgtcttttgattgacactcatatgcaaaccacaacatcctttctctgataatactgggacctacagctctcctcggctccccccgctatttgagcccacctttggggcaggtaggccaaaggccctggtgttttctgaggtgaagttgttaatgtaaagatgtgtaactcagagcagggggaagaaacacaccctcaactctgcttccccgtgctccatcttcctttctgccttccaaattcttatgaacaccgtttttttttttaaatttttttccatttaatgagcatccttttttttttttttaaagctccattggtggtgcttacttttctgttggtgttttgtgtctgttgcaatgagcatcttgctgtccacgttttcgttgctccatggtctctctcacctgcttgagttccattgaatggctatgacataatgatctacccatcttactgttgctgatgcatgatcatctcctgtcctgttttttttttttattttacattaccgatgacaccataactaatggctttgcacaaccagctttcccagcatccctagcgccccctacatctagctcttcccatggttcctttcttttctccttgcttccttctgctagactgtgagcccactcagggcaaggagcttgtggaactgcgctctgtatttcttgtaggatgtctatgaatgttgactgcgtgtgtgtgtgtgtgtgtgtatgtgtgtgtgtgtgtgtgtgtgtgtgtgcgtgtgtgcgtgtgtgcacgtgtgcgtgtgtgcgtgtgtgcatgtgtgcgtgtgcgtgtgtgtgtgtgtaagggtggacaggtatgagtgatggagtgattgaaagattggcagacagatgagaggctagatgaatggatgagtgaatgaatgaatgaatgagtgagtgaattaatggatgggtatattctctggttgagcttcttggatgaaagggtaatgtttgaatggctgttggttgattgaagaaagcctacagtattttatcttgtctgataatgtattagcatttaagctgatgtattagtatttaaggtgtctgctgactttcctcacctctctgttaaaaaatgcttttgtgtgtgtaaaacttgttctaattactaatgaaggctgaatacttttcacccatgtttgttaacaaattgtatcttatcttctgtgaactgtttgtccaagtccagtggctcatggctctttcaggctcttggttgagggtgtccttagactaggcaatggcctttcacagatatctacagaatgatgtgagaggctcagctgacttctagctcggcattagaatttacttaccctgggaaacagggaggctgatatcttgcaccagcaggtagaaaacacttttaggcttgtgtctgggttcaccatgcatttctagcttgtgagccctgacctgtgctctgtacctcttgtggtgtggcagtcctccaccttgtcctcctgagtgatagactacatatatgcctctcccctgttctggggtgtagtctctgaggccatgtcttagaggaactggcttcttagtgctctgtctagacatccccttagctctagtcttcccatgcacctcagtggcaggtgtggtcttaatttagggaatgaatgagaaattcagttcaggactgatgtgaccctcaggttagttctaggagcaaggccattttatggtctcggctcttcccaacctcctcacagggcagttatagccatctgggtagggtgtgtgttccgggagagctcatcctgccatccagaactccctcccacactctattatagcacttagcgtgtctgcctgtgttcagccctctcaccccatgcttatctggacattgaagcttggaaagccagtggtgacttcaactgacttttaattcatccacccatccatctggctatccatctagccatctgtcagtcaatccatccatccatccatccatccattcatccatccatccatgcatacacacattgggcctccatcacttgacctggtgctttgggcctctctccctctcctgaaagcaaaccccttcaccttgggcaagctgtgtgataccatgggctgtggtcatgaagcaaggcccccattcacagcctcctcctcctcctcctaggtcacggctctgagcacgtcccagctggacccctatcaccacagctttttctccataaggcttctcacacctcacaccctcctcctgtgatccaggagggccagattcccagagtgccctggggctggcccttcccaccatccgcggagctgcctccccaggcttcacactgcctggtgcatggtccctgtcatgagcttggccttcacctttgcagcttcctccaccagatggcagtggttgtgactcgtgtgcccattccttcgcaccttcattcattcattctcttacagccagcaagcatctctttaaaaaaaaaaaaattagctagtgctatactagagccggctcacaagcacccattgcaccactgtcctttgaaagaaaagatggggacatttgtaaagaagctgtgtttgtgtggccaataagaggagctccttgatttcaattcaaacttcaggtctgagttctattgccagcttgattgctctctccaattttgttcctcacaaaactaggttgattagtaatcagcaaactgtgttccctgggtgctcagaaatcatagcccagatccttaagaggcccaaatggggagtggactaagcacgaagcagctgcctctggctgcgagcaggctttcaaggctgtgagacactctgttcttctatgaggatgatctgagagccgttctggccactttggagctcagctaatgcttggctcctttttagagaaaattgcaggagatggatgctcgtacaagtgacaaggatcatgtcccaatgtcctttctgaataatccattcgcagacccaggcgagcaaggcacatggcactttgcaaacccctgtgtgtttcaggaggacccatgctaggggaggcctcctttcagctttctgctgtgaaggggaagagacgcagggctcttctgagttctcctcccactagacgcagtaggggcggcaaggccagaacctggagctggacaaattgtgtgatggatcttgcctcagggctgttgtgaggattggtataactggacacttctgactgtgaccctaaaaggcagtgtatgtgtccctgggggtgtgccagagcattggaaaccctagccctggagtgggggtggccttgcttgggtataatggggaatactttgtatctgttaaatttgtatattttcctatagagactttaacaccacgggataggggactctttagatagtacctgtgccctccgcccccctcggacacatccacacctacctctaggagaggttggggttgtctttagctctctgactgaggaccaagcctctgactcagaactgtatatggcacctagttacatccctttccaaaaggctcttcccaggggagcactcggcccgatctggcagaccccattgtccctttcccaatgtcctctctcccactaacagcatcaggccaaactgcctgagatctggtgcctaccacagtgcctggccaggggtagggcttcagtgaccttctgttgtatttgtgtaggtagatgagtagctaacaattgtaacaggtcctaggggcagatgtgtatggtctcattcagtggtttgtaatggagaatgtatctgaacccatatcaagccatctctcttccttaacatgttaagcagccactgctgtcctgggttgttttgcaccttgccttgttgtctttcatgctaagtaaaaaaaagtcctgctttctgctgagagtctgtttcttctggaactcacctaggtgtgatctggcagggctgctaagctgtgtctctgcccctctgacccgtagtcttcttctctctcaggtgtgcgtcactggcaagcctacctcacagggttgttgtgagggctaagggctgatcggctgtaacagtgtgatgtccatgctggctgtcaccagggatggtgccatgatggggttggcttgaaatcacaacctataccgttattagtggtcactgaataaagagtctcactgtggacactgaggttgtatatccagccgtcgatgtggtattcgaggctggctgtgtggtcctggctaaatctggtgtggttcattcatgcatgttagcgtctaagtccctctgtggtgccctggccttcccttcctttccatcatggtggctggtgctgctggttgtgtgaaggccaaagctggctgggccactatgctttggggcattaggaggggtggtgtctgttggtagatgcttcttcaagcttgtgtttctgtgtatgtggtgtgtgcatatctgccccctgggacagtgccaagaaccaagggtcaatagaggggcttccaaattatgacatccttgaattttttcttactgctctctcacttttagctggtaggtctgggtggctgttctcctccccgctccccctttcttcccctgccaggagatgagaaaaattagctttctctacaccaaattctgctttggactgagcttaggtttacacactttactgttgtcctcagcatggtcccattctatggatgggcagactgagaaccagggacaatagtcatgttatgtgtgaataactctttccactccaccaaataaaacctcagcaagcccagtgtcttaggctcacccctgcctgatcctggcatgcactcagaatggtctcccttctgctttgtgtcccactatccacctagtattttcctggcagggtaaggcatggagggaggagcaaggaggctgtgtcctcccaggtctcccagtcccggagtgtcccagtccatgtctgtctgagattcacatttcccacgaggctctttccatgatgttggattccatccccagtcctcgtcctgtgaatctgggcgagcagccttccacttttccactcttgttccaagtccacgccaagaagcccccccacccactgcacagaagcccagcctccgctcagttccttgtgttactctggctttcaaagccctggtgtctcagccctagatgctcttaaacccttggtgttgtcactgtgtcctcgggctcaggaccccgtgttttcattgttccctctggctgccatgtctttccctatcatactccattaccaaaatcccgactctgcctccctcaggctgtgtctgtgactgctacagttcatcctgtctttgacaacttcttggaacctttgcttctgtgctctggggtcttgtggtaggcacatgtgggtcaggtcatttgctcaggtaattttgactctgtgtctaggtgcctggtctcagatgggcctttggccccttgtgggccaggtttttgggtgactcttaggtagcttatgtctcttggaagtaaagaaagggaagccaggggcctggcaaaaagggaatgcttagattgtgactaagctctaggcttgctccaactcaatgtcaccctgcctcttgaagtagtgggcacctaatacttgctccatgatgaagtagggaaggctaagtgaatgtggataggccggtgactaggaggtctttaaggactttccccaggatctagtcagctacaggacacccttcctggtagaaacactgctttggagatattatgtccagaataaaactttctgagagctaaaatgtcctcattgacattttgacctgagtgatcctgaaaaggagttgtttggcagttcccaaattctaaggtggacttggctgtgcccatatcatcaccgaggcccctctctctgggtgaaaggagattatttcgcccccaaagcctttgttcccaccattggtgacaatcagcactgacttagaagttacctgtgagatttgggtacagcctcaagcacctggcagactggggagattggaccccttgaattcttcttttctacagagtgctccgtaggcacatgggtgggggaggggttcccagggtcttacccatttgggcatcagacctgtttttgttttttgtttttcttccaactgaaccttgagcagcttgcctgaatcatccccagccttagtttctcttcctgtacaaagggtgtcattagtgactgcccatcatatggtggctcatgagaatcaaggtctgagttctggtcatccttgtcccttgtggaacgtgtggtggccttggctgtttgccatatcctagaaatagtcaaaccaacctggtttgattgggggattcagtgaggttttttttgtgtgtgtgtgaaaacgagtgttttgttgcttggtatgcaggtgctcatgtctgctaacccatactgactgttgtggaggtgggccctgggtacagatgtaccttagtttctgaaacttcaggtccatgtgagactcggacagagtggagggcaggagggtagcacctacccagctctggagcgacatagaaagccttgctttcaaatgttaggattcagcagttttgatgggaggctctgagatacaagaccaggaagactattaagaacacccctctaggagggcaaggccaaagtctttggaaaaccaccaaggtttaatagactgtgaattggctagaagtcttgggggtggtatgagaaagatggaaaatcctagaataggtttttatttattggaaaagtcaggagctggtgtgtaggtgttgccccacccccatggctgtccagaagttgggccttctacatagctcaggctttctgagcacagggctgggttgccccctccagttcctaccctgcctagtgcatgaaaactctttatctgccatggggatggggagcagatggcttcatctgcagctgtgtctctctcagcctctacagccacggggacgccttgcacatttcctgtgggacatgctggacccaagactctggaccctggcctccccttgagtagagagacccacctactgactgatgaactgcgctgaccctggggtcaggcatgtggccttgatccctacccatggaccctgagacttgggggggtgggagaaaggctgttgtgtcttcactgttgagtctacatctgtgaaatgggctcaggttcctacctcacagggctgttgtgaggcagccgcaatgtgcttagaagcatggggcctagtggctcatggtgctttcaataaatttcttgttttaactaaa

SEQ ID NO: 19 - DNA, 24218 bp, Mus musculus
gctgaatatggttctttatgtaatagtatctttcaggttttgcatttgataatacaaacaaggaaaaaaatctgggttctatcataataaaagatggtgcctataatctctcacaaagggattttgtttcttactattcccattcttaccaagactcatctctcttcatttaccttctgttatgaagcagtcttccttttttaagtcagttaagaaccatattacattggaaagtgaaagtaattcctttaaatagtttgagtatggtacaatccagggtctgttgctgaaatagtctttgaagttcctgttggaagtcaaccctttggcacctttcatagtttgtgattggtagtacttgttcctcttcagaaagccatcttttcatccttgtaactaaggtgctctcttgtactatacagcaaggctttagcagagcctctaaaagtaagaaaagaaacagaaagctttgtttttctatcatagggaggtttttgtcattttgaggacagcctcagattcaggagtgtcctgccttaacctcctgggattacagtcatgagccattgctgccagctgaagctcagttgtttactgttactgtaactgcttgtgtgccttcttgtttgtaatgtattacaccataagaaccagtttgagtggcattgacactatctggacagatggtttaaattactggtttgtttctgaaatatgtttacaaatagaaaaaatgggtatcatgaaaaggcatatggtctttctaatttgaatctgttttctttctgagatgtcttttatttgaagccttaaaccattatcaaaataaacaactttttttttatttgggggggggggggttcgagacagggtttctctgtgtagtcctggctgtcctggaactctgtagaccaggctggcctcgaactcagaaatccgcctgcctctgcctcccgagtgctgtgattaaaggcgtgcgccaccacgcccggcttcaaaataaacaacttgagaaatagaagtatatcagtatttgtaaagagtgtctcaattccagtgtaatttcccattttaaggaaaataaaacttttattttctgtgtataagtagtttgcttgcatgtactgtgtctgactgtaagagactggagagggttttggattgggggagaggagtggtggggttagatgtgggttctaagtcagcattgtgtatgctgagaaccaaagccaagtgaccttacaactgagcatctctccagctcctaatctgtctttctaaggttgaactaggctggagagtatgtcattttataaataccaggcacacaacgtctactttgtactcactgtttatagaacttgtgtttattttgtgttaatttcttttctgttgtagaatttacatagtacacgatgaagttaaggataaagcttttgaactggagctcagctgggttggtgaatgtaagttacatttgtacatttattgttctagaatttatttgcactttacgacaagttaatgaaagaattcttgccgggcatggtggcacacacctttaatccagcacctgggaggcagaggcagaggcagaggcaggcggatttctgagttcgaggccagcctggtctacagagtgagttccaggacagccagggctatacagagaaaccctgtctcaaaaaaacaaaaaagaaaaaaaaaaacaaaaaaaaaaaccgatttataagtcaagcttactgttatttttaagtgagttcacctgtgaataatgattatttgggggaggaggcaacaggaaatgatctctatgcacttgaagattagggcgagttcacagtattacaaattataatcctcatatttaatatatggtttgattttatagtaactaaaggaagacatgaaattgttcccaaagacataagagaggaagcagagaaatatgccaaggtaagcagcaacttgttctgaacaggatcgtggtaatgaagtaatttggttgatgtttgcttgaaattagggtaaactgtcttttagattactggtttttttgtttgtttgtttttttaaagatttatttattatatcttaagtacactgtagctgacttcagacacaccagatgagggtatcagatttcattaccggcggttgtgagccaccatgtggttgctgggatttgaactgggattggacctctggaagagcagtcagtgctcttaaccgctgagccatctctccagcccctaggttactctctttaaggttatctctggtggggatagatttgccctagctctaaacttttattttttattttttgttgttggtgtttgcctctttaaaaaaaggagttgtctccttgaacatttcagggttgctgggcatggtgtatcacctgtattcacagcaaagggaacagaggcaggaacatctctcagttcaaggccagcctggtctacaaagcaagttctaggtcagagggggaaaacacagaaaccctgtctctaaaagccaaaaagagcgggaacaaaaaaagcaaagaaaattccaggtttttccttccaggacatttaatgcttttatccataggacaatatagacttattgggttatctttaaatgtggtatttttcaggaataaataatttttaattacagatgttaaaagtgcagattctataggatgtaccagaatgaaaaacttaaaacacttttttcttttaacaggaatctttgaaggaagaagatgaatcagatgatgacaatatgtaatattttcttccccatccgctggtttacatttctgtaacagttgcatatggctagcaccatggactatatatacccactgaccgattttcattaaattttgtcttataaacattgttgggtaattgaagctatctgtgtaatattaaaatatagattgatgtttgattaaaaattcttagaactgggcctggagagatggctcagcagttaagagctgctcttccaggggacataggttcaattcccagcacctacaatggcagctcacacctgtctgtaactccagttccaggcttctgacacctacaaactgaggtacatgcaggcaaaacaccaatgaatataaaataaaaataaatgatatctacttacacatataataaatgcaaaaatacaaatatgtatatatacagacacacatgtgtatatacatttaaattcttggtgctattctcgtgtggtagtacatgcctttaatcctagtactcagaggcaggtggacctcttgagttcaaggctagtattcaaaaaaaaaaaaaaaaaaaaaaaaagcagtgcccagagttaaggccgaaagattgagcccacaagttaatttatccattttgttttaactagaattaaaataataatttttagatttatttttgtgggtttttttttttttttttttgcatgtttatattacaatgtccatgcctggtatccacgaaggtcagaagagctttaatctagaactaaagttatggatggctgtgaatcatgggtgctcggaactgaacccaggtcttgtgcaagagcaacatgtcctcttaaccactgagccgtctctccagccttctttaactagaatgatcatattattctgtggttcttgtaataatgttgtgtttaatgtagggacattctgtaaccactactgagaacagcgagctttttgtggaaaatgtgacagcatttatttttcagattgcatagatatcttatgactggaaattatcacctgtcttagtcagggtttctattcctgcacaatcatcatgaccaagaagcaagctggggaggaaagggtttattcagcttacactttccattctgctgttcatcaccaaaggaagtcaggactggaactcaaacaggtcagaaagcaggaactgatgcagaggccatggagggatgttctttactggctcgcttcccctggcttgctcagcttactttcttacagaacccaggactactagtccaggggtggcaccgcccacaagggaccctccccacttgatcactaattgagaaaatgctttacagttgggtctcaatggaggcccttccctaactaagctcctcctctgtgataactccagctgtgtcaagttaatacacaaaccatccagtacagcacttgaaacaaaaactttaaggtatcaaattgagcttaaatattcatgtaataaaatgtttatagtacttctctgataagaaagagttcctttcctttgtttctggtacttttggtttatttgaggcagggtaggtcttcctacataagccccgcctgtcctgggacttactatatagaacaggctggcttttaattcttagagatccccttgcctctgcctccaccatacctggtcctcgtttctgttgttgttaaaatgaccttggaaaaaagaaagttggatttagattattagtatctctgaaacaatttcctttgtagacaggtggcaaatttgtgtgtgtgtgtgtgtgtgtgtgtgtgtgtatacaccaagtgaaaatgtcttgaatgtgtagttttctaatgtttgtattcgtctgttgaaatgtaatctagagctgacctacattttacattctggcacatctccactgtatccatataatcaaagggtgaatctgggaagtatgcattaaaaacattcctgtattttgccatactacaataagctaaacttagaacctttgacacacagaaactaaggaaatgaaagtcagtgttctcttagatcaactacgtacccgaggactgctagactgtgttctaattggggtcgattttaattgtactcttaatctcttcttaaaattagttaaccttggtttatagttcatgcaaagtagactggatggttctttgttttgtttttgttgttttgaggtctcttccccattggcattgaactcctttacctttgagtgaagtgttgggattaaaagtgtgctgtgtaccaccacacatggccagatttaaaaatgacagcctctaaactaggcagtggtggtatgtgccttctatcccagcactcaggaggcagagataggtatatctgtaagttctaggacaccttggtcaatagagttacttccagggcaggcttaaaaatcaaaaatatacatccaattcaacttcaggcgacttaagaactgtcaaagcatgaaagattaaagacaaaataaaaaccgattcctgccctttataaaatattctgaaaagccctatcctgatgaaattgcttgttgttatcttgctccctataatctggctattttttaaaagttacagggggaggcattcattctactgtctattcaatttgaactattactcaataggtaactatattgtgctttgtatatttaaaacattaaaatgttcctttttgatcatctcaccccttgaagggtaaattactatatttatctttctggttcatatagaacatttttcttaagagtagacactgaggccgggcatggtggcgcacgcctttaatcccagcgctcgagaggcagaggcaggcggatttctgagtgagttccagggcagcctgggatatacagagaaacccggcctcgaaaaacaaaaaacaaaaccccaaaacaaacaaacaaccccaaaagacaaaaaaagagtagaccctgggaatcagagagctgcttgccacttttgcagaggattatagagttcagttcccagcacccacctcagactgctcgcagccacctgtaaactcagctccaagggatccaacgccctcttctggctttcttgggtaccaggcatgcagagacatacatgcggacaaaatactcatacatttacaataaaaaggttttttttttttttttttaggataggtaggacagttttgatcttcattagacagcagcaattttaaaggggttatttgaacttttacaatgtataccactgtaactaagttaaaaattttcaagctctttctcagtgagaaaagcagaaatataactattaccaagggctatcacaagcctgcattgtgatatttgctttaagaatttgctttaagaattggaggacataaattccaacaagacatgaaacggaatccagggagtttcctggacactggttggatgagaattccagtgaattcagaataaacataaataatgccagtaataaatggcaaaaaacttctgaggtgatactgaaacaaagtagcttatcttgtggggtggagagggaaacactctccctatgtaggcaggctagcctcaaactctgagtgatcctcttttatgctcccaggtgttgtatattataggtgtatgccctgcctgtgtgactaacaagattacaaagcaaaaactgagttgggagaaatgtgtgtttcctaaactagttctaagaccaccaactttagacttctccacagacctgagttcaccagctggaaaataggccttggcaatctgttttttgtttggttggtttttttgagacagggtttctctgtgcagtcctggctatcctggaactcactctgtagaccaggctggcctcgaactcagaaatccgtctgcctctgcctcccgattgctgtggttaaaggcgtgtgccaccatgcccggctacagagcccttcttaaaacattaattactgtggaatatttcatttgcctttttgttgatgctgctgctcccctgtgtattacaggggagctaagccacattagaaaaggggcaacagaaaagttattagaaaaaggttaacagataaggcttttataattaagtaaaacatatggtaaaacagtagaggatggtggatatttagaaaaacaacttgaaaaatatatctcaagtctggtggtggtgcatacctttaattccaaaccttgtgaggcagaggcaagcagacctctgtgtgtgtgtgtgtgtgtgtgtgtgtgtgtgtgtgtgacagacacagatatgtcacaagagtacataagaggaaaaaagggagggagaaatatctagtaaaaaattaattgcaaaaattgttcaaattctttttattacactgtatctgtgtcttcagacaccccagaagaagttgtcagatctcattacaggtggttgtgagccaccatgtagttgctgggatttgaactcaggccctttggtagagcagtcagtgctcttaaccctgagccatctctccagcccattcaaattctttatgattccacctaggtgcacaacgagggcaccataagggtgttaggggaacatttcaaacacaaaggtggacaagaggccagggaacaacacaggaaattacattattgttcaataatggtctgggactagaaagggatttttcttattttattgatgggccaaggagaaaagttttgacataaaagcagcccaggttaatttaatttggtcaaagaaagttctatagaggagcttggtgttgcaagtctctgaagagcaaggaagtaggatttggtttgcagcccaggtaggctctgctgactgttagtagcttgctaggtgatcacagggttaaaaggtgacaaataattggtttgcaactcactttttcagcggcaaatgaacttcacaacgacttactgtgattcacattcaaaagatagcacagattggccatgaagcccatttgcacgctaatgaacctatgaacttgaacttgtacccactggaagtggactaacgtggctgcatgctgttcttacaagtttatggaagtctgcacagagccttccttcacagggaatatcactcattctcaagctccaaacatgctgcacactgcacactgtcaacaaaaacggctcttccttcctttagtctcatgacagcaagccaatgaagcttcctgaaaacgactctgctttagagaaataaagtgctcccctcctccctcccccagctctctggatggcttccaagtgaacttcaggagaagttttaaatgtgaagctcaaactcgcttactcgaaaacccattcttttccctaaatggaaatttgacaaaacaggaagtacacagtgagaaagagaagcaaaattgtggtcaaagaatttactgtgcacagcctagtgctttctgactaagataaaatacagaacttcaaacctgggaggaagccagtaaattggtttcaatatcgtgacacatgaagaaagcaataggagatggcttttcattgcataaaaattccctgccctacccactctgaccaagacaataacagagccatatagtatatagacactggaagtaccttacaatttcatgtaaaaaaaaaaacacatttttgaataacagaattctcatttgctttgagaaaaattggagtatcttttaccttgattactgacgtatttgaaataactccataagtagacaatttacttacatctcaaaatttaagctgtagcaattaaaatggcctaactaggtggttatggaaggcagggacaggtggatctcagtgagtaccagaactacccaggctacacagagaaaccctgtcccaaaaacaaaagcaacccctcccccacaaaacggccaaaaaaaaacaaaaaacccaaaacaaaacccaaccaacaaaacaacccctaaaaccaccaccaccaccacaaaacaacagcacaccaatacatcaaaatccccagcaagtgtcaaacaaatgaacaaaaagtcaggaaggagaccaattacatggaatacccaacttcggtgtaaattttttgagacagcatgtcttacagggcccaagcctgcctggaactcactgtgtagaccaggctggcctcaaactctgagacctgcccacttctgcctcacagtgcaatcttgttttgctctaatttcagtatctcctactgcagctaataagagcaagtgaacctctggctcagggtaaagcactcagggccagccactcaaggtgccaatgcccctccctccctccctccctccctccctccctaagactaaggcaggtggggcatgcaagcctgaggatttgttcctaaggaggatggataccagcaacgtttgcaaatctaaaactattctgtcaaagctatttctgattctcaggggttcttaacttttttagggatagatggacatagtaagaaatatgtctataaattcctatctgaagaaataagttgctagattagaatcctgaaatattaatagccgcaaatgaaacactcttaacgtaaaatttaattctatgatatactccaggtcacagccaatgagcacaagcttgtgatttgaatgtggctttttttttcaaatccagggtttctgaattcggatgcatattcaataccattatcttgtggaattactgtgaaaattctgggacttaaatgtgagcacagttacttagtgtgtgtatggaatgtgtaagtgtgcagctgtgaacccacgcgcatgtgtgagctacatcgcatgtcaggtgagagaaccaccaacagtagcctgtcccctctcccccacatggaccaggctccggatcagtctacctgctgagccatcctgctggccggagttctgggaaatctccagcttagattatagattggcctcttcatatctatgcactcctactacaaacctggtattttcacttactgctctattcccagcactctcaattttcctaattctcaaggccaagccctgaccaattaatttcacggcaactccagatcaagcaaatatcctcataaaataagaccctacttctagtaataggagttcctgttgctaggcctcatttcatacatagaagcatgaggcattgagattaaaaccaaaagcactcaggtggtgtcctcgtcagctttctgctactgcgataaacaccacggcaaaagcaacttggagaggaaacaaaagactaaagttcagtttctactcctaggacacagtccatcactaaagaaagtcagggcagagattcaaaggggaaatgaagcagaaaccatgaaggaatgctggctcactctctggtctatacttagctagcttcttcagatatactgcccaggggatggtaatgcctaagcggactgggcccatggatagcagttaaaaggcaagaaaattcctcacagccgtgctcacaggcaatcccgatggaggcaattttgtttgagtttctctgaaaagggcaattttttgtttgaggtttcttctgaggtgctaggttgtaacaaactgacattaaaaactaacagagggggattatgtacttagcgagacacagggcctatatatccagttaatggcaagagggcaaagcaaagaaccctcagtctttaccgttttcttacagtttactactagcaatagtaaagatctgcaaaatatcatttattatccaaaaatccctttgatagttatactatcttttaaaaaacaacaatcgaataaaacttactaatgtgtgaatagtctcaagtgttctatccccaaatgctcttaatatggcttaattcctcaagcggtttcatttctaggtgatttaccaggatgtttgtttttaaatccagaggtgagggttttacgctggcctggagctcaccaataaggctagaatggctggccagtgaacctcggcatttccacttgcatttctgcagtacggacttcaagtacaagctcccacagactaataatgaaagcctgccacgtaggaaggacttgaactgccccacagttgaagcccatcctctaaacaagctatctgggcttcagccattctaagtctgtgtgggacgtgagcagctgtcctcatttcatctgtcatctccccagtagcttctcctgcatcatctatatctaagcagtggttgcttaggttgaatagtccatgaacaactttttcagaggaagtgagcagtctaaggccaatggattttgataaatgatcctgcatttcagtttgttgtctggctagaatatcaagaacccttgccatttcattggctataatctcaaaaacttcctgtaatctgaagtgtagtcccaagatctcctctatccattcatgggtggtggtggtggtggtgcatagtgcactggaaaggcagaggcaggcagagcttgaccaggccagcttggtctaccgagtgagttccaggacagctaaggctacacagagaaaccctgtcccttaatcaaaacaaaaaaacaaacaacaaaagacccaaaagactttgacccaagcatgttaaacttccaaatggtatgttaagtcattgttcctactaagcaaaacaattctttcatattattgaaatctttaggaggcaaattctagtggccagactgaagtaccttggttcattttagggctcaagggggtccagttctctagcatctatgatgtgtaatggctaggtctgagtcaagtaccttcatgtgttatattaaagtggtactagcctaatctccccatatgctaatagtgggtggagggcacccataaagaatttcataaggaaaaattctgcttggtagggttaagtctagtatttaagagagcaattggcaacaatgatttcagtttaagtgtgtctcttgcttagctgtagcttccatgtctgattcacacgctctcccagcccagagctctgagggccttatgtcctatttaaaagccaggtgatctttaaccctttaaccaccagtcatactatctcggccacaaacacatctgttcctgtagtgatagaaattccaagttgggctggtgagatggctcagtgggtaggagcacccgactgctcttccgaaggtccagagttcaaatcccagcaaccacatggtggctcacaaccatccgtaacaagatctgactccctcttctggtgtgtctgaagacagctacagtgtatttacatataataaataaataaatctttaaaaaaaaaaaaaaagaaattccaagttgaggaatgatctttaagagaagtaaggccggggctggtgaaatggctcagtgggtaagagcacccgactgctcttccgaaggtctgaagttcaaatcccagcaaccacatggtggctcacaaccacccataatgagatctgatgccctcttctggtgcgtctgaagacagctacagtgtacttacatataataaataaataaataaataaataaatctttaaaaaaaaaaaaaaaaagagaagtaaggccacgtcataaggctttcccatgtgattaagaaaacctcccactcagccggagacaatgcacacaaggactaacaggtatctgtagtagtctcagaccagagacagtacagtgaaatccaccacaaacattttgtgttcccaaggaggcctttgcgtctgttgtatgttattctgtgcacaggtttcacattgttcactcattaggctataccaaagagtggaggaatgttaagtattgacccaacccaggcttaggggtgacacaggttccatgactgaactgtttcacagcaggggtggtagcttcagggactgctacactcacccgtgaactactcaccgtcaacagtgagatggcttccagtctcaagtactcagggtcccatctggccaatgggctgggaagtggtacagcagttagagctggaagctaccagttttgcccctggactattgtataatttcctgagaaactacaataccctctcttctgggattcccaacagcaaagtccactcttttcaggacccatatagcctctaaatgttcctagatttcgctgccgtattgtctttttcttccaaaactaatcaagcccttttatttatttatataggaccctgtgtatgtggagatgaagatagagattccgtatgcatgttgttgctccataagatgttgatgcttagcagccggtgggaaggctaaattctgccctttgtgctcaagtccctgttggccacagtggcagaattaaatgtcattatagaataaccagtaaagggttcaccttccttgacaaagttactgccatcaatggactgttctacagcagagtttttaagagactggtctgctaaagaccagctcaaaaacaggcctcaatgcagggatgacctgtgtggtttgacacaacaggcagcaaagttgataggttaaagttttgttacacctccaaatgaaagccttccctcatatctaactatcctggcactggttagccaatcctgacccttctctccactgaagtcactcctgtgaggccagatggttaaatcctgaacacgtttgtcagtctctgccactaggtagcacaactgcttgtagggatggtgaccagtcctgaaaatcaagaatctacatcaagaaacctgctatggcatcagtgtgtttaaacaaagccaaagtctatgctgtgtttgggagtgcaaaccaggcactttaataagggcctgttagatctctctaaaggctctagagagtttccccacaacagtggctaagtaccatggtggtctttacagagagtagtattactggttagactcctggtgctttcaaacctgaatatatgaagttaaaggaggcagttctggggtgatttctagtaagagactctggtagccttcaggggactgtatggtttcagacacagcttaggcaacagcaggaatgaccaccacaggcactgatggtgctgacaaggggtacaatccttcagaagaggcttctcaggttctggtctacattttaaactcttacctttgctagcatggtttacaaatttcctctatggcatggcaagcactgtaggtggggaagaagtgcatacgtctagccaacagtcaatgtacgggactgcagctggataccctgagagccttaaacagctgtcaacacttcaacacctcactgaaacacaacactcacaacacagagggcagagggggaaaaaaaaagataaacttttgcttcattcattactagctgctcacctcttggggatatttcaggttctttgattgagaggttaagaaccccagactactggggggagggggaggagagggtgaatagaggatgaagggttgtgaaggagtaacctcgaaggaagatattgagatgtaaacaaatggaagaagaaaaaaggaaaaaaaaaaaaaaggaaagaaaaaaaatcccagactggactggagagatggctcaacagttaagagccctgactgctcttccagaggtcctgagttcaattcccagcaaccacatggcggctcacaaccatctgtaatgggatctgacaccctcttccggtgtgtctgaagacagcaacagtattctcacacacataaaataactaaagagaaaagaaatcccagtgttacaaccccagtatggctaccaggaacagaggtcaacatgtaactggagctgacctgactactgctttggcctgtatggtcaagtcccctggccatttcatccagacacactcacacatttccggctcaccattctatctaagccactgtgcaactccaacctatacttgggcaaatcctggggttccagatgatcaggcccctccttctcctggttcctgagacgtagaaagctctgctgcatcccagggtctcaaggcaaggcagaatgtgcgccgggtctcagccttgtgaaaggggaagtgaaaccaccaagagatgtggaattctgaacaaagagacgggacacgaaggctacttcaagaaaacagcttttatttgtggtagcacagaccagatcaaactgtttacagccttttttgtttttggtttttcaagacagggtttctctgtatagctcagagtgtcctggaactcactttgtagaccaggctgacctcgaactcagaaatctgcctgcctctgcctgctgagtgctgggaataaaggtgtgcgccaccacgcccagcttgtttacagccttttatatgacttttgtttgtttcccatacatggcaacatataacttcactggctattttaaaactacagggtgtgattctatacttgatcttagccaaaaggccaagaagcgattagggtgggattctaaaagtgctagaatatagaggaagcaaggtcacatcacatataagcattttaacagagactagaccacatggcagtccttgttctccctccaaggtgctcagaataagtgcctgttgggtgctcagttcatcgggagggacatttatataacccacatcaaggctcagggacaggaaagaagaggcaggaagaatgtaagaaccaggggaagccaagacatgaaacactaacctgtgacctgtgttgcacccttaaacttcacggtagctatgacagcctctactcaggacgtgaacaagatagggtctgtcaacatcctgtcaggaagggacagggtcacatgggacgtcacttctcctaacagtagttacatagttaatgcttggtagagggaaagtatagtccctggaagtgtgcccacatacttgtaaacaatcccacataaacacactgagcggagaggaaaaccatcgacatgggcacaaacaacggaatacatctaaatagaaatagggatcagtaggagaagaataaaaaaaaaaaaaaagaaaaagaaaataaaaaagccaggtacagtggcttatacctctaactccagcactagggccacagaggaactagggcaacatgccagtcctagccatatgagatcctgcctcaaaacaaaaacaaaataccagacaaaacaaggttaatgaaggattaaagaaaatgcttacaacttataaagctgagaaaataagccacatacaagtatgttaggatgggtatgatggccaccgcttttcatcccagcacttacgagcagaagcggtgggttctgtgaatctgaggctagcctggtctataggccagccaaggatattaaacagtgaaaccatatctcaaaacaaaagtcaacaacaaaaaataaaaatcagccgagcgcggtggcggggcgcatgcctttaatcccagcatttgggaggcagaggcaggcggatttctgagttcgaggccagcctggtctacaaagcaagttccaggacagccagggctacacagagaaaccctgtctcgaaaaaccaaaaaaaaaaaaaaaaatcaccttcaacttatctccaagccatctaaaactctagaaggcaagtgctccacaggactccagcgtgcagctgactctagcagctccacaacacaggcctcttaactttgctgatctcatcttttgctaggcatcctttcccaagtgcttcctctatgaaacatcttttctcaaacactcttagtcacaaccttccacttaacttgaaagacttttaagatcattatccttaaaagccttcatcaacatacactaacattttcctgttttttgacttgtttcatgatactgaaaatacaattgaggaccttgcgtatacactcacaagcattacaagccagctaaaacaagccctcagttctgcttgcttaggttctttttatgatggtccttgcctttcatctcagcacttgagagacaggagcaggagaatctctgggttcagggctaatctacacagggattccaagacagccagggttacttgtctatcttgaaaaacaaaaacaaacaaacaaaaccccaattattcaagtctcctaaagtatttagattaactttctatgcttaatcctgctatgtatcttacttgcacttagttccctaggcatatacctttggaggaatgtcattaaataatccagatctactttaattcaaatcctgaaatatgctgtcctagtttgaattacctgtggtcctaaaaccaacaacaaaatccacagggtaaagaaaaaatcatattgacatccacacatacaccacagagtacgctttaagtagcaacagcaaaactggttctggtttttaaacctagagccttgtatatgtcaggtacagcactcttacaatcaagacctatatctctggtgcccaaaataattgtttgattacaagtatttaatcccctcaaaaaaactctcaattgtttgggaagcagctatattcaacccagcaatcaattctacttctcaacaaatcctgatgtatgcacatgcatacatatgtaacatggccaatctcattttcctaatgatgatataacatttacatactagaaccaaagttttcagtataagtaacaaatcctaggtcttttagacctgaagcagcttggttcttttccccacaacaacgtcaatgtccttctgaaagacagggacttctttttatcttgagccatgttttaccttaaagatgcagaacatgcacttatttataaaaaattatttatcttgcccctgaacactcttcatcaaaatagacttcttatacaaggcttttaagaaaagaaccaaacacacaagcacacacacatgaacacacattcagtgttctattataaaaagtactattcaaaaattgagcccagaaaagtgaaatcccatctcaaaaaaaaaaaaaaaaaaaaaaaagtccaaacaatccagaaaatggaaccatataaatgtatttagaggagggaggaagagacggacagacagacagacaggcggaagggcgggcccagggatgagatgatgtaggaagggtacccactgctaggctgatgacctagcctacactgtggatggagagaagcaaccctcccacagctgtcctttcagcttcacccacatgcgcactggcccctgaaagaatgtttaaaaagggagaaaacaagcccggcgtggtggcgcacgcctttaatcccagaactcgggaggcagaagcaggtggatttctgagtttgaggccagcctggtctacagagtgagttccaggacagccagggctacacagagaaaccctgtctcgaaacaggcccccccccccccaaaggagaaaacaagctttaaaaaaaaaaaaagaatctcaatttattttttcaataaaaaatactaaacaggtcaattaattacattctcaatggaatctatgaactactctttcaaaatagtttatttctacagtttattattaaattttgaagaaaataaagctgttggtcttttgctaggacagtctcagctagctactaacttttcctgactcctccaccatcccatgtatccacgtggctctcaccactgccagctccgcccacctcctgcttccttcagcatcagtgtcagtgagctcaggaattccacccttacttcctgccccagctctggtaacactgtagggacatttttgcagtaacacgtgtacggaaagtgtagtatgcacaaattagctaatgaggagtctctgctctatgcttgagcagtaaaattaatctgtaaatctttgtaagtctgtttggactgcataaccaaaccgtaatagggctttataaatcctcattcatgccacatgaaaggatgacatgtaataatactaagtcctgaggacctgacagccaacaagactgctggcttctacaaggacactcatgtctccgacagtctcctgagctgttcctgcacagggggaccagcattacagtcacctgtttttttgttcttctgggtctctttttccacatcaccagtcaagattctctagaagtcttccatggtcatacacaagtcttccatggtcatacctaatcttaattaactttgaatgagtccacagcttttcatttcctgtagaaataaaagtatagccttttatgcaatgcaacagcttttctgacttccattctgagattagcacagccttaaagtacatagactgattttattcaagtcctatctaaaatctagtggttttcagcagctgtgctacctatctcattgacattaaaaacaaatgaaattaataaagcattataatctatctttgggtgatctcatgtcccccgttctattttataaacatctttaaagtgaagttaggtctttccataactgcttgacctacaggatgtaaaggtatgcctgtaacatgttttatgctagattttattggatacatattatggagcattatcagttttagtccatgaaggtatccctaagatagccatcacttctaataaatatgtaattacaaaatcagcctttttagaacttaaggcagaggcccattaaaatcctgaaaaagtatttttcaaactctataaaatgaaattcctgtcaaatttcatttccttaggtacctttggggttactcccagcaggcaatggagcttgattacacaaagaacaagcaggacaattatttctaatttccttggcttgtcaccaggttacagaaaagtttttctttaaacttctactacttatataatgccttttataaaaacctgaagtttctaatacatttcctattaataactagtctacagatttcttggtgccaacggtcctggcaaacccatatgagactgagcatggattatatataatggacagtctgtttccaatcacctgttgtagttgtataaaaaacaaagttaactctgaatcatctggattaagttcagcagtttatatatactaaacaagtattgacagtaagtgactatgttaagtgattctggaaaatctaatagagccatgagagttgcgtatagttttgatatctttacttccatctcctgacttataatccaccattcctaacttactggcatctagataaaaggtagggggtttagaaactggtgttcctcttactgtactcagaaggatccaattagttctttttataatctgaagttgcttgctttttgaggtatttgttattaatttctatcaaaaaaaactaatatacagtctttgccaatctttactgattacccatgaggtaatttcggcattagtatatgacattataatctctgctgggtctgttactaattgaacaaatcttattctttacaatcattcagaaatcttttctatataggttttaaactttttattgtttatgtgctaaaaatatctactttaagatattaacttctctctgcagacgtaagaattcctgtgggagaatgagcagaaggcaaaataaccgatttaaaagatcctctaatttctggtctaccacttataacctagcattccacatcgggactctccttatctacattggcttcctgttaatgtgagggacaaggacaaagagatttcctttcttctgatctttcttagagagagtacaataaagtgtgattgttacagaacctattgtaactagctcaatgatgacaactaaaaccaaaccattagttctggtggcctctgtaagccatattacctccaaagtgctggatgataggtttgcattaccaggcccctctgatctattcttgggttttctcaatcttcttattatgtgtacagtgagcacatgtgagcacacagggcactgaagcccagagacggatgatgtcatgtgtcttcctgtatcacttgccattcttttttagaacatgtttccctaatactattaagctcattgacaggtcacaccgggtggccaatgaggtccaagggagccttctgcctctgctcaccaaggaatggaggtacaggcatgccttgcatccagctttgtatatgcatagtggggagtcgaactaagggcctcattatgggtcagcaagacttatacccactaagccatatccttagcctaaaatctatatactattaacaattaaaaatcagataaattgtaatattaaaaattggaagaccaagataagatgtttaaacattttcagaaaagaattgctgttagatgtagtacattatcttattatttcatttactttatatacaaatacacatataattcatgtttatacacatacaaagtacaaaatgattaagagtgattcaaaatagtttgccttttgcaaacagtctcaaactagagaagagccaaatgattatcaaagcagtagggtgacaattttatgtaaattgtcctataaggctagcaaagtcctgctgggatctactcatgggaggctttaaagaagactccaaggacttgtttttagtaacctgaaatgtcactttctgtgtagcaaaatgttgcaatgtagtaatgcctcaactgccaaaatacaaaataaaatcttttgagaaactactaagtttccaatatgtatagcttgaagatttgacagttctgccatgtgcagaagggctaagacctgcaggcctcactagatgggaagccgaggtaggagacttagcgccttgagttctgggccagcctagggaacaggaggaggaagaagcaactccatctgtacacatacatacacaagaacaaatacatacacacggcacacacaactgcagaaggctttttcattctctcttctgaaaatctattccaaacaagagccagggatgtcaaataaaaccaagaagcctcaaaatgttagccacggatgttagtttttaggcatagcattttgtaaaatcacagaaaaacaaataggaaagctctctagaattaagatggatggggctaagagtagtagttcactggaggtcacctgcctgtcatgctgcccaagggtctgcattcatttgcagcaaaccaaagcttaaatcatgattcatctatcccagatagccatggaatgtgctttagaaactacttctgagggccctaatgtttttctcaggaaaaaaaaaaaaggtaacaaaatgaacacatctgcattttttctcacatctgcattttttctcacatctgtatctttagaagaaaagtcacttaaaaacacagtctcaatcccatgaacacagaataaactttattatctattttggtggagagactgtaagagatttttatttttcattacttttcaaatgcacactggcatatatataaaacttgatagtggaatgatatgtgggcgattaccaccagggagaatcagcagtatacatataattttcttttttctttctttctttcttttttttttttttttggtttttgtttttttccagatagggtttctctgtgtagccctggctgttctggaactcactctatagatcaggctggcctcaaactcaaaaatttacctgcctttgcttcccaagtgctagaattaaaggtgtgcgccactactgcctggctaattttcttaaaaaataaaactacaacagaaagccaaaattcttcctgcctaaatactcactaatcagacctttctcaagagacttttaaatcagagtggtgaacaaaatcaagaaaatgttaagattctgacttaagacactgagtgttaaaaagtctaagaatcaaagctgggtgggcatggtgtgctgtggagctgaagcagggacggcagttcaaggtcatgagcttggactaccaaaatcctgtctccaaaaaccagagtccagaaaggaggagcccagaatgggtgagcttgaatattagggatgctttttatctgtggctttctctagggtataacatcaggaagctaattaaaccgactcatttgaaagcttgaactaacaaaacatcttcaacaaccagtcacgtagcctagtatttggctctagtctacagaaaatctcagcacacacctgtcccaagtcacaagatttcaaaagacacaggactcacctctgtgatactttgggttgtcatggaggtgtctgttgtcttcagcacaactctagaaaaacaaacaaaaatcctcaactgtttactcaaccattttctagttttgtgcatcaccaaaactaagcagattttaaaaagatagacatgacttagtaaaactaccaaaatacacttcacaatcttaacaaattttgaaaaaacaaaaacaacaaatattaactagttgatatggcgttagttcagacgtactcaactgtgcaatttactggggttaacatttcacattttaatttagggcataagctgttgcccaattgttaagttttgtgtcatttaacaagacaatgtgctgacgacagaatccatgtctatctggtccagaaaaccctttcatctaagaaactgtcgttccttcctgaagcattaatactttcttcgaaaaaatagtatagtattcgcctcatgcagtgacaagagtcgcttgtctaaggtcatagtggcagcagcgtctgtcctggcaggcacattcctcagcattccgaaagccggggcttccacgtttcctccaagcttcacagttggaggaaataactcttcttccccacgcaagacgtttctagaaaccacacctcctccgtcttttaccaaggtggctgccaccttgggcccctggtgtctgcagaccgcaacccagcttccgaaatgcaatgtcaaagggagacagagctatgccgggaggaaggggggggggtgtcagtaaaatcccgccatcccgagtgaaggggcgcaaagggccgcttactcacctacacgtgcgcccccgacctcgcccccttcctccacgcccccccagccacgctccgccgccggcggacagcggctcccatggccgccctcgcttccggtgctcccagcgctgcgccacccccgaggccacccgacaccgggagcctccgacagacctctcggacgactccgtgactcctccacccttcgctaggcgttgtcctggagggaagggtaagccggtgccacactgaaataaacctacccgagagagtccgcgtccttccctccagacacagaaaatgggatagagctgcgggctgctgctgccgggacaaaatggcgccggggaaccggttaggcgcaggcgcctggggaagagccggctccgcccccgtgaaaaaccctggctgcagttctggattccgtttccatgggacacgccaccgcccaatcctcgtgcggaactgctcttcctgaccccttgttctccaatcagtgttcagtcaagcacatccggagtcggctcctccaatcaaatttttgggctctcttactcaatcctctatcctccaataacgtgcgtgttcg

SEQ ID NO: 20 - DNA, 11037 bp, Mus musculus
tttacatttaaattttttattttgggtgtctctggagtgactactggagaggggaaggagaggggagggggagaggggaggtcagagttggttcttttgctactgtgtgggttctgctattgaactcaggttggcaggcctggcaccatctctctggttctcctgaagtcttatgtagctggggctgaagagatggcttggtggttgatagtatcagaggaaacgagttcgagtcccagaaccaaaaaacggcagctcacaactcttaactccacttctaaggcatcggcggacacctgcagcaagcacacaggtggtagaagaaaataacagccatatacttacaaaatttttaaatcttatgttgctacataccacactatttaacaacatcgatatatgaactttcggtatattttgatatttcataccatcaagctaaggttttctcagatgcctgctacaggcactgagaaactgaagttagtgagcgacctacctcccttacagtattcataaatactgtttatcgttggaaaacacctgacgcctagttagttaactttctggaacaaacacaccctaaggatcaaggtgttcctaggccttggtgttgtgtatatgtttttgaaccgtgtgatgttcatctctgtgcttgcttaaggttcagttgtaacttgttagccttagggtgtcaacccagttagggcgcgcgggggtgggggctgggggtgttgtttatgaacagcggtgaacaggcatgcaatcgctttttacttctccatcttaatctcagggctatatcatctttattttcctgcgcaaggaaggagatagatagtctcctaataattctgcccaaatatggaaggagtttaggactcaatgacaaggctccggcgcggggtgggggtgggggtgggagtgggtgggtgggtggggaatagagtagggggcgaagggggagggggttgcaggtaatccttcacacaagagtttctttgcacacttaagagttatttctctagtcagctcctgaggcatctctcagcaaggtttgccagataactaagtgaaactaacacagctccagcgccggtgaaattgaaacaggcttagggacatgcatttcatttagtgaatttggagagaggacagaggggggaaaagaatgacaggaactcgaaaacaaagtaaggagtgaggttctttttcttcctttttctttctttcttttattttatttttttggtttgtccacctcttgtttcctggagaaacaaggacgggggagccatcagtgtgaaagtaaacacctcacaaagctgcagtgaggaacaagggaacatatacaaaatgttccccaacttcacaggtacactgaagagatgaggggataagcaacaggatgtggacactcccttactgcttccgctccagagaacagaatagaatgtaatgggcgaggaacagtagcagcacataggggcatgaaatgagggggaaatgaggggaacccaccagagcattcaccagaaaggactgaaagccagactttaaaatatctgacaagttctcgtctggagagaccgcagccttttattcttcaatagaagtgcaataggagcatatcgggtgggctctttctcactaacacgactgcactctcgccctccgctccatcctggagtatcctcggtgcgatgggattgtttttcacaagacttgcgaacttgtgagccaggaataaatggtcacctcgaaatgaattgcgctggctcaggcgagtcatgaaatcctctcctaagcacatttttctttcacctaaaaaaagaagggggaaaaaaaaaacaaagcacacacccaaataacccagctcccaagaggagtcccctggatgaggttcagggtcccggggtcccagcctcccggggggagggagggcacccgtcgccccgggccccgcccctcctgctggcaaggctgcgcacccgaacaacaaccattttccccgctaggagcacaccgtgtccacgcgccccggcggcctcgctgattggttggaggcctggtaaacaagggccaagtagccaatgggagaactgtgcacgagggctgcacgagcctccaggccagcactcgcgtggagcgccaagccaggcggctatataagccgtttccggcagccgcttgacactctcctcctctggtctcggggtttccagagtttctccagttgcggaagacagctgttatttttctcctgaaagcttttggcacagccggcaggctgaaacttccaggcaccttttggaaaagttgttagggtttgtttgaagctttctttacattttcgtttgggttttcaagccctgactttacggaggcgagctcttcgtttgctttgaagggttcttaaagatttttttcctctccggctttcgtttttcttgaacccactcggctcaatcatggtgatgttcaagaagatcaagtcttttgaggtggtcttcaacgaccccgagaaggtgtacggcagcggggagaaggtggccggacgggtaatagtggaagtgtgtgaagttacccgagtcaaagccgtcaggatcctggcttgcggcgtggccaaggtcctgtggatgcaagggtctcagcagtgcaaacagactttggactacttgcgctatgaagacacacttctcctagaagagcagcctacaggtactgctcccagcaggactgatggtgacttgggaggtctgtgggtcggggagggcaccactaaatgtttcgagttgttcgtttgaatggtttgaactgttggtccctatatttttttactttgtaattagcaagtttttcactacccttcacccccctagagtgatttgaacactttctgaggtactgtttcctgaaagtgttgtcttagctactacttaaagattaatgtatttgtggatttcgcaactttctgtccaagaaagtgctctgggatcttttcttccatagtgtaagagatgaaagtggaagtgaagtaaggtagtctactgcccaggcactcctcattgacgctttcaaaatgtaacaagaagcctaatggccccttgtctttgtttcccagcaggtgagaacgagatggtgatcatgaggcctggaaacaaatatgagtacaagttcggcttcgagcttcctcaagggtaggcatccaccgtgtgcaccttgcactcttatttctaagtcttccccctccattgatctcttacagttcttagccttaattttggttcattgttttgacacaggcccctgggaacatcctttaaaggaaaatatggttgcgtagactactgggtgaaggcttttctcgatcgccccagccagccaactcaagaggcaaagaaaaacttcgaagtgatggatctagtggatgtcaatacccctgacctaatggtgaggattttttgtttttgtttttaaaaaggttttaaaattcttcttggtcagggataataaattagatgcatgggggttgaaatatctcaaaacattatttccttttacacaggcaccagtgtctgccaaaaaggagaagaaagtttcctgcatgttcattcctgatggacgtgtgtcagtctctgctcgaattgacagaaaaggattctgtgaaggtaaaaacatactgcttcaaatgctagacaggatagccagaactgggggtgggggggttgggggtggtacggagagggtcgtagggtagaggcagaggaagtgctgttaacttgcatggctattcatacttcctcattttattttaactctaggtgatgacatctccatccatgctgactttgagaacacgtgttcccgaatcgtggtccccaaagcggctattgtggcccgacacacttaccttgccaatggccagaccaaagtgttcactcagaagctgtcctcagtcagaggcaatcacattatctcagggacttgcgcatcgtggcgtggcaagagcctcagagtgcagaagatcagaccatccatcctgggctgcaacatcctcaaagtcgaatactccttgctggtgagtgggtgagaagagagacaattacctggttacaaattcagtgctttctgtactcaacccatctaacaaactgccatcctcctctctagatctacgtcagtgtccctggctccaagaaagtcatccttgatctgcccctagtgattggcagcaggtctggtctgagcagccggacatccagcatggccagccggacgagctctgagatgagctggatagacctaaacatcccagataccccagaaggtaagctgcagccggataggttcgagttattttgatctgcttgggcttgtggagttggggtgacctggcatttatttcttagtcggacttctgacaccgttttctctcttcagctcctccttgctatatggacatcattcctgaagatcacagactagagagccccaccacccctctgctggacgatgtggacgactctcaagacagccctatctttatgtacgcccctgagttccagttcatgcccccacccacttacactgaggtgagaactgctattctcacagggtcaacattttgtcctaggccttttgaaggaagggttaatgtgggttttctacttaactaaaaaacctgaaaatttcctctctattccccttccaggtggatccgtgcgtccttaacaacaacaacaacaacaacaacgtgcagtgagcctgcaggaaatgaagcatctgtattagcgcatttctttctgcctctctgcttgaactccagtgtttcagagactcagtctctacagcggggaacgggtacaccccagccgctgactcctcaagatgggtggcaatcagtaggcgggtctccggcttcaagtggtgcagaccagtgcccgcactgtggcataggagtgtttgctgggtggatgtcagaacactcttagaaaaattgagacctgaccactttctcggatgttggaaatgaagaacttgtttgtgttgactgagtcagggcactgctgaccttctggcgttgtctttccaaggtttttgttttaaagggacttttaaattgtctaaaatatcagtagaccatcatctgtgccatgggggacagagccaatttcaagtcatggccaaaattttgtaagaggagtgtttttgtgtgttttttaaagtcagtgttccttttttatatctttacaaagaaaagaccttccacggctggtgagcacgcagcctgtgaaattcggggcagctgctccaagttgacttcaccctgggagcagtagtagctgtgcccactgacggccataaaagccattttacagccagttgcactgtgttctcttgtaagcataatcagatgggagaatctgttatttccctgtaaccccttggaattgattctaaggtgatgttcttagcactttagcttgtcaattttgttttagtctccgttatagatgtaagctccaccagtctcttaaggattaagcccagtgacttggagggtgggggttagggtctctatccctgaacattgtagacccaggctggcctgagagatccacctgcctctgcctcctgagtgctgcgatcaaaggcccagcttggttattgcttttgaggctttctcccaacgcacagacttgtgtaattctaacactaatcctgtgaagggttgtggttgacagctggagcctgggtgacattctacattgagatgccccagcactgatcggggcacagaagcccccagaccccatttcctgtccagtgttgggagaaagtgctgctttcactgtggcctcagccctggctcggaagctcactaagccttagcactttgtcctgtgtcagctccacctgagaactgtgcagccagaatgtctgcgagctgatggaggtttcggttttgttgtttttgtattttgtgtatctttttgtatgattaaaaactatattttctacttatccaaatatattttcaccccaaagtggggttatcctttgtaaaaaaaaataaagttttttaatgacaaaaataaatgttcttttcttgtctatgagatactggagaagttactagaaagtgttcccctgtctcaatactgaaagcccgtggagagagaagtctcttgacgctgagtgacataacggctggtttggcctctgttcagacggaggaatccgtagggtctggtagtagaagctaattaaccacgtccatagtcagaaaactccttcaggatcaggcttgctcctgggactgaggatagccttgaacctctggtgcagccatcaagagcacgcagtgtcatgctcaggttttcatagtttgtgtgtgtgaatgcaggtgggaatgtggtgcttagaacccaccttgcaaaagtcagctccactttgtgggaccctgagaccaggacctcaggcttcgcagaaagcgtcttttactgctgagccatctctgagcccagttctctgccctgtttatgaattctttaaaaataactaaggggatttggaagggacagggtgagatttttatttttgttaaatccaaatgagcagcttttgtttacacaaacgcagggaggatgtggggaaaagggactgggagattaatgtgagggaaattaaatgggtgtttgctcagatgggaggcaggaagcagtcctggtgtgctccggtggatctgatgttccctaaagctcagcagacagtccagagtgagaatgggttctgactggcagaggcctcagcccaccctaccccaaaacaggatgactggtggcaatggagtttttggtttggtttgagacaagttcaggctagccttaacctggaagcaatctggctcagcctcccgagcactggggttagaagaccacggtctcattcatcacttggtttttattgagaattcccccaatataaacttggtttataagctgcaaagaggaactatttcagacttggttttagttacagggattaaatgttttagaagcagctacagttttctgtctttatagattattgtgttttttgagacagggtttctctgtagtcctgctctgtagatcaggctaaccccaaactcagagatccactttcctctgtcccccgaatgctgggattagcgtttaccaccacagcctgactctttacagttctcaacgtataattagaattcagtgtctaccctgattccttgggacctgttttggaattttctatttcttagaagggtattgatgactgataaaccatttcactgctaactgaagttattttgttcaggaaaaagctacacacatgagaaacaaagatggcagaatacatcacaccattctttctggtttttggttcatctaaatgtttttcgtcaaaatgggttttccatagctctccacacaccagtacactctctgaagcactgtattagaaaccaaggggaggctcgctgtggtcatgcacacctaaaacccagcatttgagaggcaaaagcaggaggattgccaagaattcaagacagccttggccacaggtaccgccaggtctgctagggctacagagcaagcacttttatcccccaaacaaaccacaaaaccacacatcacacaaaaaaagctgtgaacacagaactgaacagaaattgaaaaaaaaagaaatccttttctgcgctagtaattgatctttatcattcattcgctatagcgcacctgtcactttcctgcctcactggcgcacgcctttaatcccagcactcgggaggcagaggcaggcagatttctaaggtcaaggccagcctggtctacaaagtgagttccaggacagccagggctacacagagaaaccctgtctcaaaaaaacaaaaacaaacaaacaaaaaataaaataaacaataaaacataaataaataaaaagaacaatcatttgtgtctgtataccacagtgcccaggaggtcagaggacttctgtagacacaggtcaccaagctcacagcctgtgcctttatccaagccaggtgacatttttccttctttgtcttttgatactgggtttcatttagtctaggctgtgtcttcagggtgaccttgaatttctggccctctggccccaccttcctagcactggattcataggcattcgagtgtttccacgctcactttatgcactgctggaggctgaaatcgggctcggtctacactgggcaaacactttgccaactgatctgcatcttagattcatgagatccttttgtctgtttacagtgtgctggtacctacctctccccattgctgtgaaaactctcacctgaagtcctcccccatttctcacctgttcaaacatttagtagcccctcccctttaatgctgcgatcaggaaactaggtcaaagttgacggaaaagttttttatgcagctgggtttccagggacttgagggttggagcagggacaagaatgagaaagagggccaggctaagggatggagagaccaggaaggtctgcatctttgtgtacacagacttgttatgagaactgagtggccagggaaggacagataacaacacccaaggccactcaagagatttgatcctgcaagaggcagaacatatgccccctctcctggtatcccagccccagccccagccctaccacatctagcactatcgacaagattttatttcctttccgagactggtctctctctgtcacccaagctggcctggacctcactctgcacggggggccccaagctctgagcactgggtttataggtgtcactcagcacacctggactaaggcgttttctgtgacaacagacattctgtgtgaaccttgtgctgtggagccatcaaactgtgactgaaaaatggcatttttagttctgtttaattaatctagacttatacagcactgtgtcacgagtcatcgccatatcgtgcctcgcagctaactctgaggaaggaagttgccggatctgctccccaaaaggaaacccatccctcctgagggcacagcaggctgccctccacttccttttgccttctctgcacaatctgtctcaccctgggacatttcctgcctgaaggctcattttgtgccacttccccgttgctgggcagctctttccccatttaacactgggtctcattttcccgtgctcttctcaaatggctttcaatttttaaagaacaacaacccccacgtaccaccgcctttagtagagatctagttctgagtattatttatttattcattaggtccagtctagtacgggaagagctgagaaaagtcaaaaagaaatagtgagaagtggcggggggggggggggggagaaagctggggggaacaccctaaagaaaattaagttaagagaagggcctggtggcctgtcaccccatatatgggagactgaggcaaacaggtcaagagttcaagccagcttggggtacacagaaagcttttgttattaagactagaggtggagcccggcagcagtggcgcatgcctttaatcccagcactccagaggcagaggcaggagaatttctgtgagttagaggctggcctggtctacacagtgagttctaggacagccagagatacaaagaaaaactgtcttgaaacaaacaaacaacaacaaccaaaacaaaacaaaaagactagagacacagctccgttgggagagtgtctaaaatgcataaagccaaagccttgaatttgaaccttagcagcatattaaaaaaaaaaaaatgcctggtggtaaacaccagtaatccccaaatttaggaggcagaggcaggaagatcacagaagttcaaacgttcaagccatatatatctatgtagtgagtctaggccagcctgggatacatgagaccctgcctcaaaaaagcagacagtagatcaggaaatccaggccatcctcagggtcacagtagtgactttgaggccaaggtgggctccaaaaacagcagctacaggtagttacttaaaaacaaacacgcaaacaaaaagccaaggggcttctctaaacgtaaagaaaatgaaaggatccaactagagttgggacattgagagagaaaattgtggagagaagatgaaactaagcatatggccagcaggaactaatcacacatgaagacctttgactctctgactctctctctctttctctctctctgtctcgtgtgtgtgtgtgtgtgtgtgtgtgtgtgtgtgtgtgtgtgtgtgtgtacacgcactctcactttgggtgttgttgctttgacttcgtgcacattttgtttgtttgtttttgagataggatatctcagagttcgaagttccctagtggggctacattgtctggccaggcatccccagcgcccccccccccttgtctgctcttctccaccactgggattataaacattagctactatgttctgcattttaaataggtttgggctcctactcagacccttgttcttgtgtggcaaacatgttactgagtgagccagctcccagccttcctttgactaattttttttgagcagtccacagagtcctgctagagtatttttttcttgaatcacctctaagtgagaacacagaagggagataaagcgcacgtttaactgactctcctgttctaagcaccctgacaggagaagacctcctatccacagtactttggaggttgaaacaacctttcagagacagccacagattcagggttgcaggccttggctcactaggtgatggctctagagcctggaaaagcgccgtgattagccttcccgtagagttctgccttgctttctctattttgctgtgataagcaccatgaccaaaagcaactcagggagaaaagggttttattcggcttacatgtccggatcacagtccatcagtgagggaaggcaagggcaggaacctggaggcaggagctgatgcagaggccatggaggggtgctgcttatcggcttgctcc

SEQ ID NO: 21 - DNA, 57765 bp, Mus musculus
tcactgcccctcagggggcagggggctggtgattcctgagggagccctgcccccttccagggtgaattttcctaagtcaccatggagaaccagcagcccagaatcagtgccctgccaggcaggtaagcccatctctcttgtactttgttcttttaagggtaaggggcttcctagaggagtggaggtcacacagccttaataagctggcatccttgtctctctgtgtgtaactaaggaagacttagttacctgcagagaggatgctgatcatcatgatgcccctgatggggactagaggcacagggagagcagaataatgcccttttaggagggagaagatcttagaaccctaactatagctactaaccccctcggtaagatcagggaagcaatgccccggtaaatctgaaatagaaaagcgacaatacctggtggagagggagagtccttgccccttgcaaaggtggctgtttgaggatcttaatcctctggactcatttataaggccttctcaggattttggaattcagaggaaaacaaaggaaaagagccaaacaggaaagcagcgttgggaaagttgccccctccctgtccccccaccctcccacccagggtgggtggtgttttcctgaggcaactttagcttttttatggggatgtcttcaggctgtttcgacctggaagtaaccctaaactgcagggcaagcacagggagtgtccatctgaatattgctttttatttttttaaaaaaatcatatacattatatatgtcataaaaatattttgcatttgtgaaatccttgcctgttccccaaggtcttcgcaggtacaggagcccactccacaaatcgtgtgggctaaagagctgaacctcaagtgattacagaccagccataaaggcaacacagtgcttaatgctcctcaggttttattttcccctgcctaaagtcatggcaggagactagtctgcatttcttcagagaagacagttacccagtaaatgaaacagcagctttgcaacggcagaaaaaggtggatgagtcttcagactgctgagtttagaaagggttaattttttttttggttctgagggtctctgagcatcaagtgcttctctgaagacgtgggtgtaatcatattatctttgtcacacactcagccctatgcgcagtctgagatcctgacagcccctgacagctgcagagggactcactagctaggtctgaagctcaggatgcaagccagacttggggtaccttgaagagaaaggggtcttctgaggagtccagtgtgcagtgcgctacttggatgatttagtgatgctgatgccaggaccctctgcgttagaccctgaaggtacacagtaatagtgtgggttgctcaagagtcaagctgtcagggcacgtagcatggcctcggctcgttaccagcaagcaggctgcacagttgagacacataccacttctgtgtttatttctctagaggaccgtgtcccctgtgccagcatctatctcaagtcacattcccctggagttcccattccatacagctaatcccctagaacacgggccagcgcattagctttctgggcctcttaaggaccaaagaggaaaatgttcccccatgggtacattgcagacgttgagggtcggattggaagtgaaatcacagcctaggctcacacctgctagctgcatgtcactgacaggctgagcggactgcggcgtcagcgcagaagcacagaaaataaaaattaaatttaaaaaaaaaaaaaaaggaagagaaaaaaatataaaccttgactccccttttgagtccctttgtgctgagaatttgttttgggcacccacaactttaatcgaatttgttttttgattattccctttgcttgtttatttgtttgtttgtttgttgtttggccagtaaaatcctccaaaagaataaacaacaaccataacaaagagccattaaaaaaaaaaccccatgcaaaatatttattgtaattgtacagcaaaagtactgctaattaatttggtggttggtaaaagtccatgtggttgtaggactgagcccctccctcatctatagccccctcctcaatttagctgctgtggtcctcctgggctcctgcatttttctgtacatttgcacacctctataaacacacctttccagagtccctgactttttttctttcgtgcggaggctgtttcagagctagcgttcttcctttagcattttgtatcagcttgttttcctcccctccagaattgcttggccataacaaagatccattgcctttctgatgacacccagcacctcggattctgtatacacgggaggtgatttaagcatcttactgccaccctgaaatctggggtcctttatcctggcaggtgtaagtaattgctgagtgccttggatctggggagagagctcccgagcccttatgacattattacaaatgaatatatgaatgcatacgttagcggaatgaaaggcactgtgcctcggaccaacgatgggaaactgtcttggaacaaaagatcatgattaatctggtccattgtaaaatccagacgtccattaaaagacaataggtttgcgcatttccctctttttaagagctgtttaatattccggtgtacgtatgcaacaccctgttctgttattgaaaatgccagctgtcctgttcccttcctggagagtgcgtgcagatagaagcctggtgaacatccttctcatcagggcaggtcagggttcctgtttgttcaatatggtatttaaaaaataaaaccataaatacatccataaaagtgttctctgcaaggatcagcgaggagggcacaccacacacacccacattttaattaatgtgatccagctcaactgatggccgattaaagagagctaagctgttttcattttatgccattgctgatggcaccacagagaacattctggtagctagcctggtgaacacatccctctgtttatcccagccccttagcggtgggctagctgagtaaatggtttgcacagatttgttttcactgagaaatctttctaaaataccagtttgctcccgtgtagccttctagccctttcgctgacttcccagagcttctgggattaagtccaaggggaaaggaaaaaagcctgatacaaaagtccggtgttcaacggcttgtaccctcctaatactccccaccccacgcctttccccccactggacacactgtgcttaagctgaagaataagcttgacacccatctcctgatagcacccccatagttaggcgtgtgccccaccctgtgtccaaaatttcccagtccatggtcttgaactgcaatgccttgcttataggatttcctattctaaggctattccccctgtcccccctccccgcccagtgtaattaacaaaatgggtcagaggttaatcaccatgttcttttgccccttccagaagacccttttgtgttttcccgacacttacttcggagaccgcccctctaagcagagggccatgtcgcctgctgcgtgttgctggtgagtctgcatatcgccgtaatactacacatggaatgacacactcctgtgcacacacctgtacacacatgcacctcatagttgtgattaattttacaatgtgactataatctctcagcttgctccttgccctctcgtcccaggatacaggatagggaaagagctgtgacaaatcagttataaaacatacaggtctgagagtggacatttgtgtctttgagtcggccttgcctctagggtcaaaggacgtggcatgtgtgtgtagggtgagatggcgtcggtaccctttcctttttagtgtgggagtaggcttgtcaatcataagtagccatcttaactcccatccagatactgcatggtctctagctgtgtgtccttaggtagcccaggagtgtctctgtgttttggttccttcctttcatttttctttaaaaatccagaatctctcacacaggcccattgagatgtctctgagaaaaataactcatataagtcatctggcataggaacacaggcagggtactcagtaaaatccaagcttccctagcccagcccaacccagcctggcccagcccggcgcgacccgacccagcccagcccagccaggtaccacccattccctccctcttcaaggcagctctgccttttcagagaacatgactgacagacgcaaaacaaaaagcctccaggatgaataacgcccccggctcccctacccaagccctgaccccttttagaccctcccaaggtacccctgttcttcctcaaacgcctgggggtcggcccagctaccctactgcttttaattgggttcccctgtaatttggtagggagtgaatcttattttcatataaataaataaaagaaatcagattgcgcacaggaagcatttagaggctcttatttcactgccttcagcatgaatgactcccgagaaatagtgggggtggtctccagatgacccccagaaagcttagctgctcagtggtacagaaacgcctggcctgactcactaagccgtctgtgtgctgtgcgttcaggggaagtgcaacttgcctgtcgccccttacacagaagggaccctccttgtttgcctgcacaaaggcgcctctctctctctctcttcaatgttttctttcttcactggtcaggcagatggttcctccatgtgcgaccctgccacagaaacccatttctcaactccctcaagcctgtatttcatcccctgccttgagcaacaggagttatcagaggtggagtgttccctcccttcccagcaggggctaaagggcttgctgccctgtgaccccagctcctgggctggactttgggtggctttccaaattcacagggaatccaatctgagcccggcagggtcttcagtcacctttaaccagaaatatttaatcacaaacctgtgagagtgtgtgtcaacgcacttgtgcatgcaagcacgtgcacacacacatacacacacacacgctgggccccctggaccctctccccacataaaaacagcaaggttagtgacacgtatgattgtcacattgccaaatgtcaaatgcccacatccagagctctcaacaaatcctttaatcacaaaacaacatcacaacagcaccagcaataaaaccacccaaacgccaaagctctgggggtccaggctgcctccccagcaaccttaacccagaagcagccaggcaatcttgtggacactggctctctgacctgcaacacgatgctgcccccacttggcgggtcagagcagccgaccgaccttgaggcccccagatcctgttgtcaagaactggacagtcacaggcagaaaccaggggaacttttctcaaacaattctatcattagcatttcctttcctgccgttttggagatattttttctccattgggatatgcccttctcaaggcttcatcaggtcaggtcatcctgattatttcatagacaagaaaccccagccaccttcacagctggcccctgaaagtacacactcacacatactccacatatactgagtacaagcccaggagcaatgacaagagtctcccatagaaactacacagcacaggtgtgtctggttgaggggtatatctgctaaaagcccccagtgaaacccccattaataggctagcatttcagccacagccatcagtgcccaggctcctgagtcttcccactaggtagggtgcttttccaagcctcccaccctattcaggtcatgcagccctctgactctgtggctagcatctagcctccagaaaagtagcctgctttttctatgaccagctgatacctcaaccagacagaccctttttctatgccccccacccactttaccagactgttaccttacagatgattcaggctagcactcctgaaatcagccagagaagactcttagctgctccagctggccctcccttaaggaggagttggacagctcccaccaacccccactctcccaaagcactctcccccaatcacagtgcttctccctcagtgcctcagtggtactacgctaccaatcagggtgccattgccatttaacctctggtgagggtcacggcaaaggccacccatccttgtcctgacccctgccaggtaccctccagccagccccacttgttggctcccgactgggcactggggctgcttctcaaaagcctgtccctttgggctgctagccagctagagaaacctgctgcagcttccccatcacctaccggcctgcctctctgctcgggtgcctccagtagcagtgagctctctctccccagccgcttgcttgggggctcacgtactgagacgctcctctcagccctcccctgtcttttacatcagcctccgcagctccaacagcagcctgcttatgtctcggccctcaggtctttagaggaggcaagctccctctcttcagggtcctctctgtgctgtcgtcaatagcaaaacccccacccaccctgagaataaatttggggcctcttccacctgtctgggggtgcttctcctatgctctcttgccattggttactgagccttttgccctgctgttcttccagcagcccaggggagggcgtggtgctccccttaggggagggggggcagctgctctgtctctagctcttaatcagctctgagaccctctctccctctctctctctctctctctgtctctctgccccttcaccagttgctagggagaagcctctgaatgcaaagccccctgttttctatttttttttctttttcctgactgagcagtggctgcctggccagctccgtttgacctgcagaagtgggagctacaagagcagctgcagtagagccagggggctctcaagctgcacagctaagcttgactctccctctgtagccgtgaggccacacaattccctttagttttcagagtctcgggctttccctgtgaaatgaagatgagagtttttctctcaccggcttgaagtgaggactgaagcagatgagagtagcttagcctccaccagacactttataaacgctcgtggagtcgccagtgggatccaggaggagggtgacatgtaacaagtgtcataagagagacaacagtctggcttttcaaagctccatgctgcatacacgctacaacatctcctggcagagtcccctctgcaggcttaatcacacaaatcaagccagcccggaggcagctcttagcctgaggaactcacaggagatgtgggagatgtggcaggcagcagaaagccctgcagagcccacatctgcatttactagcatttgcatggtttataacaagcatttgggtttataaagcagagagacacatacagagatattccttccctgtctctcccttgaagtgacagctaagataaggaggcagcatgcttagggcatggtatagcctctgggaaatggctaactctccactcattcacaccagacactgcaacactcttacctcctagatcactagggtgaggttagggttaaaatgatgatgtcagttggccggtcggccgatcgctcggtctgtcagtcagtcggtcggtcgatcggtcggtcggtcagtcggcttcctgtcttcgaactgcaatcattcttatgagaaaacaaacaggaaatactttgccacacaccaatgcaatcagggtgggtgatggcagtcgggattcaagtcaccctagttgaagccctgagctgggtgggctgtctgtccagaactcacatgggaaatttcacaaagaggaaaagtctcatgatctccattggattggtgaagacaccatggcacagaaaagcaaagaagtccaatactcacagtctcccagctggtgtgaggttgggccaggatgaaacccaaggctctccgaggctccccaccacaccctgctgctgaagactgcctagcaaggctgtgccgagtggtgtgggtgggcaaaggatggattgactagttataagcacctcccagaagtccttgagatctcagctattttgtggcccaatccctttgaagggcagggtcaaaattaggtgtaggcacctacctattagcggaggcttatgaaaatgacattattaacctgatgcagagagggccctattcatctgtaattaaattataaatagagttagtggggggctagggtctctgtgtattgactgcagtctagagtgctcagaattttccagggctctggtgaacttttcgatgaaaagtgtcacctctgagcatctggggcttaaagctgggaacagagacctcctaaggcaagcccctcacactagggatgtgccctatactgacccctttatggtgggagagcccccgaccacctcctcaaacacaaacttagaccctgaccttcctctcatctcaagttgccatctgtgagagagaaatggaaactgaaccttctgagagacaatcccattcctgtgtgataagagaggggaaccaaacatccttcaaagagacagccttctcccagaaactttcctggttattgctacggttgccagacacctgtctgcttgtcagagctgtattcaacaggataactctggcaacttcccttccttcagagggagatgtggatggggatagaggagtggagaggggactcttaaaaaggagcagaaagcagagttctgcatccgatagaagttgggccacttaagatttgtgccaactcacggtgcagtggaaatggtctgaaatctttaaacagcagccaagagtctgtggcgcccccaagtgccacaagggggctgcctgggctacagtttttgcgttcccaaatgaggaggggggagacacgaagagggacctacgctttggatttctgcggcagcgcttttaattgcagcagatgcagaggacgcaggcaggcaggcgggcgggcgggcgggcgggcgggcaggcgggcgggcggggggcgacagtgtcccgggtggcttcaggctgcacctctcccacagagactgtgctgcagtgcagcaggagctgcggcgggcgagtggctgagggtcggagctgtccagtgtctgctttccaaagtgaggaatgaaagatgaaggagagggcttgcaggcagtgcgaagtggccaggagcccaggaaacccaagggaagagtgaagaagagcctgtggtttttgcaggagggccagaaaagtgtgggctctgggaacgatggagagtcataaggggttagtggaccagcaggtcttggggtctcaaggtgagtcagtttgctgtcctgtgactgagcgcaaactcaggcggggggctgagagcagccgaggcggggcggctgcaaacagcgatagggggaaaagcatcaattcttacctttcgagcaaggcttaattaaaaaaaagaaagagagaaagaaagaaaaaaaacgaaaactagacagtgtgactgagccagttactcgatgtgtgtgacaggtgacagtgctgttctcttaactaaattggcacagtgtcccagcagaaagatacgcaggttgctggttttgccctaaggagagatgctgctgcggggtctttgcagctcagtggggagggtctggcggtgctagaggtcccatcagggagtagatggtgtgaatctggtgggtgtctgtttctagagtgccccccaacactttcccttcagtccacccagtttgcagggagtgtttcttcggtcccgtgctgtttcagatccttgtaaaccagcctcaggatgctgtgtttcctttattgagtacccaaagccccctccgagctgttaagcgtttctctggacgccgtcggcacctctgcactccatttttcacttgttgattaaaaagaaagtcagattttattatgcttttttttccccagacaccacaaacggataaaacaatgtgttcttaaacagcacagttttaacctgtatttcatcttccagatgtagtgcccatcaaattcacacacacccctgcttcatgtgagccctggacacccccctcccctcccactgttaaagtcctcatcttttgcactggtttgaagctaattctagagatcatattgtctcttctgtgtatctcagaatatttatctctaagcaaagccgttttccttaataaaaacataaagatatccattgccacaatctgtaaaataaaaatacgtgggatgccattaccacaattaagaaattaacagcttttcctttctgccatctaacctctatgcagtgtccaaatctgcctgatgaactcataaattacttttatgattggcttattcagatttctgtccaaagtgcttcctgcactttcaaggggactgtgggggttctctaaggtaagtacagcctgaaacgcagggctttataccaaatacaatctcagtgagcctcggtttttctccctgaaaacggagccaattctcagagcctcccagggccaccaggcaaattagagacaggtacacacgcatcccccagcctcatttcaaacggaaagcagacaccggcagccaacagctgttacttgaattatctgtttttcccggaaacctctaaaggagttggactggatagacgagagagctggctatcgtccacaaaacaaaaggctcctggcaggccatggcccctgagtgatttagccacttgggagcaagggtcgcctgcactcctgggggctaggtccgggacccccacagggtgctggtccactagatggcactatctgctatgtgtccaggaccaggacagaccactccccaagatgctcaggccacagccgaaatatcccagcccaggtgattctaaaacatcattttccacatgctgtgcaaagtgcagcggcttttctccctgcatccctcccagcccagtagcagaaacgcagcgagtgaacatttcacaacaatttgctgagaccaaaacactattctgcccaccctccttttagttcccagcccggctacatctgattgctcattattttacagacaaggggatgagaaggggtcaagcatttttctcaagatcagctagttagcagaacccagggctgcagcccaggtttgtctaattcctttgcaaaatagagacagaggaaggatggagggtcgttctgatggatgggtttctgcgtgaggatgcatgagatgtgcagggaggcagctgtatggatgataaatgctggagagatggtatatggagaagcacaggtcagaaagcttccctgtgcatgggagacagacagatggatgaaataaagtaaataaacagtttctcaccaagatcaaaggcttcccggctcttccaagagtattttttcctagttaactgcttggggaacccttgccttctgctcactttctgactgtatcaattatctcaggtgtttctgagataacaggtgaccccttgacccggtcactaggacccagtcgcagctctggctctgcagcagctctctggcagctctccgtctctgctgctctcacgtgtgtgtgtgctgaggaacagcaggctgctgcctctccacagctctcctggatgactaagcccagagccctggcctcacgctcagccctcctcttgaacttcgtgttcttttattatgctagatcatcacagccaccctccatgatggtattttccactgtcaatcaaaagggggacgaagcagaggcttagagatgataaaagactgtccccaacgtcatccagggggctgatacagacccagcctgcttttttttttccgtctaaacccacactctgacagatttcctttcctctgtgaccatgcctggaaaaaaaaaatctgtgttccttaattctccctgctgtcaggggccccctttgggggctaaacttctcatccaatcaaattttagtttattttctaagcagcatcttctcaagtgcgttctatctgtaattatcacgcaagcaggggccacacgtactctggcatcctgagggaaaattgagctagttttcctgcattttctattctgactgaatgctaatgtagcaggtgtaaggaaaggctcctcagcccagaggggttgcaaggcaaggagagactctgagaatggcccctctgcacaactggcttagctttggcaggtagggtttgaaaaactgcatctggaggtgccaggatctgtcagggtttgtcaatgagctttctgcatgcacatcaacctgaatgcctcagtttacccaattttcgcatggaaatgcaaaaagcaccttttcattttgagacagggtcttgctgtttagccctggctgtcctggaactgggtagagcatcctggcctcaaagacacagagatccacctgcatctacttcctgggtgctgggaccaaaggcatgaatcccattgcctggccacaggaactggcatttaaagtgacttgaggggctgagagaatggtacagtttcctacttttccagaggacccaagttcagttccaaaacctcacctcaggctctaccagccccgtatagattctacaccctcttctcaattctctaactactgcaaatctacctaagtgcagtttaaaataacaaaaataaatgaggtgaactgaacccatataatccagaaaagaagcccgggatgtagttcagttggtagaatggctgcctagtattcataaagctctgagtttgcctcccagcaccatggaaaagtgggaggcagaagcaggagggagagatgttcaagttcacccttgactatgtagcaaattcaaagccagcttggggtacatgaaacgcttctgtccccaaaaggtatttttaaaagtaatcattttattttccatataattattataactactgagatggggcttaataccttccttaagactcctcacccacatggtgtatttacagcctggttctgcttcttccctgctgtgtgacgaccagcaagtcacttaacatctctgaggctcaatttgccaaagcataaattaggacttctcatcttcatccaaatctcaccacctgagtgaggctgtctccctggatagctgctctgccacagcccaggggccccccaatcctgaatgttactctgtcagcccataccttgcatttattcagtctgagtgttcttttttcctggctttccccacagggctggtcgtccttacaggattttcccttgttctcagcatctagacccgtaacgcccacttcagaatgggagggaggatgtctgctgccctgtcgtctccacacccgaggaatgtccgtgtgtgtgtgtgtgtggtgtgcacagcgggctgcacacagcgggctccacggtgctcggtacagtgtctgcattcagtaactattggctaattatgactaattgacaggactgttgtgggaacgaaaccgtgtgctgagcagtccgtgctgggtgcaggacaaacaatgcctgtggctgggggcccacagggggctcgttcgcttgacacctgagggcccccccaccccccccccccccccccgtcctgggagcagctcagagaactaactggcttggcttggttactgggagcctccttccacttagaggggagcaatatgcactgggagagtttcatggcagtatggggctgggggaagtgtaactcagttgagagtgcttgcttggcgttcaggaagcattgggttcgaaacccccagcactgtataatactgggtgctctgaaccttgcactcaagaggtggaagcaggaagggtcatgaattcaaaaccatcctcaggccagccaggtcttcaagagacctctaaagaaaaccaaagtaaaaccagtgatcctacagcacagactccctgcaatgtggttcagttttcagaagtgagtccctgtgggtggatccttttttttttttttttttttttttttaaaactatgatatcttgaccacaaaggaacagatcccggtaatgtctcggccaaggtcaggcatagagttcagagcatagagcgagtttgactgtctaatttttaggagacctgttgagcagataggtgtgtggggtgggtggagctgtgtgggtatgcaaagggtgggtgtggctttgaggatcagtcagtttgtcagtctatccttcagtctgcctggtccatcggttggtcggtcggtcggtcggtagtccttcagcctgttggacccaggaaggtgctgctgttctcagtcgacaaatcctacgagtccggggcctaagacggagagaccaggtcacgtctctgcagttacacagctcatgagtgcctgctggggtggaacctggtttgtctgtctgtctgtcaccatcgctcgggtgctgctgctgctgctgctgctgctgctactgcggggggcaaagatttgtgaaaggggcttagagttgctgtgggagggcttctgcctggctttgaggagaaggattatctttgctaagggatcagaggcgtggatgtttggtagatgggaacagagcacagagaggcttctcaattgatgtagatgtcacccagcaagttagaattaaaggctgagtttgggggtgggtatcattgtgtgggtatttttgtaggctatgctagcctcatgactgtgaccagacgtagaagtagccaatgtgtgtgaggacctggtttcgagtcctgtcaccaaatgtcaaatggacatgtcaagctgtatatcttcagcagaccatgggctcttgaaaagcctatttcaagaacacacatctgtctccatgctatgtgtataaaagcaggagggacaagccattgttaaaaacatttgtgtggccagcaggacagtggggtcaaaagggtgggggccatgcgtggttagtcctaagtggttcgaatactaattaataagacccggataaggcctgaggacaagtgtgggctgtgaaccatgagatgtgttaactcagtacaaggggctaacatggaaagagaactcagaggggaattgggctgctcatgttatattaaaaattagaaaagaacaagaaagactgtcctcatgccttggatccatcagccgtgagactttcaaataaagtcaaagagtgacccaggtctgctaacctgacatttatgagaaaacgggtccagcagccatttcctgccattctgtgccttcatgtggccactttggataggtagcaggcctgggaggtctcctttcaggaagtaataaggaatggtataaagttatgtataaaagaaattatgcatgatttaaattaattgtgcataaaattaaagagcctcataggtagacccgaagaggtattttttttctgtcctgttggtttaattgacaaataaaaatgtatgtatttaagctctgatgttttgtgcctagtaccccactctgtaatacttatgtgggaggagaatatcttggaccctccgtgttaattctcaatatacgtcactgttgactagaattgccactctgtacgtacattagccactgagaacttaatattcttgcgaatgcgagttgtattgtctgacccactcctgttcctcacacccactgacctctaccaactgcccttccactctgagtttgtgtgaagttattgagagaccaaccgcagccgtaggccgtgagtaagatggcccccgcgtgagcagaactgtcaggggtactgctctgtttgcctacttcaactgaatttggcctgcattaaaagaggaattaaatgagtcagtaaataatggccaggtgacaggatcccaggagtgggccactaaaaatgtttttttgaccaaaaggttaatttttattcgttgatgtataattgtagccttaaaaaacttctattttacctctatgtactaagatgtggtgagattcgaactaggctcatctgtgtttattgtatttaaaatgtatgaaaacactgggaagaccaaataggcaatgatgatgagattgtatctgtaatcaaagatggctgtgtctcttactctgtactgggtctgtttcaaaaagggtctgttgtttcctttgtggtcaggacatataggatcaatgtttataaaaaagaactgctttggggttgggggttttttggatagtgaatttgtacacattcattaaaatgataagaaatgataaatgaatgaatgaatttatgaatgaatgaatatgtgcttgggcctgtatgatgatcctagattaagataatctgccctgctcactaatggctttgaagcaagtgtttctacttcgtcctttttaaatatctgccttgtgttctacagaatggaggccctaatgtgaatggagactagcctgctggtagagaccttggcagtgaccgctgtgggcaatgagccatgggccaacaatgtgagtaatggctagttttgttattttgaacttgggtagttggctgatgggtgtttattgcattattaaacatgattgagtttgtaaataaaaccaaagatggccaaagccctagccagtgtggagactgtcatgaaccaagggtaattaatccaattaggcataataattaccgaattagaagtaatatagtaagctatttcgtatggggaaaatatcaaaggaaaagggaatttcttatgcttgggtgatagttcaattgttcatgtgcttgccttataagcaaatgggcctgcagttgatctggtggccatatataaaaaactggtcacggtggcattcttagagtctcagtcctaaggaggtagagacaggaagacctcttaggttctctggccagacagattaccctacatggtgtgttctaggcccatgataccgtatgtcacagatagtgcctaggggacaactttcaagtttgatctctggccttaatatgtatgtacacatacgcacctgcacagagtgagcacaccacccaaaagaagtatgcatatgcttatttgcatacacccatacggcatatgtgtgtcatatgttaagtgttgcatattcttttatcgttctcagggtggggtgtttatgcatcttcatgatatatttaaaatttgatgcccttataaaacaaaatgaatgggctaaagatgccatgacctatgcttctcatctagacatgtgcttatgtgtgaaacataccaattcagtaatggtacagctttctatatgcaaggacacaattggaagctcctgaatgtaaaaacaaaacccgactggtccacccataggccattaaggctaataatgtaaaataattaagcttaccaattaatcccatgcaggtatgagtctctgacagttatctcagatcataggttcccaataacttctttctattacatagagtgggtatatggtgatttatttagtcctgtaatatttgtggggattaggactcttatttggagacaaggtacataaaggataagtgagagtattcatgtttacaaacaactttaaaatgtattttctttgcacaagttttttgtctgaatctatgtacatgtgccacatgatgcctgttgcccatggaagtcagtagagagggtatttggttcctaaaatggagtaattgatatttgtgaatcactacacgggtgctgggaactgaatccaggtcttttggaagagcaaccaatgctcttaacctgtagtccctgtcttatttcacaatctttagctagagagtcaaagataattcatcaactagcaagcaaatgacacatggactcattgacacagctaagtgctcgctaagactttatgatatctctcaacatctcaggatggatacttagtcatgggtgatacaattgagcatccctaggtcttccaggacatagaattgacccatgaaaggcacactgaaaagtgtccccatagtattccatcatggcatggctaaatttcatagatattttcttgacagagctctgtagaccacattaaaagaagataaaccacttaataccctcatattatagtcctaattatgaacatcaaaggtcctttaaagtatgttgattagggaattagtcgagacatttataaccatgcaaacacagtgctgtgttggatgttaattttagtattcaatgtaaataattacaccaaggcacaaaagaattgaaaacccaaaacatggactggtaaggagagcgggccaagtgtgaaaggatttgaatttagtaatatcctaaccactgaagcaacagcctgctcattccgttctgttctccatctgttctgggttttcttgtgattgctgcatgatgtgttaaacttttgaccataactaaagtcctaggctgtttattctttgagtaaggagtgggaagaaagagatgagaggccttggccaagtaagaagtctcagatgctacttgcatcggtgaaccttgcttgctaacatttccttagacacaatgaaatcttagggctagagagattgcttagtggtacggattgcagatcccagctcccctgtgtcaggcagctcacaattacctgtaattccagttccagggggccgagatcactttgttggtctccaagggaaccacaagaatgcacacacacacacacacacacacacacacacacacacacacacaagacaaaatgaatcttttaaaacagagaaatgatcaaatcaaatggaagagaggcagtgtgaactgcagatgatggtgcagtgtctccagctcctgactagtccagttaagctcattaagaaaagtactctcccattacagggataaagagcagaccctacttctgtctcttggatctttgtgcagagaggagaatgtctgtgattgccactctgaagtggtagaatgtagcttcatagaactgttgaatacttgatgtaaggaatggaaatgttctttttctcaattttttattaatttaaatttaaataacccagtatggctaaaggctttcccctagttgtattaggtaattgtctcatggggagggggctttagaaatactatacatgaataaataaacacataatttaaatgaatgattattaattttaagctaatagctgaattactacaaagaattattataattaatatagtgctgcacagctgaattttgtgtctaattcatgtatttattgttttttttttaacttttcaatatttacttgacttcataccccatagtctatgtgaaattgtctctaatattgaaaatttatatattttagtgggcaagaatcaaaaaggtattgtcaaacttgttaatggcatgttaattgtcttttgagtgtattctatatattatcaaatggcctcaacaaatgagtagtgaattctaatgggtcaggaatgtagctcactgaatgaatatttgcctggaatgtggggcgtcctaggtttcatcaccaatccaacaaaatacaagactacagtctacctgtaccacaacaatgatagtataatttctgactaactcagagcaacagaatgcaatctataaatgaatgaatgtccactttaacacaacttcactccagtaacagatactaaggccacttaattggttagcattcagtcattcacattactttgacaccatggttgacttaattcagtaaaaatgttcagaatagcttgtgtgatcaactttgaatcccaaacaaatgaagggatcaggggtggggagtcggggagggggaagaagataagttagtggtgagtgtggggtacctctagtgtcaagagtatttcctgtgagcctagcatgggctcatgcctgtactcctagagcttttgagactttgaggttatcctgggctaaaaagagaggcattctccatgccccccaaaacaaacaaacaaacaatagagaaatgaaaacaaataaaaggaatattagtgtagtggtatatactaggattatcagcaagaaagctgaagtagaaggaaagaatgtgtgttcaaggttagcatagactacatagagatttgggagggagggagggagagagaatataggaaaagctgagggggagggggagcgggtgggggaggaggaagattatgtaaagaagtacctgtttgtttgggaagttagcccacaggcacacactatccaatagagcgaccactagcagcactaaacaggctcactgtattttaaatgagatgtgctctccatctgaagttcctaatgtagctatcagttcttgattaagtgtctagattgataagatgtatctacttatttattacatcatttactcagccacaatgataccttttagaacaaacaaacaaacaaaaagagataagcagctttctttgttttcaaattcctggcagctgattctttgagattcaggacaatgtgtcagagttctaagcaatttcaaaattatgattattttaaacatacatcgaaattgcatgcttaaagaataaagcacattatattttcttgtagttacaaagagctacagcctacaagaatatccaaataatgtaactgcatttcatattcagatctttcaggaaggtaacagcccctcatggaattatatgtggataatgcccctttcaggacttactttgaattgaagccgtgctagatattgagagtattcaaatcactcacacgaacccattagtatgggcttttttactattcaatcttttccttctttcttcatattatattctacccatacacatgcactttatatataatacatattatatataatactttcatacactatagatacattgtattagaggatctgtatataagggagttataaataaaattacataaattactaatggaagaagccaataaataagatatgaattcctctttggctaatcatgtgtatgtgtaaaagccgtggttttatagagtgtgaattaaaagctatcagattgagggccaagctggtgttgctcctgaatttcctgaaacctgtagtttttaaaattcaaattttccaaaatttatacaaatcatgctaattgtttctaaaatgtttgtcacccttttgataaatattattgccacttactaaaattatttttaacccacagattcaatgctgtgtacctgatggatggttactgtctgagactgaggctttttgggccaggagtaaaaggacttgggtaagttcaatgcttggggtcctggtgtgttgagtgatttgtgccatgcgtgggtaggttcacctcaaaaggatgaataacatctaccaacaggcataaaagcaaaggttaggcaggaacgatggctgatggctcactcttcttattctagtactggggagactgaggcaggaggattgtttagagccgtcctgggctacatattgggatcttatctaagagagagaaagaaaacagactccaaaccaaaaccaaatagctgtagacaaaaccagacaaagcaaaacaaaacctaaaaggagcattaaaaggatgccatgattggagaagatgtgaagtgtttttagcacagatgtgacaatcacatagtgcagatattagctagctagaaattagtcattttgtggtgtttaagtccttgaaacatcatgtgcacacttaatgtgcacaattttatctttcagttataaaagcaaaccaagaacaaaatgaatcaagctgccaggtgtcagctgttggtgggtttgagattgactggttttagcctaacccaggtcctctagagataagtctggggctgtcacatttgtccacacagtcttctcaaaggctattctgtctttatgtgattctagcccatcagtagagatctgagtaacttagtagggtcctcaatgtggtctgtggctctccagcttcacagtctgttgggtaccctctcgccccattgaatgaatagcagtgtgggaagaagcaatgtgattgtgatcgggtaatttatctacctgggccttaggtccaattaatatggcaccttatttacctgctttgtgaacatgagcaggacaagagcaaaaagattttttttttttgatttctgtgattcatgggcactaagatttttaattagagaaactctgaatgaagaaaaaaaatcagtaaattatgcagaaacagtcgttaacatacagataaataaatgaggcaaacgcattgagcgtgaatcagtaatgagtggttctgaggcttatgcatcaatacttttgattcaaccgtaaactgaagtctattagaaatacacataattggcggcttctggggggtgcaaatgcaggccagtgtggcctctggctcttggcccccagtggcacctgtaggaatgtgggaggaaaatgttcattgttacctttgggtcagttaggacatcacgatatgaagcaatagttgttagtcactctttttttttttttttttattttattttattttattttattttattttaagggtttttttgagacagggtttctctgtgtagccctggctgtcctgggaactcactctgtagacctggctggcctcaaactcagaaatctgcctccctctttctaatgctacgttctcctatgctataccaataaaacctgctgcacctccaggccatgttagaccaataggcatacagacatacgtatgtgtattacacatacataggtgtattaaagtgtcccccatagacatttttggcgtggtaggaggaagagaggaccaattacataaatgaacaattttataagtatgtagtggaatagaagcaagtgtggccagcagagagaatgttttctataatgtcagacatcatttttctctcatatgtggaatctttaaaaacaaacaaacaaacaaacaaacaaacaaaaaactaaaccagaagggactcctgtatggggatgggaagaatgtgggtaatgggaacagagtattgtttgaatatttggtagacatgtttgaaaccgtcctttgaaccccagtgttagtgaaataagtacgcactgctgaatctaaccataggctcttttattcttttgaaagtttgtacttgattgcgtcctgtggatgcttgcctaccaactgactcatcctgacgtgccaaaggtcctggctttcccctgtgtgggtaagggaagaagagagttctgtgagtaatagcttcggttgtatgttcttggcttgggaagttgactcatgagtgggtgttgcttgcatttttctaaggtaaaaaaaatggttataattcataagcaaaatttataaatgccagtgttaggcagtgataggaacatcatcagactaaggcctgataattaatatgatttagcactatgaaaaatccaccaaaagaagagaagcagtttttcatttccagggttgcttactattctattctatatattattgaatgtgatttatttatgtaccttgtcactgataacacttagaggttattaatttcctgatgagaaaggatagagaacaatgacaaaagtcacttgttaattttagttgtgtagatcatggccctttgctcatccatggcaccttctttaaggccaaaagagggcaaactttagactatagagatggtaggagataagaaccctgaatgatttaaatgtggaaaacatgcacagatattggggaaaacgactactaattctgtggggaatggacacttgatagatagatgtattattcagtatttggtgctctcgggcattttgatttattaattcatcacatatatatataaacacatcaatgaataaagcagcaagcactgggagaaagtatatcaataggtatatagagcagcgagttttctaagatgtgtgaatcaaagagtttggcctaaataactcacaggtatatcagaacaagaaaccatcctggtgtaagccatgcttctaacacagctggatatattgaaagaacttggtcttagctgtccacatctgtgacttgtattataatgggacagattcaggaatgaataaagatggccaatttttaaaaagcaaagacaagaatgaaaagaaacaaatattatcattcgttgttgttatcttctgacccactgagcttcattctccacatagatcaagtctttttgaccattcccctgaaggacatgtcctgggtcatgaaccatgatgttgctatttgaattgtgttgggcagctggcggctggttttatttagacaagagacaaattatttatatgaaaatgattgtttgaataattgtctaattggaagaaggccaagcacggatgacttctgtacacatgataataagcattatcaatctaattctgtccaccaaagacaacattcaattgtatctctgatccccaggtctctgtgcgtagctaatggtttggtccactatcagttttttttaatgtacccctaaagatgaatgaaagaatgagctcatcatttaattgctcacagggagcacatccaggggcagttggaagcaagttttttaaaacagaaatgtgcactggtaattttccttttattatgattgtgaagccaagcacatatgctaccatgcatgtgtggtggtccaaggaccatgttttctggagttcttcctctccttcctgtggtggtaatatcacagtagaacttctttgttgtggatctctcagtgcctttaaccactgagtcattttgccagcccagagatctgattaatttagactgattaatgataaataaaagccctccatctttaacggacttgagttgtattaaccagaaattttaatttctatgcctgttcctagattatattttctcattttcttcctatgttggttatttatgccttagaaataagttactgataaaccacctacaccaaagataggaactctagaagtacaaaagtcccttaaccactcaggcagaaagcaacattttcatccttactgaacaattacatcaaccatggtattctcactctgtaaagtacaatactctctgtgaagaatagaaagtgtttttgctctgtgaagtacaacatacactctacaaagaatggaacccacaggcttaaatcctttaatagactgactcatgagagattgggtgactaatcctaacttggttgctattacattcccattattgactcccgaataactctctttcttatgtaatgacttatgtactctttaatttttaatacaacagaaactaaaatctcccaccccacacaagagaaataaatgcagccattaagactgtctgtgctgctacccacagacaccctcatctcatttatctttttcaagggacctcgctgtgcattgttgagggtctaccttgcaacagcgatctcaggtcccctaatttacacattcgctgactggctcattatctttattctgtaggtagcttatttattcctaaattacaccctgggaatagatgcctggatatgaataaaagaaaagaatgcttgtcagaccagcacacactttgtggtttttatgatcttgcagagctgaagtctgctaatcatggaggctttttatttgttctctgggtttttcagtattaggatttgtttgatgtcattagcaatttacacatttcatcaatggtaaatatctgggccatgcactccctgaggtgggcacatgcagtctgagggagaaggcaatgttaatgtccttgttgtgactaaagaacagttcctggtggcacagtcttatctcctctaacctgaaaagccacaaaggttcttgaatctgagatgaataggggatggtcttcgtttcttcctggaacctcgttttgagatagttcactgtatttactgaaatattacaaaacttggagcgtaaaaccccaaatttgaaacatttaccgtgtcaaggatgtgagaaataggaggatcagctgtgactgttgtagtctctagatgtcctggagtggtgacccagtgatgtcatcgctcaaagtatgaagcacattgtttctttctcacagttcccacaaagccagaactcgggagtttctatgtgtgatctctcgtcagtttgcttgtgagatgtcaggtgatgtggcggtttgtctatgcgtgggtgatctgtctgcaaggttcatgttcatggctggctgctgatggggaccacaactttgccacaagagctttcttcagtgagtgtccttgggacatggtagttaatttccctagagagatctttgcagaacagagttaggtacatccttcgtaaaacacacaaaccatctccctaaagcacaaacttctccagggctctcctgctcacatggtgagccgtgatcccaggtgaatagaggtaaaccaggactttttgtgccacaggctgtggttcccccacctgcaatctcttagaggctgactaagtacctctaagttagttacctacccctaagttagttacctacccctaagttagttacctacctctaagttagttacctacccctaagttagttacctacccctgttagttacctacccctaagttagttacctacccctaagttagttacctacctctaaaagttacctacccctaagttagttacctacccctaagttagttacctacccctaagttagttacctacctctaagttagttacctacccctaagttagttacctacccctaagttagttacctacctctaaaagttacctacccctaagttagttacctacctctaagttagttacctacccctaagttagttacctacccctaagttagttacctacccctaagttagttacctacctctaaggatagttctcatggactatccttaactttcagacaaagttaattagaaactccttgaagtgaaggagctgagctatctcatgtgctcagaacctttgtaagagcgctccccagagtgaaccatcagaggcatctcagagtgtaaggagcttgttttcagattcatatttcatgtttattgaatttattagtggttaataaatgacctgatatacaaagttaggactaactaaaccaaagacatccactctctgaccaatgatgagaattctggggtgtctgaatcaatgattatgattaaccctgtcgctctgagtgaggtccattagatgcggcaggtgagatggctcagtgccttaaggcacttacttgctgacaaacccaagttcttgggttcaatctcccggacccacttggtgaaagaagaaaactgactctcagcagtgtcttctgatctccacatgtgtgcctctgagtgtgcaaatagacagacacacacacacacacacacacacacacacacacacacacacacatacacacacacactcaaatatgtaaaaagaataaacttcagtaatacattttcagtaatgttattggaaattagaaactttaaacatttttttcttaagatttttacatccataagtctgtgttgtttccctgtaagtaagctaggcaaatatttaaataaatacatatttaaatgatcatgggcagaaagatagctgtatgtggtctccttgtgcaattgcctaacttatgtacgtttgtagatacatttgaaacagtcaattccaacataaatgtattaaatctgatttctagacatttgcccgggccaccaattgcattgatcttcattactaaggagagagtgtgatctagtgggcacagccttgctgaggttcatccctgggacactgacattcactggaaggaggcagttatagtttcaatgttcacaatattgtgtttgttattgttggggttgtcactgtctgttggttttattcttgtttgtgagtgagggaatgacaattgagaaacagaccctgggatcagtcagcaagtctgaagttctgagtctcactgtgaggggaaacagccaccattgttatgggaagtgaatgggggaaggagcaggtttttttgtttttgtttttctgtttttctattgagatgctttagttcaaattatatttttaaattaaatcaatagatgaataaaggaatgaaatctgtaagtgcatggaaagaaatgaagcagagccatgggtggtcggatcagttatgatgacgtggatttgaaagagaggaggaggaggaggagggttagtctgcagtcagcctgcctgttccctgggctagtctatgggtttctaaggaaagcctgtcagagttggctcctgggatgagtagggggaagggagattggaggaagggaacttgtgtgatcctttggagaagggggcagggatcttggaagaagtgggaggaggggtagaaggctaaggagggggtggtgtgaaggcttgctgttagctcacccatgctactggctggagatggctttgtattttcgattttattgattttttcccccctctaatttctgttattttctttcttttttcatttgatctcatttgctttctttgtctagtttccttctaggtaccaacatttttctcttgtctgaaactttcttctctgtactcatgaaacttcccatttcttctgtctaccaaagatacttgtacctgccattcaggtttcacaggatgtacataggaatttaagtatatgtcagagattacagtcagaatataccattaaatggtggtgaccatttatccaatactatctgaagacggcccaataaaagagagtcatagcctatatgaacctgggtgagggggtgtattttgaatagctgctatatttttaatagtgacagggcttgggggggaattttgaatagctatatttttaatattgatagggcttatgggttaatagatcctacagtgtcttttacatggtctcagagaagccctagttcattaaaaagaaacctaactaggctctctttgaatttctaaatcttgctaagtgtatttttcttccacaaaatgctcacagacagctgacttactgagttttactaagaaacaaaatcacacacggtatagctctacacataaggaacagagaggatgttgggagtgagacaccaggttcgtggtctcccttgggatgctttgttcatgaacctttagtggtacttcaaaaggatacagctttcaaacaataagttaagctctgtaagaatggaccggtggtgaggatgtgctaggacccatttttttttttttttttttaaagattcatctaatttggtgtagtggcaaggatctttaaaaaatggcaatatcctgtaaaggagattttgcccctggaacattgtgttgtgtcctatggactaatgagttggcccgacgaggggtggaagggagatgtggaggaaggaaggtttgtctggaccggtgatgagttccacagggtatctgaaccaggatattgtgagaactgtttactgttgtttttaatttcctaccacattgatttgaagatttgcctatcagtgtggccctggctgataaggagggcgtcacaagtggtagaagatgctggcgtcattatcttccatcagatgtctttagacaagggcagattcacttagtgcaaggtccagcagagcagcagtcaaagcagacagagatgagctctgggtgctggtgaaggtctctcttccccgagctccttggttaaggaagatggatgccttcagtaaagggagagtttggtccctggagtattgtgttgtgtcctatggaataatgatttaacacgagaggagagatggaggaaggcttttctggatcagtgaggagaacttgggggatctgaactaagatattgtaactaaacccatgtatgtctctgaggtcttttacaactctcccttctttagggaacactttgtggggctgtgtcctaggctgatagacatgtggatacattggtttctttatttctatactagcagtgaggtgggtggtggcagagcccaacaagctacagtcattcccagctagggttttacttttctaatgaaattagcctgtggatctttaaaaagtatgaataaaaaaagaggacaaaatggtcaattattacaaaggagtataatgagacaaaggttgttgttaaatctactcaacagttggggcttaagaaccattttgtttaggggtacatggtcattaagtgtttgtcctatgttggtaactggtctcccatagttgttcctagttcacttcaaccccacgatcctaagcacacctgtacctgccctggaatccctcagccatgtttgtcccacagagcatcactatcaaacagttcactgtggactcctcgtagcagaagtacagtaggggacagcaagtgtcagctccatcaggtgtgtgcaatcttgtgtaacctactttgtagctttccatcaggctttagggacagacaggcacccatcatgagacagggcttgacaatctcagccgggcgtggtggctcacgcctttaatcccagcactccggaggcagaggcaggcgatttctgagttcgaggccagcctggtctacaaagtgagttccaggacagccagggctatacagagaaaccctgtctcgaaaaaccaaaaaccaaaaaataaaaaataaaaaaagaagccagtctctaaccagtggccctcagatataaacaatgcaggccattggttctacaagaaaagagctgctgatgaagtaatcatgacttataaatccatgagcagcttcaccaactcacgacagtgtttttgaggaataggcagccatacctgggtgtctgatgcctgttggtggccctgtctgagtcaacacttttggcaacgcctgggtaaagtctgaggtcatttgctcagtgagagactgacactacttttttatagaaattatctttgtgtagaagtctgaaaaacttagccaacttgcccctgggctttttggctcagtggtatgtaatcttttatttcaagagtattagtatataaataggaaataggtacataaaataatgaagacacattgatttgtgcaataggtagtgcaagaagccaaagataactcatgctattgcctactaaaaagcaagtgtgcttgttaattccaagtaacataggatagagtctgcaaccctctttcatattgagtatattagtagctgtacttaatagagttgcttgggtgtttgttggtcattaagaaaagcaaagtgcacaagctagccatgtgttaactatccacctgcttgacagatggttgtaaatgctgtaagacttactcttggacattcaccacattgaaaatcagaactttgatattaactctaaactttattattacatagttctgcttgacccactaaattctaaatcttctcttccctcttgtgctgaatgtaggacccctgatttaattatttactgtggaaccattgtcctgagtcaggaggatagatgaggaaaggtaaggctcttagttcatggcctctgtctggagtcttgtttatggctgctagctgatcattttcaaaatcagtaatggtcacctacctaaaacagttaacttacaaaatcatgtttaatccaagttgccctaatagacatgattttaaaagaaaaaagcagttatataacttgtccccagaactttagtgttaccttttgcattgtggttgagctctgctccccaacagtagttctttgggaaggcccccatataaatgctagctcacgagtctatgaggatttctgaggtggaagatgggatgggagcttcattatgtttgatggagccaaatttgacatctggatgaattaaacaaaagtgaaccacacaaaaattagatgtggattggatccaaaacagagacactagtgtgccttggagcatgtgccctaatggaagcaatgtggtctggatatcccgagaagagagccccaacccaaagatcttgttttagggactgtgtattgttaactgtgaatcaatcagtcaatgaatgacgcaaacacccagcataggccaatgatgaggagcatggggtttctgaccgaggacagtgattaaacccttatgaaatctgaggactattgcaaactggtgtctgcatcctatagagaggagtccccaaagcccgatctttgtggattcgtggcgtaacccacattcctgtaataaaattagtcataaataaagaatatgttaatgaataaaagataaaaaagataaaattggcaaagctggttagttagccttgaaacaaacataaaacaaagcaacaaaacaaaataaaacaaaacaagcaaacccctaaaaatagggcaggtagaatggttcacaagagccttggaaaggccctgtgagcaagcctggtgatccagattccacctctgaaatctcatagagaagagcagagtcgccatactgtcctcttacctgtacagacagacagacagacagacagacagacagacacacacacactacacaatacacaacacacacacacacacacacacatatacaaacatacacacacacagactcacagacacacatagacactcacatacacacacacagacacagactcatacacacatagacgcacatacatacacacacatacacgcatacacacacaaacacagactcacacacacacacacacacacgcgcatacacacacgcatgcatgcaggatgtaaatgaacgatttaaaataagacaaaaaggaagaacctgatgttacacatgcactttttaaagcatttaatgcagtgtgggttggtattaattttgagattcttagtcaagatgcttagctgtgttagaagttatctgatgattgatgaggaggcaagttgaggcaagttgcccagtgccaaggaataggagatacatttctgtaactagtggttgaatgcaggacacttacacacaaagcaacagcaagacttccacacaccccaccaggtgattgataaaagtttgccacacttgagcactggtatagcacaccaaacagccccacttagggggctgatccggaacggggcactcaaatctaccaaagtctatgaagggacgcattcttaaatgtgtatctcaaccagttgtttgtttgtttgtttataaattgaggaattcagcattggaaccatgcactcctgacatgcacaaggcagagactttcccgacctttccagtcatgcgtttaggaatttaccttatgagtgttccagtcttggtttggtagctgtaaactttcaaattctgctagaaaaattatcctatgagaaattaatcttgtcagttaatgtgcaagttagacaggggctgggcggtcatcttctgaggactgtctgccacagttgtcatgctcacatgtgaacatacatccacatgcatgtgcaagtgcacatataaacacacaccccggaaaattaagcttaggccataacagagattataccatatggtaaacctgtcacctccaattttgaatttcaaagtcccacctaaaagacaaccttgctcttaatgtatgttgggaacaaacaccagatgttcctaataattagagttatttttcttcttcttactgctgggttcagtggtgttcattacattatttaaaataaaacgtatgcaggttcataaatataaagtgctgttctcgcttagaccccatgaggtaataaatataaaggagttgctgccttcccaagtgttccgagcggaacgcaaacctaagcttatggctaattgatcacccccaactgcagttccccccaaaactaaatgacaccaattcatttgaatgtttgccttttactctccagaatgagagcgtggctggcatcgcttcatgattacattctgggaaagatcttgcctgttaacctctagagaaggagggacgatacagacgtaagtgggcatcaaacttcatgacctttgtgagagaggggcaccatcatgcccatcgaatgattcttgaggaacagattcaaagtggtcatgagctgaccattgatgagaatgttgtgtgagttaatgttgtgtgagttagtaaggagtgatccacttcagtcccaacaaattgctctcgaccaaaaagtgtatttcaaccatttctagaacgtttttacgtgatttgggtcataatacatgtggatacttcatcattgtattgccttcctggtcccctcccagagaggagaatatagtgaaacaatgaatcttctcatcatatggtagtccattgtgccatctttatatagatattaagtgagagaagtggtgtgattgacagtgattgatagcatgcacagatctggattcagtcagatttcccatgttgaggctcacagcagaaaggccagactttagctctgtgggatatgcactgtcaagatgtatctgtatttccaagtattgttcctcccttaattcatggatattgattacattattattgaatcgatgaataagtcaagactagtatgactgactaaaagcacagacttccaggtctatgaggagtgtgcatggggtatctgaattcagtgtcccgattaaatatggtctgtgaggtctactgtgtctatgggaactgtgcctttggcttttccattgttcatatgtgtgcagttactcgtctgtcgatcaatactttagtaaaaggcagaaagtccccacctcatcctcttttgagttgtgaaaggggctaatgaagcaaagactactgttcttttttttctgcgaggacttagctaagcactctatgctgctgtttggggttagtgctgagtcgctcattgcatggcttattttaaaacagtccaataaaatacatgttatgtattttgtataacatcaaaccagtgaaaataatataagtaggaatattcattaataacaatacaagtcattttaataaacacattaatataaaatattttgatgaacagcacaattaacaaaacctcaaagacacatgtctagcccttggaagttgggcgctgtccctgcttgaatcctgaaataaatgtttatcacagtcttgcactcacttcttttcatctggaaagaacaatgcatcccagtagtatggttgagaaacgtaactgttctttttttaaagctaatttgtggatcacttcataacaaatgagtgtacaaatatgaacagaacttaattcccattattctgagtattcacatgaatggttgctattattataagagactaaaagagcagcttcatgtttgatttcaccaccagggattagaatgatggtcgatgtttgtaagtttaatatttaggtggctgaggcaggaggattactatgagttcttagctcttagttctagccttaactatataacaagaccttacctcaaagctaatgtaattttttttaatttaaaaatttaaaaagtaaacaaatacaatggtgggattagcagaggtgcctgaataaaagatgctatggtgaactcctatggaactctgaggtctttgttttaaaagtggcctcctgtgtccaataaagaaatgggcctagagcttgggtatgtggaccagggatgttcacagttcatgctgatatagactgccattcttttcaatgagaaattgttaagatatgagatatataactgggtcaatatagaacgagttcggtgcagggcatcatgaagcatagagtagactgtcattgccaattcatagaacattgagtcccttctgaggctgtgtgtgtttagttagtagtaggatcacaagttcagggccaacctgagctacataatcaatacttggtctctgcccctcctttcacttaaaggaaaacaatacatccagaatgttttgtctttatattcaggtttcattttcttttctatttttatgatttacttctctttttttggataaatgtgtgctaattatacattctggaggaatatactgtaaattcattcatttctttcaaaactagtcaattggaaaagggattcttgtgcctctaatgagacccttagacaggcaggcacactcttgatcagtcctgtttccaagtgatgaattgaacttgattcattttatcttttcaaagtcacagttagacaaatgaaaaggtggcctattgttgggtcagtgaaaaaaatgggaattgtcgtcatgaatattttagagttaaactaatgctgtttaaagtgatctaaatagctcactgttttaaaacctggcatttgacaccatagaatgaagactatagcagactgaattactctctgagatgaggactttgctattgccattgcaggtaagatgttttatgactccataatcagcaaagaatcctgtcagtaaggtctgatttcttcgcagtgttcattggatcttttaagtctacaaaccaatgatacaaatgcaatatgaaacaattgctaggaagctaattggcatattttactcacagcccattttattttcgcacagcagtgtacttaagttttctacttaataatctcagtctgcatgtccaatatggctgccaccatacacacatggctgcttatatataaagtaattactgtgaagtgaattgtaaaattcaatttctctgttgcagtgctcacactgcaagttctcagtagctacctgagcctttggggcactgtgttaggatcaggtttctattattctgcaaagagctattggacagctcttcacagagaaggctgcacacaggaagagggaagagagacagatgtgactgctttgaggcaggcatgcgaattgatccatccatggttcactgaaggcccctggaaagagaatcaggaagagaactcagcaatgagaaaagaaagaaactgtaaggagaccccagtcccaagcacaagttcttctcacttcatgaatatttatcctattgcccccagggaggctatgaatgggtcaataaacaaaactgtccctgaaagaaaaagacagaggtcaaaggtggctcatgtggatcactgatgagtaccctggggtgtctgaatggagggctttgactaagccctgtcactcaggaggtccatcgtgaaaaatcccatttattatctctttcggatatgagcttagtctggctatctaaaataacatgggctgtattcttgggcttctgtgcactaaagcagtgtatgaatcaaccaagaaccctataaatgaacactaacaaaatgggtcattgctctttcaaatatgtgggtagtacaataagaatctttactaatgtatttatgaagcttgacattctagcaatgtattgatcaaggctgatgccatggggcaaggaacatttggatagatgtttgttcttttgacatattgtgtgttttttaaagggaagagcaaaatatttatttaagatgattattaactaaataaaatctgagtagaagagggcttatacatgaatctaggctgacagctcgccccagatgaacaattagggtttctgttctactttccactgtatttcaattctgtccctcactttaatttaaatagttagagacatgtgttaatccttccatgactgaacatacaatgtaatctggaattaatctattgttccatttttgtggaatcacagttgtaatggcattatcatatatagaaaaaggacattactatctcaattaatcaagctaagctgcaggaccttttattatgagagaagtagatagttacagtaccaacgaaattagagaaacctaataagtggagcacctcacatttttcctattttttttctattatttatttagacataatacaatattataaagtttttgttttgttccttgaagttgcagggtcaaagagttacatatgcaaccacatatatattatatgcatatgtatgcataggctcctgtagagacaccttgcctaggtccagtcagaatatttcactcttgacagacccatgaaccagtcttggtgttcatgtttgtatctagtttgcagttattggaaagttactacttattgtaatctcagtggctttgccagcaagcttattccttagtcccatcaatttttgttgagttataataatctgagtacttttggctataaaaatatgagtttagacttgagcttcctatctgaccatctgtacaatgaaatagtaattttcattttgttactgctttgtcctcagaatgcatgcaccagtccccattgttctcaggttaggaaggaatggatgtttatcgtcctgagtcttctttgctcataaccactggcttcccaattcactgtcggtctctgttctaatatcagaggggaaaaaaaagaagacattcttaatttctcaaacttgattagaaaaatgttgcaaaaacctcatcacacgctcaaatcagaccccaaacacataaatttcattagatgacaatacatagctattaccacagatttacaaacatcttcacaaaaagtttcaaaaaacttccacaagttaaatcatccaattttcatcccatgtgcttatccctcagaaccactggtggaagttgttgttaaacagtgggtcttgcatgcaagctctacagttatgcacagtatttccatgacatcccaagccatgtgagtaatattaaaaattattctgtttgctgattgagtgcatcccagcaagggattgcattattctgaagaacaaaataaaattgttcttaggctgttcttattcatagacatttttattatctataaattggtgtgttaatcaacacacatgcatatgttactagagaagaaaactgtaaatatggaccaatgatgaccttgtctatattataagtcatagacgatgacaacatactggattctgaggttcataccataagatgtctcaagtgcccctcttggacagctggcaaaagttagacatgtgcagtatatactgtgcacaagagtcaggcactctcataattttcttatattgtgatcaatgaattacgatataaacataaatacacttgcagataaattactagagccatcaactaattatgaaaataaatatttgaccccaaatactactaattcatttggaaaatctgaaagtctgttaagaaatcattggcataaagatgtatataacctttatccaaattgacatattcggtgtaattaatggcttaccctctagtgagggttaaggccttcatttgaaatgttatttgatttcttaagaaactttcatagtaatttgaatcttaagtaacaagtaatggaaagagaaatgtagaaagaattggaaagtatcaattttttttttttattctctttgctcttttgtcctacctggatggatgctgcctaacaccttgtttcctggctaggaggttcatgctgccatatccccctgtttaacaagtgtggaaactgatgtaagtggagtcaaagtcttggtttgggtggccatcgtaaatgttcctgctaagataggcataggctccagtaagatcaactcaacatgatcataaataccatgttgaggatttccaaaatttagagaaatgacagagagtcacaggggcacaaactctgttgatgaacttcaatacaccaagatcttgtgcaaggatctgtgatgaagagttatgtaaatattctaattgatccatatagttgttaataaaaggggaaagtgtgagagaagttgaaggacagtgttgagtcaatgatggccagtgatgatgtatgaatcgggatcatagctacaggtctggtcgtcagaggtccacacccaaacacgtgtagtgtggagctgtgatatagatattggatgtaaattagtgtgttaaaatccttaggttcatctgttttcattctacccggacttagattaaactaaatgaaagaggtcaaagcattctctaattatttaaataacaccaagtagtactactaacagtatgaatatcaaagtttagaaattcattagtaataaatggccagagttagaaacccttagctgagaattttgtgtgctgttttaaatggcggacaaaattctcgtttggttaagaacctggtctcctgtttattttctagagaagaatgtatcacagcttcatgtaactcgaggggtaaaataaaaaaatgaactactacaaggatcataattgcatagaacataattatgtttataatcgtttctccttttcatctctgtatcttttcaagctgcattacctatccatttcgatcatggagtctatggctagcctatggtcttgggtgcacagtaggctctctaagtatagttcatgttctcgggttcttacagattctgccatacttaagaattacacccataattaatgacagatacagtttgttcagggcatgcttcattaataactttaagatgaaaattgatctgatgacacactgaatcaccaatgtccccttagacagctctaaaacatacttagtaatataatccattagcttttatatgtatgatataatctgttattaatatcgtacaatatctgtgcatggacagcagtaatggcactatcataaatatagaaaaagcatattattattattattattattattattattattatttcaattaatgaagacagagtgcagtccattgaggaccttttcttgtgagacaagtagatagttaattcaatccactacaccatgactccagaaaaggcaggccttttgcaatggtgactgcatctatttacttagacaaccttccagttgtaggaacaaaccatcccatatgcaaccagacagctccattctgttttcaccggccctgtgagatctacacactcagttctgggtgagaagacacaggtgggtccttgggacttggtggtcagtcagctgagcttaagagacaagctgcaggccaatgaaagatcacatctcctgagaaacacatgaagttgacatctgacccccccccccacacacacacatgcagacattttcatacttatggaaaatttgcaaagattttattgtgaagtaatgcaacattcatgacataaataatttttaagtgacagttgatttatcttccactgtcatgctaagactttagagttctgtccaatatacaagctcatgctaaagtctcagtggatttagtaagacttatatgactatatagaaagtgcattcattctcataacctgtgttttcccccccagaatggactcacaattgctgatgtataggttctaatgttttctattgtggacacgggacacccagactgaggttcgtggatttttgaaatttctaataataagataaatttgtgacttaattttgagtggatgaacttgatttgttgtggttatattgttcagttagtatgtaagtaaatatacaaataaatgaaaaaggggttggccaactatcaatgtatagagcacattgatagcaaagttgtttacataacttacacttttagtccttaaataccatacgaattgagcatgttttatctctccttctgagatcattaaatgggtcattaaatatagggactataagcaactgtcaatattgattagggtagttcaatgttaacattgttgatttttgaagctttattatgaacttggaagcaaaggcgccacacactgaaattaaggagatccaaagacttactttgataatagaaaattcatagcgattatcataggttcatatgatatcacattaattgttatgcaaaacttattcttgtgagttctcaaaggtagttatcctctctattcatcccacagaaccaatggctccagtctgatttaaacatgggtccgtgctcacacactcaatacctaccctctgtgctcacaagtcctgtgtgagtaagactccaaattattctgtcttgttttactcaatggtatgctctaccttattatagagtataccatgtattgagacaagaatgccagtcattctgagaaacaaaatgcaaccattagttgtcattttaattagtgacgaatagttgtgtcaatcatcaaacatgcttgtataattggatgagaagaggtgtaacacgggccaatgatgacgaggtttcgggattataagtcacggacgatgactacgtcactagaggtctgaggtccatagcagaagatgcctcatgtgaccctctcatgcaggggttgcatgtcaggcatgtgcatacagtagatattagccatgcactctcaccatttcatagtagatcacagaatcaagatacaaatctccatgcacggaaaggatttaaggcattgatcaatcctgaacataaatatttggccatcaatgatatttacgcacacactgaaaaatctattcagaatgacttacacaaaggtttatataacctttatcaaaggtaatttatatagtaagattcatggctgaagtcttcatgatggtcaaggccttaatttttaaaattatcaatttttttcttttctttttttttaacttgaatttttttttaatgaaaactatcatgacaatttgtctcttaaatgaaaggagaaatgtaaaactaaatggacaaatatcaacctttttattatctttgctgttgtgccctccctggatgggtgctggcacatgatgtcttgcctgctggtccgtggttgcactctcaccatgtggatggagctcggcagctgaagtaagtgaagccaaagatctgctcttcatttgagtttctttgataagacacccctgctgtggtaaagccatgcataggctcctttcagccctattcagactgtgtgctcaacgcaacatgaccacaaacactgggttaagaatagccaaaattaagacagagaggcagggtggcacaagatctgttagttattcaacaaacgaggataggaatttgtgaggaagactttacaagtgagatgaatagttaggcaatccatcacaactataggtctgagagtctcaggtccacaccagaacacaggtacagctacagctgtgagctagatatcagaagtggtttaatatgttatcttgatctttatattcatgagttttcattttatttttataaggtagctaaaatataacaaacaatagcacattgcaatctcaaattatgaacaatacacacatccaaatttctaagtgcattttgaatatgtagacgagatctttgtccagtgatcgatttcttatattggcagagcagttcttatagttatcttcccttccccagaaaagagtaccatgcattatgtttgtggaaaaaaacacaaaacaacataattatcattggaacgaatataattatgtgcctagtctgttttgtttacatctgtatgtgatatctcaagctgtcttccctttcctacctagtcctgacacctctgactagccttgggtctttagagcacattaggctgtgtaaatgcagttcatgttcttttcttactatgaacacttctccttattgacaaatgaatccctaataactcaaggatgacacccatgtttaatgacagatgtagcatgtgacagattttattaatattcataaaattaggatagatatgatgacacacgaaataagcaaagatcctttagatagctctaaagcatatttaagaatatcaattaaaagcttttataagtcatgtttatctaattagtataaaacaataaggatctcaataaataaatataaagattaatgaaaatttgtagggcttatgttggataaatgataacccctgtcgcatatgaatcaaggaccatgactcctgggctgctcttacatcttaaagcctgtggttcatgcttggcattctggttatagatgccagatgaatgtttgtgttgattaattttactatattccatacctgaagtctgctgaaggagtcattgatgaaataaccccaaagtaaatccagtatttttatttgttgactggaaaataaatacatgacaaattctagaaatatgcacaaaataactgcacttaagagtatctattgatgtgattggtaccatgttgaactgtaagttgggaatcttagagcctgtccattatcaaataaagttcgggaagaaaccaggggataaatatggaggcctttactgaagcagagatcacagaggaatgtttctcgttcttcataactttcatagcttgttttttatagctccaaagagtatttaacgcacaccagatcctagcaagcacttatttctttaggtgcatcccaaaatatatccaaatattcgaaaatatacccaaaaatggagtgttggtaatgcttttctggtttcaaagttcatgtgttcagaatataaggatcaatttttatgtcattaatggatgtacactgaaatgtatctgtgcattgagaaattaatgattactgtgggtggatgatgactcgtggtctggatatcaaaggtccatatcttacactatctcatccataaccctgatactagtggcagagtctaggaatagtcttcctttataattagacaagaacattaacagaagtaagtttgtaagtcactttctaacaccaaactactccagagactagagagacagatagctcagtggataaaagaacttactgttcttgtagaagacccacagtgggctgaatcgcccatgtgacagcctgtaactctagttcttatgtatctggtaccatcatctggtctctttaccacatacatgtgtcacaaatacaaaatgcagattaaaaaaatcattaaatagataaaaataaaataaatatttgagaaaataattccacatgagttattaaaattagttataccatcattatattaaaaaatacagtaatttatgaaaacaggatgactgaggagtagacaggaaagaaaactgtaagaaccttcttagtatggttcagagctatatgtctagtgttttacatcataatagaacatatagtagtgtcacacatacagatgtttgagaagaggtgcgaggcaagtacacagatcatctgaacaaaggaacaaaataccaattttcttttgttgatctcttctgttttgaactctcagaatgcattcttccaccaagatgatttacacagcctagctggatcaggagccccctaataagctgcttcagattgtaatatagacacagtgtaagtacagtccatattctgctgtcgcttcatgttgcatttaaaggccatttactgtattgataagggcactatctgttttaggaagaacagtcaagtaaaggctgcgtatggcatgtgtttgacgcacaaggtttaatgaagttgtttcaaattaaggatatgtattgaaaactgcttcataactcaaaaagaaactgaggaactctgaagtttactggaatctcttgtctttagttttttggtgtttttttggtggtttttttgtttttgtttttgttttttttttttgtgaatcacaatgatcccagtagtacttgtaatcgtttgcacactaaagatgcctacgtgagtagagaagcagagactgatgttggatcaatgatgactgtgggtgctgtatgagtcgtgtattatgactatgcgtctgagagtctgaggttcacatcgtaatatatgtagagcatcctatgatcttagtgacagatgttaggagtagtctacatttacatgtagataaaatggtgatacatttggaaatcatttctaataagacataattccatagcaataatgttaagcacatagactaaatagtgtttcattcagatatgataactgggggttccccatgagtgatctaaaattgttagcaaagttcttgctcacctcagagccatgcccatttgatctgtaatgcagagatagtaatagaataatgaagacctcatgagggatatggtggagaatgacccagagaagcagacggaatgcagttacctaaacagaatcttaacctttttataatttttctgctttttgctctcagaatgtatgcctgcaggatgagtcccaccttcttcattagtcttgaggtttgagattccctgtttgtgtctgcaggattcagatagtgtgagtatagtctgtgttcttgtgttggaattcttttgcttgcataaaaacagggtagaaaatatttctggggctggtgagatggctcagaggttgagagcactgactgttctccctgatgtcctgagttcaattcccagcaaccccatggtggctcacaaccatctgtaagggctctgatgcactcttctggtgtgtctgatgacagcagcagtgtactcctgttcctaaaataaataattattttaaatacattattatctctgaagagcagatgtagccataggcatataagatgtatatgaagcacaatgtttaataaaattttaccaaattaagattgtgcaacaatagagataggcatcagtgcagaagatcccgtagaggtttaactgcactcacggatcttatagttagggcttgtctccagtggagattttcgcaatggtcctagtcatccattgctcaataattttacatagattagtagggaagaggaggactgatgttggatcaatgatgaatgtctgtgagcattcttagagtcatgaatcatgacgacaaatttaattctgagatcaacatcataaagtatccagtgacagctataagaagtagtcttcttttataagtcagtaaatgtaaataaaaattgactaggaagtcatttaatcaaaaggcagctcacaaagaagactacatatatgtatatatgtatatatgtaagaagaaagtgtgacagagtaatgaccatggaggtgagggataagatgaaatgagcagaagcaggcagaatacatagataagcgaacggaacatcaatctctttataacctcttctgtctatacttcaagaatggatatcctgcaagtcggcttcgtagagtctcccttgaaagtggacctcatgatctagcctttatgtccgtggattgacactgtgtgagtatcatcagcgtgtgtgccattgtttatggtacttacagatggccctataagctagaagagaaatcttgagaaaatgataaacatggctattgtgtgtagtacattgttaattttcccaaatttaacaacaaattaattttgccaaatttagtgcatataaataaatactcagtttgacaaaaggtcctttagagatctaagtctcactcaaggatcttgctgtttgagatttgtgagtcataattatctgcatagtgtctttaattactcaaaaaaaaaaaccacatacaaattaatagaaaagaggagggtgcatgttggatcaatgatgaccagcggtagccgtatgattcatggatcatgactacagatctgggagtctgagttccacatctcaataggacatcatcccccaagcactgttaccgttatgagtgctagtctatttatataattagtttaaaacatagatataaatttgtagcatatactccacttaagatgttacttcttaggaaaagttttaaggatatatcccaaggcatgactgaggataccgtatgaaccataattaaagacaatgttcatggtcagatgtagagctgccttttttctcaagaagcacacatattagtgtgatctacattttggataatagtcaaggagaaagtagcaagacaagcaggtagcagtcatggatgtgtgaacagattaaaaatcttttttattatctcttctgctttacattctcaggatggattccccccaagttcatttagatattctctcttattcataaatgtcacggtcagctctgttcttatagataccaggtgagtatagccaacgttcttttgttgcttcatgttgctttttaatggctgtgcatatactgagaaaagaaagtccagttattatctgggaagagcatcccgcttaaagtgttaaatggcagttagatgaaacagaatgtttatgagtatttccagaagaggaatgtataacagaaaagattctaatcatggcaaaagatcctgaggaccttcagagtacacgcaacgatcttgtccttagattgtgtcatttattatcatcttagaggcactagtgagattaattgctcaaaaaaaaaaaaaaaccattgataaatcaatagagaaggatagagctgaggttgggtcactgaagacacactgtgtgtaggagtctgaggtccatattatgaatatagtttgtacccatattcttagacaaaaatgggaaaggcttatgggaaacaacactattttttatttaattgaacatcttaaattttaattgtcaagtaattttctaagtaagatatcattctatagaaagtgtactaaaattacataccaaactcagtagttaataaacagtggttaattgagcttgccatgtaatgtgttacttggtaggttcatagccatagccatttcttttctcataaaatattcattatagtatgccatacacttagatgagtgacaaaaagcacagggctgtgaatgcaatggtctgtagacagagtgtcatgggttttctttaataatttcttctgcttttgctctcagaatggataccccaaggtaagctatggtcatcaccttcacaatctgattccttacaagtgtattcagtgtgcatgtctttcttgacattgcatctaaagattgggtactgtattgttgaaaccctagttatgacccattggttaatatgacatgtatgtaaatacaatatttcacaaaattttgctaaataaaaatttataatataagatatgatcaataggagaaaaaattacattcaggtctaatatatactgaagaatctttttctttgatttttgtgattcataatcatctcaataatcattgggaagttgataggaattggagtcctgagggttagtcttgacctctggtagcacacgatttgtggatgatgggtacaggtctggaagtctgaagtctatatctttaaactcttagtatgaactcatgtcaattattaggaataagctacagttagataaaatatcaataaaataaatccctaattcatgttctattcagcacttacttgcccaagattgttaaaatatacaccaaacgtaatactttttgagatgtgatagctgaggatgtcacatgaattaaatttattggcactgttccttgtaggttagaataatggccatttgttttctcaataagaacatagtattagagtgcatatgtagataagcaataagaaagagggtattaagacaagcaaacagagagcatggatgagcgaagggacctccagtcctggacttgccctaagttgattctcacttggatataagctccattttgctctttgagtcaatggatctgggttggctcatggttttttcactgactgtgtatacattgatgaaaagcaataatcatttgagaggacagcctttgccatatggttattaccgaaagtgggtcaaacacaatgtttagaggtttttttgtgtttttgttttatttataatgtgtaataaaaggggcactaataatggcaaaaggtatctgggaacactggcatatacttaaggatcttgtccctagatctttgtgagttataattatctcagttgtactcatagttaatgtctcataagtcaagagcagagcggaagatgatcgtggattaatgatggccgctagtgctgcatgcatagtggattgtgactataagtctgggaagctgatattcacatccttaaatactgaatatatacccatcattctagtgacaagctgagtagtttacttttataataaaaagtattagtgactactaataaattatatttagataaattagaaaaaaatataaaaattggaatttatgttttaatcaagtatagtaaatgtatacatttactatacttacattacaaacagtaattcatttgaatttgatatatgagaatttcatactacatccaaaagactataggcaatggtcttggtagggtcagtgccatgctttctttttaaaaagagcacactgtagcatattgtatccagagaggagtaataaagagtggggttatttacagtaggcacaaagtgaatatcagtctttttattttctcttctgctttgtatttagaatggatacccctaagctgatgtatatacacccttcctcggttgtgagattcctgctctggtggttgtagtcataagatatacatcgttgcgtacaccttggttgtgggcacgcacactactgttgaattaccaccttgtccaagtggtaagtaagcctctgcctcagatgtttaacgagatttttgccatgtaggcaacatataattaaaccattactataggataaaagagcccgtggctgttggtcatatactcagtgatgttttccttagatgtttttgtgatgcatgatcacttgataacgatatagatattaaaagagatagaggggtctgatgttggatctgtgatgacaaagggtggcgtatgagttgtggatcatgagtacatgtctggaagtctgagattcacatcatgaaagatctaatatatcctcatgaccttagggacagatgttaggaacaacctatttttacaagtaaattggctcatggtataaacacagtaaatagtttcttccagtcaagacatccttctacagcaagagtcctactaatgtaaaccaaacagagtcacacattcatacttgctgacattggatgacacatcaagtaaaatcaatggcaataattttgccatggttagagactagttacgtgttttctcaaaaatgatatataatagtgtatagtatacttatatgagtgaaaaaataaaaaaaagtaaacagggaaaaagcactggatcaggaaacagaacatccatacttttatagcctcttctgatatgttctctcagaatgtattatcagcctaattcatgtgttgctgctcgggagttttctgccctgcattccaaatcttccaaatatagccgatattcaattctcatttgagttacagctaaagacagtttaatttattgataaaaccctggttggtaatctggaagatcaacctggttcaaatagtaaccatggcatctgtgtgaaataaaatttttaacaatattttaccaaatttaagaatgtatatgagatgctgaagaagacaaaagattctataaaggtgtgaagttccctaagaattttgttcttggatttttgtgaatcataattatttcaataatgctggaaatatattgcttgataaacatttattaattaatagagggcggttgatttttgatttataatgaccagtgtttgtagaattctgagtccgcagcatagcatgtagcttatgaccatgcacatgaccgtggcagcagacttgtatgatcttccccctctactaattaaggactaattccgcagcaagagtcatcgcaatatataccaaaccaaagtcacatttatttgatagcattattcaggatgccatataaacaataatgctcattgtgtaagagaaccatggccaaatattttgtccagacatgtacaagtataaagcagacttagctgagagctagagaaaaagacgctaaatacacagacagaactcatggatgagtaaacacaatttcagtctctataatctcatctgctttgtactctcaggatggatgccctcaatgggattggcactttctccattgctcctgcactctgttatcagcacttcgggttcataatgtacacacagcgtgagtatagtcaaccttgtgttgatttggggtgctcagaaatgctcacactgtgttgataaagccggcttatcatttgagatgagaagccattgccaatgactaatatgccatgtgacttaagatagtgtttaacagttttttttgtcaaattaagagttagttattttccagtgaaaagtattttgataaagcttttcattttataaatatactgagttaataccccatccaaaaataagagagtaacaaaatctatactcagcatggcaatatcttgaataatatcttgaatacgtatttttaagggccttattcttaaatctttgtgattcctaatcatttccatagcagtagtgatcactgcttaacaaagatgcagacattaatagaggagaggaggctgatgttggatctatgatgacctctggtgccgtatgagtcggggatcatgatcacaggtctgggagtctgaggtccacatcttaaaatatctagaatatgccgatcatctctgtgccaaatgctaaaactaatttatttctagaattagataaaatatcaataaaaataaatttgaaagtcattttctaatcaagacataaattacataacaagaatactaaaactacctaccaaacaatagctctttcacacttgatgcctgcgatgccatgccccgtgagctcaaattggagacaatgcttttggtagggtcagagccatgaaatagtataggttattatatatttaggtgggtgatgagcagaggggtaatttcaagtattaaaatgtgtgaataaattaactgaatgccaatatttttatattctgttctactttaaactctcagaatggattttctgcagctgattttctatattctgttttcttcgggtaagcagagtgagtataatcttgttgttttgtttgtttgtctgtttatagtattgttgaaagttttcctctcttctggaagaaatagcttgcccagatcataaatatagcatctgcgtgtcaaattaataatgtgtaaggaaagaaatatgccacagggctaatgacctgtcgctccccaaattaaactaaaaatcttgttttatttttttgtgattcacaattatttcagtatcacaattgatcagttgctcaattcacatcaagaaataaatacagaagagaagggctgatgtatttgtgatgatcactggtgccagatgagttatgcatcatggtcacaggtctgcgagtccgaggtccacattataaaacacctaaatatactgatcaccttagtgacagttgataggtgtagtcaacttttacagtttaataaaatactaagaaattggagagaattttacaatcctaatatacagaaagagtatatacactacatataccaaacacagtcgacctatgggaagtaagaatgccccattttattaaaattataatcagtaatcttagtggaactgtaagccatgacaatatattttattttaaaaaatgaacagttgtgtaacacatttagatcacaaaccactcacctttgttgaccttggatcctttatttttaaaattttacttttttcacaaggtatagcctgatcaaggtttcttctccttcatctccccccaagtcctccttcacactcatctagcgtttccccttcttgctctgtctctttagaaaacaaagactcaaacaataccaaaacagacaaaccaaaatagagccaaatcagccaacagaaaaaaagagaggaagataagcacctgaagctcactcatacacagatacaaatgcagacatagacaacccacaaaacgcaaagctagaaaattaaaattatatataattaaaattaatattatataagtataatataatatagtgcaaaaattaaaaatataagtatatatgtatgtatgtatatgtgtatgtatgtctgtatatatgtcatacctgaataagattaaagaaaatgtccatgacactaaatcttccaaatttaccactgagttcttagtgagttgtcctttgttgaacaatgaaataaaagattgtgtgtatattagagccccttcacaccctgttttcttttgtaccctcagaacagatgccttcctcactggtcaccaggttcaaggtccctcatatgtgtcaggtgcatagtcaccaacgtaagtcgaagttcttggtttgaattctttcttctgtttttataaaggcatttcctagaatttaaagaccattggtctagggagaagtatgctgtggccatgaaatgcttggttgactaattaatattattgaaattaagtttaatttaagcagacataataaccttaggcaaaggagctaaaatatttatgtaaattataattaaagatgtttttcatgattaataataatcagctaataaacaataataatgaaagtttatcggagaaaccagaggcggaggttggatcagtggtgacatcttgttggaggtgagcagtggagcaggagaacaggtccggaagtctgagtcccatcccttacaggcatctcctgtgctttcctccgaggtgtgctcaaacaagcatgttacctttccgattgtgaaagtgtgaaaattatgtaatgtgtacattagaacaaagccggtcagcagtgttgagcatgagactcttgccaactgagacacagtaataatccaggaaaccatgtgcatttagaaataaataagtacaaattacaataaaagttaagcaaacaataacaagagaaatgaatttcttaatgatactactagctaaggacaatgcatttaccaaaaataatggcaagtccttgtcttgttcagggcttaagcatttattattgccttgtcaagtcaacaaacctaagagaattttgctcctgcccatgtgactaataaaatagaagggggaatgagagaataattggctataatacaagtctccttcttggtactgtcagcatagacgctttcgttgtgatattcacattatgactccccagaacacagagactcatgttagaatgctcaaatcccctgacttaatttgggaggttttaaaagcttaaagtatcacgcagaatctattaaaaccaactacactgattagaaataagcatggccttccaccactaagctcattaaagcttgcacaattgagaaccacaaagaaaaacaaagagatctcatctaagtagtaaaagacactgtgcatgacttaagcatcttgtccctaactcttcttgattcgttgtcacctaagtgtcattaggaaaatttcagatttattaactaacaaatgtagaaatcaatggaactagacctatcttgggttatggacaaccactgtatttacagttctgtatatctgaagtccaccctgacccttagacatggttctccacacagatgtgagaacagtagcaccattatatcctgtctcgtagtattaatgggctcacaagaataaaatgcagataagaaagaattcttctattaaaagaacaaaataagattgaaggtaattcctactatattttggaagtgtcaggttttttttcttagtatttacaatatattcctcttgtctcatgacaaggcttatagtcttaatgatcaatgttattattttgagttattaaaatattctgtcctattctgtctctgaagagaaagtaaatctgagtaaacaatttgtaggtaaattgactggtgaaccgcatctcagtttattcttgtctgttctgtgccttccagaaaggccaacttcacatcaatgggtggatcgtacctcggcctaagctccaggattgattgtgctgttagagtcacagctacaaccgtgagtaataattacagtctcactttctgaatgtcatttaaaaaggatattccatacagatatttgatctgcttatagtgtccagaaaaaagcttgttgtcaccaacctagctagcactacctataatttgtacacacacacatacaaaaaaatgccagatgtcttggacacaaaagtcaaagtgaacttgggtccccttgatagttctgtgttgcgttggtgacaggatacaagcattgtgttattgattttggtattcatgggcttcgcttctattgttgcaatttcatatattaaaattagaaaaagaatcaatgaacaagtatacatttcaacagttaagcattattcaattatgtaaatgtcacaaaggaaagcaacctatcaagctaaattaaaaatattgaaaccaattcagggtaacttggggaaaagggccgttgatagttcagtggtagagcccttgtcttggatccgtgaagcgctgggttctatcctcagtatcacaaaatcaaagaaataaaaagataatatctaggaatgttagtttttttggacagtgatttaaaaaggcagtacatggtgtactaattatgaatatgaatatatgaatgattaatcaatcaatcataaccataatcagcacacataccgtatttattttggtttggaaacctaatatacctctgaacaatagagaaaattgaggcatgtccactgagagcactgtatcagattttcaaacctccttttcactttgttcccttacttaccgatgtgccaaagatggtggtggctgcctctgtgtttgtctcattgagattagattagtaatgtctcatttgcctgaataggcaatttctaaaagtatctatcccctcttaccttggaacactcagtcctaactgagatgtctccatcaaatcccttccttcagggctcagggaacccagtggaagaggaggtggagtgtgagagccaattggaatggaagacagtgaggaaacaaggccttcgagacacaagaggactgctgagctcacaaagactgaggcagcaccctcaggacctgcacaggtctaagcttgatgcgatctgagtactgagagggcaactggacacaattctatattgataacccagaagctttctccagttgataaactctttcaaaggaaaaacttgttttctaccatggagtgacactggatatagaaactaccgttaacagcagactccatggctcagacttccaatacaatatgaactcagttgcaattttttgcaaggtttttcgactcatagttctttgtctgggtactttttcaccctacagagaatttctgtatatattatcgtttctgattctagtgttttgaattttcgctgggtctaaatatctctgtctcagtgtcagtatgtgtttctcatgatttttctttgcttctctttttcctattctttgcttgtattccctggtttgtgtttgagtgtctgggaactctgagggtctggttggtgatattgttgttcttcctatggggttgaaaaccccttcagctccttcagcctttcactaagtcctccattattatgattcctatgctcagtccagtggttggatgtgagcccccccccccctctgcatttgtcaggctccggcagagcctctaaggagatagctatattaggctcttgtcagctttgtttgtttttattctgtcttctctatactgtttattttagataactgtgtttattctaatgtatgaatgaataaatgggtgtgtgtttgggtgggtggggaattggggagggtgggggtggatgtgggaggggaaactgtaacacaaatacattgtataaaagtacattttaataaatgtatttcttctatgact

SEQ ID NO: 22 - DNA, 24622 bp, Mus musculus
agtgtgtggtgtctgcgtgacactgacttgagacactccctttattaaaataagtcatatgtaaatgtaatgtggggcagttaggatgaggagctgagtgcagaaaaggatgctgtgattggttttatagttataggtccttactgtagcgattcttgaagaaagttagcacatgagtccagcaagtgtttcagtggctttggttgctgtgggtttaagatgttcattcacgttttctccatggtctgcatagccagtagcctgatgaaactctggaatggcagcagctgaaacgggtgacggtgacgggctggcttggggaagccctccttcccctcaggagggtttacacattgttgcagggggctgttgccctggggttttcaagatgcaccattttatctcgtagtgctgggctttgacaaacttcctctgtggggtaccatcctcatctcggtgggatgtgcagttttctgtgcccttatcgtctggttctttgtatgtcccaggatgaagagaaaaattgaacgtaagtaatacagtttaatagcgttcccctctccctctactcctctgttcccctctctccccctctctccctatcagactattttaggatagaggaagcatttgcctcaggtacctttgcatactcagatggctgtgtgacagtgtctatacacatacacactgtgtaatgcagacacacttttgcacactatccttgtgctagagctgtaacaacacatgaagaagtaaacactcttagaagtaaccttaagtcattgaaggctgtttttgcagtataatttaataccaagtaagttttatttggtactagtctttgtgtctgttttagtcagtcgttaagatagtttagcagagtccccttctgcctttcagtgtgtggaatgttggtttgtggatacacagcagaacaggaatgcatagactgcagtggctttagaagaatgctgcgtcattgcagttctgaggagccgcccagagctctgtgctcgtcagctgtgcggcacgcacagtgggaatgaagcttccaggactctgacctcatttttgtctcagtctggaaggagagacaaacctcactttaatgctgtgctagtgtgaggtgtctgagccagtaggtgactgctgagctggccgttaggcagaaatactgcctggctcccgggtatgcaagtgtttaagcctgccggttgcagctcagttgtctgtactcaggacctaagagttaggagattccttaggaaggctgactgtttagtcagctgccaccccagggcttgagcccccatttcatgaccaagagctgaagatggttttacacttgtaattataaaaagaaaaagccagcaatggaccagaaccctaaaatacttaatacctggcagttgacagcagtttgtcagcccccatttctgcaagcagaccgtgtgctactgcagggctgggctgtcttgctcctcctcaaggggaagatatattcctcaaataataaagagggcagcgatgttagcttgaattttaactagaatttatacctgttattttgagaagggtttcaggggtggatagagaggaatgtggagcaagatagtatcgtcaaatcacaaatcctctttatgttttaggagaagtaaagtctagtccgtctgaaagtcccttaatggaaaagaagagcaacttaaaagaagaccatgaagaaacaaagatggctcctggagacgttgagcataggaatcctgtgtctgaggtagtgtgtgccactgggccactccgggctgtggtggaggagaggacggtgtcattcaaacttggtgacctggaggaggctccggagcgagagcggcttcccatggacctgaaggaggagaccagcatagacagcaccatcaatggtgagttaactttccagggtttccagtgtctcgtggtggtggaaaggctgctactctgggctgatgcactttgcattgaatgttacctttttggtctcggctaggtgcagtgcagttgcctaatgggaaccttgttcagttcagtcaaactgtcagcaaccagatcaactccagtggccactatcagtatcacaccgtgcacaaggattctggcttgtacaaggagctgctccataagttacatctggccaaggtgggagactgcatgggagattctggggacaagcccttgagacgcaacaacagctacacttcctacactatggcaatatgtggcatgcccctggattcattccgtgccaaagaaggtgaacaaaagggagatgaaatggagacgctgacatggcctaatgcagataccaagaagcggattcgaatggacagttacaccagttactgcaatgccgtgtctgaccttcactccgagtctgagatggacatgagtgtgaaggctgagatgggcctgggtgacagaaaaggaagcagtggctctcttgaagaatggtatgaccaggataagcctgaagtgtcccttctcttccagttcctgcagatccttacagcctgctttgggtcatttgcccatggtggcaatgacgtcaggttagtccacatgactcttagtgttactatttttagacagtcttaccctcctgtgtgtactgctctacttctggggggacactgagtaatctagacgggatgaagtggtagtaataaagcaacaggaagttcacttggattgtaagagtggttttttagctttatttctagacaagataaacagatgagaatgagactttggtaaattgggacttcagtgatgaaaaacttaggatcacggacagccctgagaatagacttaaggggttattagccttgtttctctggccagaaagcttcattggagcctgagacttgctctaagctacacgtgagaggaacgagactaccagttacatgtatgtgccttctgtcatagccgctgtgtttggcttctgtaggatggtttgctaagtgcagtggtcagtcacttaacagattgggtctcgacaagaagtggttctgcctaaaaagtcatcggtgcccccttttttcttccagcaatgccatcggccctctggttgctttgtatcttgtttataaacaagaagcctctacaaaagcggcaacacccatatggcttctgctttatggtggtgttggcatttgcatgggcctgtgggtttggggaagaagagttatccagaccatggggaaggacctgaccccaatcacaccctccaggtgagtagtgaatcccgccctcggtagagctcaagcttttcaggagatggagttgtgtggagggcagcacgcgggtctccagctaaaggagtgtatggcagctgctgctgttcttctctcagttgatctgaacgtttctgctgcacttactgtctgacttgtaaatcagtcagtctgctcagctctagtgatcatgtaatttaaattttctgagaaagatatagtggagtaaataattatatacatggctttgatttgggagctaagaccttatactttattcagaataaaagttccaacatctttgtttgctttttgagacagggtctctgtcttggctggcctggaattcactatgtagagcaaactggccctgatctcagaattcatctgcctctgctttccaagtcttagcattaaaggcatgtgtcactgggcatactccagcttttaaataaatcattccagaaatacttaatcctcagatgttaggaccttggctcaatttaagtaggtttttggggttagaggagatgaccaggctttgtcactgagtagaacaaagagagattagaactgatggctttagctagtgttggtttctcagaagactctccattgttgacaaacatccctttgtatcaacagtggtttcagtattgaactggcgtctgccttaactgtggtcatcgcatcaaacattggccttcccatcagcacaacacattgcaaagtaagtggagtcgggacgtcatgggcccttgaagccgatcagtagcttggggatgtccatggttcaggtggatctggggggtggggggtgggggtggggtcctactacttgtggtagtaaatacactggttttaacaagtttgtgaggcttatttgtaagggcagtctcttggtgaaagcatatagacagggcctcttgggcctgtcgtgctgagacattgaactttaggaagttgcttggtgaacgtataacatagttattggataaagaacaaactgacttccttggaagagctgaatctggtccaggctagggcctgccaagtcactctctctgctggggtggtgttgggtcacataccagccgccctctagagtgattgttgagaaatcagaaatttagcttacacaaagcagggaaaaggagttttgtcatattttagcacatttagcaacagatctaatggctgaatatttatatcgcttttcttcaccttgccatgggtaattttagcttgttagaagttagcttctggcttgtgtcacatgcctgtaatttcacctcttgggattctgaagtaggaggatcacaagttcaatcctgtttagatgacagtgagaacaactgtgtcttttttccagacaaactgctgggttcatcgcttgtctgggttccctgtcccaagtgtctttttgctgagtaatgtctggtctgtttctctcctaggtgggctctgttgtgtctgttggctggctccgatcaaagaaggctgttgactggcgactgtttcgaaacatttttatggcctggtttgtcacggtccccatctctggggttatcagtgccgctatcatggcagtattcaagtacatcatcctgccagtgtgacgctggggttgaaagctgtgtcagtgtctgggaccattgtacacattcctgttcctaggagaacgctcacagtgttgctgaagacaggcaagggtcttaaaggagccgtgggaaggaagtgtaatttacactataattgcttttgtgctaaatatgacttatctcaaaattagctatgtaaaatagccaggtttccattgattcattccaaggtcccttttctcctgggctatgaattcctgtacatatttctctacttttgtatcaggcctcaattccagtatgttttaatgttgtctgtgagataacttaggtgggttctttttaaacagccaggcagagccatttgatggcatgtactgctttgtcggcctcaccagcttcttccccaacatgcacagggatttaacaacatgtaactgaagcttccctccctcatagtctctcatagaaatagtcacggcactctgctccctgtcactagtggcaggttctgttgatgtgtgacaacttcttagagggccgagaatctttggcacagtggaaatataagtttgtagtaacctctttgcaaacagttcacggacatgttgctaagaagcagggagacaaagccccctggcggttgtggttattcttctgagatttctggcagtgtgggatgggtgaatgaagtggaatgtgaactttgggcaaattcaatgggacagccttccatgttcatctgtctacctcttaactgaataaaaagcctacagtttttagaaaaatttctcttgtgctttttgtttttcttgagtcctcagagtcctaatcgttcagcctcgtgacattcttaggaggctgtgtacacctcccaaatggaggtgctgccaggctcctcactgtcttctgtgatcccctaaacgatgtggcctcacacagcaccttggtggatgaggttgatggttcctatcctgagaattgctggacaatgcttttgactattttagtttcaaaatattataattaaactcatgactaggccagcagaaggctatgcccaggaaggttggtcactggagaattctcagtaaatgtttgcacttaccgtcaggcacggagcacgtcagtgcttggtgtgtattgtcagagaagagacatctggaggctcaggctggctggcggtagaatgggaaagatgaacttgagtgttaaatctggatgtgagggttggaaggagatgctgagaactgggacaggccttcattcccaggactgatctatggcatgaaggtccaagtctctccacagtgttgtgatgacagagcacagtgctttccccagctcttcctagcctaggagaatggactcagaccaaataggaggagtccctagaggtgggaggtgacaccataagggctggcacatgctgggaagaatgctggccttcctttattttggttatagatgtttccttaaacattaaggtcgtttgtatattagaatcagcaataagattgagtaaaaggctgaggtcccttgctgcccttttcctgtcctgagtaagctacctccagattggttgactgggtatttgctgctgcataaacacatcactagttgtccttttgtttagttatattggcaggcacctggttgtcagccccaggggttctccacaggggtgatttttctttctgtctcaacagatgttgagacacatatttgatgctactgacaagaaatgtcatgagcattctacagaacctctaagatggaagaaacctgatatgaggcagttatagttgggctgtgtacttggggaatcccataggagaattcagaaggatgaaagtccagttgctcaggagcgtggtcaccacagtctacccacaggcagcctttgctttgtttggctggctgggtttcagttgccgtggtttaggtacataccggtcaacaacctggttcacacatcagtcacccggagaatgtgagtcgttgcgtaaagtgcaaacttcagtgctaggtcttgagtctaaaaaaaatcacatttagaaaatgccagctactcatgatcagtggtccagctcagcttcccaagtctgaagatgactgcgctgtgtgtgttacttcactcagggatgacagagagttttggctgccttacctcctcgaagtagaaacactaggccaactttgctgttggactttcctcaggcttgaatggaaataaattgcttcttaccattagacacaactcagtccagccaatggacagtattacttcaatccttaaagcttctgtcaagatggcctcttgtataactctctgctatcatatctagagatcttgcacattgtttagctggagtgtaagtggcactgtggcagagatgaataggaacccttattgtggcactgaataactgtaggaggcaggtcacccataactacatagatgctcgctgtgggagtttgtggaggagttcttgttagtgtgggttgggttgggtgggttttttatttatttgtttttttttttgttgttttgctttgctttggttttttttgagtccaaggtcttagtatgtagtgcagactggcttgaggtttctggctcctctaccactgtctccccagcaccaggataacaggaatgtatgactacttacatctgggactgccatttgagagactgtatatggacagccagagggactaagtgatggtgaatttaacaagaaaaaaggatgggattgtgatgacaagagcgcagatgtcccagacagaatgacactctccaaacttggtagtaagggatcttgcagacagggctcagtaaagtgcactgggtaaaatgttggaagctgacccaaaaaccatgtctatatacccagtatttaaaattacagtatattaatacattgtgcttagttttcttagtttccttccaattatacagggtttcttttctttctcttcctctctccccagggttttgtgactcaggctaggctcaaattaactatgtagctgagaattgccttgtttctgatcctcccgcctctacctactgggaagacaggcatgcaccacctcacactcgggtttctgtggtgctgggggattaagctctgagctttctgcatgctaggccagtatgctaccaacagaggttcatcccagctctgggtctccagtttctgagccttctagtggccagcttagcattagcccttcagggtgcaagtctctttctgtctcctgtaacatttgcagagcaataacgcatctccttccacttgccccgtgatcattctaacggccattttagtggtattgcagggaagacaaacacaaagttttcaatctcattttctaggaactcttggggtgttcataggttagtaacttttttttttttttaagtgaaaacttagggccaggagttaggtggctcagtagataaaatggttgacgtgaaagcatgtggggctacctagcaagttgactcagtgggtaaagctgtatgtcagggaagcctgtaggccttagtctagtacttagagcctacataaaagttaatggagaagccgggtgtggtggtgcacgcctttaatcccagtacccgggaggcagagacaggtggatttctgagttcgagaccagcctggtctacaaagtgagttccaggacagccagggctacacagggaaaccctgtctcgaaaaaccaaaaaaaaaaaaaaaaaaaaaaaaaagttaatggaggaaaccatttccacaaagttaccctctgacctacacacacacacacacactaataatgaattaaaaacttatttttttttcaaagagttaaaaaaaacagatggcaagctgacttgacttagtgggaaagggtatttgtggccaatcctgatgacctaagtttgttaccctgatgcctggacccacgtgatggaagaagagaaccaactccctcccataagccatcctctgacctccacatatgtaccatggcatgtgagtaccttgcccccctaaaattaataaatattaaatttgaaaaaaaaattgagtctgctggtgtattccagtaaacctagcgctgaggggtggagacaggaaggcctcagccttgctggctgccaggccaacaacagcactaggtggttaagacctgtctcaaaaagataagtcagaggacaacagaggaagacagctgaagtcaacctctagcctgaacacgcgcacacataggggtgggccctcccttcccccagtacgtacacacacacacacacacatacacacacacacatacacacacacatatacacacatacacacatacacacacatacacacacacatatacacacacacacacatacacacacacacacacacacatacacacacacacacacacacacacaccccccacatgtacagaatgaagaacgtactgaatgtttacatggaagttttttttcaacaattaggtgtaggagagagtgagagagcttcatttcattccccttcccagatgtatcaactgagggaatggtggtcagatgtctacatgccttttaaagaatgctgttcacacatctatgtaccgatgcactcatgtgtgggatctttctgacaaatgaaactactttgaaaaatactcatcctttgacaatttcattcatgtttataatgtattttgaccacatgcacacaaatgccattcctttctctcctattcattctggagttcctctttataacatatcctcctagtctcattcttctagaagaataacccactgagtttaacaacagttgcttgcctgtgcatgggtgtgctgttatatagtggatcacgggcaacttatcagtggctataccacttgggaagaaaatgattctccctctcttagtagttgctaactgccaggagcccctcagctaggggtggagcctcatgtcccttcccatattcatgctggactgctgcatggcactctgcaggtaaccacagtactgggaactcgtgcagaagacagcattttatggcactcctctccaccctccaaccatgtctcatttagagtggagaacttagtagttatttattcttagcactttgcctaattgtgaatctctgcattaactgctgtccactgcaaaacagcttcaccgatcaaggctgagcgtagcacagatctatgggtgtcagccaaatgcttagaaggcattctgacaacttgtccatgacttgaatcacagtaggagattcctaccttgggtctatgacctcttcggccataggctcttgggcaagggtatagtaccagacatttattctccctcctgtagcattaacctcagtcagaaagttgttgtttaaaaacttccataatcctcatgccacggatgtaccaacaggcacaccttgcctggcaggttggtgttgtaacacccaggatccaactctggaggaagagtgatggcttctccagtgggctgcatagcaccttctaacagtatgaaagcacccagtagaaggcacttccaggtcagtcctagcttgatgtcctacaactgacctatgtagtgtcttcagcagtaggtaagttctagacagtagtcaggagcaacagtcatagtttgtactgctttggagacctctgtggcctctgtgagcgacaactcatagggaggtagctggatctttgtttaataatccatggtttgtaggagtagcatcattcaccatccatgcctggtgtctccattcaaactccctctatagaaattatacctagccagcttcttgggcctagtgtggtcaggggccttagaagagagtctactgccatcagcttgctagaccagcacagttccttactacattctaaagcttatcctgcttgcacaggaaagtgtagctcccactcctcatcaaggaagcctccttttacagcaaaaggcaaccataacagaactgcaactggacacatgtagagatcaaggatgtgaggaacccaggccccagtgagttcatccacaccacagctccggcatccgtggctcaggggacattgcggaagagggggtggaaagattgtgagagctggaattccatcaagtctgctgtgaaatataaaaaagaccagaacaagggcaatatcaatggacaatttctgctttgtcccactccctagacaaagaagtataagtaactattgactgctgggagaaaggaggactggcctctcccaggaatgaatccccttattggttgtccgatctagaatgattagccctgaaattatatacattaaaaaaaaaaaggactcagcaggttgtatttacatatttgtgtatgtatatacacatacatagacatgtactcactaataatcacataaaaacaggctctcagcttgagagttggggggcaggggaggggctggagggaggaaatagaggcggaagtgatgttactatttcaattaaaatatattttaaggctgggctgtggtggcacatgcctttcttttaatcccagcaattgaggcagagacaggtggatctctgagtttgaggccaacctgatcaaaagagttccaagacagccaagggctacacagagaaaccttgtctcaacaaaacaaaagcaaacaaaaaataaaaatcatagcatatgaagtagtgggtttgcacagggcttccttcctgtgcatttttagtcttggttgacttgcctctaacccctcccattccctttccctcacccctgagttgtttattcttggtaagcccccttggagtctggaagtcagacggcttcattctagaatgaatgtcagtcctgaatcactgtcaccagtaagcttcctgtcctaagagacacacactacacaatcctgccactgctcatttgcaagtggccttaagtgttgcaaggtaggccacgctgggccacgccaggttttcaatctttattacctgctcggcagcaaataaaaatgtctgctctcctctgccgccttacgctttcacctccaggcagtataaagtgctggcagagcaaaggtggcccattaaggcttgctcagtaaatgctctggtgttctttgtaagacctcacgaaacggagtgcctgctctgctgagcctcccctcttctgtaacataggatgtttgcacgcatcttaattaccatgtcctgcccttgctttcactaaagccttgtttagtgctttgcccttcttaataaggtcactgcatccactctatcctactgctgatctgcctcaatctttacctggtctaagaaaccttaattctttaaatgcctgcttttcttgttttcttctttctttatctgtgcatgtgtgcatgtatggaggtcagaggtccctaggtgtctacctctattgccgtcaaacttcctttttgagtcagggtctctcagaacctgaagtttgctatttcaatgaggttggctggccagcaagccccaggtgatctacctgtgtgtccctcctccgagtggccgtagacacgcattgctgtgctcggcttctatgtgggtgctaggaatctgaacccaggtcctcaggcttctgcagcaaatgccttgcccacggagcgatctcctcatctcctacacttttgctgtttcatgtgagagacaagaaaattctgagggctgagaagggtcaggcagctgggcatcaatggagagtgtgaagatgctactaccaaacctacttttgtggtggagtatacttgcggctgtgaaatgaaacacaggctgctcacgggtagtacttgccttccagaagactgggctgttacagccggggatggtgttgagtggttggtccctgctgagtacactgtggtgcagtgcagaatgcttctttttaaaaagagtgagatggttatttgctgggaaatggtagcaggtctccctgactgggatattattgctgaagacctagatagcaggtctccacttccattcattctatttctggaagcaaatgttctctaattgcaggctggagctgaatgcttcacagtgtttcccactgtgctaattggaaaaatataattttcaactcactgtgtcctgctttgcacaataacggctggcagctggattcccagttcagttcttcaagtgaactagtattttgtagtttagtgtgaaggacaatagacctttcagggtcccagagagagcctatactgtataaagaaccactggagaatgtcctctggtctgaaaatatataccaattgacttctgggttgtcctaggagtctttattaaatttaatttctattaaaatgtttggggagccagctcttgggaatactaatcaatattagttgaacagtcccatgatgaatcttacatgcaccttattgatctggaatgaaggtaattttcttttacctgacatcttgtctgtctcctggcaagctctccgttggcctccatgtgttcaacctcaccagcattttgagactcaagtcagcatgggagcagagagcgggtaagtagtgtttgtgtttagaatctggttttcctttagagcagtggttcttaaccttcctaatgatgccgccctttaacacagtttcttatgcggtggtgaccctcaaccctaaagttatttttgttgctacttaactcttacctgtaatgttgttactgttacgaatgtctgtgttttctgatggtcttaggtgatccttgtaaaagggtccttcagctctaaaagggtctcaacccacagtctaagaaccactgctttagatggctctatctcttcgtatgtagaaacaccatctacagtagaggaaggctttgctctcagagcttcctgtggaagtagcggtcttgctgtcagtggtatgcctcccctgtgcggcctgtaggctgagaagtacaggctttgggcccggacatgtctgggctcactctccagctctaccacttacagttgggtgacccaggaggctaactcattcattgatatgtccgttgttcatccaaaagatggggatgacaacaccactgacatcccagggttttcatgaggattaaataaaatgatgcatgtgatctggtcaatgacctcagccttctctgtcatgtttctgagaggctgctactctccgaacaggcttttgcagcagctgcttctgccttcgttgcccccttcctgctttcctcttcttcctcccgaggttttgctgtgtctctcaggctggtcttgtgtcttgggcctcagcttcctagctactgagattacaagcttgcctggctttgcaattctcccggcaaggtaatagtctactaggcactgattctccgggcatcttactttgactgtgtgatgtgacaagcaggttttctgaactggtaacttcatctcaagtctgagctatgagtatatgaccttgaattgcctcagtttaggttgagctgtgaatgatatgaagaaatgaagatggtttatttctctccccagcacaagaaatctcagtctgttataacagctccagaatgatcagggtacaaagacaggatcttcctttctttctggttctatttttaacatgtggttaccatctccacagataagtacccaaagtcaccagatatctgagtaatagcaactttgatagcacaactgggttctaatgagtaggaactagtacatataccttattcaggcatatgtgtaagtcagtaggtaggtacacatcccactcctggtaccaatctgcatcaggatccagttagaagacagagatcataggtttaaaccatatgggtgttttcctcaattactctttaccttacccattgaggcagcttctctcagttcatcacagaatttgtcatgttgtctggttttgttagctagcttgctctagggatcccctgactccaccttggggagctggaattacatacaggtgacatttacttgagagctagagatctctggttccctcacttgcatgggagcgcttcacccactgaagcgttgttccacaccccgccttcaaataaaagttatttcaacagagaatttagactttgaattttagttgttaagtaggtgtgaagtgctaaccaggcaattgagacagcagggggactctgaggcatcattgatagcaatgagaaggcaggacaaggaaagaaaggatggagttgccaataagagaagcctacgacaaggacaggtcattgcctaatttgtgtgctgtgtgctctgtccttgtgaaacagtcttaaagatgaagttttttgggggatggtggtgcaagattgcggagaacagagtgctagtggccagtgaggtcaagcattgtgaggcctggccagctctgtgagagccaaaggatatacacgggaactgagcacatgagaagagactgctgagtgaagaaatcatctttccggaagaggaagcagacccggagggagttccttttcctttttccagtccccaaagctctctataggcagcgaacacctgcagccattggcaaacagacttggaagagttcccagaccaccaccggcgcacagcaggctgggcttgaagttgagctgccacagcttcccagaccacacccctggtacctgctggcatcccccttgcccactccccacccccgacgttagtgtatttcatgctccatggaatggtgtgttgtctgacaggtgagactcagacatgatcacatgaccagcccatactaagtgacttcactatctgtgtgtggatcttgcctgaaccactaatcactaatcactaaggtaactttgtaagtgagtttctatttgtcttattcctcgaacaattattaggcagcattcactgtaaagaagaatcatcttctcttgttgggtggatttggagttctactgaggattatgaggaggtcagatacacacatgtcaacccccagggttctctgtgacacacctaagcttgcacactctcttcatggtgtttgaatccttgattaactgaaattgtagaaacttcaagcaataagaaggaatggcagcttgaactcatgttagtgtcctttatttagcaccattattctccagggcaggcaaaaaggtccagtggttctcagccagggctgtgcattggactcaccttgatgcttggatataggtttctggaagagacctatgattccatataggtaaagcctgggtgtcaagatgcttagaccctttatagggactcagtattcttgggggtctgagaatcccccccccaaaacagcctagatagcattcaccaggacttctggttagagtccattgggcatgcttggctaaatggaaccaggaatgtatgttggtgtgacttgcttttaaatcagcacgttcaaagatccatctgctgttactgtgtggccactgacatcgctacagatttgatttattaccttcaggaagggtcactgttctcagcatttactgcagttcccttggttcaggtccaggtaattggccataagtactttcatgaccccaatttcaagcttgtttgagctatgtggtagtgggaacacagttctctgtcttaaggatggagtgagggccagttcagtaaatacagggataagtaggttctgctatccattgggccttgtgctatatactgaagattggtgtgtggtggctcacccctgtaattctggaacagcagagatggagccaggagaattgttgtgaattccaggccagtgtgggctgcagaatgagatcctgtctcacaagagcaaaacctggcaaagcaaaacaaaaaccctaaagatcaagtagcaatttgctgtcaagtattttatccataaaaaggtctaaagaatcaggtttggatagaagtaagtcatgaagtgcgtgcttagcatgtaggaggcttagtgtctgtctctagcccctgaacacaaaacccacccaaacagtaacaaagaattaaataaaataatgaacaccttggttccacacactggaaacatttatttcaacattttcataagatcatgcttgtaacttgatgttcaatagtttacacaaacctgcatggagttgcaaaatgcaatgaagtcactgcatggaaagaacacacaaaaagaacccataaaatccctggcagcattttcaaagttgcatagctaaaaaacaagtttgttctatttatttatttatttatttatttatttatttatttattcatttatttattcaagacagggtttctctgtgtagctcctggctgtcctggaactcactctgtagaccaggctagcctcaaactcagaaatcctcctgcctctgcctcccaagtgctgggattaaagacgtgtgccaccaaggcatggtgaaaacaaaatgttatggggtcagtgggatacttgaatgggcaaaggggcttgactggagtttgaaccctggaactcaagtaaaggaagagggagagactgaatctacatcatggtcctgtttttcacatgtgctatgacttgtgcacccacatacacacttcaaacacacactagtaataaacagcttctaaaggttgcacgactgtaacatgattaaatgacaagcatgttagtgcccacttcccagctttcggcttcagagcctggatgcttccttcctgttattaactgcacatggcacatatccttaaggcacatacaaccccatttgcatgtttttaggccatatgcaaatgatcttatggttcatgtcgtctcatactcgttatctttccttttgcttgacgtggcaatgaaatttcccctggttaacaggtgtagatctggccactcatgaccaatttgttatttattctaatcaacatattggtgatttcatatgttgggcaattcacaagagcacttctggtttgagggtatgataaatggtagagttgttttgcctagcatgtgagaggccctgggttcaatcactgagggaaaaaaagagtgattttactagcaccctttgggggtggggtgcaggagatagaacccaaggccttgaacatgctgagtatggtttccccagccatgaattaacttttaaaaatagtttccttgggtgtttctatccaaggctagagttgtgtgttttatcatatgtttgcctttggttttagatactggctaagtcaggtggcactctcatgagcagtaagttttagatctgcactttggctagcacctgatattggcagactttccccccacccctccctgggccccaaatatgttatttgttacacttaacaatcctatcaggtatccattttatttcagataaagactctagtatccagtgttaaattccataaaataaggtgtattaagtaataggcaagttggatctgactcagttccgctagattccaaagctcttggacacgaagtcatggaaacatagaggaacttctcagactgtcactagggcagagtacaagcaggtgttagggatgggtggagactcaggatttaggagggaacgaaggtcataatgggaaccacttgtctacagctccagaatgcaaggctgtggttaggaagggataactgacctctgaaaaatgtcatagattctttgaccctctttccacacgtgtgtaacctgggctgatcctccctgaaggctcttcaactgccttgctgcatggacactgtcagaggtgtcagtttccctgtccacgcctaagcactctggaagcatctgcttctctcagaccgcttcctctgtgggaaaggtaatggctgtaaaagaattccgactgctgcagggcatagtagtgcatacctttaattccagcccctgggaggcagaggcaggtgagtttgagaccaacctggatgactgagtgagttccaggtagccagggctacgtagagagaacctcttaaacacagaacaaaacaacctccgaaactggtgctttgtgggattccagctgcctctcatgcgccaccatgggagtcagccatcttggaaggtagtcttccagccctaagggagatcttccatattcaggagaaaatacaatgtttgattgttatgttttgtgatgtagcgatgctagggctctagcaatggtagagattgaagtggagatgtttttatcctttgtagctaccacaaaatattcggatttcaaggctgtaatacccaattcaattttcatgagtttacattccttgtgctatgtaaacagtacattgcgaatctccaacctgtgacttccgaccctctgttttaattttcccatgttctgttctggcctttgcttgaagtgcatacttaatttataattaaatatgtaattatgggaatagataaatacaatttagatttcctatgttatataatttttagatgagtttgaccaaaggggaatcagatgataattaggatggcacaaattaatcagaaccggctgtaactgaccccctgcttgtctgtctcatttactgctcacggaactcagtcgggaagtcacaccatcctgaggagaagattaaggcactgcagatattgagaaagccacttgaggtcacagtctgcacaagagggaacatgtcacccaggggtggaggaagtacaaagaggcattcaactggcacaccagtccgaaggcgacaaggcgttgggtaccgctcagacgacttcgtccgaggtgagtgcgtgttccgagatcatttagaagcttggtaacctaaacttggtcccaggaaccacgtggtagagagaaagacccgactcctgtaggctctcgtctgacctccatttgtcctccacagcatgcgtgtccatcacatcacagaaagcaaaagctacaagcagagaactccgtgtgtactttcataatcctttccaaagaaaagcctgcagcctcaggagatctcgaggccacaatggataccgcgaaggcttcagtgtgtgcggagagagaggagcatctacatgaaatttgaggtctgagtgtatgatctgaaagaacagggaaatggaatacaaggggttattttgggctatttgggggttgggttgttgaggtatcgaaatattattaacatttcctatataaatgaatgacataggtgtctgtttccaagactgatgggcataagtcctggcctagggatctacatggtagaaggagagaattgactcctacaatcgtcctctgacacagaggtgttttggcacatatctctccccatcacaaacaaacaaacgcatgagtgaatgaatgaatgaatacataaataaataaagcgtccaagaatgagccaagatacagtgttagactaaagacagcccgatttacaaacacgactaaggacagcaaaaatgttactggcgggcatgcagtgtgggcgttcccagtatggcctacaggagatctctgagactaggcagcttcacaggccaagcctgggtttgccctccccctcccccatttccccccacctctgcctgtccaccttggctttccgaagcgttctgctgaacagagcagagtacacgagagagaggcactgggttaacttgaagaggtgtggtgatcagaaaatgccaggccagcggagaggatgcgtgttttgcagagatagggaggctgttcctggtactgctttgcagagccctagtctggcggacaccaggtgatggctgcctcattgttcctttccttctaagccttccagactctcgggggcaggggcagtggagggggtggaggcagtgactggggttggggcgggctcaagagcaggccagttcatcaaggccctttggctctaataacaccagattgtttcccaggcacaatactacacgacctttctcaaagagttttgcttgtgccttgtggtgaaggacaagccagagcactcagtaacagcaggaatttggccttgtcggctgtggcggccacactcgtttcctatgtagttagccttacccggtgctcatacggtttttggatcctggggctggcgggaaatgctcaagatgtaatgaaggtgaggctatgaatctcacgatgttggaggtagcatcttctatgagacgagcattttgagcccccttccctttgagttgcttcagtcctgagggcaacacacacggggtgtctgcgtttccagccctttccccttcccagaagctgaaaatttctgttgggcacataagtgattccaagttgaagccagtcaagactggtcaagtctgccctcttccaggacagacgggtgacaaagtctagtctgtctgtcagggtgaatttggggacttttgctgggattttctgtgaggggaaggaacatgtcatctccagtttacacggagcactggtccaagcctttgtcaaggacctgaggcaagaagccggtgctggtgacgtcagtaagctactgggtcctgccctttataagatggctgggggtccaggccagtttggggctgcttctttacggctgagacagtcctgaagcagccccaccaggtgccaggcatgctctgaatagagttgcctggaagagacagaaatccctgatgcttgggggagaacaaaacagccagggccagagccctgtgagcaggcagagctgtgggctcctgggcaggctgccctggctgccctgctcatcccagaatcccctggcagatcagaggcagaacctttcttcctagaggttagagaggcttcatttcatttctctctctctctctctctctctctctctctctctctctctctctctctctctctctctctctctctctcgtgtgtgtgtgtgtgtgtgtgtgtgtgtgtgtgtgtatgtgtgtgtgtgtgtgtgtgatgctgcctggggttgtgggcagcagaactgtatccacgctatgagcaggcacctgtatcctgcctccacccttccccatccccacttagtgcctgcaggtcaaaactctgcctcctcccggtctgctctctgcagctccttccctctgggtccaccgatgagcctatctggcgccttttcacctatcagccccaggcagatgcaggcctgcgggccccaccccagcagcactgcctggcctttaaggtgctctgcgggtgatcccatcttgcactctgccagggtctttcttgttccatttctgcctgattttcaataagattatattcttaggaggactagaaaaggaggaggaagaggaagagtaggaggaagaagaggaagaagaggaaaaagaggaggacacagctgggagaacaagaaattatttaaacggtaatataaaactgcgatagtgaaaatagttgaatactactagcccaagaacaagcattgtcttattggattagagttgaaaattatgaaatagacatacatgctatgagaatttactctctggggaaagtgggtaaagcctaaaccagtgtttctcagctggggctggcttctcctgccaaaggacaatttaaagtccgagtttgaaaagattagtcagtgaaccctttaaccatctctaataaggtccagaagaaaacatttatccttgtgataagaatttttacagggcacaagtaatggaagtaatatcagtacaggtaacccacagtcatacaagggcacagatcagccacatacaaaacagcagctgtaatagaggaggcaaagagttaatgtcctcaatatgtaaagagcttgcaaaaataactaagaaaataaaagatcacaataaaaatgggcaaaggaaatgcatgactaggaatgttatttaaaaaaaagaaccacagagcccaggcctggtggcacactggcaagggcttccagggctcgggaggaaaaggaggaaatggtttgctcaaagttcaaggccagcttgagttacatagtgtggtcagatcaggcaaggctccatgcaaaaacccgcagtagggtgagggagggaagatgacggaaagaaataaaaagagggaaagaaagagtgagtggccagccagaaagcaccgtggtacatgcctgtcatccagcactgggaggcaggggtaggaggctccacactttgagaccagttaccagtggggcttcgtaatgtgactgaccgtttcagcggggaggggactaccgagggctaacaaagggtcttcagtcttctgcaatgagcagaattttgtgtctttattgatctgaacaagttgagaagcagctaaaaaagataccatcctgtgtccgcatcggcgtagcatccaagagaaaggctttcttggatgatgaacagttgtgcggttacagcactttgggaaccatagactttgcatgcaataaaatgcacccattttcagtatatggcaagatagaataagcatgcagaccaaggtaaatataatcacagtaaagttaagcaaattttaactggtaaagttcaggatctgtcaccgtccacgtcccctcttacttactcctttgccacaagcctcaccggtacttgctttcctttggtcttttctagaatttcatggaaattagagtaggcaattgtgcctgggtctttaatccccccctttttttattgctgagtaatattctgttgcataagcataccataatttttaacgactttcatttttgagctgcagtgacctttggagcggctggcgggctgcagatgggatgcgatggatctttgcacatcctctccttagataagggaggtttcttgcctctcagagtctcacataatgaagagtagatctagccttctgcttcttgtttagtgtatttaaaaatatcattattgcacacataaaagaaacaaacttgaagatgttcaactaaaaaaaaaaaaaaaaaaagaaaagtataaattgtcctatcagctccacaaattgatttagatgttaaagagaccaccaatccctcaccacttgccccttaatgggcccaccatttttttctagaatgcatactttatctttccctttatgtagacattaatatatttgtagaataatatgttgccttttacttaaaaatttcaaaacatttaaaaataagacaagctaggcagtggtggcccatgcctttaattccagcacttgggaggcagaggcaggcagatttctgagttcaaggtcagcctggtctacagagtgagttccaggacagccagagctacacagataaaccttgtcttgaaaaacaaaacaaaacaacaaatttaaaaagtggctggagagattggctcagtggttaaaagcactcactggctgctcttccagaggacctgggttcaattccaacacccacatgggggctcacaacttctgttatgactgcagttcgaggggatcaaacaggctcttctatagtctgagggaaatgctcatacatgcacgctggcaaagcactaatacacatataccaccactaccaccaccactaccactactactactaaatactaagaactaaaaataaaaccgtatttccatgttcttgacttacacagcaacaggacactctcccttatccctgatacctggatttgcttgtttgtttgtttgtatgatgtgtgtgcatgtgcacactgcagagacagagctcggtcattctgctttgtcattttctgccttattccctcgagacatccaatggaactc

SEQ ID NO: 23 - DNA, 14899 bp, Mus musculus
ctggcccgcccgcccagcgaggaacctaggtaggccgcgggcgcccgcgcccatagccccccatccgggagcccgggaggaaagggacagttgaggagctcgtgcgctccgaggaggctgcagccctgcgcgcgcggcgagccgaggccctgggatccgaactgccacctccgccgccgccatcctcgaagcctccaggcaaggcctccaggccgagccgctccggagctgctcacccgcgcccgggcgctccgaatccaggaacgtgagcccccggtctcccttctccaagagagcaaagccgccgcgagcgggccgagtccgtcccctcccgccttggctccacgtctccggctcgcctgcccgagtcccgacgccccgggaaaaggcttccagggtccccagtccaccccacccccggtaccgctcccacccggacccgcgtcccgagcttgacactcccagcctccgccacctccaaccgcagccccagcccgcctcacctcagtcggctcccgcagcgctggacacaggaaactcctgggtcctcgactccggctctcctcgacccccctcttcggttaactccgcttgttttctcgacaaaatggcgcccgaggtcgcgcgctcacgtcgcggcctttcccctcccagttcccatttcaccattcgctgcccgctttggcggagggatggccctagcgcccagccaatggccgcgcgctgaccgcaacggcggtccaatcgccgatgggtacccgcggatttaaaccaatcacacactaatcactcgcagaagtcgaggaagaaaccaggctcctgctagcaaccaccaatccagactcctagtttgcggggctcaggccaattgccgctcatcagccctgggactgggtccgagtctgggcgcctgcgcacccgggtgtaagccaatggttagacgttgggaacttcgatttgggactcgaagacataagccttcgaggtgttcgacctatggggactggctggtcattgcctccgggaaacaaaaaaatacggaagggagctcgttaatgcattgccaccctgcgcacaaactactctaacttagagacagggtgatgctcgtctactttccttcgtctttcgaaatgtcacggtccgagaggctgtgcgggttcccagcggaagcattgtccacccctcggatctctttagcaaggagcaccagtcatcagaaggcgtcagacgcggggcaaagttgaggtcctttgcatcctgggttatgtagtcgcacgccccgcctattcctgtcgcaaaagtaacgtggtctcttccatcactgtctgcgccctagagcagcaatgcatgctggagaatgtagtctcccagatgcccacctaatcctggctcttttaaagtttgttttccatttgtcttttgaagcagggacgctttgcagagatatagaaacagaagttctcctcctgctcttggctattctcaaggatgccaatgccttttgcttcttggataaaaggctacgttatccactgtgtcctcctatcttttagactttttgtttgagttttgaaacaaggtctctttcagttaacccaactgtagtccaggctggcctgaaacatactaagaagcataaattgaccttgagctccttgcaatcttccaaaatactgagatgataatagacgtaacctctcataccagtactatttgaactttaaagagatgtgttaaagacttttattacttattttacgtgtacaggcgtttgcttgcatgtaaatctatgcaccatgcatgtacaatgtcctcagaggtcagaagaggatgcccgtccctctggaagtgaacggttgtgagccactgggtgggtcctctggaaaagcagccagctcttgtaatctctgtgccatctttccaacccctagatgaaaaaaaaaaagtgtctgagtgcttgcctatatatatgttcacctagagagtgtggacctggtacccaggaaggcattggatgccccgggactgagatgagagtctcagcagtaaagttgtaagctgctctatgagtgctggaaacccacccctgcacctctgcaaaaacagctcctctccagcccccatcttgaactttttttatcaatgttttatttgtgcaatttagcaatatgggggttgtttcgttttgtgggttttgttttcttttgttgttaaagaagaagagagacaaagatgaactgagactgttctggagaagggggagggggacatacaagtcaactacccaagatcaattctgtaattctacaaccagtttagttcaagcttcaattgcccccaaactgaaggtaagctgaaataaagctgatataaacggggcctcctagaggagattcttaagctcactgcccatctctcctcggaggttatacatcactactaaaatctgacagccataaaaactgagccaggattttcacaatgccctaaaggtcaaagtcctttgactgtgtatctaggctgggtggttcttgtctttcctaaaatggctgagaagaccttcataaaggatctagaagggtcaccttctaactcagcaattacgaatgtttgctttcaaacatccttaagaacaggatgtcctaacgagcagacgagctcacctggctgattctcagccttcttcccaccctccctgtccgactttcacaaaatatcccggggctaaagtaaaatacaacagaagaacttggtgttaaaagtaaaaaaaaaaaaaaaaaatttcttaaaaatttaaaaggtttatttattttatgtatatggaagtgtagctgtcttcagacacaccagaaaaggtgcacccaatcccattacagatggttgtaagctaacatgtggttgctgggacttgaactcaggacccctagaaaagcagtcagtgctcttaactgctgacagttgatggctcctggcgtatatagagagttttataagttcactgtgctccagtgaatgccccctcatccgtgagtacgcaggcagatcaaattggtctcaaaaaaaaaaaaaaagaaagaaaaaagcaggcagacagagtgtctcatacctcatgacctgagctcagcactcacatttaagacatttaagcagaagcagtcagatctctgtgagttcaaccagcctggttccaggacatccagagctacatagtgagaccctatctcaaaggtggtagaggggagagacagacagacagaggggacaacaatgacacacacaggctaacatctgggcaggggcctaagaggtgggataaatatgataaaaatacattaaatacatgtatggtattctcaaagaagtaactgcaatattgtgttggtttttttttttttaagccctctgaaacaaccagaaacccacttcctacctggactatatcactagcttcctgagttacgctgggtgagttacttcccctccccagaggggagtcagcacagagcctctagtgctagtcaagtgccctggcccatttatttgttcttttgtttgcttcttgcatagctctgctgtgttgcctgggtggaactcaaattctcagctctacctcagcttctcaagtgcccggaatctaggcacagagatagagggtatacttgctagccaagatctgtagcactgagttccaacacggccctgtctttgtttttaatcagccaacttgttctaaaaatactatgtaatctcatccacactttatgtcccagtgaggtaggggctgagttagtcactgttttttctggatcataaaactgaggcttgtagtagagctcttgttttgtatgccagcaataacaagctaaatttaattttggtttgccaggttgtttgtttgtttgtttgttgagctgaggactgaatccattgccttgcttcttagtcctatgctctaccaccgagcaaaatccccgaactctttcatgttttaaagacttaattttatgattgtgagtgttgtgcctgtgtgtttggatatgtaccattgcatgcctggtgctcaaagagccagaagagagctcttgtgggtaccagaagaaggtgtcaggtacctcaacccagaactggagttactctgtgtgggtgcttgttacccaggtctcttgggagcagcaagtgctcttacctgctgagcactgggtcctggttgtttgtttgtttgtttgtttgtttgtttgtttaaatacagtctaatgtagtccagggcggccttactttttaacagaggctggccgtgaactcctgatatccctttctcatgtgccagcaataaatggaaaggtaaagaagttaacctcctggccaaaatccaattctgatcaatgacaaagaattaaagcacaagttttgtgtggctcgcttttaaaaccccaggggctgtggaaggaacacatgattcctccgagtaaagatgcccaatagtccccattaacctgaaactccaagagactttggaaactggggacagcattaccattggctaagggagctgccacattggggaaggtggcaaagaaatgaaccacaaccagaaaaagctgcccctgaactctaggctccagctgggagaggagcggcctaactttagggtaggggcatctggaagctgagcatttggagggctgccttctttgtgagcagtcaagcaagggggggaatggacaaggtgtgtgggctgtcacagtgacctgggagaaagctgtttctgtggtatgaggggccaacagacagagctaagtgagtcttggaaaggggaagatagcaagagctggaagaaagaggagttccagagagatccacacgtgtttaaatgtgcttagcttttagaaaaaaattatctgtagactagggattgacgtgagtcctgggttcagttcctctcatccatctgtaggtgctgggaggggctcagccttagagagctggaggaacaatgcattcctccttgttctttgatcatcctgggccctcctcctcttgacatttctttcctggtgtggaatgcttttgggagattacccactttgagcaccccatatcccagctgataaccactgtaagaatgaaaggctgtgacacaccaccctgtcaactggacacagcctagatcagattggcctgtagacatgtctgtgggaggttttcttcattgttgatggagggcccatgtcactgtgtggcatcattcctggtgcaggtggtcctggcctatgtaagaaaacctaaccatgagcttgtggtccaactacctagcagcatcccccatggttcctgctacagttctttggctgtgagttccttgcttaaaggaaatgctacatggaagagcaagctatcatcagtttcctgcttgaattcttaccttgagtgccctcaataatgactgtgacttaaagtatcagctagatacatcttttcctcagttgcttttgggtccaagcattttatcacagcaacataaagaaaactagaacacaccacaatgtcacccacacaccacagtgtcaccctcgctccccagaaagacttgccttttcccttctctgttgatatagggaatccaaatacctgtttcctccaagaaattgcaagccaggtcagcatcttcctgcaaacaaaaaagcccagaggtcacgctgcagcagcccgtattgtccagtatggactcagggaaactggtagtcctggggtctttttcaatcctgccttcaatcagccaaaagtggccctttgctgagcctgtcccactcccagggtcacaactgctcaacactcaccctggatcagaagaccctcacctccgttgtctcttcatctgagcatgggtctctcctcctcctcttcctcccctcctcctcctcctccccctcctcctcctcctccttcttgtttaagttttttttttttttttttttttttttttttggtttttcgagacaaggtttctctgtatagccctggctgtcctggaactcactctgtagaccaggctggcctcgaactcagaaatccgcctgcctctgcctccccagtgctgggactaaaggcgtgcgccaccacgcccggctttaagttttttttttttttttttttttttaattttatgtatgtgtgtatactgtagctgtacagatggttgtgagccttcatgtggttgttgggaattgaattttgaggacctctgctcgctccggttggccctgctcactcctcactcaggtcaactccgcttactcaatccctgctagctccagcccaaagatgtatttattattatacataaatacactggtgctgacttcagatgcaacagtaaagggtgtcagatctcattacggtggttgtgagccacccatgtagttgctgggatttgaactcaggaccttcggaagagcagtcagtgctcttacccattgagccattttgccagccccgatctctctctctgcttgagacaaggtctccctatgtaaccctgtgcctggctcatctttgtaagttattttaaaattttatttggtgtatgtgcgtgcatgtcaaggtctgagaacaactttctatagttggatctctctctctccttacacttggttgagggaggagctctcgtttctacccctctgcgtgctgcaacctctctggccccggagttcccaggtgattttcctgtcttagagatgggagccacttcacccagctttttgtgggttccaaggattgaattcaggttgcctttcttgattggcaagaacttttgcacagtgagccgcttgcacctgtgagggaggcctaggtggagaggagccatgagggattccccttgaggacacagatgaagaaggaggcctgggcacgaccaagatgtcaggtcatgggacacgtagctggaaagtaggctgggaaataggccaggccaggatacagttgggttagaagagcttagtatatgcccagctatagtacatggagcttattaataaatataccaggtctccgtgtcattatttcagaacaagggcaggcgtagaaaagccctgaagtttttttctttcttttttttttttttacagcactggctgtcctggaactctctatggagaccaggttagcctcaaactcatggttccgcctgcctctgcctgctgggttgtgggattaaagacctgtgccaccatgcccccagctttgctagcctcttctctctgaaaatagtctcctgctttcacgagagcatattcattaccctcacttttcccctccctgctcctcaagacctacctcttcagccactctcattgccctattgatttatttgcatgtgtgtaaaatatgtgtatgtgtgtgcttgtgcatatgtgtgtagagaagatggagtttaatgtcagatggtccactctgttgctcttcactttttatccttgttgttgtttttgagaacagggtctttcactgaacccatagctcacagactggcttgactagatggccaacttagctcttgacgtgtgtttgtttctacccctcggtccctagcacaaggatcacaggcacacaccactgcacacatgtaggtgctggggatcaggacacagagcttcatgcttgcatgacaagtgcattcctgactgagccacctgcagcccttcctagtcttcctttctactttcatgtcacacactcactaacgtctaaatctagttttcatgtagaagagaaaacatgcaatacagctctctgagagtttggcttatttcacttaacgtaatgctctccatccaggttcatcactttcctctggatgtgggtttttgtttgtttgtttgttttggttttttcgagacagggtttctctgtatagccctggctgtcctggaactcactctgtagaccaggctgacctccaactcagaaatccgcctgcctctgcctcccaagtgctgggattaaaggcttacgccaccactacctggctggatgtgataatttaattcttttttttttttttttttttttttttttttggtattttcgagacagggtttctctgtgtaaccctggctgtcctggaactcactctgtagaccaggctggccttgaactcagaaatccgcctgcctctgcctcccaagtgctgggattaaaggattaaaggtgtgcgccaccaccgcccggctctttttttttttttaatagtcaactgaaattcccttgtataaagcaaaaacaaatgaacaaaacttccatgtatatgtacatgtatatatatgcgtatgtgtgtaagtatgcatatgtgtatgtatatgatatattcttcttcttcttcttcttttttttttttttgttttttttgagacagggtttctctgtatagcccaggctgtcctggaactcactttgtagaccaggctggcctcgaactcagaaatctgcctgcctctgcctcccaagtgctgggattaaaggtgtgcgccaccatgcccggcatgatatattctgttacctgttctttactcacttgtggaccaatggacatctgggctgaccccttttcttggctactgtgcaaaatgcagcaataaacatggaagtgcaaatatctctatgctgttctgacatagaatacttggtctgggcatagtagcacacgcctttaatcccaacactcaagaggcagaggcaggtggatctctgttagtttgaggccaacctggtgtacagagtgtttcaggacagccagggacaccctgtctcaaatgaacatttattgaccatctgtatgtcttcctttgagaactgtctcttcattggtctagttagtgattgggtagtttaactttagtatttaagttttagagttctttgcagattctaggtattaatctgtcagatatatagtcgacaaaggtttttctcccattcagtaggcttttcattctgatgatggtttcctataccatgcaaaaagagcttttattttcatgccacccaattcatcagttcttaggcctatttcaccagatttggagtccttttcagaaatccttgcatatgtttgtatctttttgtgatgtagttaaccagtgagtttaattaaggttactcagggggtataggtaaaattatttatagaagcttgagcaactgaaataagagtataacatatactatactataatcatatgatatattaattatataattgtataatagtaccactgaagaaaatgtctttcccccaacaaccgttggctccctatggatcttcagggaagggtggggctttgttagtccctcacccttagcaactgtggttgctaaggtttaggagtggccttactggaggaagtgtgttgcctgagggtggactttgaagtttcaaaaacccaagccgccagccataggagctagcacctctctctctctctctctctctctctctctctctctctctctctctctctctctctgcctacagagtagctctcagcgactgctccagtgcagtgaagctgcggcgctcccccctgccttgatgatactaaacctctgaaactgtaagcaaggccccaatgaaatgttttcttgtataagcatgaccatggtcacggtgtcttctcacagcaataaagcagtacctacagccctcaggaaaggtcccatgagccctgcctccttccaggacaggatgctaatgagctctatcccctcccccatttttattttatgtgtgtggatgttgtgcttgcttgtgtgtttgtacagccagctcctctgaggtatcactattgtgaaaacaccctgaagtttttacttttatttacttgttataaatcaaatccaccctgctcatcctaaaactagaagcagctgctctacaaagtgagttccagatcatctagggctgttacccagaaaaaaacaaaaataaataaataaaaatagaatcagagccaagcatggtggtacatacatgtaatcttaacccttgggaggctgagacaaggcagaggccaggctcggttgctcgaactaagttcaaggtcacaaggtaagaggccaccaacccaactgaagtgtctggatgtctttgctttttattctagtgcagatggtcaccgtgtctttaccccctctacttcacaatcattcatggttggctaagtttaaaaaaaaaatcagtgcaaagcaaatgaaggaaagaggaaggggtcagccattcaattcaccgaagttagggaaatgtgcctgggcttttgtgtgaacaaggttttatctggtggccggcaacaagggtttacctagaagtcttctaaggtaaagggaatacaaagattttaattattggttgtcaatgcaagttttacagtgtttgatagaaaacactaaaatttaatatttcttacagggctacaccagaacatgctaccctaaaacagcagaaaccaaccaactaaccaagcaaacacacagcaacattggggctggagagatggctcagtgacactggcttctcttcctaaggtcccatgttccattccgtcccggcacccacatgatagatcaccgctgtctgtaactccagttccagaagattccacagcctctatgggcaccaggcataaaagtcacgcagacacacatgaaggcaaaactccatatacttaaatgaaatatgacaaatacctacaataacaaaacacccaccccgaccaaacacacacataagagctaacctagtcacacaatgctgaagtttgcaggaatccgctgctcctttctctctgtctctgtctctcctcagaatctgggctggccttaactttgatatgtggcatacagggatttggtgacacacccacacttggttcctgttacactggctgcagagcccagggcttccttaggcaagcacttccttaggcaaccacctgagcttcagcctcagcccaggagtcccttttgtaatgaaatcaaagccaattcagtgagctacagattcctggcggctagtgttcagatatgcacagttttgggggaggggggaggagcatcaagacagatggatggaggagttggggacatcctatctctcctggcagagtgaatgttccctctgatatgaaacaaggctcctaccctccctgttggaccaaggcctttctttgactgaagcacagtgggagtacctggagtggggaggttacacttcccctgtgtttctcctctcgaggccgcaggtgacagttcctgaggctgcaggtgacagtgcctccacttccccatcccttctccttcttaaaaaaaaaaagaaagaaagaaaggaaggaaggaaggaaggaagaaaagactccaaacaattgtattactatgtttctactgatactgacaatgctaaggtccagctaaaaaaaaccctgtgagggcttggggaggtgaagtgtctgctgcacaagagtgaagacctaaatttggatcatggcatcaaggagtacagcaccgcctctgtcacttcagtgtggagggggtggagagggaacaggaatgtccccaaggatccctagagtttactagccagccagtctgactgatgggtggagcttgggttcaatgggaagcctgtctaaaataatatgcttcagagtgagagaaggtgccttgaacatgtgcatttggtctctctctctctctctctctctctctctctctctctctctctcacacacacacacacacacacatctatctctataacacactcagatttctagttgccttaaaataattttaattccatggacactttttaggaataacaaaagatttgggtcagttcttcttatctagattatacaaggaaaaaaaatcagtcaacagcaacattcttggtgttttatgttttataatataagaacccatttttttcttataaaaacatttatttagtccaagcataggacaggatcatctaggaatgtcagctccttccccgttcagagtttgaaagtgtaggcccacacccttgggtttgaggagactacataagaaggaccagacccctccctacttttttattttccatgctttgaggtaggttcctgtccaggcttccacacagggttttctatctgagatcacgctcttaggctacttcctcactcatcacacatcgtctctgcatccccttcccttagcttcttttacattcaagatttgggaggccatgtggggggaggggtacacatgctacagcatgcatgtggccatcagagcacagcttttatggaggattctctccttctctctttacataggttccagggttcaaacccaggccagcaggcttgaataagcacctctttcttacagactcagcttgcagccctgaactctaagctcttgattaaatatttaagatgtcctatagtacagttctctggcatttacaacattggacaacattcatattttgtccatgaaagttaagtgtgtaatattacaaagactcctattggagtttgtttctcttcctaattataaactaagaaatagggcaggggaggacctcgagggaagggcgcttgccaccaagcccgaggagcctaagtttgaactcaggaccaaggtggaagaagagaaccaactcccaccaagttgtcttctgacctccacatctgcataacagcacacaccccttccccacctccccccatatacacgaaataaataaagtagaagctctaacaaagatgtaataaatgtttaaaatagtttgccatctctataagacctatagaatctcagtttctcacaaatatcttttattctatccttatttatatttgacatatgaaaggggaaactaaaggaacactatattacaatcatatttctttttttttcctttttttttttttttcaagacaggctttctctgtgtagtcctggctgtcctggaactcactctgtaaaccaggctggcctcgaactcagaaatccaccgtatttctttttttgatatttatttatttatttaatgtatgtgagtacactgtagctgtcttcagacgcaccagaagagggcacctgatcccattacagatggttgtgagccaccatgtggttgctgggatttgaactcaggacctctggaagagcagtcagtgctcttacctgttgagccatctctccagctccattttccaatcttttagaacaaattctaaccgtctaaaactacacagaactcaaggtaatctagtcttctacctgagataagaacaaacttcccttttccaatctaacataattcctggtattaaggtaaatctgaattcatgtgatacagtttgtcaaacttttccctaaaatcttaacccatttaaattgtttcatatatatatttggatattattttaaagacctatgatgcatttgtggggttaaaaggcctataatgggtccatgatactactcattctacaaagctaagaagtgcttgtctgtagtgtgtacatgttcctgaatgaacaacatgaaatgattccagaatctacacacatacacaaatagcatgtgttcacaagttaatctcacttaaagaaaacctagtcttggcctggagagatggctcaacagttaagagcactggctgctcttccagagaccctgagttcaattcccagcaaccacatggtgactcacaaccatctgtcattacaccctcttctggtgtgtctgaagacagtgacagtggactcaattacattaaataaataaataagtctttaaaaaaagaaaaaggaaaaaaaacccagtcttctctttggaggggaagcctcaaagcaatgcaatgtagaacaggtatccgtgtatacaggtatgtgatgggttttcactgctcaacttcatttcttggtctttcccacaaaaccaaaacccagacccaaaccaaacaaaccaaccaccaccaaaaagctactcataccactgcctccttcctgactgtctttgacccacatatcaaatgcacgcagcaatagccaataaagtaggggctagaaggatggctcagagcttatgaggcgcactgagtgtccagaggacctgggttctgttcccagcacccacatcaggtggctcacaactgcctggaactctggcactcatagttttgtggatttttgtttgtttttttgtttgttttgcttgtgtgttttgttttgtttttgagacagtttctctgtgttgaccagtctggccttgagcttagaaaatccacctgcctctgcctcctgagtgttgagattaaaggcatacgccaccactcattgctgatgtttggcttctccaggcacaaaatgggatgcttgaccaactggggaactgaaggttgcatggggggtgggttaaagggagaagttggggggtcaggggggagccacacacttgctaagcactttgcaatactgacagtggagaacttgaatgctgggagccaaagttaccttgggctctgttgacccttctgtaggtgtttatctccaacctctgatgtgacccgatggcctcgtgactaatgttaagtccttctggaatggacaaacatacctctgcatcccaccggttcaaaggctaagagtgtcatcagataacgtctgtggcctaaaacagagatttcccttcttcactggagtcaatcgacctgatgcccccaccagtgtatttggatggaaggtgccttggtgtgtcattttcatgaaactgttaccgcattggatcatggtgtttgagataacctgagtccattaatagacatcaactattcatatttgggccc

SEQ ID NO: 24 - DNA, 5495 bp, Mus musculus
gcccacgcgggaccgtgctgccgagcagggcgcttactggtcaccgggttcctgcggccgccgcgtcctgggtccgtgaagcgagcctccgtcgccccgggagtgggaaggtggcacggccaggggagccggcagagggagggtccgtcctcctcgcgtggagccctgtagctctgccctccccgcgggcgacagggagggacttcaggaaagagctgggggagcccgtgttgattcgtgctcgagtcgggcatcaggaccaccccctgccgcctccgcagacctgatgggcgatgggcgagtgcgaggcgggggacggtgtgcaccccgcgccggctgggtggcgctcgaagagctgtccatggtgtctgtcgtcagggaggcagcaggaggctgttccctggctgtttcagtgtgttctccgagctccaggggcgatggaagagtgctcaaccgaatgcagtggagagtgggggaagccagcaaccagaaactccaggcagtcaaacaaaacatggctgtcactgtcgatttgccagccgtggaattttataactaagggcatcacactgtttcaaactatctttttaaacgagacattatgtctaaaacttgtgtccagcagaattattctgcctatacttcagagacaaaaatgggaggacattgtagtccctggggctttagagaggaattgagaatccaaggagcacggcaatcatgttccatttgcctttgctttcccctagcctcttcccctttttactttcttcccaaaagcacaatttaaatatgacgtattgcataaaaacatttcctctaacatgctgtcatgtgactcaacgcttctctattttagagaagacaaatccaccctagttttaaaatattaaaagcaaactaaacacaagagaagccacctccagccaaggagatacacacttggattcagttcttagatcttttcacttagtctcctaagaacaacttttacttttttgttgtggttacagtaaccacaagcttataataacaattgcttgctgtgaattgtggttagccatttttccctcccaagaagtgtccatttcaggtggggacagtcctttaaataaaacagggatgtttgagagtgggatttttcttaagtgtgatgactgtatatgacatgcaccgacaaaaacgggttcaggagagctggccactgaattgtagtactttggaggtagcttttgttttttgagacaaagtagcacagagcccaggctagtgtgccaaccatacctggtttacgtggtgacagactgaacccaaagcttcatgcgtaccaggcaggcattctacaagctggggggcatccccagccctagggatgaacctttttatgacaactgaaattaccccaagtggagctgtaatcaaacttgcttaccccatcattcttttcacaccaagaatccctgtgaaactacaccaaaaactctttgtcaaggtggaaatcatggcactaagcgctttctaaagccagccttctgcctattcttggtatcctgaactaagaaagcggaggtccaagcttctgttataatgtctttcttcaaattaagctaaagcagcagtggtaggtcttagctttcccaagtcctttcaaaatacatttttaattataaaataaacccaagatttgaaaagcatactagtgacctttgaacattccttattgtcccttttctatttattattgttacaacatatccaagtagctgcacgttttagcaaaccagtgtctatagtagactaactcaaaatatataggcacagtctaaagctttgcaaagaagccaattgtgctgactggaactgagcaatggtgaggctgtcagaatgctcataccctgattcttgtcgctagcaaacgacagatgactgggtgacccgagtctaaaaaagttttggatatctggtagactgttgtggttatacaagagaccgagacgaaatcacaggtaccgtttgttacaaaggaggcagaggggaatcaggtccccatgtaggggcatgaagacaaatggtagaatggagaattatgacaaacccaggtgcaccagaaaccactagaatctatacgttgagctgagaacctttataagatacatgattccagtgacagttatttccagtttttggccttaagcactcaagagagtagctgttctaagacactcagctagtaaataccagtgttatggcagctgagaattccatatttagtgctctttactcattcaggagtgacaacctcgtcgagacataacgagcactttctatatgcagttctggtctccattcaccttgcatcagactcctaggacagtgtccaagcctgttcctaagtgttagcataggcagttggagcttatccaaacaattactaaagctggatataggaagagtggttttatactgatgggcttggaaacagtttaaggcccaaatacatatttgtgtttgttttaattcatgagaatgagtgctctgaaatttaatttcccttaggagccaagaaagattaataacaacaacaatgacaaaaaaaaaaaaaccaaaaaacaaaaaacacaaccctcatccttaatgaatatgtggagataagtcataatacctccagaactgatggagaaaggagagcacaacactgtccaagtgcacactggcctgttaacagcctcaccatatgaaccactgtatgtatgctctgaacttagtcaccagcaagatacaacaaaaggcgtgtttaaaaattaatttaatgcttggctaaagcttaattacatatatatttttcaaacgatagtcctgaatttctgaaaagttactcttctgaaaatcacagaatcagaaagcatcaaccttaaaacaagtttctctgagtatttacagtgtggtagaaacattacagaataccatggatagtaaattgcctgggtgtgtctgatcagcaaggcatgttctttattgcatatataactcacatatgtgggattcaaaacaggatagactaaagaaatgcatatctatagctgggcagggaagacaatagtgagaaaggtcagtcagcccaggccatgcagttagtttgtggctcatcctaccccacactactgcatatgtcgcctcaggctcgtattaaacccacagctgcctccagggcagactcccagaagtcccacactcactcaacgacaaagtcttatttcagttttcattttaaggcagcacaactacagtgacagcagtcactgtggggggtgaaggtcatcacctgccagcccttcagctgctgcagtgcagtatttccctaagatgattgctattgggtaagttcctgctgttaaaaagcctcctctgtagaaaaacactgcaaaatttccagcatgaaaatccatggtggtataaatatacatgcacacacacacacacacacacacacacacacacacagacacgcaaaattatacaacttacactaaacactcatcatttatagagcatacgtaaacgaagttaatttaatgaccatataaaatacttccataaacaaaatatgacaggcagtaaagaaacatccatagactcctagaaataatctgagttcctttcattctcaagaaatcacatttaaggacacggtattaatataatgtttttgtattaaaacaagaatcagtatattacagtttaagaaactttacatatatacaaaatgtacacactggaaatggcagcaaagcaaacactttttggtcgcagatctattttccttcaatcagagacttgacttccttcacattgtggtcacttgcaacagatatagcgtgatccaaagcccgaacgcttgcaagaagttttactatctgttttatattttccctgaaagagataacaaaatttgtaatattatattgagataaaatttgttcttgattttacactaacttagagaatctgcagtacagccttccaagcatggattttacgtatggagaagaagacgtggacgctacagcaggttttacagcatctgcagggctggcatatggttcacctgcaaagatgcttgccaccaaacctctgtggagccactctccagatcccactagtgggaggagagaaccaaaacctggaagccatcctgactgccccacgggcaacacgacaggtatgtatgtcactctcaaaacaacatgaaatgtatgagaaaaaattaatctgttatctagccacataaaacaaaactcatgtgtaaatgattggtccagggacaggaaattcattcatatacagaataaaacaacttcatttagataaatgattttgattaatatctacaaagaaccccagtgtgatcccaagccgccctggagcgctgtctgcttccttcccagccatacagtccaggtccttctggagcacagcttaacacaaactctacttcaccaacctatcaagaggcagcctccaactcctaaattcatccactaaagcctatttctgctttctttctcagccctgccgtaagtactctgccttactttgaagaaaccctgaaatatgaacatcagaattcttgactggatgagtaagcatacatcgctgactaagaggacatacagcaggagccccaccccaaggttatgtagatcagggaaaacagaagggacgtcgaccaagctccttgtcctgctgctatgtgaaccaaggcttacagagcactcaggctggccctgagctcatttggaagcccaggcaagccttgaacttttgagagtctcctcctgactcagcctcctaataagctgtggtctctgccttcctagaaaattttcatgaaaaccagacataagttgttcccaaaccatcatgaaatggcctttagtccacggtattatggatcaaggtatagagtgaaggctgggctcttcacacaaggctgtatttcagtgggcattctttctacgtttacatctccatgatgacacctcaaaggccaaggatcactgcacctaaattcacccactgtgaatctattcaattcctcaggagacaaaattacaactattcactgctctaagacttaccataagtctttttctaaaagcttccaaatttaatgtatagggatagcgggatacaaatttaaaaaaaatgtgtatcttggtagttttgtaacactaaataaatgtacaatgaaagggaatatggggctggtgaaatggcttggcactgactgctcttctgaaggtccctgagtttaaatcccagccaccacatggtggcttataatgatctgtaacgagatttgacaccctcatctggtgtgtctaaagacagatacagtgtactcacatataataataagtaaatcttaaaaaaaaaaagagagaatataattagtgtataccttacatacacaaataaaatgaaactgtttaaac

SEQ ID NO: 25 - DNA, 2088 bp, Mus musculus
gggggggggggattctgtaactccagctcaggggtactcatgccttctctttattcacatctttgctttatttgggaaccctcaggactccctgccaaccagtgtacctacaacaggccctgctttgacatggacaaccctctaaatttcaaacagtcttagcgacccatagactccctttgagggtgtgtcccttaactaggcttaaagataatctcagttatccgatggctgtttacttgatggttcccgctaggacacaggaccaagtataaaaagtgataactcaatagacgttgctaatcccactgggcaagaataagaccactaccaccatcttgagccatatttgaagcaattaattgaatactggcccagatgatggactctagccaggtccattcctgggttcccagaaaatgtctacaagtcatatattttgcagaggcttataaaggcaaacccataaggttacatttttctcagcaggtccaatcagcggcaagcatatatcctgaagcacttcttgtctgtgtacctcccacttacatccaatcaggggcaagcatacatcctgacgtatttcctgcctacgtacctcacacctacatccagtacgattaggccaaataaacttgtttaagggagtgaagcatgtggcttgttttctcccataagcaatagcttccagcatttcggggaaagatctgtccttgggcaagacacttaaaggttagcaacagttttttgttccatggatctcttaggcacagtaattaaaacttaaaacatacctttttggctcttacaacgtttgccttgcaagccagaggacccgagtttgatccccttcagatcctatgcaaaaaaaaaaaaaaaaaaaaaaaaaaaaaaagccctatgttttggtgtgagttttcaatctcaactttgaggaagcagagcccacctagcctacttggcaagttttaggtcaaacaagaaatcctgtctcaaaaaccaaggtggaaaataccagaggaatgattgtcttctggctgctaggtacacgaactcacatatgcacatctgcatccagctgcaaattggcacatacacaccctcctcaataaaataaaataaatagaatatgaatagaaaatacaaaatcttatactactccacaaaaaacctaaaattgcacctgatatgtggcatcctgggagctacctcttagcatggtccctatcaaatgtgttaaaacagtaagcaaggcttgcagctcgatgatttgagagcagcggccagctactcactatctgcctgccattttgttaccaaaaaaaaaaaaagcctttgctcaagaccatgaatactaaaatctgctgaaggaagtggtgggagctgcattacttaaactctttcaaaatctcctgaaagaagtacttcagccagccccacagagaatagactggttctgaccctcagggcatccatacgatgacctcagagctttttttccctgtgtctgttttctatgaaggagaaaggctggagccgaaccagtgaaacaaagacgtaagttcatcccctctcccgccccaaaccctttaatcttcagtggagtcccaattccagatcatttccaccagagaagttttaaaagcatccacatgtaatgtcaccgtaaaatatgataagatcacccccccctccccgccgccgcctttaaaggcagcactcatttcttagagcttttcgagtttccatttcttcttctgtaattactacctatgtcatcaggaatggactctgaataattctcccaattctctctggtgactcaaaatgccctccaccttccagcggtcaaacagagcgcaagtttccttgtaagatgccagcagcccctgtgatcaagtgagggttgtttgctctttgggaaccaaataattacctgtcagcttttcaggcaacgggcagaatccagaaaggtaacagcacaaggatatgggaatctttgcaggaccggtggctttccttccttcctttttccatttatcctttctttagaaggcagataaggcggcattattgattgaggagtgt

SEQ ID NO: 26 - DNA, 51831 bp, Mus musculus
agagttacctgagttgcgctgagcgcgcgtatccctggaaatagcggaggcgcgcgaacaggtagaacagtccgcacagggctgcggctcctgcgagagtcgatgcaaggcgacgcggtgagcacgagctcccgccatccgggatcacccccacccccgaagtgtgcccccacgctgccccgcaccttcgtggaagaagatgccggcgacccagagtgtggcgaggaacagcggaaagtactcgctgcagtttaccctgcgaggggtaggctgggtgagcgcgtggttcaccttggctgacacccgaacccgcccggacccgccgcgctcactgggctcggaagacgcgctcgaactcgggagggccagaggtgagcggcggcgacacgtggaaagcccttcgtgcagagatcacctgtagggagaagtaggctgcggccgtgggggtgtgggagtcaggtgtggtgctccgcagatctggagcgggatccgtcccttagttcccctctccttgcctctcactgagcgactctcttctaatgcccttctcccacctgccccatcagtggtgttcaatggagaggccctgtaggcctgagggttgattgactagggtgatgcgcggctgaaacacctgccggtgggaggaaccttagaagactttactcctgaacgatttgacttgcaaagcacaggcaaatgcctacctcccgttctgcaggtctggaccccctgcgtaggcaatggaccagggcaaaattggctgtattctttaaggaacaaggaagcacacgttctgtggctaagggaccctggtttcccctctacagaatcagccagaagggactctgccacaagccagagtcagtctagcttgggtctcagtaccaccacacaatagcataaattcttgtctcagtttctgtttagacatcatggacccagccttaaatctggcagatactgtgctccagatgcgtggagttgggactctcccaacctaagcccatagctattccactagtcactgtattgcactcccaaacagataccagctcccaccacaaggcaggcacctcaagtggcccctcagcagggtggccatccttcacctggtcctcccctgtagacactccttagagagtgtctatacctgctccagggaagtggggacttctcagctggaactttggccctccaacagttcttgaattgcttggaccttggtaccaggaggctagcctagaagcctcctgtccttctcctgagcctgggcctgccagcaccccaattccctaccccaggagcctgaagagagcagactacaggatgtaagatccacccacctcccagacaggagccagcccaccttgcaacagaactcccacgagggtgacggtagccagaagagccacttcgtccttcatgttgccagccacaggcagaattagctttggtgttcttcttatcgcccagtgtgctactcagacgctggcccaggagaggaagagcctcggcgctctccacccctttgcagtagaggcggggaggggtggggatatgactgtatccacaaaggcagggagcctggccaggctgggaaggtagaaaccagtgctgtggacagcttgaccacttccttccagttgttcctggcctttccgtgcttagtcctgtggtggcggaactcatgctgctcacccaggctccctctgactgctcacccatgccccctctagccttgtgtgtttccagctaccatatcatctagaccctgcatccttggtagtttcccactggcctttcagacttccccttcatccagggtttaccctaggctctgggctcctggactcccacccctgacttcccctaccccagtgatgactgggtctgtattcccatccagggctactctgtaatgtctagtgctgacacacccttcccaactccctatggcttcataatgtccaggtgtccccagccacaatggacctacccatgttcttcttcctccttggcatcctgaggcccatccccctcagagccccaaaggctcatgaatgatattttttatccttggttatggggaaatacttgtctctaggctggtgtatttgcccagcatcctacttggctccaggcactgacccttcccttccttagcctagtcctttccacaccagacaaagctgacaactccccaccactgccacacttgtggtgtagtcatgtgtgccgatgttgacagaagagagacccagttctggaaacttccattagcagtctgggaaaggaagcttaagagtacagaagctgagaaactcttgttgtcgagccctgggggccaccttgtgtggtgtgtgctcctggactgttcttccttgtgaaatagccacttctcttttccgatgaagctggtttgaggtagatttggtcagcagtggcaaaatccagatccatctggaagagtggacggagccataggtgaagggcgtgaaccagcacaggacaggagaggagcgtgtactggggaactaacaggtcctaggccacactcctgtccctgcagccagcttggccatatcatgggtgtcataagacagggtcacccttgggagcttctgcttccccacagccagcctccgtcctcgttgcctgaggccttggtccctgtggactccccagaaccccttcggtctctttgttcattattgccctcagaagatctgaggcctacctgctggggctctgcaggtttctcaagatcacagttgggtcaacgctggtccttgcattacaccaacgtgtaatagcagtagctggtgctctgaactcaaggaatggtcaggacacaggcgttccagggcaagatgggcctgcaccatgccaatgcttgggttccaaacttcaggaggctgcagttggggcagcttccgggagggaaggcattgaaaaggcagaacagggctggtgagatggctcagtgggtaagagcacccgactgctatctgaaggtccagagttcaaatcccagcaaccacatggtggctcacaaccatccgtaacgagatctgactccctcttctggtgtgtctgaggacagctacagtgtacttacatataataataaatgagtctttaaaaaaaaaaaaaaaaaaaagaaaaggcagaacataggatacaggcaggccatgctcctatatgcccatgtggatagtgtgcctgtctgcgtgcctgtcagcaaatgaacatctctgcgtgtctctgcggtgagcgtgggtgctcgccggtgcaggctacagacaagtctatgtcttgtgttacttcaggctctgctctgccaaccttacatttcctctcaggcccatgtgtcctcccatcaaagttcattctctctggcctggccacaggaaacagaggcttgatatcagcaacttctcaggaagtccctgagcagatgttcagggcagggacaaggggcttggtctttgactccctccctgcatcctttgattcttctccttgtacttggtttgcctagcttctaagggctccactggacctgcccaccctctgaccaaagagccagtcctgcaggcaccagcatcttcttccctgagctctgcatggtatacctttgctggctcaatccttaaatggctctgaggaaccttctggatgctgagttcatggttaaactctgacccggtggaaaggtcagtggaccatgagggtagagagaaaacattgctactgtactggacatcagccacagtgcactgtcaggcccttgactctaagctgtaagtaaaaggtatattgtgtgcccatgatccctgcacataggaggctggggcaggaggatggagagtcttaggccagcctgggctacataagaggcctgcttctattttagactcattaaaaaaaaaaacaaaaaaacaaaaaaaacagcagggaagaattcccatagggccaggcagtggtggcgcaggcctttaatcccagctctcaggaggcagaggcaggcagagctctgagttcaaggccagcctgggctacagagcaagttccagagtagccagggctacatagagaaaccctgtctcaaaaaaccaatcaagtacatttcccacatgccaatccctagcttcctccagtgttaattatcttgtatagccagaatatgggcctgcaaacccacacattagcacagacagaatgccatccggccatttacagatcttactcatcttccaattgtcccctcaaatagtaccaagggctcaaaaaagatgttacattgtgtcagacacacgaagccacatatcgtttgattctataaacacaaagtggccagaaaaggcaaattgtactatagaaggtgaaaaatgcattctgtgattagctggtgctgagagcattggggtgactctatgttcagtgtgtgaggtactggagattgaatttggggttttatacgtccttagcaggtgttttaccactgagctatgtccccagtccactttttatcttacttttaaaaaaaagaaaaaaaagaaaaaaaaaaaaggatttcactgtttcccaggctgtaaactcattcttatctcagacaagacttggaaccaggcttttcccctcagctgggattattggcttgcaccagaaagcccatgaccatcttaaaagatcaagggaggtgtggtagcacacgccctcaatcccagcacttgccaagcagaggcaggcagttctctgtgagttctaggtcaccctggtctacatagtgaattccaggccaccttaaaaaaaaaaaaagtcttcattacttgctaaaacattttggagtatttactcaatttgtgtatatgtgtgtacatgtatgggtgggtggggacatctgcaggctccttggtcagtctctgtattcctttgaggcaggctctctccctgaacctcgggctcacaatttctcaggttaaaactcagcaagctctgacttggagctgggattgcagcccgaactggactcttaccttgtaatgcgagtgttgggaacccaaacactggtcctcgtgatcagacagcaatcgctctttactctgagccgcctgtcctcagtccccaactgagatgtttttaaagtggtgtatgaacacttctcggcctttggctaaggtgtagaagtgacttacggttttgtttgcacatttaggtaaacactaaaaataatttaattgtatgtttataaagttgtttttaaaagcagtaccagccgtttgtggtggaccaggcgtgtattcccaggattcaggcgactgagacaaaactttgaagtttggtctgcacagtgagttccagggcattctgagttacagactaaaacttcttctcaagaaattaaacaaacaaattaattaatcaattgacgtattacaaaggatgtattctttttacccaggccttcttccccaaataccacctttaagaaaattaagcatttatcagccaggcgtggtgacaaatgcctttaattccagcactcaggaggcagaggtaggtggagtttgagtccagcttggtctacagagttccaggatagccagggttacacaaagaaaccttgtcttgaaaaaacaaaccaatcccagttaccccagtaaattaacacgaatggatgtgagctaatctctacattgctaggtttcattactagaggcaagctattttatatagaaaagagcttttgttagggacgcaaagaccaaatagcaggctgctgtacaggtcgttgagggctgcaggcctctggtgtgtgtgtgtgtgtgtgtttgtgtgcgtgcgtgcgtgtgtgcgtgtgtgtatgtttgtttgtgtgtgtgtgtgtgtgtgtgtgtgtgtgtgtgtgtgtgtgtgtgtgttttcaaagttcatggagggaacgtggaccgtatttggctatctttttctggtctgttttgtttagctgaaaagcatccttgatttcttcctaagtaagacacaattctgttcctcgctctggctgtttgttttactttagtttgtagggttactttgtagtcccaaatataaaccagcttggccttgaacacatagagatctacttgccacttaagtgctgggattgcaggtgcgccccaccatacctggccttagtttttcacgattttaatgctgtatagtgtctttgtaatcaataatgtatattgggtgagggggatgaggcaaggtctcatatattcatgtagcctaagctgaccccatactgagtatgacttaaactcccaaccttctgcttccatctcccaaatattgggattacaggcatttgttaccatgcctggctatatacattggtttggtttatttcattcattcattcattcattcattcattcattcatttgataatgttaaaacaacttaacttttttactgtagttgctatttggtcatggtgtataattattttgtatacctccagattccatttattagtctttattgaagactatcaacactttaaatctttaaaatgtattttatgtcatcatcattaaaataaagccaatattgaattgggtgaggagcgtacacctaaagtcctggcacttggtgagacaaaagcaggagggccacaaatcctaaatccgtaacttagtgaaaccttgtctcaaaatacaaaataagaagccgattgggggtagaaatttgagtgctggtctgggtgcacagttgggaggaaggagggggtcccattttgtgaaccaccctggcttgaaaccctcttggaggacctcagtcatggctcaatattgtatcccagctgagaatcgacacctagtaaaaggtgatttagtgatgtcaaaccaaactctagttttgaagtctgtgatgatgtcaaatgtctagacacagtgttcacagttgacaggctctgaaggaagtctctcaccccgggaccttgagattccggttcatgtggctctggatacaaacttcccctttctgaccctcagctgcttcttcaaaacctatttttggtagtatgcactggttttgtttgtttgtttgttttgtttttttttcgagacagggtttctctgtatatcccctggctgtcctggaactcactttgtagaccaggctggcctcgaactcagattgcctgcctctgcctcccaagtgctgggattaaaagtgtgtgccaccatgcccggctctgcactgttgttatagcaacactttgtcttcattattttctctggtttcctctgtagagacccaccggtgtgtttactcgtgtgtgtgtgtgtgtgtgtgtgtgtgtgtgtgtgtgtgtgtgtttcatctttctcatgtgtgtgtgtctctctttgcccccctccatgcaccccctctcttttggttagggtcttccaggctggaattcactctgtaatcaaggatgactttgaactctggtctttttgcctctacctcttaagctggcattctgcgtgttcccattgtgcctggcttttattcgatcctggggattgaaccccaagtttcatgcaactatgctttctgatgagctacatctctagcacaccccatcatttcaccataatgagtcataacttgagtatcctcccactaagatactccaccagggatggctaggatctccctgacacaggcagaatcccactttggctccttggctttcagactaagaagtatcagaggaggacagtcaaataggatcagaattgttactcactatgggaagagtttgagcatccctagctatccaccagggactggttccaggaccccttagcatgctaaaatctgcaaacatttaatcttatataaaatggggtagtgtttacatagagcttacacacgtcctcccacgtctttaaaccacatctagatggcttgtaatttttaatacaacaccaacattatgtaaatacttttactgtttggggaaacaatgaccagggaaggaactctgcacacgtctggtacagatgcaagtttttgttctctgaatagctgccattcaagattggttggattctcatagctggaacctgtagtttcaaaaatcatattgtaagctggatatggatgaagacaggaggatcatgtgttcaaggccagcctgggttacatggtgagactttgtcaatggcagagctcttgtttagcacacaggaggcctggttttgatcttccactataaaaacaaaattaacaaaacaagataaaaccctcaaaacattcttgtacctaggaagctaagacttagcatctccgttgaaggggatgggtggctcccattatgaccttccttgaagagtgcagaggaagggttgttcccattatgacctcagttctttcaccatctgacctctgtaagaaccgaggaggcctttattagcagtgggttagtgcagactcagccaagtggaggctgggtcccagctgcagggccgtgtgtggtctgggagtgtgattttcagctattgatgtggtcccatcccttctcacctaaaaccacagtgctccagcctgtagaatgaacggccggccttccacatttacagtcttgccagacaactgttcatgttaggttgatgttgtttgttttaagacagtgtcaagcccctgctggccatgaggtttctaagtagccgaggatggccttgagttcctggttcttctgtcctgatttatgtggtgatatgaccaaccaaacccatagactcatgcatgccaggaaagcacactaccaactcagttacaccctattttgcaaccccctttttgtttgggtgtaggtttttgtttggttttgtttttgttttttgaggcagggtttctctgtgtagccctgactgtcctggtactcactctgtagaccaggctagcctcgattgttttgtttttgagacacggtgtatctgtatagccctgactgccctggaactcaatataagaccaggctggcctccaacttgtggcaatcctgcctctgagtgttgggttacacgtgtgtgtggccacaaatggctcaagaccatctgtttgggccattgcattaataacatcatgatcaatgacaggatgggcaagcaaggccacatgcatccactggaggcttggtaggaacaaacactgcagaaggtgaggagccctgcacatatttagggtcccatgcttgctttctcagtgaggtccaccttgcagtgtcagatgccccctcaaaggagatgtaagttactgggctttttgtgctgctacctcttaaccaaaaagggagcataaggcttggcctctctgggttcacatatgggaatcccactatgacccacttagacacgaaggaaggcagccaactgtgagtggggctcagcaggaaagggctttgtgtcaggcgtgatggtgtatcctggaactctctctgtagaccaggctggcctcaagctcatagatccacctgtctctgcctaccgagtgcatgctggcattaaaggcgtgcaccaccaccaccaggctatggtgcacaattttaattgtgcgcttggggagcaaaggcgggtagatttcttttaaatttattttttatgtatataggtattttgtgtgcgtgtgtatctgtgcaccatatactgagagttgtttgaatcgttaggtttgacccttagcttcacaggcaatcctgacggcacatccctgtaattctactacgaggaaagtggaggctgaaggatcaggagtttaaggccatcctcagtccaaactgaggccagcctgaaaacctgagatgctatctttattttaaaaaaaaaggaaaggaaggaagggagggagggagggagggagggagggagggagggagggagggagggagagagagagagagagagagagagagagagagagagagagagagagagagagagagagaaagaaagaaagaaagaaagaaagaaagaaagaaagaaagaaagaaagaaagaaagggaaggggaggggaggggctagagagttggctcagtggttaagggcacttgttcttgtgaaaggcctgaactcaattccctgaatcagcctggaggctcaccacctccttaggcaacaagcactcaaatagtgtacagacacagacacacaaaatgctgaaaatcacagctggtggtggcgcacattttaaatcccaacactcaggaggcagaggcaggtggatctctctgagtttgagaccagcctggtctacagattgaattccaggaaagccagggctacacagagaaaccctgtctcaaaagtaataataataataatctaaaacaaaataagataaaggattggagcgatggctcagaggttaaggttctggctgctcttgcagaggatccaggttcgattcccagcacccacatggtggctcatagacatctgtaaccccagttccatgaaatctgaaaccttctgacctctacaggcactaggcacacacatgacacaccgttatagacacaggcaaagcattcatacacataaattaaaaaattaaaaaagaagaaaggtgctagggttggtgtatgtgactaattgtagcactcaggaggcagagacatgggattcacctcaagtctgagggcagagcagtcgatagagtgagttctaggtcagccagggctgcatcgggagacccagtccgtggtcagttgcttcggcctatggtgaggcacgtcatcagtatggagttacctgagggcagggacttggctgggtacttccaggttctcaggttcttattcaagatcaaaattaaagctcacagaggttgcaaagtagcaatgagttttactcaaaagcaaagcaattaaacatgtctgaacaatccgcaagagtacagcaaggtagaggagagatgttacagggcccgactgactgccgggagcttcttgctgagagttggagtttaggtggctattttgattgatgtattaggtcagacggttggtttttcctgctatacctggcccttcccataaagcacagcccaatgcaggtgaggtcctctgctgcttgcaagttacctggtgcattgttatgggtgaagtgtgcctcaagctgcccaaataattattagaaaagagatatgtgggctggagagatggctcagcggttaagagcactgactgctctcccagaggtcctgagttcaattcccagcaaccacatggtggctcacaaccatctgtaatgggatcggatgccctcttctggtgtgtctgaagacagctacagtgtactcataaatatgaaagaaagaaagaaagaaagaaagaaagaaagaaagaaagaaagaaagaaagaaaggggaaggaaggaaggaaaagaaagaaagaaaggaaagaaagaaaggaaggaaggaaggaaaagaaagaaagaaagaaagaaagaaagaaagaaaaaaagagagaaagaaagagagaaagaagtttttaaaaaagaaagacaagagctatgcatagcacaaccaatggagtcccagattactaacctagttcctatgcttgctttccttgagggggagaagcagagctactttcaccacggtgctcaagaaacaaagacagggtgtgggagagcagcactctcttccagaggacccacattcaattctcaaacccacatcggagcttagaaccatctgtaactcttcttccagggtatatgatgctcttttctggtcatcaggcatacacatggtgcacagacacacatgcagataaaacacatatgaagaataaaataaaattaattatctttaaaaggaagcaaagatataggtagagttggggacctcttcaaggtcacattccactgatgtcacttcctcccactaggatcctcctcctccagttctgccacctcccagttgtaccgtacgctatcgaccaacctttagcataggctgggggggttgggggagggggaggatttacgatccaaacgttaacagtaattttgccttttgcattcaagcctgtagctcacaaggactttgcttatgtgtcaggttgaggttgcatttttcccccctaaattttgagcaaaggcttgtgggtggggtggggtggaagtggacacttggaatcgtttgtttagattgaatgtgtgtgaatgtttcagctgcatgtatgtatgtgcaccacacacatccttggcgcctgtggcctgagctgggagtcagatcccctgtaagtggacttgtagagatggtttagagatgctatgtaggtgctgggaatcaaatctgggtcttctgcaaggtcaccaaatgctcccagcagcagctggggctggacatggaacatcgtacatttcccgcaagtgctctaccctgacctgaacccccagcctacaaaagacttaaaaacataattctaagcttaaaatgtgtaagaacgtgacaaagaattgcagtctccctttaaccggagttcttatcttcctaccacagttgacacccaccctgtcccccatctccaggtatgttcttgcaaacatcccccccccctccccgaccattttaggataatttggaggcaaaatgtccgcaggaatgttttggtttgttgcgctcagaaactgggacattctgttgtatagttacattacagttgtcacaatgaacacatacattgagacaacactctgactaacaaacctcagcccgacagttctggttgctccagtactgtgctgtggggcaaggaactcctgtgccgagctgctttcagttccattgttctctcgctgtcctggaactctctaggtagccaggttgaccctgaactcacagagatccccctgcctcttcccccagagtactgggactaaaggcgtgcacgtgcctgcctctcttttttagatttatcattaattatgtatatgcatgtgagtatctgcacacaagtgcacaggcctgaggcggccagagtgtgggatctccctggggctcagagttacaggtaattgtgagccttttgatatagaagctgggaacccaactggggtcctcttcaagagctgtaagtactcttatacactgagctgtctctccatccccttccttccttccttttttccttccttccttccttccttttttttttttttttttttttttttggttttttcgagacagggtttctctgtgtagccctggctgtcctggaactcactctgtagaccaggctggcctcgaactcagcgatcctcctgcctctgcctcccaagtgctgggattaaaggcgtgtgccaccactgcccagccctatttttactttttacaacccagtgttttttatttacccatgtctgtggttatgtgtttctgccttgctgctgatgtgccactaaggagaggtgagacacagtctaagatagaggcctcagcctgtgtttctctgggtaaaaacaactagggctgagacaggtgtggttctcaaactccttgcacccagacatcactggggaccacaaggaattaggaatggggttctgagggcccttgatgagcctgggatggggcagaatctggcttagctcggagtgagtgccagaagtgcagaggggttggaagaggggcctgtctatgggagacttaggcacagctctgtatgatgaaggagacagtccttgcttgtacaaattgttttattcatggaggatgaggatgcatgtgccttactcagggtgagccagagattcagtatcgtttgcagggagggatgcccagaaagggaaactcattggctaaacacagggcctatctaggtacctcattagcatggagaactctaggttctgtgctatgtgactggttaccatggtcctctgagtggggtgttgtgatcacgtgctctagaacaggaaactggtctggagttcaaactcctggcatcctggcattcttttttttttttttttcaagacagggtttctctgtatagccctggctgtcctggaactcactttgtagatcaggctggcctcaaactcagaaatccgcctgcctctgcctcccaaatgctgggattaaaggcgtgcgccaccactgcccagcctggcattctttcttttcttttcttttcttttctcttctttttttttttttttttactttaggtttgtgactatactgtacctgtcttcagacaccccagaagagggcattgggtcccataacagatggttgtgagccaccatgtggttgctgggaattgaactcaggacccttggaagagcagtcagtgctcttaaccactgagccatctctccagccccccagcctggcattcttaattatgagatttttatggtttctgaacttggtacaacctgttcttctgtctggtagcgcagtctactgtcccatacatgtcttagttaggttttctgttgttgaaacaaaattggcttgcacttccatattgctgttcatcaccaaaagaaaatcagggcgggaactgaaacagtgcaggatccaggcagaagctggtgcagaggccatggagggatgcggcttactgtccctgcttcacatggcttgctcagcctgctttcatctagaacccaggaccatcatcccagggatagcactgcccacagtggactggtccctccccattagtcactataaaaaatgtcctacagacttgcctgtagcctgatcttatgaggacattttctcagttgaggtttccgcctctcaggtacctctaatttgtgtgtcaagtaacataagtctgcagtgcatcccgttgtgccatcagcctaggggatggggtctgtggccccactgattcccagatgcctgtgtgttgctccagatggagcgggctggctgcagctggacagatagatacctttccctttggcttcttcctttttctgaccacttcgagaagctgtgtggacccttagagtgttgttgttgttgttgttgtgtgcacacagtataagtgttcattagtcacagaagaatgacaccccagactcaaatagtacgtaaatgcagagtgttttattctgcagaagtccagcatgctgcagtctccattatcaagatagagaaacaaccaagtgagctcgcaggcctgatttaaagctcatcaggggaattccagcaacctttatcttgctccatctctagggacattccagagccattaccaggccatgggggctggaaaactgtttctggggaagtctggaaactgctgctgacccgttgtccttgcctcaggccagggcagcttctgaggcctgggacttgcctggacttgctcagttcttggaaacagagttaggccttgtctcctgaactgccagtgtgaagcctgtcatggagtcagatcagccttctcaacagctatcctcagtgtgtgtgacacttaaaggacagctttgaggaatccgcttctctttgaggaatctcttcttagatcactaaatcagatgatggctgaggtgtgtgttaggccagcttctgctcagcctcgtcttgctcagcctcaggggtcggaggtgggggtcggactctcagctggtgggtcagcggcttctgtctttgccctttgtggtttggggttccctgggatctgtgggcagacgaagttgtggatgctgaggttgagtcgcctgctgaccttggttgggcctttcacttttactgccatcctctctaggctgtctttggcaaggaaggctttgtggaattctggtctgtaactgtatacgcgctgtctcactggccgaccctcctgtcctgcactgtggttgttagcagcctccatcactctcctggtagaggggggtggaaactggtctgtgcagttttttcctactttatggtggcaatcttcccctgcaatagggatggcgtggttgggcctgtccttcaggagtgttctaccaccccctccccaactgtctgctggtgactttgtgaagaacctctagggagcagatagtgtctaagtggttctctttgctgtgtgtacagctgtggagtgtccctccgtgagggcttgtaacattggctgcctctgaatccatttccagtccttagtttggaggtacttctcggggctgtcggttttgttgttcttgagacacggtttcactgtgtagactacaccggcctgaactagcagagatccacctacctgtgcctcttaagtgctgggatcaaaggggagtgccatcatgtgtggccttcatatctgcttcttacttcaaacagttctattgttcataaaaccttgttgagatagataaccatttgtccctgtcacctggcactgcagacttcaggacatgtgggctagtgctgcttgccactgtaggcttgagactggaattggtgttagctggtggctacctggtatcaatcagccttgtttctcatagcagtggtgatggtgtttgcagctggctgtggcagctgcagctcttccagggttgccatggtgccaggtcagtagtgttccagctgcccccggctctcctggattctctctccactcctgttactgctccagtgccatcttttctgtcttaagatttgagtgttttgctcccatgtatgtatgtgcatcacatgtgtgccagatgccaccagtcagaagagtgttggatctcctagaactggagtgacagagggttgtgagctgccatgtgggtgctgggaactgacaccggattctctgaaagagcagccaatgatctttatcactgagccaactacccactccccatgtttcctttttaaactcttccttttcttccctccctccttcccgtcattcctttgtgctgtctcaaactggcctcggactcctggccttccttttgagtgctagagtctagatatgtgctgcacgggtcagactccatgtgtccctttttgagtattttggtttttttttaaattttatgatatgtatttattatgcacatagccagctcggcgacagcaaagatgcggagcctccgcggctctttccgtggatgccgcagcacctttgagttgcacttgcatcagtgccaagcatcgggagaaggcagtgctgtgtgtgggaggactgggaagacacccaagctcagatcctggagcagcccctcctctgcacatcgcattcacgccgtggaggagcagagcagtcacaagttgagcatcttagatgggagctagctgtatcccacccccatctgttgacatctccccagacctgcacagggcaggaactgcaggctacccctccaggctgcacacacaggatgaggagttcaccaaagtacctgtgtttgctttttgtttttgagacaagctctatgtagcccaggctgacctagaattggcggggattcttctggctcagcctcccatgggcttaggataattgaactggtctggcttctgggagctcttgagctgcctcctggccccattcctctatgatccagaatcttccttgctatcagggcacctctgctactggcaggctggtcataggaggagcacacagctttgcagaggcccaggctggcttcccatgagtcctcttggatgtacctggctggtgaatttgggcccaacaagactgaacactcctcccacagtaacttcatctctagtgtctgcctcctctccctacacctcagttacttttgcattgtgactttcctctggaaggatggtggctttctcaaagcttccacgagccaagcctgatgctactgcttgctgggggctctgccaaggtggcaaattttgtatcagagcagagggctactatgtctctaagccctccctccctccaatctagcaatggtggtcattcagactggctcctacaggcagtgtcctacagtgccttgtgttcccgttcctgtttctaggcttatgagttcttagttcattttctgttcctgtaacaaaatgcttgtggctgaataatttaattatgagaggtgattatcatctgggcatagcggtgtgtgtctgtaattttagcacttaggagtgctgaagtaggaggatcattctcattgtgtgtaaagaaggctttgggggtggttggtatgtgtaatacagtacacacttttaatctcagtgttcttgggaggcagaggcccccaagatctctgaatttgaggccagcctggtctatctacagagcaagttccagaacttcacaaaacaacaacaaaaaagcatttggatctcatactgggtcctagttggctcctaattatttttttccagtgcaccattgctttgtatcggccccagctctccagtcccactttgacttcctggaggcctagaatgtgttgttccccatctgtcttgtctgaccacagtgagaggactgctcttttgtagcatgccagtggtgctctctgccttcattgccaccagcaagggagcccccacaagacatgcaggaagagagtgaagctaatcagagaaattgacagctgtcaaatgtcccactgaagtcaaacatgcttgtgatttccatactagtaaaatatttttattatttttataacacaaggaaagtaaagatttctttttggtgtataccagagctaagggaagcagagtaaggggattaataggacttttatgtacttttgatgatcataaaaagttaacaataccaactgcttgccataaaacttatcatagctccaaacacatataaaggatcagttttaaaatctataaaagtaaaaaatatacagttggacgctctaacacttattccatcttcaatataaaattgtaaacatttatttacacaaagcacatgtgtataagagagtccgagcacccttttcttcttgagtcatggctcggagaagatgggagagaagtgggttacctcttcccaactcctcaaagccacactcataaataaagccatgggcagctctgggcagaccccaagaatcacattttattgctatgacactgcagcaagtgagctgcccactgcctgtggccagcctgggcctaaggtagagtgctggggccaactagtgtggcctgggcaatggaggcaggaggtgggcagcggtagcaggaggctggacaaggaacggggatccatctccagcccttagccctgtttttggtagagaacccactgaagtcactcccttccttccccctacagtggggagaatcagagggcggcgtcttcactgactttatgattcacctgcttctctgagagctgaactgagtttctgggggctgggggagggggggacatggcaggagaaatggctatgagggacaaggacctgagagcacaggtgccctcagtgaaaaaggcactgccggtgcaaactagttagcagtgtgtgcacgttctgaccctccaggtgcgaaggctgctcgtgcttctccttggctcagttcttaacactggacgaagttccaggaccccaggacaatgggcagagctgtagtttctctatagaccactctgcacggaagtcactccagcaaacacctttccctccgccatcctgttaaaggtctcactctgtgctcatcatcttgcttgtgatgaagacaagtgctccctcttgctgttagcagcccacgcaccatattctattccacggtttctctgctcagacatgtccatcaatagaccttttaagagaacctacttcaatctttagcaaggacgggttagtgttataaaaccactttaaaagtgcaagtcatcagctgtgggaggagcagaagtctggaggataaaaaataaagtgatgcctagacggcaggctgcctgcagccttctttccccaagcccgtgccaggctcagactccctaaggagttggacttttcctcttctaatgcagtgaagtcagccacttttcccgttttggctggaagaggccaggagttagaagggtcgtggggatgatgtggaggaggaaagatgtgtgtacaactgaatggcacttctacggtgtacatccgggttgtcagacatgctgaacctccaccttcagcatttagccatgctagggcatggagggattccatgggggcccagtgtcctcaagagtgagtggcagacaagaagtaggagatttcaggagggatcctatctggaccactagatgtaccatctgtggcatcctaatcattttggcatctgcagtcacagcctgtactgtggcagtgatttccagtgaccatgaaagctgacagagcaggaataaagaaggcctcaactcccaaggaaaccctgggttcccagtgccacttacaatacaaccaccacctgtcctaatctgcttaaaaatcttaaattaaaaaaattatgcctatgctataaaatgcaaataatcctatttaaaattccaacagaagtttgttcccagccttgaggcaagtggagaaatctcgggtaaaaacagggcacatattcttggtaagcctgatatggaggggcttaactgtttccactggctttttggtcatctgggtaggaagctatcccaaccctagttagtgatgtcaatgtgctgagccagcccaatggaccatcagagactgaccagagctggcctcaggtgtggcttaggttctactggcccaattctctgggccatggcttttggtccaaagtagttgctttcttgaatctgagaacaaaaatataagatgactaaacactgaaaacaccacagtcgtctctgttactgtgaccctaaaagatcatccaattcattgatccactcctcagaagtcctgttcttcagcagcgagtcgatcaggtcagtgtgtccagccacactggacagaccactgctacctggctgcccgctgtaggcaaagggcagctcttggcccatggtcctcacagggtaagcctgcgcacagtgtagccctggccggccgctcatctgggaggtggggctctggccgaaggcccccagctcgggccccgaaggacttaagccaggcaagccctgctgcggggctgcttggggaggtgcagatgcaggggcactgttcctctgctgtgcactcactgggggcagcatgggccctgctgcacctgctgaactcagaggcgccatgggcctgctgggcatggcttgggagaactgctggccagctagtttcaggtgggcttgctgtatgtggaaactgggagctgcagtgaaggggttcacactgctgttcccagacgtctggctgctcaggtttggcattccctgatgctgccacgaggcattctggcttcccatggctgctgacacccttgggacttgtggctttgttaaaccaggaggcagggttcccttactgtgctgctgggaaagactggcactccccagagagttctgtccatatgcagccgaggtggaggcgttctggcccacgttggtctgccgtggaatgtgggcatgtgtgctggtagcctgtggtgggggctgggcaactatctgggctaggccagatgccatgccataaaggctgttctgaggcaaactctgggacccagtaaactgggccactccacggtcctgctggcctgagctggaggggagagaggagacaggggcatgtccagggcccatggacatcagagtcccaggctgagggaacactcgaggacagctggagttggacggacccaagttgttcatcccaggcacagcagcagaaggtcctagaagaaagaaagttctagccgtcaaatcagcattcatttttatgtttgtgtgtgcatattggtgcaggtgcatatgtgccacaagcgtgagggagtaggaggacaacaggcaggggttagttcctgtcttagttaaaagagtttctactgctgtgataaacaccatgaccaaacctgagatggggtctcgctatgtaactctagctgtcctgcagctcactgtgtagaccagggtggcttcaagctcacagaaatcgcctgcctctgcctcccaagtgctagtattaaaggtatacaccaccacacccagacgcagggactaaagcagaggccatacggggatgctgcctactagcctgtttaccacggcttgctcagctcttactcccaggaccaccaaccagaccaggggtagcagcacccacatgggctgggccctcccacattaatctctagttaagaaatgccccacaggtttgcctactctcaattgagcatctccctcttcccaaatgtcataaactaggcatacagctcccttccacaccaggtgggacttagggatcacattcaggacatcagacttgacctgttgaactatcttgccagcccatgttggcattcctgactgtcatggtcaactgtctctgaggcccaagctgagctcctcttccacgggcatcaaagtcagagccctcacatgtcatgggcatgaaagtcagagccctcacatgtcacgggcacagggacaggacagaactcaaagacagatggagggagatccacaggcgaaagccagctgtctcattcatttatttatcaagtagccaacaaagttttctcagctgggactagggatttcaagaccaataccccagaatctgtctgtggaagccaacgccatcacatggtgtgacaaggtcacagcttgagcagcaggtcataggaatgcacgactctgaaggcattgtgcctgccatttggggaagtgttgagaactgaatgtggggctgagggagaagctcagtaggcagaactctttcttagcacgcacaaggccttgactccagtcgccagtagcacagaagaagcacatgtgagtgcacccatgcagacacacacatgtaatacacatacacacagaggcatacacaaatgtgcccccataggcacttatatctcatgtgcataacacccatcaaagggagacttaataaaaataacttaaataacagttgtgacgaaaaggggagagctgaaaaggaccacttcactgtgctaacagcccatatacatcagtgtggcatggaaggagttgagaacccaggccaggcacatgctccagtggctccaatagacttccaactccatattcctagccagcacaccagactgcacctagactctttcctggctgtggtcagtttctatgacacttcacagtgaacgttaactaaggaaggcaaggccagcatacacctgccatgtgacttgcaatctctatagctcagaggtgacgttgaggctcagttgcctcccttctttgtgacaccagagtgcactagaatacatctttccatctggaaatgttggttttcttttaaagacaagagtctttgattcactaagaagctgaaggtgacattgaacttgaccttccagcctccacttcccaagtgctaggattacaggcaagcaccaccaaacccagcttgctgtggggttcacctaaggatacaaagaactattttaattaagatttacacataagccaggtcgtgggggtggcacacgccttttatcccagcactcaggaggcagaggcagaattcgaggccagcctggtctacagatgagtttcaggacagccaaggctattacatagaaaaatcctgtctagcaacaaaacaaaacaaaggcttacacataagatgcctctaacagtaataattctgctccagatggatgtttaactgagtatcctcatagttaaccctggagaccttcttgtgccacaaagaaactgaaaatctagccctcccttcctaagcagagcttctgtgagcaagtcaattccatcaggaccgtacaccatgagctccactccccagcctgcctcccccagcctcctccacctctcctcacctgtgaactgtccaacctgttgtgggaaggtgctttgtgttgggtcttggtactgggggggtgggcgggtcagatgacgctgaaactgttgtttctcctacaaagtgccaagaacagaaacaaacaggaaaactcaatggaagtctgaagtcaaaaccaatgaggagaaacgcaaggtgtacaagcaagtgtgtcactcacaaggggcaccagcaggcctgtcacttgctcacaggcgcccgtgagtgcagggaaggcaagggactgctcacgggtgcagtgtttggggcgataagcatgggctctggtggtaactgcacaactctgcacaacagttacaatggacatcaatgaagtctattggctaagcaaaccatatgtggtaatgaatatatcctaataagcagctagtttaaagatggcgggcgtggtggtggtggtattgcacacctttaatcccagcactcgggaagcagaagcaggcatatctctatgtttgaaaccaccctggtctacagagtgagttccaggacagccagggctacacagagaaaccctgtctagaaaaacaaaacaaaacataataaggacctgaggtagtaagcaacctcagcaagtgtggtctctagagtcgggtccacagtattctctgtttgttacgtgggtaagcatcgccatggcgtgtcagagggctttggtgtgggtcctgctttcttcctcgtgctgtcacggggtttcttttgttcattactgaagccaggcttgcatcaagggcatctgtccccgcttcccatttccacttagggttacagacttggaccctgctttacacgggtcccagagttatgaactcagggtctccgacttttgagtccctccctggcctcttccctccctttgagataccacatcgctctgtagcccagactggcctcgaactcactgtgtagctaaacatgagggtgattctcctgcatcagcttcctggcagctaggattacaggcgagggctcctatgcccagctggctcccgtcttaattagaagacatggttcaacctctcaaaggctctcatgattgcctggggtctgcactatgcctggcaacccagtaggaaaatgtgcatcgtgatcgcaggacttcaagggctgctctactttatgccatttttatttatttgtgtgtgtatggatgtgtgccatggtgtgaagttcagagagcagcttgctggagtcagccctctcctgccaccttgtgggactctgggtcacacttaggtcatcacactgcatacaaggacttctacccactgagctacttcattagccttttttttttctttaagatttatttatagggcctggagagatggctcagcggttaagagtgctgactgctcttccagaggtcctgagttcaaatcccagcacccacatggcggctcacaaccatctgtaatgagatctgacaccttcttctggtgtgtctgaagatagctacagtgtacttacatataaaaataaatgtttttttaaaagatttatttataaagaattatttattttatgtatataagctctcttcagacacaccagaagagggcatctgatcccattacagatggttgtgagccaccatgtggttgcttggaatagaattcaggacctctggaagagcagtcagtgctcttaaccactgagccatctctccagccccttctttaagattgaatattaaaggttttgttgttgttgtttgatatagtgtctcaccatgtagctcaggctggcctcaaactcagagattgacctgcctctaaccttcaagtgctgggattaaaggtgtgcaccaccatggctggcatattcttaaaaacatatttgtttgtgtgggtttatgtgtaccacatgtacagacgtgtccacagaggtgagatatggtggttgaattcctggaactggagttataggcagttgtgaaccacctgatgtgggggtgctgggaacagacctctagcctactggtcctaacttcttaaacaaacaaacaagcaaacaacctatcatcacgcgtgaatgtgtgcgtgaatgcttgctcttgagatgtgtgtgccacggtgtgctgtagactctcactcttcacgtgtatgtgagattcagggattgcatgcaggccataggctgaccagcactttagcacttcacctgtttttattgttttaaaggacacgacactgacattgagtgcaaacaagctgaaatggtgcctgttacctgctcagccaggaggtgctgcctctgcaggaactgctgctgctgcagctgctgctgctgctgctccctctgcttctgctggtccaggagcagctggtgctgcttcatcacagctgcctgctgctggctgctgaggtatggcgagctgttgtgagtgctggccacagacacagtaggctgggttcccacactggcagctggggcagctacagggacactggaagggttctgctcctgtcaacaaagatgaagggatacaagtcagatagtatggatccaaccctgatcaggccagataagcggcacccagtgatagtcttgttctcttttgtaactccaagcctctgcttccctgattttatagtttggacatgaaatgtccctcatgtgtgtggaggcatctttaagttttagcacttgggaggcagaggcaagtggaactctgtgcgttccagatcagtcagggatacatgagaccctaacttaaaatagcaaacaacactccaaaccaaccaacctataaaaagcctcattaaagacaaacaatagggctggagaaatggctcagtggttaagagactgactgctcttccagaggagccaggttcaattcccagcacccacatggcagctcacaactgtctgtaacgccaacctttgacacccttatgtaggcaaaacaccaatgtacataaaaataaattattttttaaaagccaaaaaacaagccaggcagtggtggcacacgcctttgatcccagcacttgggaggcagaggcaggcagatttctgagttcgaggccacctggtctacaaagtgagttccaggacagccagggctacacagagaaaccctatctcgaagaaaaaaaaaaaaaaaaaaaaaagccaaaaaaccactaataccctacaaatatcctagcctccaaccaaacaaaacaaaagcaaaataatgctatgttgttaagaatgcagacttgccttatggctggcccagagagcatgaaatcgtttttatgttcactagtctatgcgtatttttctgggaagacacagatactttatagtgtttagatttcaaattttatttggtgtttctttgtgcaccagtggtcagcatcaagtgactttcttcattgtttcacctcattttgtgagaggatctcgtgagtctagagctgctcagtgtagttagacaggctggccagtgagctgccgggctcctgtttcaggagcaagttctgagcacatggcccaccagctctgtaccctgcctttcttgagttcatgcttaaagccatggaacttaatacattcatcccctccccctcgtttcttttctccaaaacaaaacaagcaaggcctcacactgtagcccaggctggcctcaaacttgtggcaatcttgcctcaacttccctgtgctgggattactgtgaaccacaactggtttgttgttttgtaacagggtctcattatatagacaaggctggtcttgaactcagagattccccctgcctctgcctcctcagagaatgcaggatttaaggtatgtgctgccatgccaggctatttgactatctaaaacacacacacacacacatacacacacgagaaggatttatttatttaattatatgagtgctctgtcttcatacacaccagaagagagaatcaggttccattacagatggttgtgagctaccatatggttgctgggaactgaactcaggacttctaaaacagccagtcttaatggctgagccacctctccagccccttattttatttattttttggcaaggacttatgtagttgtttggcatgcaagagacgactaaactaaattaggtgatttctcaaatgtttatgtagttaaagactaatttatactaaggaatttttttctttctagacaaggtttctccatgtagccctggctgtcctggaacttgctttgtagaccaggctggtcacaaattgcaaaagatcctctacttctgcctcccaagtgctgggattaaaggtctcaccaccactgccttgctacattaaggaattttactctatttttattaaggatcaattccagtcatctgtaatctcaactcttgggaggcagaggcgcggggaatcaggctcaagagcagcgtggctccacagccagccaaggataaatgaaccgtgcctcaaaacacgaacaccagccttgccctgttttttacgttttccacttcaaaggatgacagcagccgctaccactgtctcgtgcatgctgattctagttcagtatgtgcattcactagtgcccgtagctgagtgatggcaagtgaagggcctactcacctggccaggtggaaccaatgaccggaagggcatgtttcctgactttggtttcatcagaaacaaggagttctgctcgttactcagatggggcagctgctggggaagatatgccatcaaagctggtttgttctggccagacccaggaccaccttggccacagtctgctttgtaatgagaaaggggctttgtattgccatagtctagcacagacccttggttattcacggggttctgattcaagttacttggtgactggtgactcagcaggttggagtggctaggttggaggtaggggcctcctggccgaggagaactcttgttcacaccgggcatcatgagcagttttgagttggtaaagtcttgcttgtagccagaagggctggcaggcttctccatgggataaggaacatctaagggactgtgggagggccctgcctgctgccacgtggccagctggcctgggccgggtgctggggcagcttgctggggattctgcaacatctgctcgcgcttctgcttggcagctatctgctggagctggtgagcagaggacagctccgaggccccgcctgggccctggctaggtaataccacactcgtgagggctctttgtgcactttgagcctgggctgatgccggcatcaggtttggactggaattatccaccccaggttgactagttgtgtgaaacagagtctgagagctcccaaggcttggagaatctgtgcccacaggggcagatgaggctcctaggaaggtctggcctgcagacccagcccttacttgtggagaacctaactgctcctgctcaaaagctgctggagagaactcagtcttaatattaatgtcctgggccaggggggtttgtgtggcagagccaggaggctctggatccttcttctcctcaaagtcctccgtaaacaggtccttcatgtcttcgtcgggcactgacctgttgagctcctcgatgagctccttccactcctgctcattaaggttgaggtccggcatgaggttgctctgagctacggagcctccagcgcccgcgatcatgcacggcaggtcgtccactggctcctgcttgagttctttactcaggcttagaggaaagggctcactggagttgctgcctccattcaggtggatgcctgagtctgccagacacttcttgttgatgggatcgagccccagagagtgcttcccagcggtctgcagggtgtctccccctgaaggcttgtcgggctggcccaggggcgaggcaggaggaagcccattggcagacacactgacccccagaggggcctcccggcgtgtcttcttatgcccaggaaacaagtctccgtagccatttggttgatcgccattctgaggggaggcagcactgtcaagactcctcttcactgtatcatgaagatgctgaaaaacattggaacacagacttaggagcagtgccttgtcttaggtccctttgctcccaacagtgactcaagcaggaccttgattgctccctcacacctccctgccctctgcttccccttgtagcactgcctctatcactaggtctggcctggccagtcagaactagacatctgaattgctatgggaaggtgagcattgcacagggcgtggcaggacacaagcttgatgatggctgctgtgcattaggtcaccacaggaatcctgtatcttgtgatacccaagacctgccaatgtcctcagctgccacctccagcccctctgcccccaacccgactttccagtcctaaaccaatacatttttccttgtgcttcggctgatttactatggatcctataacttccaaccacaggagccgggctagcttgaatgagaagggcccccttatgcttatatattagtcagtcagtggaactgtttggggaggagtaggagcctcagtggaggagttaagtcactgggggtgtcctgtgcagtttcaaaagcccacactggggacagtcttgctctttctctacgtgaaacctgtggatcgtatgtgaactcttgggtactgtgcagcaccatgcctgccaccatatcacttcccttgacggtcctagactaaccctctgaacgctttcttttgccttggtcatggtgtctcctcacagcaagagaacagtgactaagacaggaatgctgactgtagtttttcttcctcaggtagtggcaatggaggccacagtaatcctatgtccacctacctgcccatttcttatccttatcaaagccacacgctccctccacagggcacgcaccacatgagcttctgcacgcaccacatgagctggttgtatttttcagctcttgttccacttaacatctacttattttgtgtgtgtgtgggggtatgcatacagaccacagtgtgtgtgtgtgtgtgaggggtattcatacagaccacagtgtgtgtgtgtgtgtgtgtgtgtgtgtgtgtgtggggtcactgagccatctcaccagttgccccattagcaaccttacaaacactgccactcctagaaagtctgtcactggactccatcatgtctgctctggcaccctcattttctttgtgactagcttcactttgctagccttattaagagtttacttgtgccgggtggtggtggcgcacgcctttaatcccagcactcgggaggcagaggcaggtggatttctgagttcgaggccagcccggtctacagagtgagttccaggacagccagggctacacagagaaaccctgtcttgagaaaccaaaagaaaaaaaaaagttttcttgtgccagtttacaagtgctgtggggactatacaggcaaataagtcagtcattgcacttaatggccttccagtctcctgagagcacagagcaaactggacattgctatagaataaggcaaacaaatgtcccatgcatgccatagaataagctccctaagagttgggggtgggaattccttgatgagaactggcagagtgtggctccctccctcccagccctgggcttcagctctaaacacctccttccctatgctcacatttattaagttatatcttatccttacccctcacccccagtactgaatccatctcctactatttctgagcacatgaagtgtgatatcaaaaatgtcccagcctggtgctgtgtgtggtatatgcttgtgatcccagtacttagtaggctgagttaagtctttagagttcaaagccaacctcgactatggagtgagaccctcttcttcttttaagatttagttacttatgtatacagtgttctgtctgaatgtatgcctgcacaccagattccattacagatggttgtgagccaccatgtggttgctgggaactgaactctggacctttggaagaatggaagagcagccagtggtcttaacctctgaaccatctttaagtcccttaagactcttcatttatttaacaaagaaagtgttcctcataacagttttagttttcgattttcaggagtcagagcagtgcagaatcccatgctcatgaatctggctgcagggaagggctactgatttggaagcagtgcggcattctctaatctgaatttgtgtcctagcagcagcctgtgatctggtcactaggagtttccttcacctctcagtttccactgctgccaaccttctttcccaccttatcagcattttccttttatccattttaattgtttgggtgtttggcctgcttgcttgtctatgtgtcacatgtgtgcagtgcctatggaggacacaagagggcactggattcccctgggaccagagttctagtcagttttgctttgttttgtttttaaatttatttatttattttatgtaagtacactgtagctgtcttcagacaccccgaagagggcatcagatctcattacggatggttgtgagctaccatgtggttgctgggatttgaattctgaaagatcagtcagtgctcttaactgctgagccatctctccagcccctctagtcagttttgagcttccatgtgagtgctgggaatagaacctgagtccttgaagagcagtgtccactctccactgctgagccatcactctagcccctcatgaggattttcttgattattaaagctgatggctcagagttctacccctaccagctggcagtcctttaaatccacatatggctacatagtttgtctaagaaagggaaccgtggggcagagtaagcaacttaatctgatccaagaatccaatttaagaacaagcccttgggggctggagaaatggctcattgcataagagaggctgctattctagaggacctgggttcaatccacagcacacacatggtgcctcacaaccacatgcagctctttctatctttcctatcatcatcttttgctccaagtgacatctggctggtcactttcccatcttttcagtgaaggtggacaccaaaggtgtcaagtcatttataagccagtcagctgcctcagattagaacagaatccctctagagtagccacatgcaaacagctgcagacaagttccaaaagaacagctcacttttctaacacagtgctgcagccaggagaagtgcttggccacatcctcaactaggcaaagatttcactggaatgatgtaggctggggtggggtactgtaggatgtggtagccctggctgattcgcaagcactggacacttgcaggagtgctcagtatgtgcaaaatccctgcaggggaaggaaaagtgggggaagcctgggtgcctagtctccagacatccacaaggaagatgagaagacaatctgaacaggttgaataatatcaggatggagataggacacagaaacaaggtgctcacctacaatctgtgatagtgtatgttcagtccccaccactactagagtaaagttatgtgaatattgtacagtaatacaagcccagactccatctatatgagcatatgctgagcttagagatacagagaattctagaatgatctagttccatggggtactgttccatgggatgatgtaattgggtagctgtggtccgcagaatatctagtgtctctataatggcatccttagtcctgattcccaccccacgtgggccagctctcctacaggaaggccagagattcttgatgctacccaccaaattcaactctagggggaggtctccaggatatcagcacagctctgaagctatagtcattcataccttacagacaaaaatcagcatcctggcttgtgggcaacacccccatcattctttacaaggtctcttccaaactactactaagattttaaagatcacttttattttatgtgcatgcatctaaaagcactatgtttgtgcctggtgctcacagaggccagaagagggtgtctagtccactaaagctagagttacagaggcttatatgttatcatgtaagtgctgggaactgaacccaggttctcaggaagagcaacactcttaaaatcgctgttcccacctgcctgggatttgttctagggtctcactggttatacatctggctatgttagctcttgagttctgagattacaagtgcacacacactgtacctggccaagatgtcagcaatcccctaattagtggccaccatttcttcttgttgctgttcctccttcctccccggccacataccacccactgcgtccctcaggtcctctataaggtgacttccatccgtcctactctggatgtggaccacactttgagtccttccgtttctctgtcatctgtgccccacaccatatgccagctaatgagtctatgtatcagcctctcttcaaagtgcctcacattcctgtccacggtcttgttttagcatcagctcgcccacccctgctgctctcccaccccgtcctgggacagtgaggagcacacaggggatggaatgtgctgtatcctggtgctcacccacctctgcagactcctgcttccctcctcttcctctttttaagataaggtttctctgtgtctctgtgtagccctagctgttctggaactctctaggattaaaggcatgtgccactaccaccacctgcccagttccttctttttggcctccgagctctctcttctgatccctgtcctcggatgaagcagtgtagtcctctcctctgtcctactacacatgtcctagatcacatctcctccctcttcctcatgctccaagggctgaacacctcacccagaacaagtccaatgccactggctggaatgctaagttagcagctgcctctctaccacctctcctgctcctgctcctacagcgtacccctcaccacctctcctgctcccacagggtacccctccaccacctctcctgctcccacagggtacccctccaccacctctcctgctcccacagcaccccatgaaccttgcaggtctgcaaatgtgcaggctcattcctgcctcggggctccggcactcattcctctctttgcccagagcgacttttctcccttctcctttcagagtgactcaaccgtcataccccatcgtctgcacccccagttttgttcacttcatgtgaatgagtaccaagcatataagagcaaactcccacatacaccccgtcctgggacagtgaggagcacacaggggatggaatgtgctgtatcctgtgctcacccacctctgcagactcctgcttccctccataaccatctgcacacctgccctagggcacacaggtgccttcagatgcaatctagccctaggtagtgtccccactccttattcctattttagaggatgttagtactagccagccagttccacaaacagaagccagagacccctgcccctatatcaaagcagtctccaccatccccctttaccttttacctacccctccttaattttctcttttatctaccagttcaaccaccagtccacccacccacccacccacccatctaagacaggaagggtctttacttactgtgtaagctgtactgcctagaagtcagagcttcacctgcctctgcctcccaagtgctgggattaaaagagtataccactatacctagctctttttcttcttgttgttaatgttggtggggagtcaacaggactctccacaccaggcaagcacttaccactgagctatatttataccccaaagtttttcttcaccccacctacttgctgtatccactaacaccaggggcttctctttgaactatttgaatgatttctagaaccagtgttgctgtaccatggctcctacccatatttgactccagggtcaaataatgatggtgactagcaaatgtgtgatcactccttttctcgagcccttctgtgactcctggttgctcttgggtcttcacagcaccaagctttggctctgctgtccttgagttttttctcctcagtcataccatagctgcaccaaggctgtggctccctggaactcctccagagcacaggataaaacaaaaagaaagcctcatgtttggctctttcccctactacaactcattgtatattcagactgacctagactcataatcctcctttcttagcctacaaaatgctagggttgtagcaaatacccacacctcgctagaactcctaatgaattcagcttccttccctcacagctctattctgcatagatacgttcagaggcttcacggctgtttttgttggaaaaattcattatttacaaagtgtaccttgccactctgtcactgtcttcagacacaccagaaaagggcatccaatcccattacagatggtagtgagccattgctgggaattgaactcaggacctctggaagagcagtcagtctcttaaccactgagccatctctccagcccctgtctgagtttcttaatctgggatcccactgaatattcaaacacccctaggacatgagacccattgatcccatgttacagccagtaaaattcagtaaatctcatgttttctacagctttcagtgtttggctatcttgggaaggatccttgtaaatactggaatctgctttagagccttcagcccaatcttgcagatgaaatcccagtgggaaaatggcgtgcatcagcgtttcagatcatacacatgttccctcagcaaagaatggggaagagccctccaggtgctatcagtagaaaaacaagcccacacaggcccacagcagttcttttttaagagatacataagcctttaatcccagcactcgggaggcagaggcaggcggattcctgagttcgaggtcagcctggtctacaaagtgaggtccaggacagccagggctatacagagaaaccctatctcaaaatcaaaaaaacaaagagagagagagagagagagagagagagagagagagagagagagagagagagagagagagggagagagacataaggagctaggcagtactgctgtacatctttttaatcccaatactcaggaggtagaggcaggcattatctctgagttcgaggccagacttgagttagttctacagagaaagttccaggacaacctgggctacccacagaatccctcaaaacaaacaacacgaaaaagaaatacaacagaactgcctctaacataccctgttgttaggattttacctcttttatgtcatttgcctgtagtttaaaatagttgcccattagggtgcaaacagcccagcacagggagtacatgaggcctctggaggtccctcccacttgccagagacattctgaggatggcaaggtccctccagccgactttacagtttggtgcctaaaaactttttggagtgttattgtgggtcgggtcttgaacttttgactgtcctgccttgccatcccgaaggctgggactgtcgccatgctgcaaatgcacattgcattcttttcttttcttttttaaaaaagatttatttgtttcatgtatgtgagtacgctgtagctatcttcagacacaccagaaggcatccaatcccattacagatggttgtgagccaccatgtggttgctgggaattgaactcaggacctctgcaagagcagtcagtgctcttaactactgagccatctctccagcccacattgttttcttttaggaagagaacaggtttatcaagtacactggtactgcctgcctccattgtccttaagtgtttactgtgaattcattttagattaagaggaaactacaaaagtagtatggaaaggccactctgtccagcagtctctcccctttctcttttaaactagctcatgtagcccaggctggccttgaagttcttttagctgagggtgactcaaccaacagagacacattctcagatcctgaagtagtgtaactaatgtctgaaagatgagaaggccttatgagtggggaaggaactattttagttaggctgaagacaacttggaaggtttagtttacttaaaagaagtagggctttctagcaagttcgaatgcctttttatcatcttcttcctcttcctcctcgatgaggaacaaggtgagtttcatctcacccatgaagaaatggctgtgggattcccacgtcatatctaggaacagtgagtgatactgactgtgtgctgtggagagagacattagcaggacatggctggaacattaatagcacaccttatcactcaggaaaagggaagcaagcaagaggacagaagaaaacagagcataaaggagaaaggcaggccaaatacaacagaaaggtaagcactgtacatgagcagcagaccagcaattagagggtccctggttaaattccctaagcagaagttaccaggtgaggaggcataaagggtgagcatggagagctaattccttctcaaactcagtttgaaaggtagacagactgagtggttgccagggactgaaaggagaaggaaggaaggaggaggaggaggaggggggctgtagaagagaggaagagctgaaggagatgtagcatttcttactaggaacacgttctgtaagtgacgtacaactgctcaactctatgaatagactagcatgcccactgaactaggtatctaaaatgggagaatgaggcagcatgtgactactatcacactaaagctcttatttaaaaccgagggaggggcagctagatgattcagtgagtaaatatgcctgcttccaagcctaacaacctgaggttattccccagaaccctggaagtgccttctgacccacacacatgcagcatgtgggggtggggtgtgtgtgtgtgtgtgtgtgtgtagaggcctgaggttgaattcaggtatctttctcaatcactgaccaccttatccactgagccagggtctctcaggtgactccagacttcagtactctgacaagtccagctaagtgccctcgcccatctgtctctgctccacagtgagcccccacgctcacccagcatggactgtgtgctagggaagcaaattcagctcctcccacatgcccagctcatacttcctcacttaccattgccctagatcccctcaggactctgaagctctgttcagctgtcttcctgttttctactgctggtgtgggtcacaagggaccctctttccagaactttgagatggcatgactgacatggctctattttactaacctaagtctgggcacaggcacaccctttaatgacagatcattccctgcagctgtcaaaattaagttatataggtaatttcccactttattttcctactgtaatttctattattctgatattgggacgtctgcagtggtcctccaaattccaccacccacccacccacctacccacccatcccccaatgccccagttttttgagatagggtttctctgtgtagccctggttgtactggaacttgctctgtagaccagactcctcaaactcaagagatccatctgcctctgcttctgcctctgccttctgggtactggaattaaaaagtatgtaccaccatgcctgcctccttttcttccttaaaaaaattgtttttttacatttgtttatgtgtttgtgggattgtgtgtgcatgtagcaaggcatgtgtgtggacaacttgggggagagtccaatagctctttcccaccatgtgggccctggaaactgaactcaggttgtcaaacttggcgatatatccttatccactttttccttgccaactttttccccttggattttcctctttttatttttaagaattttttatttctatttatgtgcgaacatgaatgaatatgttggattgcctgaagctggagtcataggtgcttgtgagctgcctggtatgggagctacaaaccaaacccaggttctaagaacagtacatgttcttttgttttgtttttgatacacagtcttgctttatagcccaggctggccttaatcctcctgcttctgtaccatgtctgattctcttttcaaccttatttactttatttatttatttaattttatttttcaagacaagatttctctatgtaatggagccctccctggctgtcctggaactcagtttgtataccaggctggcctggaactcacagattaaaggcatgcaccacaccctgagtatgaatgtttgcctgtatgtatgtctgtgcatcacaagcatgcagtcccataggggccagaagagggcatcagatcacatggatctggaaaagtagttgtgaagaaccatgtggttgctgggaattgaacttggatcctttgaagagcagctaaactgctgagccacttctcctgcccccaggcctcacttctgatattgttgggatttgcttcaaaacataggttacagggctggtgatgcagctcactggagtctttgcttagcacatcaaagccctggtttcaatctccaacactatacaaaaccaaaaagtaccatacagtgccgagctgcttgctacttaaaaggctgaggagggatggctgcttgaatctgggagcttaagactatgctaggtgatagtgagactttctttcaaatacaaaacaaacagatggggaaaaaaaaaaaccctcaatacccaggcttggaggcacagagtcatcttagctctctcagcatagaggcaggagtcacacagctaaccgaaactacaaagcaagaccccatcttaaacaataaatggcaaaaggccatttgggaacgagaggcctgagctgttcatctctcctcaagaacagcaggggttaggttccgaagtcactgtgagtacaggctgcctcggaagtatgtcagttcactctgtctccggatgcattcacctgctccacagagcctatgcacatcctccttaccccatccccatgtcccgggctctaggttcactgtgctcagctgatctctgcctgttagacttcagtgtgcttccttcagtctcacttcagtctccctctctaaaggaaagtgctgagccagggacctggatccctaatgttgagctgggtggcgataacacaggaccctgatggagcagcacaatcaattctctcctcttgcttcacactctgaaattctctttcagttgtgtctgatggaataggacattcctgctgagaccctagtaaatgtaaatttccatttacctggttaatctagataagatataagcttctgtagctagagcaggtacaggatctgggaggaaagcaggagaacaagttgaattctagctgggcacagcaagatcttgtttccagaaacaaaacccagctgaggctacaacacagcacagtagaacagtgtctgcctcacgagcatagtgccctgggttcaatccccagaaaaggcaagaccaagaaaaagaagaaacaaataagaaaaaagggcacagccttcacagcccctgggtctcagaaccgctgacagcaatgtaaagccagcgttgctcggccctgcactgcccacatccttctgctacccatttttgctgtctggaagaattacgtgtgtataatccacatatacatttaatactgtaagattttctgagactctgctctctgaattttgaaacttcttgtctaatgaaagcacaatatgtattctctctgctttcaaacagcatcttagtagcaaaaaaaaaaaaaaaaaaaaaaaaagtgtactgctggacaggatgagggagtgagtgcatcccaccgtctgtgaggcatggcaagggtgttatgtagatctgtaaatgccctgaactgagcacactctcacacagctaaaggtttggacatacccatcactgaagctcattagcaacagtaagaaataaatcccaggactgatggtgaatacctatagtttcagaacttgggaaataaaggcataaggataggagttcaaggccagcctcaaccacatagttagggggcagtgtagtaggctacatgagactctaaaaggcaaagaaagaaagaaaggaaactgagggggtggggatgtaagagtaagcgaggaggtgaagagttgcaaagtgctattgcactgcactggctctccgccagtcttcaatgaaaaccattggtctttactaaataaaataataaccagcagcttactttctaatttttagagtgctttcacctatgatccacctgcagaaactaagtaatccagtggaagggtaaagagcctttactttgaattctggttctaccagtttgctggcaacgctgtccaattagcctgctgttaagtctcagtttacttacatataatcgccaaataatgtctactatttgagactgaagtgaacattaaataagagagaaaagactttccttgtttcatatataggaagaaaatcatgggcacctttctttacattgcctttgaaatgacaatgtccttggtcaggcagtggtggcagaggcaggctctgtgaactctgagttcaaggcaagcttggtcttcagagtgagttccagcacagccagcactaccaaaacaggggttgggggaacaaatcaaaagaaccgatggctcagtggttcctctgaggactagaaattggattccatggatcctatataaatgccaggtgggggtgggagcctgcctataataattcctgcttcagagacagacgggcgcctcagagcaaactggttagctagactagccatatcagcaaactcggaatttgattgatatttgattgataaaccctgccttaggtggagctgggcgtggtggcgcatgcgtttagtcccagcacttgggaggcagaggcaggcggatttctgagttcgaagccagcctggtctacagagtgagttccaggacagccagggctacacagagaaaccctatctcgaaaaacaaacaaaacaaaacaaaacaaaacaaaaaaggtggaagaggtactgacaggccgccatctacacacacacagaattaaaaacgtaaggatatatggttcgtaaaataacttgtcttctgatcaaacacacattcagagcaggggatggctcagtggggaaaagtgttagccatgcaagcctgatcatgagttccattcccaaaacccatgtaaaaagccttgtgggggaggggggcacttgaaacacacacccacacacactgttgtttaaacacatcactagaatgcctttatctttcagaaaggaaaccctaagaggatgtaggtgtcccatggtggagcatctgcttagcatgacaaggctctgtgttcagccctcaaccctcagaacaaatcaaccacaaagcctgagacttgctatccactgtactctctgttgcacattcccccagaccccaggagccaaccttctcctttgtttctcagtctgactcaagtatctcgtacaaatggaattatgtagtgtttgtcttttttgtgactactttgtttcatttagaataatatcctctaggttcttcatgttagaaatgaaaaggggctgggagatgggactatcagtaccctgcttttggtgcagacatgaagagctgagtttggattgccagcaaccacacacacacacacacacacacacacacacgtgtcccagaaaggtatctaatgtcagatttggggtctgtacatacacatatgctacacacacatgaaaacagaaaaagacaagattgccttcatttaaaagtactactattccaggggctggggagacggacggctcggtgaagagcatgcgctgcttttgcaggggacctggccttctccccagcaccccatggtggctcacaatgtctgtgactctagtcctagagcatctgacactctctctgaccttctgaccttctggagcatcaggcacacatgtggtgcacatacatttttaaaagtaatattgcagggttggcaagacgacacagtggtaaaggtgcttgctgggtgaggctggtccccagtgcaatctccagaccctacgtaggacagatgtatgtgctggtaccaactggagcaggaatggaagtgcactgtgtgtagagagcagtacaaactgctatttactgatgctgtaacagtgtgatctgggatgaacaacaaggtttcatacgaaatattgctgtcttcctttccttcacatgaaccaagatttctaaggacttacatttataaaaacaggataaaaactgagaactcttcttcattctaatgacaagaaatgcttgtccattgttatggacaaggtaggagtggctgcttcacctgtttcattaagattaaggaaggcatttctgctaaacctggactcttgcttaataattacttataaaaacttataatgcagttgggtgtggtggtctttaatctcacttgggggacagaggcaggtggatctcttgtgggttccagtctggtctatataggggagatccaggacagccaagaacctgtctcaaacagacaacaaacaaattgttgttcattacatattaaaccattataatgcaacttacaaaacagatgtggcagatgtggcacatagacactcacacatgtctatgctcttattcaacaattagtatacatcatttgtacaaagtaatgggttatcagatagtcacctgtatctacaagctactctggccacagtagtcaccctctttaccttctcatctctcccccctctgttcttttcagagtcccccctcccctttttaaatctagattctgcacaggtattctttgctatgaatcaccttaattttctttaattagcttactttttttttttaagctaggggtataggctcagaagtagagtgtacaagaggccctaggttttttgatcccctgtaccacatacatagctgaacaatgaaaatctgaagttcaatttatagatttatttttgttgcagagaaatattgaagagtgaccagtaaacgttttctttttttgtttttaacaattaattttaatttttaagatttatttattattatatgtaagtacactgtagctgtcttcagacgcaccagaagaaggcatcagatttcattacagatggttgtgagccaccatgtggttgctgggatttgaactcaggaccttcagaagagcagtcagtgctcttaccagctgagccatctctctagccccccagtaaatgttttcatacatgttatatcaaaaatcaaaatatatattatatggagtcactctaaaaaaatttaagttccaagaaacaacagtagtgattcaaagttttgtttaaagaaaaacattctccaaatggttattaaagaatatcatgctactaagatgcctactggcttcatttaagaaagtgatgtagccatcttatttttaaatgttaatatttataattctctagaagttaaattccttgaactataaatagcatgtttcaccatttcaccttctaaagtatctggtttatattaagcatgcagaatgtacaatttttatttttcacttaaatgaattatggtggggctggtgagatggctcagtgagtaagagcacccgactgctcttccgaaggtctggagttcaaatcccagcaaccacatggtggctcacaaccacctgtaacgaaatcagatgcctcttctggagtgtctaagacagctacagtgtacttacatataataaataaataaatattaaaaataaaagaaatcaaagtccctttagatgctttttggtaagagggcaagtccttgtgagtactggcctattatagtttgcaatgatctaaataatgaaagctgattacatccatttagcccagttctcccaaatatttcactttaggtgtgtttctgaggatcaaacccagacactctaggcaagtgatctattactgagccactaagtcattccagtagcccctagaattcaaatagccaatataaagctgatgttccatagaacccttggaaaaaaaaaaaacaaggataagccaggcagtatggtacacacctataattccagcactagggaggtcgaggcaggtggatctttgatttcaaggccagcctagtgtacagagtgagttttagtatggccagacctaaacagagaaactgtattgaaacaaccaaccaaaatgaaaaaagaaagaaaatcaagataaattaagactcgtcttacggatcagttctttttaagtgttcctagcagcgctcaggaggccgccctgcccgagagatgcgtgggcttcgtgtcccatcacgtggctgacacagacccagtatctgaaattcttggttcccaggaaaaacttactattgatgttgaagaacaagtatctgaaagctggaagcaaggtagaggaatatgagtagcttaagggggttttgtataactggttaaatacaagattttataggaataatacaatttggcaggttaaataaaagatgtagtagaaaaaaaagtccattttaaatatattggaaatacacatgagaatggacaatagactagcagaaatacagatcttgcctggaagtttcaaaattattattacaggtaacataaaaagacagaaaagaatcaacaatgttatttaggaaaaaatatcacttattttttttttaaaagtggaagaggtatttgtctaggaacattgtttttaaatgtgtaaataagaggccaaaaatgtgaaattcagggccaatattagctccacagcctgactacatgggatcctgttctagaaaagctgggattttgtttgtctttgatttttctttctgttgagagctggaaattgaactcctgcttgtactaatgctctacccctgatctacactttcagccccactcaaactctcgttttttacattttttattttatgtgtatggcattttgcctttgtgtgcacatgatcttcataatctgttcaccaggcccaaatatcttccatctggcaccaaaatcttaaaaaacaaaacaaaacaaaacaaaaaaacctaagccagaggcagcaagatgatggctcaaattacaaaacctgtaacttgagttacctgagtccagcatggtaaaaggaaagaattgtcatcacatgtattcaccatacagtaaataaataaatgtaataaaaattaaaaatgaaaactccaatgattaacacaagttaagagccagatagtaaactcatggttatattatattctgatttaattataaggtgtttccaattctaatagctaagaatagtcaaagtttaacagttcagatatgctttatatagtcttcaaaaatatcaaaagtctaccaaatatgacatttatagttaaattaaatgtattattaaatttttgactaagaggcatgtctgctcctgacagtacccccttcatggatcaagagaagatactgagcatcataaccgcctcagagagctgctccagctgtacaaggtagccactggggaagaactgcccttattcatcgacagaccaaaagtactgtccaggaaaggacacaggatgtgggatagtcgacagcttagctctgccaagaaagggtaagctagtcttccatagttgctgcttcatttaaggtctgtcagatggttctgggccagaaggctgaagacagatgcttcaacattttaaatgggcaactgttcaggtagtcagctatctctataaattgattaagttttgaaagctatgttttttgtttttgttgttgtttggtttgtttttttgagacagggtttctctgtgtagccctgtctgtcctggaactcactttgtagaccaggctggcctcgaactcagaaatccgcctgcctctgcctcccaagtgctgggattaaaggcgtgtgccaccactgcccagcgaaagctatatttttgtgcttcaaatatattcagataatatttaaatcattctcagacttctggcagggttgaagacaagttataatctcataaatcacacttaagtttaatactaaaaaaagatctagattttaaaaagatggtttgcagatggtaatacaagttaaaaatcaaaacataattcagctattattatagactaagataatgttaacgtaatatacctaagttcgcaaattgatagactagatggttattagtccatatcataccttatagtttatattaactgttttaactgttcattgtatatctgaaagaaagggcctttttagtggacaaaaagggggaagcatggatttggcttaatgcttgtattatgctatttgggttctcaaatttcatgagaatccctcatgtaaaatgctgagggttctttccctcagttgatttcgattgctaaataaagttgccagcagccaatggctgggtagggagacagaggaggggactttaagattcacaggcaaggggactgagagaagaggaaggacagaactgtcatgctgggggaagtgcaggacacagacaacaaacatgtaatagtcatggaggagtgcgtgtgtttacgcacacacacaccgccctaattagatctagtatagcaaagacagaatgtagactttagtaataattcaggagtattggaggggaggcattatcgagtaacctagtcactgggctgattaagacatattaaatataaggcggcacatgtgtttatatctgtctgtctttcattcaagaatccagaacactggggcaggtatggaggaacttgtgccgcccgccattgagtggttagagcacattcattgtgtgtttgtttcatcccactgcttactgcttcccaatgaacctgacttctgtccctgcttaccaacttagcagttgtccgtctgccagactgcttaggccactggcttttctcacacactcagcaatctcgtgtctcagagattctgtactggtgaacctatctggaatgttctttcctaagactttcggctagccaagggctttctcttaggtacaaataagaacagagaagctgggtggcggtggtggtgcacacctttagtcccagcacttggaaggcagaggcaggcggatctctgtgagttccaggtcagctagggcggtacagtgagaccccacctaattaactaattaatgaggtctaagttacctaggctgctctcaaactgtgcacagtgagaccctgtctaattaattaaatcttccttcaaccttctgaggagctggtctcctaagtgcccatttccacttctgggtagaattaactttttgaaattactgatcatttctctccatggcaccaagctttaatctctcctgtccactgttatattcctagtgcctagaacatgatggcccacacagtaggagctcaacacctgttaaaaaaaggaaaaaaaaaaggggaaaaaaaaagaaaaaaaaggaaaggagacacacatgcacacacacacaagcatggagtcagagttggaaagcaaatcagtaaagaaaagaacagaagctaagagccttttggaagaggaagtcaagaatgatgacttaagaaaccactgaatttggcaataccatatttggtgtcctttaagggggcaatttcagaaaagtaggtaaacagataacaatgtgctagtaatttcaggtggcaagggcaaaagggaaggaggaacacagactgagtgagagtgtttgctctagtttccaagctgaaaggcctggtgagaaaggaaaagtcatctttacaaacaagactgccccacactatcacagaacagtggcttcttcatgcttagatgtcgtcttcaaatgaatttacccgtctaactcttacatgaatttccagtctcgctctcaggagtccacactggggagtggagtagagtagtgtgcatcttcaggtgctcacaggacaaagcctctgggaatttgggaggggaagcagcgtgcaaatgacaaggtaacaagagctcaaaggggacaacggttcaatcaaagtgaagtgtgctttgtattgttggtgtcctacttctccataaacgacaagttaagctgggcatgctattgcacacctgtaatcccagcactcaggaggcagaggcaggtggatttctgtgagttccaggccagtgtgatctgtaggaagagaaaccttgtctcaaaacaaacaaacaaaaatccaaccaaacaaaaaaaatgagagtggataaacagacgagacgagcagttagctaaaggagagcagctgcttgtcagcaggcgaggcaggaaggtagctttaaggatgaacaggctgaagtgtaactgtcacaaccactcatgggcaattcctcttgactcagtagcaaatgtctaacaaaggccatagagaaactgggaataaagatttataacattttattatagaaacaaactgtccttacttccatagaagactattttcactcacagaatgaaggtttgtatgaagtgggtagtaactttctataatctagcaagcctaataaggccatcctgccatcaggacacagtctctgggaccagcagggtaagctcagcgagtgcaggtgctcgctctccgcccgagtctgacccctgatcccagggcagaaggaagggaagcaccaactcctcaaaggtgctcttggacatccacattcaaactgtagtatgccagcacctatgcacatacccaacgcaacacacacacacacacacacacacacacacacacacaagcaaaaatagagtacacaagctttttcaagagcaaattataaagaaaatgtaataggctggttcctcaaaagctaggatagagaaaagcctgaagtactgttcctgatctctaacatggtgggtagtggtcaggcttttgctggggtgatgtgtttgtgagctaccctaagaagaagaggacaagtacgtaaaggggactcttattagcagtgtctatctcatcacacacaaggtgtgccggctagggaacactagctgtgtagtgactgcctaacagtctgatattgccccatgctgggagggttaaataacagtctcacacacacacacacagagacacacacacaccacacatacacacacacacacaattgggagtaacaggtcttctcttttttagctctctgcaaagctttacacttgggctgtcaagatggctcagccagtcttccaccacacctgatggcatgattataatcccgggactcacttggggaagccaactccagcatgttatcttctagtctccacaggcatgctgtggcatacatctactaaccgacatccacatattttttaaaaatgtagtgagaaaaattcaaagttgtgctatccaagttgaaatcctacatcatcaaggcctctttccccctctaaaggagccactgaaatggaaacccctctgcttccttggagaggcctctcttgtaggcccaaccccgggttgaacagctcagctagcatcacgtcagtgaaaaggcccttcctctgtagagaaagctgaagtctcaactcacaagaccctcacatcaagctctaatatggtaacatcaacctgacatggcaaatctatctgctcagggtttcacattcaaaggacttactgacaagtcagactcaagtcgctttttaaagctaagcttggtggtgttcatctttaatctcagcacttgggaaggaggaacaagcggatctctgaatttgaggccagcctggtctacagagcaagttccagaacagccaggacgacacacacacacaaacatggtgtgcccaccaaaaataaataaataaaagtttttattttt

SEQ ID NO: 27 - DNA, 2415 bp, Mus musculus
aagagaattaagactttatgagggaacatggcttcagggtattgcaaatacaaatgaaataaccatgttatgaaggttttatagtagcaaaagaaaagtcataatctttcaatacattagtggaaacatcaggcaggtgtttccagcaaactgaggctaacctctgctgtaggcctcatggtatcagatggtatccttagcctttggcttgggaaagctagttgtctgtcagtacatttccaaagttttcacatggtagtcacatggagattaagtcagatagacaatcgggcaaagaatggctttgaaggaggctaatgatagtccatgacatctgtatctgcaacatcccaactccacaaccatgaacttctaatcagtccaccaggcctgtagaatctttaacagagggcgttttccttctgagacattcatttcataccctttgcacaggacagggtgaagggcagggtaagaaactcaaacctccagctcgtgagatgcttcagtggctaagatcacttgcgattaaacttgacaacctgtttgatgcccaggacctacaggatggaagaagagagccaactcctagaacatacaagtcatggcacataagcactcacacagacacaccctcaccctcacataaacacatacaaaataaaaataaataagtgtaataaaggaaagaagcccaaacttgtgagtgaaaagacacctcttttgccttaggcagctttctttcatttccttcctaagattttggaaaacgaaaaacacttgaaaataactgtcttggctaaaacccagcattctggctcaagacaggaagagaaactgtcaattcagtctataccctgtctcctcccttgccaacaccccaataccataacaatgcttttgggaagctgaggcagaaggactcccacttgcttaaggtcagcttcgactacattgtgaggttttttttttttttttttttttttggtttttcgagacaaggtttctctgtatatccctggctgtcctggaactcactctgtagaccaggctggcctcgaactcagaaatccgcctgcctctgcctcccgagtgctgggatcaaaggcgtgcgccaccacgcccggctctacattgtgagttttaaacaagctggggatacagtaagtgcttatttaggaataaaaagaaagaaaaggtaagttaagatagaagaaaggaagacaggaaggagggaacgaaataaacaaaacatctagctttcttacatatttacataagcatctctccctcattttcatttatttatttgtgcgtgaagctgggtattaacatttcgtctaggctctgccccacagttacctggctgttgccaggtatgcctgactcactataaaaggggctgcttgctccctcctcactatcgtaccctcccttctctgccccttctctccccattcctctccctgtctctctccacgtgttcatggccggcctctactcctcttccccccaccccccctctgtctctactcccttcccatgccctaaataaactctattccatactatactcgtcatgtgattggtccctcagtgggggaagggatgcctcagcatgggcccccgcagaggcaccctcttccccagcaccataccgcgcctctaccaaacatccctggcttccttttctttttttataaaacacaacactaggaatcacttattcctgcacgggcaacatgtataaccctacagtgccaaagtcccaacgcataactgacttgcaggtaccaggtcatcactctccctcccaagctggtacccaacctctcacaggccatctgtgttacctccacattctgacagcccctccctcctcattccccttggaggccatccatgcataaacaaacatgcagcattttagacccgatgaaatcatccttactcacgtttatattcagggcgactagcagagtgcagaacctatgtgtgcctttgaaacagtcacttgattgactaaccacaaaggtgacctaactgtcttggagaagtgtctgcattcagggctcaggttcagtcaggatttcccaagactaaaattcacagaataaaataaaaccactctgtccttgcttaatataaacaattcattctctttcgggatagcgctcagagtgcccagatgcgcgtgttctcttccctactctgtacagagtattaaggcagagcttaggcctggctcttccgtagttgatgattccctaagaggacggatgaagagactggggtaactctcacccacagggactccttccgcacagttggaaattaaagcgcaggagtttagccagtgctgttatctcaggtttcctcagcccctcccagggctagctttcccagacagcactg

SEQ ID NO: 28 - DNA, 16129 bp, Mus musculus
tttgtccacattttagttactttaatgggtttttcctactggggtttccatctctcttatctgacttacaataatttatttatatttaatattgttacttctagttctataatcacatgcattatataaattgtaaatattatttctagtgtctatagtgaataaaaattaacctttttagtacatcaaactattaagtatgtattctctatcaatcttctttctaaaagccctccttaagctggaaacatggctctgcagtaaggagtactctctgctcatacagaggacattcgttagattcctatgcttggcagctttcatttgcctataatcccagctccaagtgatttgatgctctgacctttggagtcacccaaatttgcatgcacatacccacacgcatatacagcataaaaataaaattaatcttaagttgttcttttcaccaaagacaaaatattcttctgtgcttaaggttttatctcttttcattttcaactttatgattttcaacagagcagagctccctgtttagctgttcacaatcatatggacatcgcaggcacaatcctcaggtggcaggtcctggcctaggttccagcccacccacccggtcagctatcctcagcggccatctgctcacatcctctccacaatctcccttggctctcaaggttccagttgtctgtgagaatagaggaaaaaaacatccagcgaagcattctgcacgcagcactcttctcagttttccagagctgacttcagggaccctgcagaaaacaaaacaaaacaaaaagccacccctactgccacccacagaggctgtaacctgaggacaaggctgtggcttagctggtaggaagtcctcatgatccctggacagcctttataggtttcttggctgtttcctggcaggagttagcatgtgggcggtgagaggatcagaagaatcttggctggtatggtagtctggacaaagtttgaaagaggaactctcacagctccattagctgccaacatgggaataaagcacccacatggatattgtccctctgtcactcagggacagaaaagggttcccacaatgcctagcacctgggaatccctacacttctccagaattgagacaggtatatactgctgcactttttccaagaaaagaaaactacttctggatattcttatcccacctccactgtgatgtttggctgggcatttgaacactgtttgggatggtggtatagccttgctgaggaaggacattattccgagtgggtcttcagacatcatagactcaccactttcagttctccttgacttctgcttgtagttgaaggtgttcttacttagtgtcctgttccagctgcctgctgccatgactctcccaccatgatacattcctaccaccctggaagcataagccaaaataaaccttttcatctatgaactgccttggtcgtggtattttaacatagcaacagaaagtaactaatacaaaagttgttaccagagagtagggtgttcctatgaagaacttggtgatgctagttttttttttttttttaaagaaatgtagaagactttggaaattgcatgtgtaaatcagttgaatgctgtgagcatggttggccagccactctagtgggagcctagaagacaacagtgatgaaagtaacaggactgagggaaagccagcttaggagatttctgaggggaacagtgtcagcaactgggctagagaccatacttgtgatattttgagaaagaatctggctcccttcttactgtgtcctaagaccttgcctgaggctaaatttaaaatgaagggactgggctgtttttgtctatttaggttgttttcaggtgcaaagctctctttccacactgcccgtcttactgtgtgactttccagtattatacaggttttcaaggtcattaatgcaccttcaggtgggtctattttagtctgtttgtaaatatagttttatcgaaatgaatgtatttgtaggtagcatattatattttactcaattttattagtctaaattgaagtttaatttataggtagctgtactctggagttgaattctcaactctattttttttgttatgaaacattgtgagtgttctgttaagctatagtaaattctttttgaagtcaaaattttcctctataatcagttaaaagattatgggaactgtgggtcttgttttacctgaaagacagattgtccatcatagtaaatttgcaataaatcatttcttccaagcacggtctcatatccatagcagaaaaagctcccctcaaaatcatgacatctctttggcctagaaaataaggactcctatttgtgtaagattgatgatgtaagagggggtaaaatttaataggtcataagaacatctttcttctcaactcaaaaaaacattggagaaaacagaaatgggtcatgttgtttctcacagatgcatttagtttagttctaagattatatcatagcctgccctactgggagagggtaatttcatgattttcacagtgaccacaacacaaatcttataatcaaatgcatttttcttgttcttgaatgcacataactccagactcaaatttcttaccatatagtctcaataaaaacattcagttagaaaacattggtgccaaaaaaaaaactttgagcacagaccatctttttgaataggagctgtaagatcaggtctcagatctgtgaggcactgactgtgttcttgagagaactttcacctgacttattttgccatatgtaaaatgagacaggacctggtagtctgccctaaagttttttctaagtccaccattatggcatcctttagcttagacggaaaaacaaaagaaagaaggatgggggagggagggagagagtgagtatgagagagaaaggaagaaaggaagaaaggaagaaaggaaggaaggaaggaaggaaggaaggaaggaaggaagaaagaaagaaagaaagaaagaaagaaagaaagaaagaaagaaagaaagaaagaaagaaagaaaggaaaagaaaagaaaggaagaaaagaaaggaagaacaggtgtaaaaacataactagcagactccagaaaggaacacattgtttattctatgtggctagcaccaagaaatattccaccattgtgttgatctactttgccgtgtctatgtttggattggaggcaggccaaaaatattggcagtgatgggaatttcagtgtttctttcttcccacaaagtaaaagcattgtttatgccaacctatctatgtgtcctatgattaggtttagttgtcaactggatataatatagaatcacctggcaagagacttttaatgagaacatgacctgcgggaacgtatgtggagctataatcttgattatattaattgaggtgagaaaacttacccactatgggtggcaccattccctaggtagaagattgtgaactatataagagtggagagggaacaaaacacataagcatccatgcattaattctctctgttcttgagtgtaaatgtgccttaacttcttctcaatgatggactgcaatctagaactgggagataaaataagttctttatccccttaattattttcggaaggatatttttattcaagaaatgggaaaaaaagactaagacaatgtgtattttccagtaacaaggagactttgaaacaattttaagtctggtattctaaaatgaggagggaaaataatctgtagatattcaataattaagcatgatttcaatgtatcaatagagaagaaatatactttcccttcatccaaggaaatcttctgtataaaaactttcacgttccccctataaaagggggaggggcttgaagcagaggcccctgagactacaaacctctgaagaatctgattgccaagacagacaacatgtctataagagaaaggaataaagatgcctatttacaacaacttacatgtaaaatagaaatctgggtctgtgtcaagaatattcaccaagaggacagaggggacagggaatgaataaaaacaaagtgggtggtgtaagtgtatggaaattaacccttgactttgcatcctgtttttaagaactaataaaaatatgtgtaacacaagcattattccttttaaacaccattccaaggtcaattgccaatgctgccatcatcaattcctggagaaggcaatgggttactttcctgacaacatgtctgagaggccagttctcgaatatgaactgacaccttgctcaaagtgcatattactgaagcagtgcacagtgggtggtttgtgtgttggcaaacaaagtaaggcaactcccattcttgtcataggatggatctgcttcatctgcgctgctcttcgcggtagggagatgcttgtccaagcacagtattctcaggcctgcacttcccagaaacccagctttcacccattatccctcctgcaaacaaaataattgtggtggacctggtggaataagcagataagcccagttactcagaagactgaggcaagcagatcacaagttcaaggcttgttttggctacagagggaactcaaggctgtcctgggcaacttagacccagtctcaaaagcattttttagtaaaaagactgaggatcataaaaacctcagtgttagagaatttgctcagagtgtgagaccctaggttgaaacttcactatctcaaaaccttaaaatcaatcaatcaataaataaataagtgcaaaacaacatagcaaaaataaacattattaggaaagagattgaaagagcaagttagatatatgtatgctacagttctaaggtgcaattcacatgcagggtagaaaagagcctttttgcttaccttttgtataaaataattcagacctaggttgaacctaaagtagcttttgttgaccacagtgtctccaatgaactattggaatgatttttacaaggcttgataaaataaatgccagacactttgggttgctcctagatttagctaaaaatattcagtgactctagagaaatgagatttaccattttaaaagcgctgatgtagaggaatagtatccttctcttccttccttctacactggagatggaatccagaggattttacatgctggacagtgttctaccactgaactaggcacatatcagcttagctttatagacacagtttggttttggttttggtttttatcagttctgggtattttgtagtgtgtttacaaagtttcagcataatacaaactagtagaaaaaccttaaattctaaggtcccaatgtcatgcaataaatgaacatttctttccttttagtggagaggaaacccaagttaaatagaattacagttcagggagtgaaaatacagcttcccaggacaactgatatctggtgagaagtgacaaatccagagacagctatgagccaaactggaaaatcaaatgtcatgagcactctttctgtgtgtatacctctgtttctctgtgtgtgtgtctctgtctttgtctctctttgctctatgctctctctctctctctctctctctctctatatatatatatatatatatgtatgtatatatatatatatatatatatatgtgtgtgtgtgtgtatatatatatatacatatatatatagatatagatatatatcctctgtctctctctgttcctctctctcaatctctctctgtatgtatccgtctgtctctgtatctttctgtctctgtgttcctgtctctgtctctgtctctgtctctgtctctcattctaccttgtcttgtaaagctaagccaagcagtggaacatagaggatagaggggaaaggtaggatcagaagggagcacaaagccacatgtctgcacaggctggagttaagttatcggctactaaggttgttctaatccaactctttggattacaactggagttttagaagaagactatactggctagttttatgtcagcttgacacaaaccagtcttcagagcctcaagtgagaaaacacctccataagatttggctgtgagaaagcaggccaacatatatattgagcaagctagtaagcagcatacctccaaggctctgcatcagcccttggctccaggcttctcctctgttagaactcctgtgctggcttccttcagtgatggactacaatgtggaagcgtgaacctaataaaccctttctccctaacttgctttttggtcatggcatttcattgcaggaatagaaaccctacctaaaacaaagactggaatgaattagctgtttctgtgcattcaaagggtcttggtgaagccacagagagccaggtggcccagactatagagaaggaagagaaagaaaggccagggtagcagatgcttgtgtctcactgagcagttgccaggcagcatttgctgtgctattaggaactgagaatcctaaaatcaacatgtcagtttgctgggctctccagctgcgagcctgctatgctacggtaaggtgccagaggctgccacccacaggagtgcagcagtgcacatgctgtggggatgaagaagaaggagctcgaagaggacaccctgacagtaatcaattcccatttcctgcacatacctctgttcttctaacattctgctctgctttcatctcattaagaaagaaattattttcattggcgtgatacaatgaggaaacactggccttggacacatagaattttgcttctaggctcagtgcccatcgtcttcatgactatggtcaattaatgcaaccttgatgaacctcagttctcttctaaacaaatgaagataatgccacacggatagctgaaatgacagaattgtgtaaacactctaggagacattccctggctttgtgacacaggctgtaacttgcactgctctcagctctccttcctgttcccccagacagttcctcagtacctctcaaaactattctcaaacacagagaagaaggaaaaggcctttagaataaatgttgcacagctcataagcacatagggccgggagctctcctgtgaatgcagccatgaacacagggggttttctgcctcataacttggccaatttctattcctctcattatggacacaactggcctcgagccagcagagtccacaaggcatcacaccttattactgtcaggcccagtagcagctgtaagcatacattttgttcattatcgtgtgcatgatttgcaatgaggaaaattactagagggctagactctggtctattatagaggagcaccactgatagatgcctctgagggacagagtaaacattaaataaaatggttcatgcaaagaggctactacagggtccagttctgagtacagataaaaattacttttctttttgtagtctgccaataattaaaaatacagcaaaaggggagagaaggtaggagtgagtggaaaagggggtaacatttgaaatataaataaagaaaatatccaataataatatttttaaaatatggcaaaagacaaaataaaactcaaatgtgttggtcaaatattatccttattttctatatctgcaataactattttccagcttagaatataagaaaacaggccttgatccctcttgtttcaatgtcggtcagcatttgtacctaaatttatttctaacttcatatgtaagatcatatggtctttgtttttctctgcctagcttattttacttagcttaatgtccaatagcatctccattaatgttctaagttgttgtatagaaatctcctccaagttaaaacattgcatcctgcagggaagcttattaagactcaggaagaaataactcagaagtttcagaatatactgaaattggccagatatactaggctcctccttcctcaagcatattgaagcagtaggaacttctgaaagacagtctcaaagaagcctagctctctggaaaaaacagaaaccacccgagttgcctggaagaggctcattgcaactgatctacccacagacaagctctccagcttgttgagctgctgggaagtcgttcagggagctccagacttccagctctcatgcgcggtcaaccatgcttggagggcagttgctaatgcaactgtcttggactcatttctgctcctggtagcaactcctcaaacacactcctataattaatttttctcagctttctatcagaagtataagtctgtccatgtctccccatgaatagtgccatacaacacaaaagatcccccttttgatgttaaatagcatcccattgtatgtatgtaccatattttctttactaagtcacccactaatggagtgttactttcccctatatctaggcaattgtgaacaatgttataaatgaacatgagaatgtagatatatcattggctttaacatatttgaatataaacaagaacagaaatagccaagcataaggtagtaccaaatttaattttgaagaacctttatactgttttccataattaatgtaccaattcatattcctgtgggtcgtttgaataggtatggccctcagactcatgtttttgaatgcttgacctatagagagtgacactattaggaggtgtggccttattggagtagatgcagccttgttagaggaaatgtgtcactgtggaggtgggctttgaggatatatatgtatacacatatatcctcaagctacacccagtgtgacacactgtctcttccttgctgcctgtgggtcaagatgtagaactctcagctcctcctccagcaccatgtctgcctttactctgccatgcttccagcaccgactgttttcctttataagaattgccatggctgtggtgtctcttcacagtaatgaaatgctaacgaagacaactcccaatgctgaatatagcagttctcttttctccatatccaggaaactgttgccttttgacttttataacaatggtctatcttcgtatggttttgatttgtgtttctatgatgatcagtgacagtgaggacattttttgctcattaaaaaaaatggatttgtttttggttttgcttcattaactctcgagtcattagtatgtattcttttaatattcttttaatattctgtgtaatgaaatctgaggtgtgtcatcgaggagcctctcgtcagagctctgttagctttgatccaccgtttccctgatcccaaagcttcatcttttattttctttcttgttttgttagaatgtggccttgttgcagttttttcagaagagataaaaagtaaatttcacttctccagggcttctcattaacatggacctattcccaaggctgctatctgaagttaatgctttgttaagcctttaaaggtaagagagtttaactttgcaggttagaattcgactctgtggccactccatcctgctcctcctgtcttgccatgcagtggagtcacaggggcacggataccctaactttggccacaggaagtgctctctggagtctcagttaacccacgtccgtgtagagcagactgccatctggagagaccacagaagcatttgcttctgtgaaagaagaaaaggcctgccccagctgttgactacatcttctgctctgtaccatcaatcaggagttcccagcacagggccagagatcctatcccagaattagaatattcctctgttttaccagtaataagatagatatttaaaagttcaccctacagaaatgatagaatattcattctcactataaaaataatagaaaattttcatataaagaaacaatcagagactatgtgtaggaaaatgtaggacacgttcataataaatagcaagcaagggatcatatttttttctagagtttatattcctgtgtagcacccacatctatgcatgctccagaaagcattttttttttttggtagatgcctgaaacggcagaaaatgctggaccttacacatagcaggcctgcggcatgtcctacagcattgccacacagcaacagttagtctgtgcttccctgtgagtctccctttggcatccctactcaccccttttggagtcattattaggcaaaacaaaagtgtcttgaacacaaatcctgcaatatcaagatagtctttcttataaatgacatggttactaaaaagtggatagtatactaagtggatgccttgaataaagagataatgcattttctgggcaacagtttatcatggcacttaaaacaacttgaaatccttgtaatttaaaacatatatttgctatttatctaataattaaaacaactaatatctaactgcagaacattccacttcacattttcagatcacagttgaccacaggtaattatagtgttaaagacaaaaaccacaggaaatggagaacttctgtaacagtttccaaacttatactgttattagttgtgatatctctgtcattttaaataagtctattttgtggtttatgtgaaggagccatttttaatggtttcaagaggtttccaaaaactggtttcagaggcaaccaagtcaggctctgctgctgcactggaggcacaaaccacggccctgagggtctgaagacctggaatcggtacagtttgggctaaaaggagtcttgggttggattttgttctcacgttcccaaagtccttaacctactgttctcaagcacagcttgctgcccaggagaatgttgtaatctgattccctggtgtcaaagaaatgcttagtacataccgttataattttctgaaactgtagagaacccttttgcatacaaattattatctatggaatgtgagtcctctggagacaagctcattagttatcagccttgtagaacacaaactttctcataagcatttatcatcatcttcagactccgttcaccacttggctagccattgcaagctgcctcctctggctggcacataatacttttttagccccatccattttagggagctttatctacactctacctcccttttaaagacctcatgggtcaaactgtctcttagatccctaccacactaatctctcccttagccattctcccattaagctttgccggtgtaactgtggaaactatttcttttatacttacttatggtaccatctgcctttctgcagacatcaaccccctgcatgatggtttcaacttcaaataattatttactattggttatttatttagattgagagattaaaggcgattctattttattatgatgtgtctcaagagattaaaggagataaagttctttatatcttagttcattgaaatttacattttttggatcttagaatccagaaagaggagaaactcaacaattgaggatttctttactgtgattcaaaaacaaaaagtggtgtcaaagccatctttctgtattccatgacccaaggtctcgggaagatgaggggaacatctgtccatatccggctgagtaaaagaactgtgcaggttgtaaaaagctgggtctcatggaccgggcatctacaaaccatcactgtttccctctcacattcaaatgatttagacctggaggccaaccactgtctgatcccgaccactgcagaggataagggcctttgtctgagttctgggttatgtccaaagatggaggtctagggaaagatgaagacgacactttataattttgtctaaatgtgtcttatttatgtctgagtttaaaaaggaacatgtggaaggctcagctccatctttccttacaacagcactacattggccttccccacatgaggagtattgaagagaactgactattttgtctgccttactgaaaacactcactgaattcctggagtctgttttctctgctcctcgcatgtgtcagtcaagggcaggatcaaagtccaaatagtttatgttcgcccagggtcacttaagagggatgcttaattagaactcaagagagaaagttgaggttttagatgggattttcccataagtaactaaatattcttttctatcaaaagagtagaactttctcaatctaccactattcttatttacgtctttactgtgtgaaaagctatgaggtactgataaagtcaagtgcaaagctgacctcaaatgttcttgtctatttgtgtgtgtgtgtgtgtgtgtgtgtgtgtgtgtgtgtgtgtgtgtagtaaccaatagctctcttattgaattaaaggcttgctgaaaaggaggaaaatcattcctggcattggaaatctgagtaactaactagagtttgtgagtcttagaggagaacctactgtcatcattttactaaaccaacacaattccaaactgaattctaaagttttaacctcatacccacagaaaagtacattctccaactttcaccaaagaaacttcttcttagagcagatggagatcattacattaaactaccatgggtcaaaatgcaagaacaagtgcctggctccagctggtccatcaaacacacccctgcacccaaggctccggaaacatccaggaagaagaagaaaaactgctgtaagggccacatgccaggaatctgctatgagacaatgtctcctggaaatgccggggatgtatcacccatgatacctcaacaatacagctagctaaaaaagacccaaacaaagataacaccaatagacatctaacatggtagtgaaatatttcacagaaccctacccctaggcaaagaactgcagacaactaaggaatgaagacagcacaagaattagtcttctctactgatgagcccctaatctgttatccaatatcaagtactggataccaagccctgagctagtatgcatgcaagtaacacgaaacagaatgagcacctgtgttgatatatttaggtgtgtgtgtgtgtgtgtgtgtgtgtgtgtgcataagagggggggtagaggaaagagaggaagaggttatgatttcaagaggaaggaaggaaaacaataaaaatctcaaggaaaatttattgaaatgaataaaagaagcaagacccttccttggtttttgacatttttatctcagtgtaaacagtagtgtgtttgtcagaattacatcaatacaaatatccagtgccttctaaggtacccaacaaatgctgatggttctttatatgtagctttcagcgaagagtcagcatgttgcagaggtcttccttcatgttagagtactttgtaatgtattgagacttttataaaaaaaaaatgacattttcaaatactcaatgtttagtcttccaacctatgaatgcaataatccccatattaagtttcactgaatttttaaaaagtaagaatgtcagttttgatgatactaactatgcttcctcctaattcctctcaggttcacaccctagctcccttactcccctcctccctccccccccctctctctcatgctcgctcacttgcttgctctcactctcccagttggtgctatcatttactcctgagtatggctatcctctggttgttgcttgacctaccaaatgacacactgttaaagaaaactgactctctcctcagaagctatcaactatatataactccccagttaggagcaagaggctcttgaattaacccaattccaccctcaccatggtactctaaaatgttgactggcttgacctagttagtataggtctgggtggggggggggaaccacagctgctggaagtttatgtgttgcagtcctgtcctgtcctgtcctgtccagaaaacagttactaaatttaacactgttactaaacttaacttggaacttgggaaaacaaaacaaaacaaaaaaaccccgccagtaagtcaatggtgtcctctgctggtcaagggtggcatgtacaacataaagtttagctgaggtaaagattcagaaatggcaggttcagaaatagtctacaggagcatgaactcagaaatgaaaactaattccagtcagcaatggaagagcaagaactttaagcagaaccctggagaaccactgcttgcttgtcttggcttgctcagtttgcattcttacacaacccaggaccaccatatgaatgatactgtgctacatccactccagtagtgacaagctcgacaggccctgaaaacctgggtgctgttccgaggcgaaaagttcacggaaacttagtctcctggaatcgtggcatcctgtataaagaatgctccaatgcccttgctttagttggtaaacacatctgtgtgctttcccttaatattgatttattacaagtgctcctacggattgatattttgacatatagctaagttagattctaggcagtccttgatccgaccttgggcatggatagctaagtcactgccctatacaggaatttaccattatctaggaagatggaagtttgtgatctaagaagtaaccagagtagatacttagaaatatggatagctgagttacacccatacacaagtatttacaatggcctagggggaaggtggactatacaatagactagaataggaactgtggcaagggcacaaagcccttgaccctggcttctaagattaagtgggccttaggtggagatgtttttgatcccagttgttagcattgaattttatcccaactggttcctgccggtccttccatgtttgcattcctctgttttgtgtaagaatccagtaacctctttgtaccttgccggtatgtcacccaacttccctattttcttctgtataaaaagtttgatgctcgatttgacaaattacattcagattctacacaatctcatctgtcgcttctgtttgtcattcgccgactccttgtccacctgcaaccagagacccgttccacacagataggagacccaaaaaggcgatagtctgcggcaatactgcccacagtgggctgggctcgccatagatctatcatcaagaaaatgccaccataaacttgcctacagtccagtccgagtgagacaattcctcatttgaggttccttcttccaaggtgtcaagttgacaaaaaccaaccagcacacaccaaatggtgcccccttccccccacccccccaccaccaccaccacatacacacacaccatttcctctttccttgtatttctgactcatatcttctatagaaagctataggctttcttatgccagctagtgggatgtatggctttgatcggattggtgttttttatgaaagcagctcccttccctcagctctcaccccaaggtctgttccttctggtaagtctctgacttcttatttcagacattaactgggaatgtgaagaagctcaatacacgaggtagtccgctcttaaatgtgtcttcccaggggagtcacagtttcttgaatccataacaggggatattgagcgtttctatgtatatatatgtacatcctggaaagttccccaggatgctttctgccattaggcctaagtaaacaagtatctcttagcttcaacatctttataatcagagacatatagaatgttcaaactaaaggccgtaagggtgtaatatgcaaaagcagtcttagagaaatacagaactgcacgaaagactggcaaggggtaaatgttgaatgctagcaaatatcttctctgggaacaaaactacaatgttcagctaacttaataaccacataagctgaaaggtttgcaattccatcgtatatagcagtctcggtagtccttgatatttcactatatttttgcaagatgctactagatagaatacataccgcatcgagcgttaagcttccccgggcagctccctggaatgttactatgctaagaaacaaaggaaatgagtaacacgatattatcatcaaaaaaaatttcaacgtgaactttttcagcaacctttgtcgagcacacacctcagggaaggagcacctagtcaggttgcagagtcccctggggagagagagccttggcgctcaaactctcggccgtctcaaagccctcgctagctaccaaagcactttgggagtcccgccctttgcaagtcccgccctttgtaagtcccgccctttgtaagtcccgctcttttaagtcccgcccatgtgcccgctgtcactcagcggggacgctggaccttgcagtgacttgggcctcctttctttccttcccttacggtgat

SEQ ID NO: 29 - DNA, 7304 bp, Mus musculus
gctgatctgagctgctgctaaggaccgaaacgcgcctcaagctgtcacttgccgcctggagttcgttgggaaagttgaaaaagcctagtcctgtttaggaaatctatccagctgtgtatatactttttgcttttagggtatgaagctcaggaaggataagaaaaacaagatcacacagctggcaagtggcaaagcaggacacaatttataactccagaacgagaatttgcagttgttgcgccagatgccctgtagcggtgagaaaaaatgttaactttaattactgtgactcgttttgtccattcaccccagaacagataacatctatttgttcaaggtataggtgttttgtatagggttcagaaaattggaggtaatcgcactgggcactgtattttgcctccaatcctctgccctaatcttgctccgtttgtgtgtatatgagtgcatattaggcactcagagacattagccctatctctgtcctcgtttggtttggtttggtttggttttttgagacagggtttctctgtgtggctctggctgtccacaaacaagctctgtagaagaggctagcctggaattcagaggttaggctgtctctgcctcccagtgctgggactaaaggcgtgccccagcatgcctagttgctgtgctccttagtagagtgaaccctgaaagacattttatagacatggttacctggactgaaggaaatcaacaaatagctcatccattaagactccactgtaatggcaagttgttgaggcaaggtgacacttaagaggttgtgtatctttctcccttcagccattgtgcatactcaattacattcatttccagaagtgtgggcgaaagaggtctaaggatcagcccaaatacagggtatcacttcatgtcaagactctcctttgctgctccttggctctagtccctcgaaaattctcagaaggataatctctaagattaaatacaacagaaacacaacagatgatattgtaactttcacaatatccaacacaactgtctaaatgtacattgacaacctgttaggctagatatggtagtgagtacctttaatcccagcactcctgagggcagagccaagcagatttctatgagttcagagtcagtttgttttacgtagtgagttccaggacagccagaactatatagtgactctctctgtctttctccctccctcactccttccctctcccccctcctccccccccccccacatgcactcgagcgcacacacacacacacacacacacacacacgagccactgaaaagtcctgtgagcatctttcaggtacctacattactgaagaattccacccctgtcagttgtattccttgttatagttcctagacaggagggtcctcttgaagttcttgtgcagagtcttgagccttgtaaacccccatgatcatcctcttccctccaaaatgtgtattaatgggtcattcctgtgatgagctcatgcaagttacctctccgatataggctaatgaggatgtgatggtttttatatgcttggcttggggagtggtttagaaggtgtggccctgttggagtcggtgtgtcactgtgggtgtgggtgttaagaccctcatcccagctgcctgaaagccagtagtctgctagcagccttcaaatgaggatatagaactcttagctcctcttgccccatgcctgcctggatgctgccatgttcccgccttgatgataattgactgaacctctgaacctgtaagccagccccagttaaatgttgtccttataagagttgccttggtcagggtgtctgttcacagcagtaaaatcctaagacatggtccaaactagaggagataactactactctatactgttattacttaattgcattagtcagggtcctatatatgggaatgaaaatacatatgtatgtatacacacacacatgggaatttattaaagtgaattatagatcatgttctagctagtcactgtcatccaacagaaatgccaagaatccggtacttgttccgtccatgaggctgaatgtctcagctgatctttggtctatgtgtgtatgtggtgggggggggtgggggggtgggggggttaatcccaaaagataggttctaaaacccaggaaggaataccctggcagcaggacagatgaactggccagtgaacgtgaagacaagcaggaaaagaacaaagccttcgttcttctttttataggggctgccaccaagaaggtggaagaacacctttaattccagcactcaggacacagaagcaggtgggtggatgtcagttccaggccctcctggtctacttagtgagttctgggatggccagaactacatcatgagacctgtctcagaaaaaaagaaagaaaaagaaaatgctcacaggtacacccagctgcttggctttgaattgatttcagatacagtcaagttgacatcaagactatccaccaaccaatctttaatttattcattcaatggatatttttaagtctatgtctggcattaagttaagtgctagagaacccggggaaaaaccaaaaaccaaaaaacaacaacaataacaaaacaggacagccatgttttctgccttcatgaactttctggaaggagagaaacagcatttaacagcgtggaaagctgctttgtgaagacaagtcctaagaatgccatctacagaggactggggtggtgagaacatatgctaagtggtcttggtctccactactgttgaaagaagaggctctgaggaaagagacattagataaagacccacaggggtcctagaaagactccaggtgcttgactccagttgtttgggggtttttgagatgagatcagactcaggctggcactgaacttcggatcctcctgcctcagcttctcaggtactaggatttcaggcgcgcactaccacgggcagtatattagagaatttaattttgtcatcatgctctgtgtgtaaatcttgtcgcctgctcttgggctactaatcaccaccctttcatctcagcctgaacagccctcccatctcttgtagaacgggtttggtggcggtgcactccctctgcttttatttgtctgagaacaccctatctgttctgcatttctcagggggtggcttcctcaggctaagtacccttggctggcagtttcttccagcactctgctgagaaacccaaagccaatcttatggctttgtgtcactagactggtcgcttgtgttacttgcgaaattctgtcttccattttcatctccttgttttttttttttttttttttgttttcttggatgttttgtttcttgagacagggtttctctttatagccctggctatgccagaacttgctccatagaccaggctgtcctcaaactcagagatctgcctgcttctgcctcccgagtgctgagagtaaagatgtatacggtgactgcccgattaatttttccttcttaactggaaaatgtcaagtaaactgacttccatccagtgttcatggatgggttttttttttttcttgattgggtatgatgttggcattacttactacattttcctctctgtttcagaattcccattcagttgttttagattctgatctccttgttgggcttgcttacgtcacgtgttgttttctttattttgaacctgcagctttacctctttcttgtctttctgttgctacagggttgaggccagaaaaccatgcaaacacttgttcacacacaagcccacagttctcatcttaaaaggagcaagagatggtttattctggagccattttgagtaataacgactcgagggaccagatacaggttcccccagattccatgttccaatgtggaagtgattacatgaagtttgatagcttcacagaacaaaagcagtcataaaccaaggcaattgaaaatacatttgtgggtacgttagagaggcagcaagacggggcaagctctctataggcccaagatgctatctgatgacattcttagctttgggtttggtgggagctagtggtttgatttaatggattgaaaagctttttggtctagtttggttttttggtttgttttgttttgtttttgagcaggacctctctgcatagccatgactattcctggaactcactatgtaaaccagagatctgcttgccactgcctctcaagtgctgggattaaaggtatgtacctgtgaggcagtggaccttgagaggaagcctggtaaggtcgagttaaggcttgaagcccgggggaccctgaagggacagtaggagctttgcctgctcctggcaccaggcccctgtcagataatcacatccccccattgagagaattgtggccatcagtcacataggggcagtgccccatgcccctcttcctgtaggtgaggcatccatctcaggccaagccaataggaagcacctgctgtcagatccaacccaccccaacgctgtatataataacattctatgcagaggcataaaggtgtgagaattactccattgtctgagagcatctgtcacaggagctgtaacactgcctaggaagagaacgctctcctgaaccttgccccaccagaagctcccctgcacttccctcgccaaccagtgcagcatctcagagtagcagcaccagaatgggaacagaggcacttcccactccctgctagtgcctttccccttcccttgaaccctcccaccttgctgggccagaggatagcctccggtacacagaccaacatgcacccccccccctgtatcgttatgcgtattggtgttttgcctgcatgtgtgtctgtgcaccacatgcatgcctggtgcctgtggaggacaggacagggtgggttccctgacacgtgcatgcctggtacctgtggaggacaggacagggtgagttccctgacatgtgcatgcctggtgcctgtggaggacaggacagggtgggttccctgagattggacttacagatggttatgagctgccatgtgggcaccggaaactgatctgcatcctctgccagagcagtatgtgctttcaacacctgaaccatctctccagatcatccaggccctgttcttaatgtatacaatgcagaaaaattcaggacacttatacatttattttgagaacattttttcatcttgtaaatcaaaactctatacccattaattagtgtgttaattgtaatagactcctccttcaccttagctcttggaaaccatcattctacttctgactctagaattgatcctatttcaatgttactatttgttacaagatgttagtttagacacagatgtgggcaacgattggctgttcttagggctaagtaggccaaagtaagataactagctcttagacctgcagcattttaacccctccacccaactgcatttctaaccagtcaggctctgcagacacagcttcctttagaagttctcattctttttgggtgtttgtttgtttgtttgtttgttttttgagacagggttaaacccagacctgtacccccaagtcaccattttattttgcagcttactgaactccccttatacacaattattttgcattccttgtcacgtgatccttaggggtccatttccctgaatcagtttctagaaaaatcacagttccttcaatagtgtctttctttaaagtgttcctcaaagtcatatattgtcccccctttatttatttatttatttattttggtttttcaatacagagtttctctgtgtggccctggctgtcctggaactcactctgtagacccagctggccttgaactcagaaatctgcctgcctctgcctcccaagtgctgggattaaaggcgtgcgccaccacgcccagctctgttgtcccttttccacttgaagaagtagtcaactattatgatcttgttatggaacttgcaagtaaccacttgtgccctaagacaggtctggccacctgtcctcaataagccactttaaaaagccaaattaagctctttggaacgggacagcagaggggtaagatgtagctgctagagtttccccgctatcatggcgaatccacaaggattcgccactgaagggatcagattttaataaggcttataagattaggtttcggttgttgcacccagagatcgagttaccattgtttctgaactgagtctgtgttgtgttttcattcacacagtggctcgtctgggttcaggaaagtatagctccagtttagtgttcttatggatcatcgactgtacccaagaccagaaacggaaacaactagatcatcttcaactgaagaacggagacagaaacgtgatacaggtacacaatggactacttttcagctatgaaaaataaagacatcatgaattttatagggaaatggatgaatcttaagaataccatcctgacctaggagtctatcatggatgtcctctgagaggctctatccagcagttgactcagaaagatgcaggcacccacaaccaaacagtggatcaagcttggggactcttatggaagaatggcagaaaagatacacttcctaaggagataggaactccacaggaagaccaacaaagtcaacgaaccaggacccttggggatctcagagatcaaaccactatttatattaaaacattttagaatttaacaaatgttaattgttctttaaccatgtgtagctagtagtactacgaacaggaaaaaatgaaatataatttttttcacatatttttatgaatgttagcacgtggtttgtctaaggtgattttaggtttgaaataatcaactaaatggagaaaaatgaaaaaaagggaaagtataagttttattaggcactaggcaaatgaaattaatgaaccagaacaaaagtcaaaagtgcactgtacagtggaaaggacatccccagagatggacgagaggctgagctaacaattcatgaactgctactcacacttttacatattgcatatgaatgatgaacaatacagaaatggttttactggacttgggctatgaattttccaatagagttcagcaaaccctcccccccaaaaaaaagccaaattaaaaatggaaagcaaaggggctggagagatggctcagtggttaagagcgctgactgctcttccagaggtcccgagttcaattcccagcaaccacatggtggatcacaaccatctgtaatgggatccaacgccctcttccggtgtgtctgaagagagtgacagtgtgctcatataaaataaataaataaaacttttttgaaaaactggaaagc

SEQ ID NO: 30 - DNA, 19396 bp, Mus musculus
ccttggtgaacaaaggagtttatttggaattacttctgggaacatgggtgcctcgccacccttagtcatcacaaccgctggtgctgctgctgccgccactgacaacggagccacaggaggacgggaaggagatggggatgagaggtgggagtggctaggcggctcctggagccctgtgctcaatgcagtgaagggagattaggagagcgcagcttcccaaaaactggacgtaggaatacatttttgttttagatcctgtgacacccatcttcccaacgtttgccagagatctcaatactgttgaattgtcatcccaatgtatagtctgagatcgacccaacggtttatgtgggggcggtaacctcagataagaagtctctatatcaggggttcccccaaaacaaaggcctggtctttgttcggatggggctaactctgtcggggccgcaactcagcaaagagctcagagggtcctggacctggatagtcaggatatctagggatgggtactcgtgagtccgaagaaatgatgtatccagcagagaagagagagggacagaagtggttcccacgtggccaggaaagaccaaaaccatcgcgctggggacttaacttctcccgggtttcagcaccatctgataggttatttctccgctgccgcctgcgaaatgagccagtttaaaacagattagattatattaaaggcaggattactgggaaactgctctcaggtgggcaagttcactggtcccaaggaccaaggccagggacgtcgctgtggggaatgggaggggctggggaggggagggagagagaacaaaagaaagggacagcatgcagagagagagcggagaggaggggagagagaccaaaatgtctggattatatagagaagagcctctaggggaagggcaggctagcccctgggccggaaagttcagggttggaggcagggtatgccaggtaaggactgagggatgttgggagaacctggaggccaggtttgctttgctatgtaaaatatccacctctgtcccctgtcctggggtccgaaaccaaacacccacagcaggcctcacaaaagaatctcttctccccagcaatcattactgtttttacaaccctggggaagcagccttgcgagttccctcccgggtcgactacatctccctccccgcagaagagaatgcttccgctagagggagctagagtctctcctttcgaagtcggggaaacttggaggggaaaaaaaaaaaactttctagggctctctattcaagaggagacactccctgagaagaagactcttgttagtcatcttggccctgccaggacccagcattgtcgcagatagagcctgctctgggagctggtgtatagccaaagagctaggcagagttgtggtgatttgaatgagaaatgtccccatagtctctggcatttgagtaacttggtctctccctgcttggtaacaccatttttggaggtttaaggtggtacagccttgctggagggtgggctttgaaagtaaaaaggccttacctacttgcagctggctctttctgctctgtgcttatggtaaaggatatccgttctcagcgtccagttcctgctgctgtgtctgctgtttcagctccgtgatagactggtatcctctatcctctggaactggaagacaaagtaaacccatttgtaagttgtcttggtcatagtgtttgttacagtaacagaaaagtaaccaagacaaggatgcaggtcctcactggctctctggctcagtgcctggctcagaccacaagcagagttagctttctgaacccttcccatcccctcagactccagctcccttgagcatcttggagccagatcttggcttagagaaaggaagagctgctctcaaagcccacctcctcagaatccctagtacccaagagcagcatctgcctgggtctccatccactgcagcgggggttcgacctgagcattattatacaaatatcttgtatgttgtaaaatactggaacttttgccagacctcacagcccagttaataatgtaccctgaggtcacttaagacctaagactggtgtgcatgtagcctctttgtttcacctgcctttaagagaaaaattaaagtaggggctggagagatggctcatcgggtaagagcactggctgcccttcctgaggccctgagttcaattcccagaaaccacatggtggctcagtaaccatctgtaatgggaactgacatcctggcaggggtgcaagatataaaactaaggacagttatgggagcatcatgtgtttgtatgtatgctgtgtatatacatgtgtgttggtggaaattttcaagatgcccattcacagaaaaatagtttaatactttacgggccacacaagttgtgaatttctgtacaactgacaaaaagctttccaagtcactttagagaggcaaggatttggagaacaaactgaacagtctgactctatgtaaggtttaaacatctctaggccctttctggctacaagtcctgaccttggaaagccaaagacatgttgggaaaacacccaagattaccagaaattagaagcagcagggaaattcaaacaacaacaaaatctccttcaattttggtttcttgaaaatggaagactggcagtcacaaatgggacacttgcattagccctgtgccaccaccagggttcagggacattttggaaaaagacagaaagactataagcgtttgtggaggagcagaatagacctgtgtcttacctcaaactcacagcagctctgcccagcacaagaccagccagccagcattccagcatggacccaggagagccagcattccagcatggacccaggagagccagcattccagcatggacccaggagagccagcattccagcatggacccaggagagccagcattccagcatggacccaggagagccagcattccagcatggacccaggagaggctcacagccctcaccgctagctgaggatgtattcatagttgacagtcgctagtggagaagagtcagctttctttaagagtgttctcccttgtaagatggccatgccccaccagatggctccacactcaggagtatgtggaatgcattaatggaccctacaggctaggagaaaaggaggaggaagagggggaggtggtatcatgaagtcccaaggggaactggaagggagagggagtttcagaagaagttaggtgagagagggtgaacagaaccaaaatacgttgtgaaattctcaaagaaaggtgcatagttctaaaacctaagagtaggaaaatacaggtgagggtgtcacgactcacacctttaatcccagcactgtggagacaatgggagacagcactgtgagtttctgtgagttggaaacaagcctggtctatagtgagtccatgagagccaggacttcagacagagacagacagagagagagagagacagacagacagagagagagagagagacagagagagagacagagagagagacagagagacagagacagagagatgaaggtgagaaggaagctgacgaggacagaagagccctcctggactctaagtcaaacacctgcatgttttggatccaggggctctgctcctgagctgacttcccagatccccttttgcaggtgattagggaagtgtacacaaggaggctgttttgaggtggcaagggtggagccttccccccaccccaggagaacaataaaagggagctatagcacacaagagttagttaatctgcagtgggggtgagggggagagggtgtgatctttaaaacatttcccttctgaaaagtctcttcaaaagccagtgggtgggaacaaaccaggccaggttccccaccaggaagggcaccacagcaacctattgtagagtcattggcacagtgtctggagtggatgtctaagccctatttccaaaggtctctagggaggaatggggcagtaaggagaacgcaatagaggagaggaaccgatttctcagcaccagataagagagtggttaaacagaaagggggaaacagtaagaaggggcggggcaggtcgcagtgggtagagtgctttcagatcctgcagaaagcctgcgattcctagcactctataaactggatgtggtgactcatacctgtaatcctagcacttaggaggtggaaactggagggtcagcattttaaagctatatagtatgggggccagcctgagcgacatggaaacctgtcgagaaagagagagagcttttaatctcagcactcagccagaggccggtggatatacatagtgagttccaggccagtcagagacacagtgagaaggagttggggggtggggggggaggtgaagggaaggaagaggaaactctaacaggccctttggttagatggaaatttatggatctcagtaaatgaatctgagtgtgtggacaagctttgccctctgggaggactcgcacctgcaccccagtagcccagtagtatgggcaaaaccagatccgagactctgccttgtaaatcttgctacattagagggccagaactccttggggaaaagacctggctgcatcggtagcacaggaaacctcatgggaagtgtggctctgctagccatggggtggaaaggagcaggagttgttttctgtatttttcttctggtgcctcacacacatgctaggctagcgtttcccaggcaccacagcctggcccctggggtttcttttcttggtgatggtaatattctaaaaggatggctttgtgattctgagagtttgctgaaatccactgaacggggtgccctttactctagcaactgtatgacaaataactcagacctcaataaaactgtcaccaaaagaaggacaaagacacgaccttatgggattccaacactggggtgaattaaagtaatagtggtagtaacaagtcacacatttagcacacaggaattgacctgatcaaaatctcaacacccccccaccccaccgcacccccgtaaatcgctagttcattacaaagcaagaagcattttaggagaaagcctgtttctcccaccttctctctattgctgtgatgacccaccccaaggaaaagcagcttagggggacatgggggtattcagctcacaaggccaggtcacaggtcatcctgtggagaagtcacgatggtactggaaggagccggccacctcacatccaatgtgaagagcagagagaaacacgtgcagtctgctcagctcactttctctgcccttgtacactgccagacctaagctcaaggaagggcaccgcccagatttaggtgggccttcccacatcaattaacataagcaagacaatcccctactaacaagctgcctgcccagcctgatttacatctctaatctcctctcaggtgattctaggctgggtcaagttgacaattaaaactaaccaccatctaaccaccatcgagggaggcgactcggtcacaaaggaacaaacacggttatgtactcactgatgagtgaatattagcccaaaagtttggaataaccaagattcaatccacagaccatataaggcctaagaagaaggaagaccaaaatgtggatgctttagtgctttttagaagggtggacaaaatactcacaggaggaaatatggagacagtttggagcagagactgaaggaaaggccatccagagactgccccacctgggaatccatcccacgtgcagacactaaacccagatgtttatggtggatgctgggaagtgcttgctgatggacgcctgatatagctgtctcctgagaggttctgccagaacctgacaaatacagaggtggatacttgcagccaaccattggactgagctctggagtcccagatggaggagttggagaagggactgaaggagctgagaggcgtagccccatggagggagcaacaatgtcaaccggccagaccacccctaccccccagctccaggggactggaccatcaacaaaagaatacacaaggagcatcccaaggcattggtcacatatgtggcagaggatggccttgttggacatcagtggaaggagagaggtcctggggcctgaggttgtttgaagccccagtgtgggggaatgtgggtgggtgggggaacaccctcatagaggcagggggagggggatggaatagggggtttccgaaggggaaaacatttgaaatgtaaataaagaaaatatctaatcaaaacaaaaaactaaccaccatcaccttcagcaaaatcccatctccctctccaatggcctggtagcttctccatcgatgggcaaatcacatcccacctgagaggacctggtgagaacaggtgggtgcacaggggttctcaccgcaggtgcacagtctgagtttgatcacaaggactcaggaggcaaatccacactgagggttcatttgccatgaagatctggcaaagactgtccttaaacttctccaaaccgaccagagagaaacagcgaccagatacaaaaactaagaacacatgagaaacacttccgggacactggtgactgtgatgctttgcagagctggggactctgggacagtgcagggtttttgttgttgttgttgttgttttgggtttttgtttgtttgtttgtttgttttattttagtgactgcattgtgaccccaagagaatgtctttgtttgttaggatgtggagtaagcattgtgacagcaacttatgcacaaataggtcaggacaagggttctttgtacagcttttttttttgttgttccaggttacccaaaactaaaataggaggtctctgaggcaggaaaattatgaattctcaggatgctctgagctatgtagtgagatcctgtctcaaaaagcaatcagttagaaaactaaaatgtgtgtaaagactggatgtgtccttcaaaattatgttgcaacgacaaagaagtaaacgaactgtttctagctaagaaagactaaaaggattttaaaacagaatgcaagggataatactggattaaaatatgggccaggaaaaaaaatatgagtagaaaggatatcactgggctagctgatggactgtgagtgagggagcctgctaagtccacccttccctgtcctgaacactgagatgagcaaagtcttcccacgggagaggccacactgcagtacggaagaggaagggcattacatctgtagttttctaactccaacaacactaactacacactcatggggaagaaagagataaacctctgtgctggggcctttctactcttctggtaacttttccatagatttgaaacttttgttttctttataacccagagtggcctcgaattcaaactatggccaatggtgcccttgaccttctgattctcctgctgccaaaagccaaaggacagatggttccacctagcccgggagagctaagatgcccccagctctctggggcagtaggaagccttgttgtaaaaaaacggaatagcttattgttactggagtcatacatctccatctcctgagatgtgtttatgagagagactcctacacacttctctttagtaatactaggaggttctgctgagtcctgatttttttaagccaatcttaaattttttaatttaattttagttattttttaaagttagtcttaagacacatagatattcttgttatgacaaaattcaaacttagtaaattgttttacactgtgccctgtagaggggtgcacacctgtcaccccagcattggatggtagaggctagaggatcaagggttccagaccagcctgaactccagactcactctctctctctctctctctctctctctatatatatatatatatatatatatatatatatatatatatatatcttttaacaagacccaaaccacaacaattacttaatctaatgatactctaaccttctcaagtcctacaaacacaggatgagatctatttcctagtcccttaaccaggatagccagggcgtggccttccgtggcttttccacccgctctctgaaatgaacccactactagaaagtgtccctttgcaatcccagagccaagagtctttgccagccgcgacccctaggtcggctggctctggctctggggtttctccttttcaaatacctctctgagctttatctgagcaacagcggtcctcggagatgggggagggagctcaccacaagctttggtgacctctcttccttctccctagaaggctctccacctgtgctctgttcagggacgcccggcataggttcgagttcagaagaagtcttagaatgaggacgcagtgttggtatctgagatcccgactcttgccgaacaaattccgaagtaaatgcctcaccgtcccctttagaaagtaggtcggtgatagtttctccacagtggagatatctctgtgctgttgagcctgtaaaataaatatccaaaggctctgctctgggtggagaaggctgcagacaggatggctttagttgtgagctatttcaactgcaaggtcaattgaaaaaacaaagaagggacagagaaatgactccgcgggtaaagacgcctagcaccaagctaatgatttgatccattcccagaacctactgggttgaacagagcccattcccaaaagttgtcctctgactcctggcttgcggatgcgcataaatgtacacacataataaacagatgtaaattttaaaattctagttaagggcactagagggatggctcagaggttaagagatctactctggtttcagctataggggatccgacaccctcttctgtcgcccaccacacacacacacagagagagagaaagagagagagagagagagagagagagagagagagagaacgaatccttaaaaaaactagtacactagtttgtattaaaagaaagaaagagagcagtggtggcacaggcctttaatcgcagcacttgggaggcagaggcaggcgaacttctgaggccagcctggtctacagagtgagttccaggacagccagggctatacagagaaaccctgtcaaaaaaagaaagaaagaaagaaagaaagaaagaaagaaagagagagagagagagagagagagagagagagagggagggagggagggagggagggagggagggagggaggggggagggagggagggagggagggagggagggagggagggagagagaaagagagagagagagagagagagagagagagagagagagagagagagagagagagagaacagaaaaggctacatacaaaactgtactttcaaggtaaatttattcaaaaagaaggatgcggcggtggggatggggtggaggcagctccagaagagcgggaaagcgttgggatactttcttgccgtcagtcccattatttctgccgctgaagcctgaactgtgaggccggttgcaagccgcgaagcgagaacgcccgcctaaagaaggagagacagtgccttcagctccgggcgtttttccagtggaaagatgtcaggctccgtgggactgggaaccgagcagcttatttgcattgtgtctcgaagccaagcttctacctactccactcggacccgagcaccgcaccagccggtccatccgggtctgccgctctacaccctgcacgccagcatccagggcctgcagctcggaagcattccagagaagtcgcgggagccgcccggggactccacagcccaggcctctcccaagccacctccgctttccacagctccttgccaccttccgtactttccccagagctggaagtaggaaacttctcccctgcagggatcggataggcttactccgtgaagctagcccgacccgagtccagattcaccggatttcaacaaaaccaagtccatccgcgtaccccactccctgggcctgcacagcgcgggaggaaaagaagccccacgccaggtcccaagcgactcgggaggggccaccaccctcggtagacctcgaggattcatccccaccccggctgctttgtaaattgttcttaggccaccaacaagaccgggatttcgaaatccaccgcgtctccaagtttgttccctgttaaaactcacgagtcttttggagaaaagggaagactatccagggccctacaaacgttcggggctcagagtcacctctctccctttcgcaaaggaaagagcgactcagctactcccagctctccctccctatcgcaggtactcgagcgggaagaggaggatgcgattcttttattgtgtctcagaaatccccaacccccatttgactcacatggcccccgatgtcaggaggagaaagagactcttgagaagaaaattctacctgcgtgggtcgatgtatttatctggtcagaaaggagggagtataaaaacaaagaggtgggacttggtgagacacgcctgtgatctcaggggttccacaggaggatggccctgagctggaggccaacctgggctacggagtgaggtcctgtctcaaacataaagaagaaaagaaagaaaaggttaaaatgtaaaagagaaaccctgtctttcaaggtgagcacacctcaaccagggagctcgaacggggtcctgtaaattattgcagacaagcatgggttcctgttgcatttctctggtccctggctgggcagctgcagactggtacggcttcctgcagatcgctcgagccagcctttgccagggaccttgacctagcacggacttggtcgccacgcttagctccccctgacctgcttttgaacccgctaatccaccccaactcttgccccgacgttcactccacgcgctaattcccgggggccccacagcccccacactccctctcggcccgaggctctgaagggcacaaccagggctccacactgaagcaatggcctcagctacaaatatccctctccttggttccccttaatttaattcgttttctttttttcaaaacaataaccatacaaataccaatcttccggaacggaaacgaatctgacacactggtggtctggcaaagcagtggtcacagtggctggccagggacgagagccgagagccggggaagggtaagccagaatctagtgtcctgccaaagccagagaggctggaagaaccgcagacacaaggagttcattccagattctagggagggagttttccgtctgaaatgacacaagaacacggggatcctagtgatggagcctgagtctggagggactcctaatttgccctcatataattcttcatatcttgtattttcctagatgtatgtttttctctgtaaaaataaaaactggttattaaagttggtgaaattagatcgcacctgcatacctgccccaaagtgtgggtctgcaggtttgctggaagttgttagatttgtttcatagctgaacagagcttaggcgagaaagctttctttctggttttcagagatcagctgtgtaaatgtgtcctgtcttctcaaactactaaactagatatcagagtttagaccctaggcttgcctggcccacatctgtgaaccacctggtggccccacccaaccaggacctctgagatctccagccttggctctgcatcacacaatgcatttagctgtccagtgcaaagctgtcagtagatctctagagacacatgtccatccgatagatgaaggtttttctggagcatgcagctatttccagagaactgggaaagtccttaggggcatcatagaataggctccttcagctgcaactgcagtgaggggctcagctgatggctggggtcttcaggcattcccaggaggctcagcaaggcaccagcaaaggcagccacacactgttcttcaactccacctattggaagtcacttcccagagtgagcgtgtagctcacacaaaggatcctgtgttcagtctccaatgagacaggatgcagaggggagctcacccaaagctaggagtctccaaaatttccccagccacctcccacccccagggagcaaagaggcctcaggttctcctccaagcaacaggacttccagatcctcagtgctgggaacatggaagagggtggttgatggctcatccttcacgtggaagcagggtggcaagaggggaaatttaatctgttattcctgataaataaatgtctctgcgatgtgtctgtcccactggaaccaaccatttttaagatgctggtgcgctggattcagtcagtccgcaaatttattttttttttatttttattttttttttattttttttttaaagatttatttattcattatatgtaagtacactgtagctgtcttcagatactccagaagagggagtcagatttcgttacggatggttgtgagccaccatgtggttgctgggatttgaactccggacctttggaagagcagtcaggtgctcttacccactgagccatctcaccagcccccagtccgcaaatttaaaggcacagaaggacactggcttctccccaaaggtagacaggggaatagtatgggtagtttatcctgggctccgagaagcacctgaaaattccagccttggagctgttacttgctggggggggggggggaagctctgccagcaccttctctccctgcttctcccaaacagaagggtgatgcctagctgcctctggggctggaaaaggctacaggattggtggacaggtggggtggctcaggtttggaaatcgctcaaatctaacttccatgtggacactggactagaactacaaacaaggaaagatgggttatagttgtgccaggtgtccaagttggatgccgaagatcggggttctaggttggacttctcagctaatggctcttgagagaaacaaaagcttcaaccatgctggccgctgtgctgtcctggagccctggtggccaactgagctctttctgcacctctaccttggacagacacagggacagctgaggtcacaggtgaagccattccctgtcctccctggctaccaaaacctcctctggaggaagaagagggaccacaaggagctatggtgtatgcttgactttacagctaaataatacaagcctctgtttttcctccttggcaccagacatgggagccaatggtctgaacaaattaattaactgttataacaattccaggagttggaactaacattcccattagataggtgggggggggggggggacaccgtaacacagaagctaagcaacccattagtatctagttggtgacataaaagattagtcaagacccacagctctgagtcacttctccagcatcatcatccccaggagcccagcagctccatgatccatcctcatcgggcagaattggaaaagatggttccagaaggtgactgaaggggtacaaacagccacccagtgaccaggatgcttccctgagcctctcccctctgactgctccttaaaaagctcctcttctagctgagctgctggctggacagccagaatcaggagcccaaatgttctcacctaagaacatttgaatacagtgtaaacaggcagaagtgcctctgtcgcacagtggatgctagttggcataggaaggagtggagtgttggtatatactatacacaaaagaaccttgaagcacattgagaaaaagaggccagccattagtgcacacactgtaagattccactcatatgagacaccccatacaggcaaatccatagtcacaggaagacaatagtggttcaggactgagagggaagtggggggagcttgaaaggtgagtttccctccaaggtcccttgtagctcaggctgaccttagacttgctatgaagccaaggatggctttgagtttctgatcttgtcacccccatctcccaggaattgggataacagtcatgcccagcacaactggtccccatggtctgggaattaaacctgagcctttctgtttgctacacaaacactctattcagacagcatccttagcctatgaaaatgctttaatatttgtggtggtgatggttgcacttaactgtgatacactgaaatctatagaactgtacaccataaataggagagctgtgtgatatttgagttatatgccaatataagcaccactgtcacaccacagccagccctgggcagacttctggctagaggcaggaactcaacagctctgtaaagttgtcagctccttgctacagggctggcacatgggcagcaggtattggctcactcttgaactctgacagaactagatttccttcatgagctgaaggaacagcctggagacccacaagagacacttagacaggccagagccatacctatggaacctagagtgttgggaagtggggatcctgcctagagcacttctgccaactgaggacccttgtggaccaaggcccacagaacagtggctggaatagttggtatccccagctggaatcagttagccctagtctgcttcagttcctgctccagcctcaacagtgacctttccagttctgcacctgctcccattgtgctacagcacaagggctggtcacagacacatcctcaccatcatctcctgttgcttaaaatgtgtccataggggctggaggaaatggctcagtgggtaagatcactttctgctcttttagaggacctgggtccaatttccatcacttacttagtggtttatgatcttagtggtttataactgtagtaaccacttcagctctaatgaatccaaccctcctgacctctgccagcacgaggctcacacatggcgcacagacataagtgcatgcaagacactcacacataaaattaaatattttaaagaaaagtgtatgtctctacgcatgacaaatactgggatgtttaactatttttaaatatctctgtgaacctgaaggggctaacccaggaggaggtgaggcatcagaacataaggagcctggcacctctctgtacccacaaggacatttcagagaactcaatcccctcccaccttcccccttctcatccagcatggttactgtgctcagaaaccatcagctccctctgggaatgggataggcaggggaggggccctcctgtagcatgcatgtgcagaggtctggctcccagatgagaggctgggaaaggaagtgaggggtagaccctttcggtgaggtctgcttcatctctgagccaggactaggtctatactcagtttgccctgcttaccccaaactccaaactccctttagcaatggtagaattctacgtggtgacaaatataagcactggattctctggggacaacacaaatatgctccccaggacctccctggagatatttgagaggactcccaaaccaggaaagagcccagatgcgcaagaggctaagctcaacacagactcttggaggatgaagtattgagcaatcccccctccaacacacaccccagcaagagggaagcagcaagcaaaaactagactgagctggttccaggtctgctgtcatcgtgtcctccagtccttctgctccaccacctttgtgttgtaatttctctggctcttcgatacatttcagaggaaaggctgcactcagtagagtgcctgcctggcatgtaagaaactgggtttgatccccagccctgcgtaaagccttcattttaaaaggtgatgacatacacctataactccagcatcctaggggtggaggcacaagaatcagaagttgatcacagcctacagagctgtgggtttgaggccaggctgtgctagttgagaccctaaagaggaagggagggatggagaatgaggaagaggagatggatgaggttggaagagaggttctctaggcttatggtcaggttgggatgtgaggcagcaggaagaacacagtaggaataaaactcctgcctcccttcccagggcacactcagaccttcagacaaaggcaacacccccacccacccaccatgactgtggcactcactggccaaataacaacatagtagcacccagacctccttagcaaggacagcactaaagaacacagtctccctaagtgcaaagactggccagagaccagtggcaccaaggaaccggatcacctgagagcttccaggtcacctggagacccagaagagtccgaacttccagactctagttccaaagcactctccaaaaccatcagcctctccaggaaggatggttcagctcacttggggaccagagcccagaaaaggctcctggaaaaagacttgattgacctcctccaccagtgaagtgaagatttaacatcatgaaaagaagctggtggtggcacatacctttattcccagaacttaggcggcagagacagatctctgagtttgaggccagcctggtctatagagtgagctccaggacagccagggctacacagagaaaccctgattggaaaaaccaaccagagaaaacattgtgaaaagacgcaactctgcttttgtcggcacaaacacagctttgtaggtggcatgggaggctgcttgggtggagggtatgaggtctagcttccactagtttcttccgcttctgtttttctatactagatgtagggcatactttgagaaagccagagatgagataaatgcagatggctcaggtaaggtggtcaatgggggagggggctgtgggggctgctgagaagtcctactgccctccagagggcaggctaggaggggaccagtacaaggctggccactttgcctaggtctcagatgggttccagttctctggtttccttaactatgcaaagtgctggtgctttctcagctccctcttttcttctctcccatcctgtcctcattctctccttccttccctccctcttctctcttccatacaaccagcaggcactgacagtccacactgtcccctctgccggccaattacacaccatggaagccataccccacccccacccccgctcctttctttgcgaatagggcccagcaggcatcctctcttaccgctgttctttccttttccagcactacaagaatcagtgagaatcgccaagtcacatctaccacctctcccaaaatctccaaccgttttcacacacacacacacacacacacacacacacaccacagaccaaggcactgactgactccccacacccaacacctgttcaacctcagagacagagaccccacaagcctacccttggtggtcacagacacccgctaccagatcttgggatctcctgaagtactttggcttggactcacaccaagcatttggctcacccctagtacctagtttattccaaatctgcaagtggaagaaaggaagaagagtctgaaggatcgggatactggcctttaaaggagccatagaccctcggttacacacaccatccttctcaatctttcccccaaacctctttttaaagctgagtcaaatacaatgagactgttccccacacttcctgacactgtctaaacagaagcgggactctgcagaacgtgtagccaagaggacacaggctcctgtccagagatccgtctggagcaggcactgaacaaggggctgctccaggacagaagcgcgagaaaaaaaaaaagcccgtgctcagtctcattctctaggtgtcagtcccaggagtgacaacctcagagctgcgggagagcccagcgtttgctcttggcagtacaacctggcggtctgccggtccagctccgcacctcaccctggctggggacagcatccgcctcccgggcttgtctggcgaaactcgcgggatccccacaataagtggctgttctgtgtgcctgagtgtgagtgccttggttgggggacgcgtgccctgaaccccagacctacaccccactctctaccgtcgcccccaccgcaccaagttccggagcccagcaaacctcctcttttctgccgggtcgagtcagggtcgcctcctcgagctctgagttttccatcaagcggagccagactgaaagctaggtgcatttccctggagatatagggaacagagggaagagggcgagagggaccaatgggtagggagtaataaagtttatgagagggtgtggggcggtcttctgtaccacggggctgtccagtctcccattgccaggctctaaacaccgccccacgcgaggaggcgcgaagacaccatcccctcccccttctccacatatctcttttcctcctatccctcctccttctcctctttccctccccttgtctctcttcccctcactccctcctccttttttcctccccctgaacgaactcccgttgcgctgcgcctactggatccacccagagtcctggaaccccagctcgcgcccaatcgccgacgggggcggggcctgtagggggcggggcagatggaggaaggggtggggaggggcagggagggacctgctaccctgagctaggactagcggctgctgtggcccaagcagcagtggcggcgggcatgggcgatgggggcgcggagcgggaccgcggccccaagcgccgggaggagcctggtggccgcagcgggcgtcacggagagcaccgcggagcggaagatttgcgtgctgacacaggtagcgcgagtccgagggagattgctgggacctccgcctccagccctgcgggctccagggagagcggaggggacagcgacggacagcaggcgctcggtgagacagaccactgccgccgcatcctggtacgaggtaaggggacagccgcagctctgattccctgggccaccaagctgcctttcctggggcctccgacatccctacaacgtccatctctcagatcatacagtggttcattcatttggtagttcatcctgtaaatactccgagtgcctattgtgtgcgggacactgagctgaacgcgggggacaaagcagggggctggaccttgtttcgtcctgctggaccggtgctctctctctctctctctctctctctctctctctctctctttctctctctctaggcccatccgggctggttggtgtagtaaggacacgaatcagttggagaagcccgacaccgagagccagggcctccgcgccggggtccccggagcaagggcggagaaagtcacgcgcgcgctgtagggacaggattgggagggacccgagtgggcagctgctgaggaaggctgggccacgcaggcagtcggatgcgtccccgcttcaacccagccttatttcccagcacctagccttgcgtgggttgaggcttagagatggctgggtgggcggtagggtagcctgacctgccgcggctccgctgctccagttttcccactcgcttggataccgccggctccggcgctcctccgcctggcctggccgcctggcctggccgacgcttt

SEQ ID NO: 31 - DNA, 873 bp, Mus musculus
ggttatgtagatattttaatgtcctttccctctcacctcaaaggttatgtttaagtattgcagagaggtgctaaaataaagccttgagattgtgaaacagaaatcctaacgaaggtgctccatctctcaggaagttcccaataacccgatcgacattcactgggcacattaagttagctgaccttgtactactgtgtgggcacaaaggtcattaactgtaagccctccctttgtataggcaactaaagggccttggtgttaaatgagggcgctcctaagaaaccaggatttagtgaaggtcgtcgaagggctgccaaaagatggctcaactaagcaatcttaggtatgcagagattataaccaagtctttgctgacatgcagaccgtggtttgggccaacgaagtcctgactgggatctcttgctttttctcggtgcccacatcctgcatcgcggtttgcagactccaaccaggttttctagtttcaagggtgcagggtagcatcttccggaaaaagaggagaggctaggtaagagaataaaagaaagatccaagaaatcctggctaaacccttcatcgacgttcccgccccttccacttcccagggcctgggccgctatttaatccccatttttcacttctcggggtgccaggcacgcacccagcctcaaggggaggacgtccctctcagtggctttcccagctcccatcaatttcaaagcgttttcctctcaggcccatcagggggacccccagagcggggcccagctttcccggccacgccgcgctgctgacacgcaggcgccagaatcaaagccacgcttggtctcgcagccaggtctccgcgccaagcgagggccggcggcccggagc

SEQ ID NO: 32 - DNA, 3811 bp, Mus musculus
gagtagtgtcataaaaaattcacaaaacacaagtttggtcatgcaggcagccaagacttgaaagaaaatggcaatcatgaaaagacaaagaattcaatgaaaaaatttcctgtggttggacaggaattccccacatagtccaggctgggctccaagtcacagtttccctgtttctacttccacagtgctgggttttagaaagaaacccaaaccactgggtattatacaagaaaattactgtaaaagtatttcagagatccttttctttgcctttttggctgggtttcccaggagagtttaagtttaaatgtcctcagattccttgaggacatgatcactgtgcactgagttaggactggcctttagtttctaagaggggatttagaaagttgtgcgaggatagagacggctcagtggttaagagaacttgttgcttttgcaaaggatcaagttcagtttccaacatccacatggcggctcaaaacaacctctagttccagggcaatctgaggctctcttctgacctctgtgggcaccctagcaggcacatacgtgacagcaaatacccaagcatataaatctttaaaagtaagtaggctgttgcttctaacatttaaaataaacccttttaattctgcctgcccctacaaacatttatctttcagagattcaaacctcttcatttggtacctgcttttctctattccattcattccttaaaccctgaaatgtgttgactcttcactatattaatttggagtttttatgaaaataacaaatcttagccttcacggggaacaatgccagtttgggaaacaaaaagctcaggaaccctctcaaaagcaaaaaggaagccaaggtttagaaagactaagcatgaacactgagcatggactaggctcagggactacagtcaaggaaggcataatgcccagcatgataatcctacagaaaaagaaagcaatcaatgtaagtatgcatcactcttaaagaattctcagctgtgacagtgctgtgacacgtaattgccagtaacctatgttacaaaatagtatgtttccagtaaaggccacttagtacatacaaggaacatgctatttacttacagtattgcaactgtaattgaagtactctaagatattacccacaataagctttgtattaccactttagaaggcaaaaatccttccccaattatttccttatacttacaagcatggttttgcatttttttgttgttgtttgtttgttttttgtataattgtgttgattgcccaaactctgagcaaactaaaacccattggactgcaccctttatgtaggtgaagggcatatgtgaatttcatttcaataaagctgcgtataaaaaaagagatacaactcaggattacagtttataacaagaccatatacacacacacagcatcatcaaaaattcttaaagactatgaatgtatacctacttacataaatggttacagttgagcatctctgcatacctaaatttctggaaatggctatattcattaacacatatagtttatcagcatatatccttgcaaagacatgttttctagtgccctttaattatccgagcctgctaaaatctgagaaataagatggtaagataaagcttgcttttctagatggccattaattaatataaatctgatgtcatttagatttcaaattttgagagacagttgttccatttaccttaagccatgcaggaaatccagcagcaaaaatctacgtgaaagaacgcctaaactacgaaaaattttagtttttttattatccaaaatgaagtaaagatttgctccgagggggacaaaaacccctaaaaactccccaaaccatatttggcaaatctaatggtgtgcctatctgtgccaacttgaagaaatggggagtatggtatttaccataatcaaagaggaggtcttaaagatacttttttttttttctggtaaaatgttttcccttaactttctaaatatggaatttttttcctgtgaaagttgagacttaatttttagtctttctaaagacactgatattttttccatgcatttatggttgactacccactatagagaaggctaaaatacttcaaagtactcaatcacgtacaaattatagaagccattacattatatcacccccattttccacactattttcacccatcctgttattttctttcaataaatcagtcttccacataactcaaacgaaggttactgctcatataaacaaagattcattagcttgaaccatttctacatttccatcaaaggacagaaagaaaatggtagctattggttccttctggtacttaccaacattacaagcagaagagcgtagtatttctgaggcttcacgttgctgaatccacaagaatggcatctgccacttctgtggctgcttctcacaccacaagccaatctttgaaaaaacgtcctttttaagtaccatcatctccatatatctttgaaggttcctgttgtgttttggaaatttaaaaagcagcctgcctagctttttgaaaggaagacctactggaactttattaatttctaacagaggcaccgtatatattttcactgatgcaaacagaccagtgctagggatacaatccagggtcttgactgtgctgtgggaatcctcaccaccgagctagccatctccttcgaaaagctcaggaggggaaaaataaaacactcaaattacgcatatcagcatttttaacttttcagagaccctcagtaggtcttttggcatctttctatagtgaacttcagaacctgaaaaacaaacacacagtactgtttgagttactggagaaaaggtgttgagatgctgagcaaataggctcaaaagttctttaagtattctgaatgtattttcatcggtaagggtaccaagtggttaagggaaggggatgatgtgttaactaacgttatctgcacgaagatgtcacaacaaaacacattattttgcacaatataggtaacaaaagaaaagggaagttttccacagttatcaacttcgaatatacgcagtattttagcacagttcatttagcgttagtcgagaaagactgctcacttgcagtcccttttcaatgtcgtttacgttcgctggtggggtaagaaaggttaggtgctaacttcttttggtagatccttcctttgtcagtttcagggccaagctccacaacccttcgcgatcacattatctagcaaaggatttctttgaggccctttgcaattcacgaccgaacgaaaattcagtggtgggagcaggggtctgacacctgaggaaatgatcatgagggattaagaaaaatgacaaggcaaaaaataaataaataaaaataacctaggtttagctccactcacagggtgcacgcgagcttttcgtcttacaggcgcgaggcccgtcgtcccgagtccccacaccacaacaaagacacattttgcccagagagtctccccaggaagtctaagggtttctccacgctcagtaaagcgactccctgtgtcccggggtggcgaggccttgtgcaaccccagcgggttgcggttcactccgactcgcgatggcatttctggctcgacagccctgaaggtccccagtgtagcctccgttcagtcctagccggtgcgcgaggctatcaagttctacatcctagcctcaccattctcaccatgccacctttcggctccacgagcccctcgaaacctcggctcgccgcagctccagggctccaacatggcggccggtccagttcttctctgggcgctct

SEQ ID NO: 33 - DNA, 3040 bp, Mus musculus
ggccaaaggaagatgtcatatatcctgccctgtcactgcctgacttatttcctggagacaggggctctcactgagcctggagctgtgttggtgactagcaagccccagtgatcccacagaacagggacttttatgttggtattggggatcataactcacgtttgtgtagcaattgcttgtgctgtgtaactctgagccacctctccagcttaggaatattattttataatttgaaagatctaaaaatgcattttcttttgtagttatagaaggtgctcttggctagagtggaggagtggctagggagatgactcagttggttaaagcacttgctgctctggcagaagacctgagtttggttctcagcacctgcttggcagcttataaccgtccacagtatctccagttccaggagatctgaggtcctcttctgctctccatgaccatgcatgcatgtggtgtacattcacacatgcatgtaaaaaaccatgtacataaaagaaagagaggaaaaaacagatgctccgtttattatttatttatttaatcgtggtgccagtggtcagagcctcgtgcatgccaaatgaatggcctggcacatgtccatcccaaccctaaggatgctccttttaaagcttcagagtgggactagcaggatggcccagtaggtaaataaatggtggttatcaccaagcctgttgaccgacccaagttccatttctaggactcatggtggaaagagagagccagctcccagaagttatctactgacctatacacagacaagaaaaaaaaattttttttttaatccttaaagagttcagggtagcaagaacaaagtacagcgactgtgctacacgtgtgagttttacagggagaagagggtggttctgaaatggtcaaagaccattgcagagacggaagaggagggtggagaaactgaattttgactcacagctgagtaaagttttggtgctggctgttggattctcggataatgatttaccaggacagggacttgttaggtcttgcttcgggtgttagaacacttttgccaaattagacagtgctgagcggcacatgacagtttgctggctacttttcataagcacttactagatctaaagcattgtgggaatctacagtggtgtgggtattactgatgtgcgttacccttgggttatcgtccctctggtggaacactgatcccacgttgtcaatctgcgttgagcaatagataacgctccactagaaaaggtcaggcgtcctcttctgaccaaatgctcattctttcctttcctttcctttcctttcctttccttcccttttcccttttcccttttcccttttcccttttcccttttcccttttcccttttctcttcttttccttcttccttccttccttccttccttccttccttccttccttcctttcaatggtggaccaagatgtacaattgtatgttgatctggtagagacctggaatagagtcagacgtgtgggttaaatgaggacctaactaactaatccagcaaggtaaagaagaatcgtattctcccaaggcctagacacttttcctttctgtcagcacttggtggtatttcgggagcaccggacatcaacatctttgaatgttagttacagcacagataggggactgtacatcccctgacagttctctaggaaccatgaagacatccctttaaatgaagcatgggccaccaacctgctcagcagccagggtgcacgtaccctatgaaggtacagtatactgcattattagggatcattttcacgggacggatgtcattgtcatttatcttgggattgctttgtgaggcagtgaggaagcgctgtgagctgctactggtttgccctcctttacttggagaggtcctgggtagtgacttacacattttgcatcacagctcatgttctatttaaatatttcagaaactaacttggaacgtttgagttgaaatagactgtattgaagtgcttgtcaaggggctggagaaatggctcagaggttaagagaacccgggttcgattcccagcacccacatggcagctcaccacttactgtctgttaactccactgcagtgcttctaatgcgcatgctctccatgggtgccggcgcactcatggtgcacaggcaaacactcatcaaagaccgaaagaaatgtttatccaactggtgtgttagacttaatttcaaactcttcgctaaatggttttagtgtaagaagttctgatgcactgagtcatttagtgaaccaaggacatgtaaaacttaagtcattagaacgtccatctaggatttttatttcaagaaattatagttacaatattgttattatagtgaaaacttaaaatttcctattgacattacttttgacttttagctaaactatcattttgtatgagaatctgcactatgttaagagcttggggttttaacctggttgatttttaacttcttttttttaaggaaccttaacttgaaagcagcgtgattggcttccatatcatctttgaatataaattgatattcctagtttcagcgtgtcctcatagagaccaacagaccaggtttattctttcaggaagtttttcaacaccggaagttgtgtgttatctgcacatggactggattgcccactgactcatacaaacatcggaaaaaaggactgaagaaaggcgggtttcaggaaccaactccagcccacttacggcttttgagcagcttgaaagaagataattctagaaatgagtgacgagatcctagtcatttctacatttgtctgtagacattcatcgtctttattaacctgtctgcttggggaatggtatttgagctattgtccatcactgtagcagctagtaatctacttgtggtcagagtttttacctgtgggtacagaaatcacatcagtagtagatggaagagaaaccactcatcaagacagtgatgtcccacacacccgcagaaattgactttcattaaacaatcactaaaagagtgtggtacccacc

SEQ ID NO: 34 - DNA, 14451 bp, Mus musculus
aggcattggcattgtggagatgaactaggcaggtactctccctcaagtacttcccagcccagaaggggacaggaccacacctgaggactatcctaaagatctgaacagtggagacagaatgaagagagcttgcttggacagctttatgtagcagagctggtacaagtgacttaggccttgaagggtgagtagttcattgagttaaaacaggtattgtccaggtctggataaaaggggagagggcaatgataagacaacagaaaaatgaaatggggcttcagtgggggaatatttacaggcccagaaaccccaaactgatgatcatagggtgatgtgacctatgatcaaggcctatgtcctacaggtgtagccctatacaacatctgactttggagcctggcaccacagtggcaaggtctggagcactttgccttactttctgggcctcactgctgcagacggaacaatgacggacccagtgctctgagcacactcccaaacaccctgactggagagtaggtgtgtgaatggcagctatcactgtcacgtgaattattacattgatttagaaggatctgttcagttcataaaccccaaataatggagcccagccagtcatgagacttgcagaactatagagtcactggggtagagctggtgctggtactggaggccgtgctaaaaatgatccccgaggtcttagtcctggcagaggagaaacgcagcaggctgggctgggtaactgtgttggcaatttccccttcaaaaccacctgaactggagccccattcattagcatgagaatggcgcgccggctgggatctgagggtccaaaggtatttgtattcgaaagagcttcctctgttcttggctcaaagtcactgcggcctgagctgcgaggctgggcggggatccaacacacactgcgggtagcctgggaaagaggggagtcctacccaagtggttgctccgagcctcgggaccacactcagaaatgcagcccagaacaccttccccatcccagcccacccggagccatccctgtatttgggaagctctcttgtaagttcttgaaatgtctccccacccctccagcctttatttctttttaaatcctgtgtggaagaaggcaggggtttgagacctgtgtgcctctcacaaaggaacctagagttttcaaaggtggagaagcactgcccaacgggattagtaatagtaaccatcattacagctagtggttgggagctgccccttgccaggcatcatgttaggaattttacatacattatcctcggtgtggctctctttttaaaattcatgccacaatcctgagatgtggtttcaagcctcactttactgatcaggaaactatgatgtggaggatagtgttagcttacccaggattaagaaaataaatttcctatctggagtatgggctacagtattaagttccacacctcctgattgcccttccggctgcccctttggaaaggagtccagtggaatgaagggatagtttgacaatttccccttcaggtcctcccagctcaggctccggtcatcagcatgagaaccaggtctgagcagaagacccaccctcatctctggcccttctctatcaatccttctctgggcactcaggtttgtttatccccctagggatctgctgtggagcccagcatgatggcatttctaagggaaaggcaggaaaggcagggagcagaaagatacccgcctagtttgtgtagcaccctgtgtcaccctcagggaagaacccagaatccagaatggaccccacaagaatgttcttcacttgtctgcccaacctcttcctcttgcctagtccttttgtcatcttcaagcaggcaccccattctgttctcccaccacctccgctctccctccttatcctcaccaacaagaatccaagaacactccagtgccttagccactctgtaaagttcccaagtctagccataccgttactgacaacttcatggagcctcagctaggttaccatatgttaccaagaaaatggggtcccctctcaggattcctagtttcaattataaaagaattttggaacagactcagaaggaagctctgggacaatcctataagcacttgaaagaaaacaccaggtcaggcaggctgcctgggaaaggcaaagatgccccaatcctgagtatgacaagccttgccacacccccacacagatctcctttctccacaatctttcttcttaatgtcccattccatcagaactttcaggcctcgtacaagccagaagccctggtgtctgcttgtgtcttgtttcccatctgtcctaggactaactccacactgctgcagaagaccgagcattcctccgcactggggtgggagtgctctgtgtaacccagacagagtgctgactcagtctcgggcatggtggtggcattacacaagggccacagctgcctgggaagccacactcttgctctccctgaacccccagaggctgtatgtaggggtaggcaggccgagtgctcaagggccctgccttgccaagctttttatctgcttctcattatcctcgccctctgcctgagaaggtaattaaatctgtctcccatcaaaagctggggctggcttcaccccaaggcctggctggcatggcagggaaataatgaacactctcaccagccctggagggggcgggtcttagttggctccaccctcgcccatcacacaaatctgggagctaacattcagttctcctcagggttaaagaaagagtctgagccttctaggttgtggaaaatagagccctagtgtcctggccctgaggcttgaggttcaggatccccagtggggcagctcaaaggaagagtatgtgccatgagctcttcttgtggttaacagaacacaggacccggagcaagtttgctttgagagctcagaagagagacaaggttccctttctttttccctttatctcaccaagaggatgtaatgatgaagatgaaggctaagaaactgacaccggtctctatgacctgccccagttacaaaatgaacacaggaaggcttcgtagaaagcgctttagaggatggcagggaggcacaggagagaagagacagggatatgacagggagactggtgttgtgggaagaaggcagcagggaggtcctcagggggtcctggaagtagtgggagtcaatgaaggtttaagaggtcagaagttagcgggccccatgtgcagggctggagagacagctccatgtttaagtgtgccagttcctgctactaaagaccagtgttattggcacccatgctgggcagctcacaacttcatgaaactccagatccagtgcccccttcaggtttctgcaggtacctgcaagagcagtgttgtaagatggaaagaaaagggttagtgtgcagttcggcttgatccctctatctcaaggctctcattcttggctctgtctgactcaataaggagggtggttcccggagcttagcaaggggcactctgcccagagtcacttgggctatggcacttgacctcaatagtcttccctgacaccgggattctgggatccctctggaggcctcactttcttcccctgtgagatggcaaagatgaggatagttatagtgaagtgtccctcacagaccaatgagcatcaggtgtcttatctgtgtcagaagagccctgatctggttgccacaggtttcctccagccacaggaggcctggatgttcttctggtttttgatgggagctctcacaatcctggcatgagcgcatcctagtgggcaggttttgggccaacctccaactttcaagtagccttgtgagagccgctactcaattacccttaatcttcttgatgaggtggagtctagccaggcattacaggccccacaccaagtccccaagccctggtcacagattactctgccacagccctcccatctcagtctccagatggctggtggtggcagggatgatgtgtccttcctaccctactgccttctgggtgggggtggtgatcagatccacagtgtggaagagatattctgaatttcaaagacccggcttcaaatttcaccattagaatttggccagaggcctggaaggccttcttaatccacatgtctctaggtgcccctgtgagtcagaaaccactttctggaagaggggtttccttagatccgaggaagccagcagacctctggaaggagcagacttgcatggtggggattgcaaggcacagagtgctgctagctaagcagaccaggcagtcatctcaaagtcagtggacgaaggtgctcctcccagctggagcttgggttgaagatcttactatagaacaccaagaaacgttccctatgacaaaccacatgcatgggcgcacagcatggcacacacagaagcaagccaggaacccttccaggcatttctggactggccaggacgccacagtcatcagcaaaagggagatcaggacaggccttgcttgagtgtagactttgtctctctgcatatgtttctgatgtcatgtgctcacatttgtcctccatgtccttgtcctggagctgataaaagtaaaataggagttcgtcctaagactggaaggcagatatatataatccctgccttgggatggtcttttactgcctacactaggactagaaagccagatgacaagaagggtggccgcacgttgccctttgtgaaacagggagataatcagggcatgctgggtggcaggaaagcagagtataccaatcccaaggactttgttttcaagtagttgctgccacaaggtgccactaaaggcccagagaggttgactgacttgcccaaggcctctcaggctttctaaagcctcactcctgagcattttgcactggtcatagaatggatctgctgtgcttctgaaattggttgggagagtcacaggcaagttcccaagaatgttaacaagcttgcttagtgacaggatgggaggagaacacctggggcccaagcctggaagtcgaaggatttgtccaataacatccaggaagagaaaggggagctcctagtggggcatgaggttcaagcccagttcccagacactgtgaggctaacattgccattgccgggaaagcagtagttcacccaatgtgcccaaggtcttcctgagtggctgtggggtagcccctctaccctcaattatctgcacacttcccaccagcccctagatgagcccacttcagatcttggtctaacaatgtgaccatggccttcatgggtcctagttatagtccttttgacaaaggcaagaacagcacttaccacagtcaggattcactgttgtgtctacacagggatttctctgctctgttctctcttccttctgctgggctccagggctcggtccactaatatttgttcaatgccagttggagagagacgttggcaacatggtagcccaggactgccaacccctgaagcaagagttgccctgttttctcatgagtgatggggacttctctaacagattgaactcagacaccatgtggtcccctccccctcttcagaggtgcctaacctcctgtctagctctatgtacccttcaagactcaacctaaggagtaatgtctaattcttaccccatgcacagaatgggttagttattttccccttgtgttccatagtaccttgaccatcaacagcattgctaatgatcaaagatatagagccacctgtgtgtccacctctgccacaagatgagcttctagctatagacactagagaattagtgtggtggtttgaatatgcttggcccaggaagtggcactatttgcaggtgtagccttgttacaataggtgtggccttgttggaggaattgtgtcactgtgggcttgtgatttaagacccttactcttgctgcctagaagtcagtcttctcctagtggccttcatatgaagatgtagaactctcagcttctcctgcaacacgcctacctggactctgccatgctcctaccttaatgacaatggactaaacctctgacctgtaagccaggcccaataaatgttgtccttctaagatttaccttggtcatgatgtctgttcacaacattaaaaccctaactaggacagaagtaggtaccttgtatgcagctactgatctagcaaatgccttcttctcagtacctatccataaggaccaccaaaagcaatttacttttaattagtaaggccagtagtatacctttacagttttgtctcaaagatgtattaactctcctgttctgcatcataacttagttaagaagggatcttgatcatctgtctcttccacaaaatatcacattggtgcactatattaatgatatcatgctgattggaccaaacgagtgggaggtagcaaccactttggaatcactggttacacatgcatatcagaggacggaaaataaatccaaccaaaattcaaggaccgtttagctcagtgaaattcttacgagtccagtggtgtggggcatgcagagatattccttctaaggtgaaaaacaagttattgaacctggtccctcccaccaccaagaaagaagcacaacatttatcgagtctgtttggattctggagacagcacattcctcacttggatgtgttattcaagcccttttaccaagcgactcagaaagctgctagctttgtgtggggcctggaacaggaaaaggctcttcaacaggtccaggctgctgtgcaggctgctataccacttggaccatatgacccagaagatctgatggtacttgaggagtcagtggcagatagagatgctgtttggaggctttggcaggcctttgtgggtgaatcacagaagagacctttgggattttggagcaaagctctaccatcatctgcagatattattctctcttggcaaaacagtgcttagcctgctattgggccttagtggaaactgaacatttgacaataggataccaagttaccatgcgacctgaacagccccttatgagctgggtatcatcagacccaccgagtcataaagtaagacatgtatagcaaacagtctattaccaaatggaagtggtatataagtgattaagcctggagcaggtcctgaaggcacaaacaagttacatgaggaaattgcccaaatgcctatggtttctactccttatacaatgctgtctgctgccaagcatgagcctatagcctcatggggtgttccctagggccagatgactgaagaagagaagactaggacctggtttactgatggtatatggatttcttagatttctaaatacgaggcagagtggtgggcctagagccttgcctggtgattccttagaaacactccccaaagggctgatcgtagggatgagttgtcctgccacatgcccagcactattaggtccacagagcaggggaaggatatgagcctagaggcaagaaaattaagcaggctctcatccttagactctgtctcctcattcgtggctggccagtgactcacatgaaggctccatgtagcctaggcttggcagctgcagaagtgatcatagggctcatggcgatctcctgcaggactcagatatgggaactggacactgaggaggaggcaaaggcagaggacacccctctggttgtatctggtcataagctcctggtgatggtaaatcttcattgtcacctagatatgaggtcacctaggagacatacctcaagtgtgtcagtaaaggtgtaactgacatgggaagacctaccctgaacatacaggcccttgaacacaagcacgatacggcacgtgtagaggtcagaagacaactggcaggaaggagttggttctcactttccaccatatggaacccaggaggaaccgagtcatcaggctttgtgaccagtaccttttacccactgagccatcttgccagctccagatttctttttaagtgggtgctgatcacattcattaaggcccatgtgtggagatgttaaaacccagtcacctcccaaaggccccaccttctgacaccatcacatttggggttagcaatttttaaatgtttatttttaatcatttgtctgcctatgggtttacacatgtgggcttgtgttcctctagaggccagaagagagcacagggtctccaggagctggaagtacagacaatgtgagccacgtaacgaagggcccacaaatagagcttgggtccctctggaagaggagttggactcctaatcaccaacctatctctctagccccaggataagcattttaaaatatgaattttgtagggacacaaacttctaatcttcaacaaatagggaggtccggccttgcattctgttcctctttggttccaacagggaagcaagtggtactagcagtgtgaggagacctaatgtgttccagacagagtggctgttctgttacaaacacacaaactacaagtgcataaagccagggtctctaaccacctgccaggtaggagctgtgctcaccttcttgagagaaggaaacttaccaaacagaaagaagacatagaaaacagagattgcccccaaactcataacagattggattattattattattaattattggtggtggtggtggtggtggtggtggtggttttttgagacagggtttctctgtgaagccctggatgtcttggaactcactcggtagaccagactggcctcaaactcagagagccccctgcttctgcctctttaaaggtatgtggcaccacatctggcttcagattgaattaatcaagtcttctcacagagaataatccagtcctaaaggctttatatgctcaattttaattttaaaaaaggaggaggagaaagaggagaaagggagggagggagggagggagggagggagggagggagggagggagggagggagggagggaagaattaatttatgtttaaatcttttgtatcctgcctggcatggtggcacacgcctttaatcccagcactcgggaggcagaggcaggtagatttctgagttggaggccagcctggtctacaaagtgagttccaggacagccagggctatacagagaaaccctgtctcgaaaacaaaaaacaacaacaaaacaacaacaaaaagcttttgtgtcctagaaaaggggggacatctttttaagtcattttgtgaagccagcaaaactttaatctccacttcaagcatctgcacagtggagaaaataataggttggcagggcagcatcaggggccttgagtgcatgtgcacagcatgtaacatgcctgctatgtattccacatgcactagttgttttacgcggtcacaccaggatccaggttgaaatctctgtctcactgaaccagacatctagaatggcatccctaggacaaagaaggggaaggaaaaggtgaactatgatacttgaatagagaccctaaaacccaggggcaacctggcaaactggatcccactagactctcattcaggcccttcaagctagctgcacccatgacattttgcacaccaagctctgagaacctgtaactgactgtattaagacacagccagggccatttgaagacaaaactcaaggttctctgcatttgctcctcaggcaggtacccgaaccaaccataccacagccgtagagtgcttggccttatagcccaggctgtctttagatgtaagagtccccgtctttaagacaggtagtgaagctgctctgtggatcactgaaggtcacaggaagaacttggagtgacctggcccataacagtcacatctgtctgaggaactgtctcctctgaagatcactgccttccacacctggcattcacagagactggaatccatctcctgtgtgtggtactttctctgtataagtggaacacacatacagccttctgtaatagctacttggccaattccaaaacatgtttatgtcaaaatattcatgactgacagattcccccaacccaccccactttcctctctgaactagagaaacagcctattcaaatcctatatcctgactcacagcactccggcatcatcttggaatagttctgaatacctgtactcctcctgcagatatgatcctacaacccactttcagttcacagtcgcatacatactacttctctctatatgtgtaatcgtgtaactcatggagaagccagaggtcaatgccaagtaccttcctcagtcactcttcaccttgtttattgagacagagtctctcactgaacctgaagcttactgattaggctggacttgctgggcagaaacccctagggttcatctgtctttgccttgccagtattgggattacagaggtaggatgttttatatgggttatggggttccaaatgcaggtccccgtgcttgtgaagcaatcactttgactcttgactgagccatctttccagccctgcatgtatactgtgtctctcttccccatctgtagaagtccatcatggagccagggtggtgcagagtgttatgaaggtcactgatggtctgaagtcctgaccccggccctgtatctgtgcaaccttggaccagatcctaagcttgccgagtctctgattccctatctggaaataacaatagacactcagcatcagcctggtgcagtggttctcagccttcctaacgctgtgaccctttacttactgttcctcatgctatactgacccacagccataaaattattttgttgctacttcataactgtaatttttctactgttgtgaatcataatgtaaatgtctgtgttttctgttggtgttgatccatagattgagaagtcctggctcaacgtgagactcctttatgagctgacgaagagatactcagtgtaccagatcagtaggcacatagggaatctgggtactgggatctaagtagtctggagactgggtggtcctcacatctctttctcccctgttgaggctgaagagttgaagggtaagggccagcccagttgtggctgctggctttggggctcttcagccactggggaagctccagggaaaaggatggtgtccttaagaaacagcagcttaggtctggcccgttttccctaaagcagggaaagcaagttggtcccaacaactcacgggaccaacaactgcaccttcctgtctgttagaagctgcttcttcctgctttgaacatggagaaactgaggacagagaaagccttggcataccatctagtccagctccctttttggctctgaagggaagaaagcaggggatatataaagacattcctggcatctttttagcacaataatgttcatgtttttggaagcaaaagttgtcttgatttttacccagaccaaccaggtaggtaccctctatctcatcatccccattaaaagtcagcaaacttaggcagcttcctcaagagctgcccctaactcgaggcagaattagaacttcaggtatctcttacccactcatatccataatcaacacgtacctcctaacagagtggactctggtaagaacccatgttttccagtcatacgccattcacttcaggcccttaggaagtcactctgttatgctcactgctctattctgtcttgacctccaggactcctgagcatcattcaaggaattctctggtctctaaacccaagtctaaaggcagctgatttatctgatttatccctgggagccacacccagcacagggccaagcacaaacacaagtaagtgtgaatgagaacacttgtggaaggaatagaggaatgaaaggatgaaaggaggaatggaatgatggaagagaggaaggattagaagcccatactctcttctatagcttctctcaacagaaaaacaaggccccaagtgtctatcccacattgattaacctcagtccctaccaccactgctacacctgatccccagccccctgccacactgttcacagcatttgtgacttgccctgccaccctcaatactactaggacacagagcactcaccttaggcaagtgaccaggccttgaccatagactggcagaggaaggatttggaggcctggtctgggccttcaaagacctagagcaaatgtccaccttcttcatccccatcatcccttgcttactgggaactggtgaggttcatgctacttccctgaggtggggagggggctggggggactcccagtgtttgtcagcagagtatggtattggggaggactgtgtttccatggttactagccatgggagctgcagggagatggggccatggtgtacatagacacagatccacacggacctgcaagaaaaatagcaacagatttgctgagtcattggccccacatatttatagtctctggcgaaggcagacctgcctatcagaggctaataatactgcagcagtgtgttaattgcaaagacggagtcttcaagcatccattcagacacccgagactgcttcttgaataaagagtgaggcctcacaatgagccaggcttcctgtttggtagcatgtatagttaggagtgtgtgtgtgtgtgtgtgtgtgtgtgtgtgtgtgtgtgtgtgtgcaggtatatgaaacctggttcttgcttggcacaaaagctactgttatatcaagcagactgaaaccagcccacggcatggtgtgacagcacactcttcaaccccctcctatgggtgtctaggattcacccactctacagatggccagggcaaggaggggtccaaaacaaaggatatgaggatgcttggctatatcccagggatgagaggacatgaggcatgaggcaggatgctaacagcaactctccctggggacagctattatcctctagctctgtacagccaggtaagtcagaagagagagagtagaagacttttatctccctgtaggtcaaccaataggccacctggcatagcaaagatcaaactggagctggaatatgaaaaactgagccaagctcagtcagtactgagagctggtatgccaccttaaataaatatgtaagggccaagttcatccctgtagagggatctctgcttcaccctcgagatgtccatccagacacagtgtctgccccaacactgccttatggtggcagcaactgtgctttgaaacttgggagatctacatgttcccaacacctgggcaataaggccctgagtggagctataggtgaaatggatatgtatccctctcagacagcactattcttgctccctgtgaatcttctgactgaccaagtatttgcctggcttgggatcagttctccttaaaggctctgttcctctctggacatgttccttcttatactgggcctctagtagagccaggttagagcgtgttttcccaaaagacccctagcccctttggtcttctgctgcctgtggcccctgcatgcacattgcctttgggtttaggaggggaagggtggatggcaacagccttctctcagcttcagcctcagtgtcacatctagatcagtccttgaccttcctgctcagcctacaagacacccatgctttcctcacaaccaggaaggaacaacaaagcaagctcagcaggaggagggtagctgggctggctgtatcatctgggcctccatctcgcccacaccaatcccccaaacagctcatgctctcgtgactgagtccacagtactctgtgaagagaagggaggaggctcggggagagaggggcatctctccggttctcacttcttaagagaaggttgactggagagccgttattaatagtaaattaaatagtgaggttattctgaataataaagagcccttctgctccaagttcccacagtcctctctccagggaaacacttgtgatagcttgagatgtggactccgtgattggcatttgtagggcgaagcggggacgaaaatgtagctcggtagtgttttcttatcacactgaagcttgggtttcatccacagcatcacatgaacgaggacagtgagtcacttgggatatggagagacgcaagaggatcagaagtttgaggccaccctcaggaacacagcaagtctgagggcagcccgagccacacacgcttcttaccaagaaaggatgaagccaatgttcccactctatcctaaaataggctgccaagcacacccaagaatgtgtcctgtgaccccacactagaagaccttgacactcagtatgatcgcatcacgaagcctgatctatacccaagggtgggaaccgcatcactgtggtctctacccatcatggagaccctctcactcactcactcgcccactcactcacagtgtgaccttgggaagccactgaactgatctagtctctctcccataaaatggactaatggttgcatctcccccgagagcttggcagaagggttaaaattaatatgtactgaatgctattgattatataaagttattatatg

SEQ ID NO: 35 - DNA, 5361 bp, Mus musculus
gtttcttaaattttatttattctagagacgaagagagtatgagtagtgttactcggcatagaacaagaacattgagtgttacgtctgcgggcagtgccctaagctgttcaacaatccctccagtaagtgctacatgtgccagttgttggggtcagagctgtgggcagagtggtgacctttgggtactgtcaggatttcaggtcatttagatatttggatctcatatgttaatgttataacatggtcagcatgtagaagttttcaccaggaataagcaaagctttcagggataaggcaacatataaattagtttaaatttatggaataaaatgttaatgtagtttgtagttccccatgattcagtctttggtttttaacaaggaaggttacatgacattgcccaaaggtagcaatatggctgaaatgtagaggtatatcacccccccccccccttgcttacatctgggaaatgggtgattttaaatgtctttactatcaaatttttgttggtcccttgggcatcttacatttgtatccaagcagtttacaaaagggatattttctagacaggacagggagcagaatattctagcccagctgaggttctggcatgtaagccagcctctctttagacctacccagaaggaagagtcagtgtggagatgaccgcaccccacaaagcagccccctctctgtggcctttggagaagcgtttctctaactccacacacatttggattatgcagctactaggtctcattcacatctgacatttggaaagagcagggatttacaagtcattattcctctcaggaatcgaggcagactttgttgggtttgcttgccttcctgatccgttagcagtcagcagaagtcacccacctgcctcatttcaggattatgcagtgtgttttgaagactaattgtgcttcctaaaaattattttctgtctaaaatttaaaaagtaaacttggcaatagccatgtaacaaaatagtaagtaatttatcaaattttgatgctttacagcaatttttgttatgttggactcttttcttctgtttaagtaaaattgtgtgttactaaagctagtttttagagataatttcctcatagtgaacaaagaaggaaacagttcagaagggaaaaaatgaaaaagtgaaatggctgtacacagagtaaactcaagataaattacttcatttttctaaatgtattaaaattcagatgttattagtgaattagaatgttttgttttggatagaatgagacattataatattaaatgagagctatccagaatgacattgtatcccaaatgcacacataaaaagctagctagacgtggtgaggtatgtctgttaactcaccacaaacaagtgaagacaggagaattcctggagcttgttgactgtcaccaggttcagtgagagacagaccctgtctcaaacgaacaagatggggagtggcagaggaagactatatatgctggcctctggcttcagcacacacgtgtacacacaaggatgcatgtacacacagaagaataaagtaaaaaatagctaatagtagtttctattacagttctggggctgttcagaaacatttaggatttggcagagcaataacagtgaaattctcaaaaatgtaattttttcatattccttctaaacttgtctaagaaaatttacttgattttctaaatataaaattgaaatctgtgaagcatgtaatacattaaaagataaagttttgagccaggcatggaggtgcacgcctttaatcccagcactcgggaggcagaggcaggtggatttctgagttcgaggacagctagggctatacagagaaaccctgtctcaaaaaaccaaaaaaaaaaaaaaaaagataaagttttcagtacagatatctcgcagttcattaaataacctttttgcttttcgcttttatactctctgttcttactgggatttatctgccccctttctttgatttcgcagtatcagaacagaattggtagcaggttcagacttgtgtggccttctgtgtggctgtgccgatggaagcagatgtcaagctgctctagttcctctttaccaggcagaggctgctcttctcatgtgttgtggttttagtcttcaaggttttgtcttgagctttgtgagttgtagatgagcctgtatcctaaggagaatacaagaccttcagcctaactccatgaacagagatctctgtgcacacaaggttgtctttaaacttttaattgaaaatcattttttttcgtacactatattctgagcagagtttcccttcccagctctgcttcctttcatccacccttgctcctcatgcctctgctctcagctgctaggatggcaggccatagccaacgcctcctgacacttttctcatactgcttcttttctgttttgtaaagatgacagaagaaaacagttacctcagtggacttggtggtggtggttttggaatttatataaagacaaaaagggcttaaattccttaaaattgtatcataaaatctgttccctccttaattcttttatcattcctatttattggctcttatgctatacataaacttataatttataaacacaatagtcatttgtaaattctgttcttgaaaacatgaaacagaattaagtaattgttgcctttatacatacatgtggctagagctaatgggagacctttttactcttaacagcaagtgatgatttccatgtagttgctaaaataacacaatattttacttcatgttgtacccaggtttttcttacacacaaaaaattaccgtgtaggatttgtacattgtttggaattgggctataagagaaaccaaaagtcattatgaactgaattttttaaaaaaacgttttcagtcatgtgatttgtacatatggcatttgtggttgttaactatgagacagtgctctgcatctgcatactctgtgaggacttcctatgcgtgactgccgcccccaggcctcttctctgtcccaagcaccacagggctggctacgtaattccagcctttggaagggcaggcaggggctagaagatcgaggccatctgactacggtccagtttaaggccagccagggcacccaggctacaggagagtttacctcagggagggagggagcgagcaaataattacaaaatcatgtgttttaccaagacgggtttttccccccaactcattgttcataatggtcactaggtggcactctagcagttgataatttaaactgaccacttttgctgtataatctgtatttctgggaagaatataaattttaaaaactttcaacagcttctcctgttttatctactagttcatatagtgtccttaggattcttaaaattcatctttaacatgtaaatttgaaagatactaccagtgtaaatcttggataataatttgataatgatttctctgctccttatcaagatggttgtcagtgatactaattcacaagatctttgcaggaactggtgaagcagaaggtgaagcgtcagctgacaaggcagcagaaggcggctgccagacgccggctgcagaaaggagaagccaatgtgtttaccaagcagcggagggaaaacatgcagaatattaaatcgagtttggaagcagccagcttttggggagactaatagatttctgatatgtattatttttttagatgctataattttatttttagccagtatattggtcttttttggaccaaagccagtaaattatggaaataaagcctctttagactcagagcttccaaggtctgattaatagtaaatctgccaagcactctgtttcttaaaatttttcaggtaactaatttaaatataaaataacgtgtgaaaaaaacttcattggcagtaattgcaaaacatggacatcatttttatttcactgtgatgttcagactctgccttaaacaggtagaaaaatgacttgcctcagattctggatttacatgtaataaataatagaacaacttaatgcaatctgtagttctctcttttctccttcagtcggtcacacttgggcttttactacattggtgagttggctttaggatcacctgagacagtcagtacacagttatttgaccattggagtgaaactgatcgtcttctgtttctttagacttctggagtggagatgaatcagtaatgggtagacgagcagcagcgggtcttttggtgccgttctcattggccctgtggtcgtgggaaaaggaagtttaggttcctaccagtatttttgcagttgtcagctttccccaggtttcagcagaagtggggggagggagggagggagggagggagggagggagagagagagagagagagagagagagagagagagagagagagagagagagaatgcatgactccaggatgtgttcctacctcagtgttaacaagtctctagaacaacactctggtgtgattcatccctcaagcgcattctaattcagtcagtggaagtgagtgtaagtatacaagcactgtcccttcagcttccctgagcagatctcgaatagaagatcgtcttcagcaagaagtgaccaccagatggcagtgtttgccagcagtgacatgataaaaacaccagcttcccttttaccttagcaaaattcattctgactatttgtaactgatcactatctaagcgcatttaaatgtttggatatatgaatatgtcaagtgcagtttctttgaaaattagactgatttttggaagtgttgatatagccctgttttaaaatgtagtttaagctcagatactcattttttatactctgctaaaagtgtttctataacataaactgatgttgaagatagtttaataagaccacagaatgtttattttgtaatacgtttttcttatgtccaaagcagattgggaataaaagtgtttgacctcatttttcttggctttacttcactactgctacataagaagcttgtttctatttgatttatatggtttgtgatagtgtctatcagagttgtgaagactagatggaagaggatttgtgaaaaggactggacacgtaacacagtggtagagtgtattttcatttacttttgtatcacaaaacccttaccagagccggggtggtggtgccttcctttaattccaagcactcaggaagcagcctggtctacacactttgaggacagccagagctatgtagaaagaccctgtctggtaagtaaataaaaacatagccaggcatggtggcaatcagcaggtagattggagtttgaggtcatcctggtctggagagtgagttccaggagagccaagattacacaaaccctgtct

SEQ ID NO: 36 - DNA, 24383 bp, Mus musculus
agttagctgtcttgtctccttgatggctgctgtctcaacataagttctcagctcctgctctagagccatgcttgcctgtttccatgcttctccagacgatggtcatgaactctgctgccctccggaatcatgagccccagactaaatgctttcttacgtaagttaccgtagtcatggcgtttggtctcgatgcgacagaatagtagttagctaagacacttcctggcgatcccaaactagggtcctctggcttggtggcaagagtcttcacttgctgacccctctcttggggcgtcgtttgtttttatttttgtgtatatgcttatttgcacatgggttgtgtgcatatctgtgcaggtatgttaatgcacatgtgcggaggtcagaggataaccttggacgatatgattatacacttttctgcttttttgtttgtttgaaacagtctcacaagcctggagtgtccccaagtgggctaagctagctggaagctacatggggcggagactggacgtgcacgccatcttgctcgtgttctgccgggggttggggaaactaacgggcttcagacttgtaaggcaagcacttcattgactgtgtcattccgctggcatttgggtgttgttttctcttgttttaaacggggtctcactgtgttagagtgatatttttgtacattgtgtgaagatgtgtctctgtccttccttgcctgcctaaggcaccttctgattggtcaaaataaaaagcctatggcctataggagaaggtagaatagagagggtgggtcatccagcgcagagagaggaactctgggaaagtcaagtaccggaagacccgccaccaagaaggaagtcaggcttatgatgcaaggagaggaaaccaaccatgtggccgaacttagtataaatgagttaatttaagagctagttggggagcaagcctaaactaaggccataatcatcgtaaatgaaaataagcctccagccgggcagtggtggcacacgcctttaatcccagcacttgggaggcagaggcaggcagatttctgaattcgagaccagcctggtctacagggtgagttccaggacagccagggctgcacagagaaaccctgtctcaaaaaacaaacaaccaaacaaaaaaagaagaagaagaaaataagcctccatgtcattgttcggcaactggggcgtacatggaaaagccttcgggttacaactacgtatccctggctagtctacaactcagtgtgtaaactatgctgatctgtagagaccgacctgcctctgcctctcgtaaactatgctgatctgtagagacccacctgcctctgcctctcaagttcaggggttaaagatgtccaccactcccttcattttgcttgtttttgaaattggttctcaaattacagcctagactggcccggaattcacaatgtagattagactggtcttaaacccatggtaatcctcctgcctcatcttcccaattagtacaattattggctggagccacctcaaccagcttaactataaatgtatatgaaggttggacttggtagcatgtgtctgtaatcttagcactccggagactgaggcacaaggatcaagagtttgacactttgccagcacctgggaggcagaggcaggcagatctctgtgaatctgagaccagcccagtctatagagtgagttcctggacagccatggctatgtatagagatcatgtctcaaaaacagaacaaaacaaacaaaacaataacaaaaagaggttgatgccaggattggagagatagctcagagataaagagcactagctgcttttccagaggtcctgagttcaattcccagcaaccacatggtggctcacaaccatctgaaatgggatccaatgccctcttctggtgtgtctgaagacagtgacagtgtactcatatacataaaataaataaatctaaaaaagagaaaaagattgatgccagcctgtgctacttaaaaaaaacaaacaaaaccagagttgacaagatggttctgcaggtaaaggcagtccccaccaagcctggtgacctgagttcagtccccaggacccagtgatgaaagaagagaaatagctccagaaagttctctgatcaccaaacccacttcagagcatttgtctatctacagagatacacacacacagatacacacacacagatatacatacatgcacgcatatatatatatatatacacatacatacagatatacacagatatacacacatgcaaacacacagatatatacatacatatatatacacacagatatgcacacacatgcatacacagatacacatatatgcatacatatacacatatagatacataagcacacaaaaaggaaagaaatttaacaaaaatgaaaggtagacccaaaaccatacataaaataaaataaaatttaagacttctttaagacagtgtgtgtgtgtgtgtgtgtgtgtgtgtgttcggtttgtgtggacctgttgaggtcagaaaaggtcattaggtcccctggaattgggctaaaaacagttgtgcgccatcatgtgggtacagggagctgaacccaggtcctctgcaagagcaacatgtgctctagaccactgagcagtctctccgtccccaaagaaacaaatttatatggaaatacaaagtgagcaaattagttagttttttaaaaattttgtacaagtatgtgtataaagcaatagtgagaggtacattcagggtgcagctagaccctcggtgctgaatagagctctcaaacaaagccatccacacggcatcacctggctcacacaaaggcacagctgcagtccagacagggatggaagagccttcaataaatgttgaataattggatattcacaaagaaaattcaatcccggcttttacttcaaatacatccccaaatcaatttgaaatggacaataagcttaagtatgaaagattgaaaaaaatagaacttcgaaaaagaatctcatggaaactaatttccatagtcttgtggtagccacaacctcattgttgaagccagactgctatagtaacttgtggtcatccatgcctacatgaagttaaagtctagcgtccatacctcacagttgagctgagtgtggtgatccaggcttatgcaagaggatcaccagtttgaggctagcctgggctacgttacaagaccccaccccaccccaatctcaaaaagaaccaaaatccaaaaaccagctaggctgggtagtgcatgcctataaccccagctcctgaaaggtagagagacggggttgggacataggaatctaaggccagcctggactaaatagcaaatttgaggccaactttagctttatgaaaccttgtctcaaaacaccactgccacaatatattttgcctgtctttgtcgttgggtcaagcagggaggtacataagcccccacctcttgttactcattttggacagaggcagtgcagcctattattcattttagacattaaaagccttcctttctgagacatttcctagctcttgctgtatactctctctctcttctctctctcttctctctcttctctctctcctctctctcttctctctctcttctctctctcctctcctctctctctctctctctctctctctctctctctctctccctgtttaacactggaaatccatctgtctgttgattattcatttgttcacgtgtttgttttgagattcggtctcaggtagtccaggctgtccttcaactcactcaatagctgaggctagccttgtacttctgatcctactgcctccaccgtctaaatgctgccattgtaagagaatgccagcaggccgggctccccctgagccctgtcttcctggaggttccctgcagagcagggctttgtctgcctgcccccagcactgggtgctctgtgaatacttaaaagattccagcccgtcttttcctgcttctctctgggtgattcttatttttatctcctccacaacttcctacttaattttaactttccgttccctcctggctggtttatattccaggaggctctatgctattcagttccttatgactccttctaacagcgttcgattctctgggtcttgtcctagcttggttttctttcattgttctaaaggatagcttctgtttacgtaacctttctccttatccctgtgtgtatgtcatgcgtagttagggtctcgagtgcaccaggaaacacgccatgtagccaaagagaaccctgcgctttttccctttgttgtccttttggtttgtttggtttttattttttgctttttgttggtggtgttggtttcttgtcttgtttgttatgtgagatagggtctccctacagagtagccctggttaccctggaactcactatgtagaccaggctggcctcaaactcacagagagactgcttccccgccccacccccatgctgggatcaccgcccagcttcttttgatatattttggcttgttgttttgtttcttccttccccagttttgtgtttccctttcactccaacagtaaggctgtccctgggctgtcactgagcagtactgtttgaccctcacctggaggaagggacacccggcatctcctggtgcagtcaggtctagcgaacgtggagctggggtcacggtttctccaaacagctctagcccatactgagtacaacacgggacttggaatggatacccatgcccagtggggactcctacagtgggcagtttctgtgctaagactcttgggggatcactgtagcctgggattcttccggaaggccgtgttcctttcctcttctttggcaggcgtctgaggaccagccagctcctcctctttatagtccctcaagcgtttcctcttaacaggtgcaagatatttctagcccttctaactctgtggcagctctacccccacccaccaggtgtgttagttagctttccgttgctataacaaatacttgtgataaatcaacttagtaagagggaaggttcagtctatggtcccgtcttcggttacacaggagaacgtggcagagggggctgtccacctcatagtgtctggaaagcagagaaaagggaggcagagtaagagcctcagttatcaccctatctctacccccactccccgcctcctccccctcccacccaccctgcgcattccccacctccctacccccccctccctgactgctttccccatcaaggccagacccccagtgagctaacttcccttcactagactgcaccttctaaacggtccaccacctcccaataaacagtaatagagacggaggtcagatccttcatccttggactgaagatagagcgctcatccttggggacatatcttaacctgaggacaggcactaagaaaggagtttaccttatttattgggtcgtccttggtcggctgcttggacttaacttgcaaagcgttagaaagcagactggaagtgcagtgcgttcggtagaggacgacacaggtgttacgtcagtggtttgggctcttccgggactgggcatcgggccagcggtggtttcactgaggaccttctgggtgttaagatttgaaaatggctcttggaagcctttcagttccaccagctgagaaaactttttttaaagtttttttttttaaaggttcttcatttttcttcctctttcttccttccttccttccttccttccttccttcctttctttctttctttctttctttctttctttctttcttttcttatctttttttttctttttttctttttttatttcaagacagggtttctttgtgtagtcttggctgtcctggacctctatagactaggccagctctctagacctggctggccttgaattcggagatctgcctggcagaatagttctctcctccctgtgtactgagattgaactcaggacctgaccgtgctaggcgagcgctctgctactgaactagggctcccttcgctcttcagctttcttgtccaggcagcagtggatagagagagtcaacctcttcccggtgtgtgcagcacctctgtccccactggttatctccacatctcttccctccttccttcagtgttttgatttcagacagggtctattctagcccaggctggcctggaacttgatgtataggcaaagtacgacagctttgtaatcctaatcctgctactttcacctcccaccccccatgctgggttcccaccaccacacctggtttatgtgatcttggaacccaaacccagggctttgtgcatgctaagcaggttctctaccaactgaactccatccccaaacctgcctctccgtttcttgcttttgttgctatttaacctaaggatgcagctcagaagccttgtccttcacatgcaaggcactctgttctcttctaggaccaaagtgggcaaggaatctagaagcacgtaagggaaacatcagggtggaatacaatgtcttcaaagtccgaccctggccagccaaaagttctaggtccaaaagttcccatagttcctcccccccactcccgccccccaacacacacacagcgccagcagctggagaccaagctcacatagcagcttgtacgagacattttacattcaaaccatgatatctcccttggatatggctggacgcaagagcactttgtaaagaatggaacagagatggcttagatggctcagcagttaagagcactgactgctcttccagaggacctgagttcaattcccagcaaccacatggtggctcaaaaacatctgtaatgggatccaatgccctcttctggtgtgtctgaaacagtgacagtgtactcacatacataaaaaagatcttaaaaagaaaacttatttcatttttattttctgggcagtgtttttgcctgcatgtatgtctgtgcatgggtgttgcagacagttgtgaatgggctgggattcgaacctctggaagagcagctagtgttcttaactgctgagccatcctctccagcctccttcctgtttctgaaaacaaggagtgctatgaccaggacatatcctctggatgtcctggaacttactacctcgctgaggatgcctttgacctcccggtcctcctatctccacctccccagttatcacaagctggttgctactatgccccgtggaaatgtctgctatgtaaaccactgagttgacagggaatgtgttgcacagcggggcataatgcaggagatgagggagactcacgttggagtttgggacttgaacactgaataagtgtcagcagcatttaccaaatgagggaatctctgcagaaagaagcattagaaagtccaatattaatcaggcaatgctggcccacacctttgatcccagcactagggaggagaggcgggcggatctcctagtgcaacgccagcctggtctacagagcaagtttcagaacagccagggctccacagagaaaccctgtcttgaaacacccccaaccccccaaagaaaagaaagcactatattacctggatatggtagtgcatgcctggaaccctggcattcaagaggcagagacaggaagattgtcagatcgtgtggtcagcttcagctacctagtaagttcaagaccaccttgagccacatggaaagaagactccaaagaaataaacataacacccaggcttattgcctttaggggtgtagccagtagtgaagcctataacatgctctggcctcagaatttcccaatcccagcactcttttggaaaaaacctttggcagctagatggagcttgcaacagatgctaggtgtggtctccattctggagagaggatggggaatctctgacatgctctaagtgtcgaaaaccatgaatgcccagagagaaaagatgagaggccctgagggtggaaaggcttggtcactgagagcccgaggtgtcccgagatggaaggagtgtaaggggtgtaacccagcaggaagttcagagaaggataacagttcctgaggcttatatgccacgcactttaacacagcctgaactgaaaatagtgggatagccctgtaatcccagcatatgggaggtcaaggcagaggaacagagagttcaagggcagcctagactacatagcaagactatctaggaaaacagaaggatagagtcttctggtcaagccccatagcaactctgcatggccaaaaatcgtaacctccttttcacagatgaagaaactcacaataccacacagtctttgtggagtggcaacaccaaaagtcaggctttgaccataaaggatgggtaggtcacaggccccttagtcttttgagttcagctgtacaaaaatttgccaactgagagttcaccaaacaggtggttctcagatgggcagaaatagaggtggaatcaggggatggtccctaaggaagaaagagagaatcaagacagaggccaggagatccatgccttttgcctttaaaggagcagcatgcaaatcatagtcaaagagatatgcaaatgagattcaaattgagttgggaatgagcatctgttatttctgagtcaacagctcaggcacttttggatgagccctcctcagctttctcccagggttgccagggtcaggaaccccaaagggaaggcctggtaactggacagaagtgggcctctaggacagcagggttctaaataggaagggaagccccacccactgcatggaggtgagtcatctatttgcatctatttgcatattcatattcatctgacaaatgcttgtaaagcacctactgggtgagagggctgaggcagatgcagaagacaaggaggggctcactgcttctaaggtctagatgcactcttctgggttacgggatgaacagcaaagacgccggctttttctagaatctaagccagactttcccaacctctgagctctggactggacactttccatcttcctttagcaacatcctgggcttgacccactagataaatgaccctagtaacccttgacctgtgatagataaacatgtccccagacatggcctaatatggaagaggccaagaagcattcaggttgagaaacttccattctagccaaacatggaggtatgtacctataagccctggggaggtggaggctggagggtcaagaaatcaagccgggcgtggtggcgcacgcctttaatcccagcactcgggaggcagaggcaggcggatttctgagttcgaggccagcctggtctacaaagtgagctccaggacagccagagctataaagagaaaccctgtctcggagaaaaaaaaaaaaaaaaaagaaatcaagtacatctgtaactacatagagagtatgaagccggctggacacaagaaaccctgcactaaaacagaaacaaaacaccgctcagatgtctaaggccatgagcccttcatctgagcaggcgcactcctggggctgagtaagggttttgttctaaggacttagtgttctatactgttatttatttattctttttttttccccatttttttcgagacagggtttctctgtgtagcccaggctgtcctggaacttactctgtagaccaggctggcctcacagagatttgactgcctccaactctggagtgctgggattaaagaggtgcagggtccccactgcccggctgcaaggctgttcttgagtgctttcctctggccttctgtctgtcttccagttgacatcagtgggtctgtgggctccatgcctacctccattggtaggtcccaagagtttggaagggcaactttgccaaccagtgttttcccagtgctgccctggaatcctgagggacccctggaagcctccgagggtgttgggaggggccggcaggagtagagtcagcccagcaactcagaccttcttggttttgtttctgagtttctgtatcacgtcctttggataaaaagtcgcaagtggacaaaagtcccaaaggacagctgctaatcactcagccggacgtggggtcacgagcaagcatccctttcccgacatgtctgctctggagcgcatggtgcggtggctctggggtggctgtttggaggctttctcagcttcctacccagctcctgccatggataggaacagattgtggagcagagaaagaacactgtacctaaaaaccaagcagtctacgtatgtgttcagagcagacgggacagaagtgagggtccttgatcaactacatcccaaagctgtcacacccagttggcaatacaaagaactggggctagacaaccagaaagaactttccaacttagcacctgggggaattgctctctgagataggagggtgtccctcccatcagagctgaggctccgaatcctgcagagataaatctctgaaactcagtaagagatagagccagacttgggggttttacccaaccccactgtccgagaattctcttctgtctgattcatgtcaggaagagtgttgggatgtgtggggatcttgttccccaagggctgggggatggaacgggcttccccaagtaccacaccctcgggacccaggcacaatcaggcatttcacatctcagaagggtcagaatgaaaggccagtgtctgtctgtttgccccccacccccttccatctccagatttttccatctgcccctgggccacagcctgctctttctcacttctccccccaccccagaccccgtgtcatacacagaatagtagaaacagagggattgtctttagttctctgtgtggctggtgctctctgccccaacactccagtgaggaagccccctcctgtcacgcactggatcccagagggttcaggggctctgatgggccacagcagccaccagaccctctgatccagctctctctactccttacaatgttctctgcattgtggccctaggtgaggggtgacttcctcatggacacaaaaggcttcctcccattggagactttgctaaaggttaattgtccaaaacctggttgaatggctggaccaaagaagccacttctgtcattgcctatatgtccccaaaaagggatgttctctgtgctgcctgcaggagcccgtatccaataggctctctccaatgccacttttgccttgggaccccaatgctgatgattctaacatccggaagctgacatcactattctccagaccctccacctgtttgtcccaccaccaccaggaactgtgagcaaccattccgggacctgacattctgtaaacttcacaccaccttccagcatacccagccaggagtacttcctggataaaatattaaacgcgcaaatctgagaagtgccttaaccagcgacagactgcacgaccacagcctggcgaaggagacgcacgccgtccgggggtgggaaggtatatatagacacagactttgcatctatcttcccaacttgtttgaggcagagcagtgtctatggaaaaatactgccgcaacctccagctggggtggcctaaggtcggagccggggctggcaggaggggtgtcaggaggagccccaaagctgagctcagggtggggtgacaaaagccctttgtgctggttttctgtacaatgccattggccaactctgcaagggaaccagaggacggttagaggcaaggtctcaagatagagcaagacagaagagcggggatctagggctgctgagagcacacctcatgccccctgtgccacagagcctctaacgtggcaccgtgatacatggggtgtcatgcagttcatagagatgggtcactagtgttcctgcttgggtctggacctgcaaagaaccttgttgatgtacccctgctctgacccagagggatgagggtggggctaaatctacatttcccgaaacctgattggtgcatgtaaggtccaacctaccctggcctgggcatttgctaggctccagagtcccatgaggatccacatgaatttaagtttttttgcttccaggttattttttgttttgggtttttgttgttgtttgtttgttgtttgttttgagacaagggtctcactatgtagctctggctggcttagaactcactctgtacacctgactggcttccaacccacagagatgcacctgcctctgcctcctgactgctgagattggagatatgtgacaccactttgggcacaaaaccaagagtcttagaacacagctgagctcaacctacgtgtgacctgtatgtggcatctgtcgaggactatagtacccatgttttctcacagtgacctggaaaacccaagccagaacatcagggggccagcaccaaaaaaagagatcaaagactctgtagtgacagtccccaaatcctgggaatgacaaataagagtgttcatgtcatttcagactatcacagagcccatctagatttagaaggcagactcactttgtctcagaattagttagccacaggagcctggactgataacattctacaaaggacacccatttggcttagggtggctcagagctcaccatagctaggactaataatatacccatagctgagcccctaacccagggagggccccagtgcaggtatgcctgggaagggctcttctcagaccggcaggatgtggaagactggaaggtgaggctggagagaagtcgatcaggctctggggagcttgccagctccgggctgctgcaagctgcctgctgctgtgggctgggtgctacttggctgcgcccagttggaaggtgctaagaggaggtgctgcggctactgtgccagctcagcctgaggaggaagtgggaggcagaggcagggtgggcacggggccctggcacaggaagagcagactcccctaagaggcctggcaccaggacaatccactgccgaggcaggaattcaaacagggaggagccgagatgcagtaccctgaccttcacacacccagtctccattatggccagggcagggcaccggaggcaaatgggttaaggatttacagatctcaagtgagggatgcctagcacctcaccgaaagacagcaggcatctctctggctggtgaactccagtctccgaggtagagcctttcccatgctacagatcctgggacaggtgctctgactgtgtgtgcgtcccctgccctgatcccaggggatggagcaagagctggagagctggtgatgcagtcttagctaagtctagtctgtcatccatcagtctctccagcctcatcctcactcaagaggcaggcatccctaggagctggtgaaagtcagggcagctggggtgaggggccttgttggagggcattgagcaggggggggacgccaacctttttttccaagaaaggaaagatctttttaaaagatgcatttttattttactttagtgtgcacacgtatgcgcgcgcgcgcatgtgtgtgtgtgtggtatgtatatgcccttagaaaccagaagagggcattgcgtcctctggtcctggagctgtgaggcaggtatgaaccacttgatgtgggtgcttgcttcgaaaggaactcctggcctctgcaagtttgtaaccacagagcatctctctagcgtctctcagcttgtggactgttccgcatctttctagcaacattgttgttactggcttatagattgtttgtagtttcatttttattcttatatgttgaggggttgggggtccttctaaggccaggagaggaactcagatcccttgatgctggagctgtaggtggtcttgaggtgtcccacatgggtcctggaaacaaaaccagggtcctctagaagagcagcgtgtgctcttaactgctcagctatttctgcggcttctctgagttctggttttgttttgaaacagggtcttgctatgtaacccagcgtgatcttgaactcactatgtagcccagcatgatcttgaactcactatgtagcccaagcttaccacaaactcactttgagcctcttcctgtctcagcctctcaacacttggaattaacacaggcatacattatcactcctgtctagaaacggacatgttttgcaaagttccagacagctgttctagctagaaagaaagaagggaaggggagggagggagggaggcatacacctttaatctcagcactcaggaagcagaggcagacagatccctgatctccagggcagcctggtctacagagtgtgttccaagacagtttttctgtctcaaaaaaacaaagcaaacaaaaacaaaccaaccaaaaccagataagcttcttcctttcttctggtcacacaccttgccttgggaggcaagtatcagggagaggctgtggccccaagtctaagggaactggtaccaacttctgcccaaatcattccccattcagcctgttactgctggagaatccctctttaactgcatttccacggggacaccaccaggctgacctcctttgtctgtgcagaggagacacattttacacactcttagacacagctgtgtccgaccaagagacacactccagtgcacaccggaaggatgatatggaaggataccgtgtacactccagaacattctcagactcacgcctgcgtccacacatggctcatgaacaggcccgagacccctcaaagacacatgcagggatctagctcataggacacacacaggcaggacttaccacagaattctaggaaagggaagggtcttgttctctgaagtacggagtcctgacgtagaataaagatcacaggcatgggccacactgagtttaaatatatatattttttaatttttacatttttatttgaaaatattttatttttaatctattggtgacaaggtcaccatgtagtcctggctgtcctggaactcattctgtagaccaggctgtcttggaactcacagagacccacctgcctctgccttcttagggctgggtgggttaagaggctacaatacctgacctttttgtttatgtgtctacacatatgcatacgtatcggtgtaagcctatgctatgggtgtgcagatgcctatgtaagccagaagggagcatgggattctctggagctagagttacagaatgctgtgaggagccactgcattctttactggagtgctgggaaattaacttgaatcctctgcaagagcagccagtgctcttaaccactgagccgcctccctagcccttggtactctctttttgtttgtttgtttgtttgttggttggttggttgatttggttggttgggtttttgtttttgtttttgtttttttgagacagggtttctgtgtagccctggctgtcctggaactcactctgtagaccaggctggcctggaactcagaaatccacctgcctctgcctcccaagtgctgggattaaagacatacatcaccactgcctgactggtattcttatagaaattacatttatctatttattatgtgtgtctacacacatatacaccataatgcccttctggaggtcagaggagacaggttgcagatgttgtttctctccttctaccacgagggttccaggaatgaaactcaggctcactgagataccttgctggccctttcattgatgttgctgctgctgctactgctgtttgagactggtctcgaaagtagcctaggcatgcttcaaacttaagctcttcctgcctcagtttcccaaactgagattagaaacatgtgccaccattttaacagaatagaaatttaatctcggggctggtgagatggctcagcagttaagagctccgactgctcttccaaaggtcctgagtccaaatcctagcaaccacatggtggctcacaaccacccgtaacaaaatctgatgctctcttctggagtatctgaaaacagctatagtgtacttacatataataaataaataaataaataaataaataaataaataaataagaaatttaatctcagcatggtggtacatttctaaaatcccagtgctgaggaacttaaggagggaggatcaggaattaagggcagactcacccacagtaagtttttttaagggtagcctgggatacctaagatcctgtttcattatcctgccagccaaacaaccacaaacagcagaaaataagagttagagaccccttgccatgccgtggtggcacactcttttaatcccagcacttgggagacagaggcaggcagatttctgagtttgaggccagcctggtctatagagtgagttccaggacagcccgggctacacagagaaaccctgtcaaaagagttagagaccctgaaagatgctcagtcagtaaagagcacttggaggagagaacccacaaatatactcaatagatgtgaagactatgaggaagaggccaaagagacaaagaagctcaggatctctcaggatgcttttctgtgttcaccacagatatgctcacacgatctgaaattcgctgctgtgaaaacagaaggaaacggtcctgtcaggagaaccagcccctgcagttccctaaggctggcacaatggaggaaggtaaggacgcatcccaggctctgggagtccctgacagaaaagccatggcagcaaggcctcctttgagatatttgtaacctagacggatttgggagcaggagctggaggttgggggagcccacttgagaggctatggcaagaggactcaatatttgaggcctacaacatagcagggggctcaagctaagcaagagctgggcaccatggtgcaagcccctaatcccatgttgtgtgacaaaaaaataaacattcctgggggaaggcaacatatgttctcacctcagattgggaacctatgacagcccaaagaatagataacaccagtgtcccacttgttgaaccaataggttttactggagttacttacaggaatatgggtgaagggctatttacagaagcagaaatgactcacagacagctgtatcagcaaagcccaccccagcacagatgacagttcacagagccaggaacccagagcacactgcacagcctgcaggcagttcaacatgtcgggcgtttgttgctctaaacctcttccagggagttcagctggttcctgcgcctttcaggaggctggtctggtctcagaagtggctgttgcagcttttctccattgagagttgctcagcttcaccgctctgaaagggacgctcagcatgtattgcttactgtgacagagaggagcctagtgaatctggtcagtttcagggacttcctgaagctattttgagttgtgtacctttttgtttaaagagcttctctactgggggttggagagagagttctgcaattatgagcactggcggctcttccaaaggtcctgagttcaaatcccagcaaccacatggtggctcacagccatccattatgagatctgatgccctcttatggggtgtctgaagacagctacagtgtacttacatataataaataaataaataaattaattaattaattaattaattaaatgaccagggtagggtgacagctttaattcctgccctggagaggcaaaggcaggtggatctccgtgaggggtgcacaggacctacagacaagtgctagagagatgactcttgcagaggaagagtttgaagccctcctggtgagcaaagtgagttctagggcaaccagaactacatagaccctgtctcaaacacccaaacaaataaatatggctagaaatggtggtatacatctctcatcccagcacttgggaggtagaggcaagagaatcagaagttcaagactagcctcaactttacagtcagtttgaggccagcctgggcttcatgagactctctcaaaaaccaaagcaaaaatacagggtgggaaagatggctctgcaagtaaagggacttgccttcaagccggactaccagaattcaatttctggtacccacacagtagaaggagagaaactgtggttgcctgtaactttcatgtgaggactgtaaaattaattaataataaatgaacaaacaagaggtatgcttggctctcctggcaggagcatggcggtcctcctaggtgggtgagctgggaacccagggaggacacgaagagggaaaaaacgacgtcattgttgctctgctacctctaggagctcctccaacctctggaccttccacaacggctctccagctccttttgttaggggttgggggtgtctggcaaaatccaggcagaaggcagtgtcctctgaggcaccgcccctccttcctacctctacaccttctctgtctgcacttaagtactggattcatagtcctccttagtactggatccatagtcctccttagtactagatccatagtcctccttagtgtactggattcatagtcctccttagtactggattcatagtcctccttagtacttgatccatagtcctccccacctccagcttcagcctccttccctgtccaacccaaactctagggatcatcctgttctctctctctctttctctctctctctctctctctctctctctctctctctctctctctctctctctctctctctctcgcccaggctactaactccctctgctctcagttttgagctctttctgtgctgtcagtagtttccttcttgaataactcctccaagcgcctcagtctctccctcaggtccctttcctgtctcacccctccttcgcgtgctgcccaatcctcctccctttccctacctcgtccctcttttaacttcttacagaaagccatctccatcttcccaccttctgcgcccacagccgctaacccggtctccatcccctctgagatagcgctcctcagtcatcctgcccagactcctctcctcagcccctcacccacccttaacttgcactgttgggggtgctagtctctgagcctccttctagactcttccccatctctgtagttccacagaaaggaagcctgcactgctggattgtcttctccacccctcccaggacttctctctccccccacagaaggacatctctccccccacagaaggacccactagagcccccaatagcaaagcctgtgaacctctcactccatcctctcaatccgatggctcactttctcctccatctgtttcttcttcctccctcaactctttctttaatactgaggatccagcccagggccttgcacttgctaggaaagccaaacaccactgagcttcgtccctaaccctcccttcattgcgacattacttagaagttgaatggtttcaggtgaattttctattaattgtagagttttccactttttcttttgctttgtttgagacagaatttctctatgtaacagtcctggctatcctggaactcactctgtagaccaggctggccttgaattcttaaagatccgactgcctctgcctgtctagtactgggattaaagacatgcgctaccccacaacccagtcagtctgtgctcctaactgcggagccatctctctagcctgcctatttcttttttgatgttggtttgtttttgtttttgtttttgttttagatttaagtgtgtgcactcgcgcatgcacgcgcacacacacatacaggctcactcactatatacacagaggaactagagttacagggagtttcctgatatgggttctggggcctgacccttcagtcctctgcaagaacagtgtcttggttagtttgtcaacttaaaacaaactagggtcaccagagaagagggaacctcaattgggtaaatgcctcatgttgattgcctatagggaatttccttaattaatgattgatggacctagcagggttcagttcactgtgggtggccttggctggtttaagaaagctgggggggacggtttgcgcatgtgggggacgacagataggtgagccacactcctccactgtctttctgcactttctaccttcaggttcctctccgcctgagttcctacctcggtgatggactccgtgatggactatgatcctgacacgtaagccaaacgaaccctttcctctccaggttgctgtttagcacagcagaagcagcagcagcaggcttctctctctcctctcagaagcatcatgtgctcttcgatgctgagtcatctcactaggcccctcccgagccctcttccacaccttctgagagataatgtctcacgtgaatctctggctggctagaacttagaaccagagcaggctgatctccaaacgaggaccatctcctgcctcccagatgctgggattccaggtgtgtgggtatgtgcgccacacacctggctactggaacacatttttgttaattagctgaattagtcatatagtcgtattatgctaaactgcattaatttagttaggccaagtggtattagttaattaaattcctgtaacatggaagacagcggctggggagaccttttcctaagtgctcctcgctctatctcccaatgttcgaacttaaatctctattaaaactatattttaggcaggtgtgggtgctctcataggatcagaaatccaaagccattttttggctacatatagagctcaaggccagccaggctataggagaccttgccttagaacaaataaaacaagaactgtgggtcataaaaccagtaggtgtagtggttaaagcccagagtctcaaaatgtgaaggctcacagcccgataatcactgcaaattcaaggctagtctgagctttaaataaagttctagccaacccaaggctgtatatagggagacactatttaaaataaagaaataactatttaaaataaacaaataaaataaagtaaaataaaatgggtccttaaagaatgtgaagtttctaccctgcagttccaagaaaacaaaagctggttggactctgttgtcagggctactcaaagactccagcttttttgtgtgtgtgccactgtactgccctctagggcaccctcctggtctcctgaccaaccttgggtggctgccatcctggggtatgccaggcagaaattgaaagggcataaccaggctgggaaggcacacaatactgccccctgcagcccactgatgcgattctagtcacgtagccacattcgactgcacagaggtttaggaagccccagtcaggcccgaagaatcatctgttggcaaattagcagtggcctcaaagcacccctgcatcactccatactgatggccactgacgtcatcagcctctgcttcactccacactgatggccactgatgtcatcagggttctttctggccttagcccctcctctctctacacacatccctgagctgttcttgcccagtcctaccctcaaggttcctaccaaccttccttcagctacatcgccctggagtggctgacttacctggacacctgggccagacttcagtttctaggaggactccgtcaactctcaacctgactcacatgccaacacaggagccaaaatgatggggtaacagactggaagtagggcccagtgggtaatgtgtgtgccgcgatctggactagttaaagctagatgtgtgttttcagtcttcagccctcttcctctcgccttccctgcctcctgtgtctgtcacccccactgccatccccacccctggtgctgaagatttaaaccaggaccccaaccatgctccgagggtactctctacaggaagcagacgcttcagctccttcttttccctaagtgcttgggttttgtgatagctcataggagaaggtctcgtttcctatcaatcgctgtgataagcaccgtgaccaatagcaaattgggaactaaagggtttatttcatcgtccatgtttgccatttaagaaagtcaggacaggaagggaggaagaaaccatggggagatgctgctttatgcagcccagatccatctacctagggaatggtgctgcccatagtgggctgggtcctcccatatcatcaatcaagaaaacatgggctggcgagatggcttagtggttaagagcacccgactgctcttctgaaggtccagagttcaaatcccagcaaccacatggtggctcacaaccatccataatgagatctgacgccctcttctggagtgtctgaagatagctacagtgtacttacatataataaataaataaatcttaaaaaaaaaaaaaaaaaaaaagaaaacttatagacaaagccacgggccaatctaacctgggcagtttctctactgagactctttcttcccagatgactctaggttatgtccaattggtaaaaactaaccagcgcaggtaaccaacctaccacttgtgtcgcaaaatccactgatttttggaggcaatgctgaggctcagagagagtaagtcactgagccagagttgacaagtgttatctgtagagtgcccacatcctgaagaagggatcacatgacctgcttctcctatgctagtacaggcacacatagacgcacacaggcacacacaggtacacataggtacacacaggcacacacaggcacacacaggcatacacaggcacacataggcacacacaggcacacataggtacacataggtacacacaggcacacataggtacacacaggcacacacaggcacacataggcacacacaggcacacataggcacacacaggcacacataggtacacataggcacacataggcgcacacaggcacacacaggcacacacaggcacacagaggcacacataggcacacataggtacacataggcacacacaggcacacataggcacacacaggcacacataggcacacacaggcacacataggtacacataggcacacataggcgcacacaggcacacataggtacacataggcacacataggcgcacacaggcacacataggtacacataggcacacataggcacacacaggcacacataggtacacataggcacacacaggcacacataggcacacacaggcacacataggcacacacaggcacacataggcacacacaggcacacataggcacacacaggcacacataggtacacataggcacacataggcgcacacaggcacacataggtacacataggcacacataggcgcacacaggcacacataggtacacataggcacacataggcacacacaggcacacataggtacacataggcacacacaggcacacataggcacacacaggcacacataggcacacacaggcacacataggcacacacaggcacacataggcacacacaggcacacataggtacacataggcacacataggcgcacacaggcacacataggtacacataggcacacataggcacacacaggcacacataggtacacataggcacacataggcacacacaggcacacataggtacacataggcgcacacaggcacacataggtacacataggcacacataggcgcacacaggcacacataggtacacataggcacacataggcacatattctgtgtctctgtcacagagctgtgacttctaaaaccaactccacagaggtgttctctaacttccacatgtgtgagcgcgatggcaatggcaaccatgcacatccccctacaacagagagagaacacttagaataagccaggtgtggtggtacacaactttaatagcagctcttggaagacagaggtgggcagatctgtgagttccagaccaatccggtctacatagtgagttccaggccagctagggagagtgaaactacaacaacaacaacaacaacaacaggcacttagatcagaacaatgcacagctcccagcaaatgctgtcaaagaacctactgtgtgactgtgtagctatcaggaaaaaaacaggtcaactcaggatgaacgctcttccacatgctgtgtgacctcagggtaaatcaattagcctctcagagccacatttcctcagttggtgaacagatactctttaatgtttagaaagcaaaacaactcatgcatagcatttagcattagccttaagttctgaggaacagaggccatgtaggtcatcaccatttctcagggcctcacctaggggccagcgcagcgaggcactcaatgagaactaatctcttcttcaccctctagccacaactaagatccggcaggtgcttgcagacagtgacatcttgtgggaaatctcaggaactgcaccgtggcaaatcgctgctccttttactgtggggtccttggaatacccagtcaacatcaaggaagcattcattcattcactgccttctgtgtacaaggaactgatccaagtcctggaataaagaaagcaagagagactggatggctacacggggagtgaaaaaattcccaaggattataaccttgtcattactgctcaactttaaatatattttgtgtgtgtg

SEQ ID NO: 37 - DNA, 12267 bp, Mus musculus
gcaggagagagttttaggtcttttggaatggggacagcatatatgtaagatgtagctgctagagtttcccggtatcatggcggatgtgtaaggattcgccaccagaggaatcagattttaataaggcttacaagattaggttttagttgttgtgcccagagattgagttaccattgtttctgaactaagtttgtgttggctttcccttcacacagtgggggcggctcatctgggttcaagagagaaaggtatcctgtaaagcatgggtgtgctaaatgtgcaacacaaaggttgtgggggatttgaagcacaggtgggcttggtaaggacccaccagtgggaacctagggggctgggtggagagattgtggagttctgagtcagagtctccatgagataaaacaagttgaccaatgcctgaccagaccactggggcagagagttgctggcacaagcatgggaacgtgtcagttcttttttaatatttcccacaacaaatatatatcctgattacagtttcccctccctctacccccctccccgttcctccctgaatttcagggttcagactacaaactgcttctgtgtgactaagagaagaagaatcagagtaaagagaaacatactctcttaatctccgaagattaacggcaggaggagctctagaatttcacaaaggtgctgtcaggacacatgaaaatctagagaaaaagaccagcttgaagagaccaaaaagaagaaagcctgccaatcacatcctccagagattctgagacacacacacccctggtgtagggggacaccatctgaaaggtaagccagccttggcagaaagatgtgtgggcctcccacagcctcacaagcctccagtccagttgtgggtttgttttggttttttgtttgtttctccagcagatgagtcagcaaaggagaggaatcctgttttgctgccaattgatatgacttggagagcaatggttagaggccatcccaagacaaaaactattgtgtaaaatcaagagagcatgggggcttgaatgcagggaataaccacaaaccaggaacctgaatgtagtctgatccacaaagagagataaccctggaaggcagctgtggagagcaagaggaccagatgttgactagccaaacagtgtaggtggtgagatgttagactcagtgaatcacacagggaaagaaagctgggtcctccatgactaagaacatactgagtccaccaactgaaactggccttgagtttgatagtctgaatctgagctcagcaggtagatcaacctgcagcaccacctgtctgccattcatctgagcagaaacagcaaatccacatctgcatcaactgatacttaagaggctgaacaagtctgtataactctcctcagctgcattaacagcaaaggaatagacatacacacaatggtctatggttttgtgtgtcaacttgacacaagctggagttatcacagagaaaggaacctcccttgaggaaatgactccatgagatccagctgtaaggcattttctcaattagtgatcaaaggtgggagggccccttggaagtgatgctatccctgggctggtagtctttggttctataagaaagcaagctgagcaagccaggggaagcaagcaagtaaggaacatccctccgtggcctctgcatcagctcctgcttcctgacctgcttgagttccagtcctgacttcctttggtgatgaacagcaatgtggaagtgtaagctgagtaaattctttcctccccaacttccttcttggtcatgatgtttgtgcaggaatagaaaccctgactgagatagtctacatacacaatggaatttttttcagccttatctttttgtcactgtatggaaatggatgcaactggagtccattatattcagtgaattaaaccagtctcagacaaatgtcaggctttttaaaattacacgtttagcgtgtgtgtgtgtgtgtgtgtgtgtgtgtgtgtgtgtgtgtttggatgtgcctaccatggctcaggtaccacagtaagcatgtggaggccagaggacaactagcaagagagcaagacagttctttgtatcatgtggtccagatgacacgactcgggtcattaggattggagcaaatgcctttatcactaagccattttgatggtctggtttctagattttatgtagatatctaaaataatgcatgtatatatgacattaaagtaaacctaaacctgtctcgggtaacaaaggagagggaggaggagaagcagagagaacatgctccagtatacatgtaccatatatacttactgtgtctatgacaaccgttccaaaggggtttaaccaaggacggaagatacatcctgaatgtgggcagtaccacccaataggctgagtcagtaggggaaagtaccaggacgcatctctgtgggctgactgcagatgcagaccagttacctcaggctcctgctgccaggcctctccagggctctgagccacagcaagcctcttagaatgcttggtgtttggtcaccgtaagaagagcaattcattcaccacagcaaccagatgaaggctaggaacatgagtggcctgctgaggagaagcacatcggccacagcacagggcgtgcacctggaagctcctagctgggctatctctgagaagccataggaggaggaagaggtcctggaaagatggctccgtggttaagagcactagctgctttcccagaggatccgaatttggtcgccagtacatgcgcgttaactccagttccaggagatctaatactggcttttggcttctggggtgcacagtcacacatgcacgcaaaacatctgtgaacattaaaaaaatttttttaaataaaaaagaaaagatagagaataagaacttgaggctcttagtacccacaacaggggctgcctgcttgttactcaaataagacctttttcttctctctactttttccaaggagccagaattgcttaggtagcaggtagcaggcagcataagagaaaggcctgagctttggtcgaagcaaagctgaactagaggctagtaacaattcatatgtgggtttattcactgaactgaacaatgtgactacagaaatgaaactattattggaaacacgtcttctggggactttttgctacccaaatgatgacccaaaaagttacaaggcacctacagaaaatttcctctggggcttaatgagtcatggagaggaaaatacagttgcttagattatatttctttttatatatactgtaagtttttcttattgtttgtttttgagacagggtattgtattgccagggctccagggatttttctgtctccgctcccactcctgaaccagcataatgtgtgctatattttgaatgtgactcatttaaaagaattgtccaaaaggcacatatatgcatataatacaatatgatacgataccatacaatatgatacattttctttctttccttctttcaccatattatagctatatctggttagctcttcctcatagatagatagatagatagatagatagatagatagatagatagatagagatatggaatatatatggagctggagagttagtcaccagtcagcaagcactggctgcttgcacagaggatctaggttaaattcccagttcccacagaatggctcacaaccatctgtaactctagttccaggggatctaatgctctcttctggcctctgttggcaccaggcacacatgtggtacacatacatacatacatataggcaaaacactcatgcatagaaagtaaatctacaatttttaaaaccaattcttttttataagttatttctgtactggtgaaataagccaattcaagccagattaaaactatatatatagatgtagatatagatagatagatagcagagtttgagggcagtctgggttacatcacaagattctgtcttgaaaaaaatatacacacatatatacatatgcatacatatatacacatatgcatatatatatacacacacacacacacaggtttattgggaagctactatgtgggtgagataaggaaggaggccaaggaaatcaacatgggaagggagatgaagaaaaaagggatgtgtgtgtgtgtgagagagagagagaaagagagagagagagagagaaagaaagaaagaaaggaaggaaggaaggaaggaaggaaggaaggaagaaagaaaggaaggagagcagctcagggaacccaaaatgtctggagtatatagggatgagactctaggggaagggcagccccagccctcggcctggaaagttcagggttagggggagggtatgccaggtgggaactgagggatgctgggagaacttagatgccaggtctgctttatgtaagatatgcacctccgtgtggggaattgcaggctggtctccagttgagctgaggtctgaaccttggccaccccctgaagagtgggatagaggaatgcccacccaggaatgagtggaaggtgtataacatccctctcaagcctgactgaccagagaataggtggaactctggcgaggtgtaggccttttcccttccccctcttccccagggccctccttttttagttcccgacacctcagttccttgtccctgggtctgaaactaaacaacttttaaaatattaagacttaattagtttaaagcaaatgtattaagaagtataaaataaccaggtatattgattgctccatacctataattccagctctcgggcagggcgccatttcaagaaaaccatgattctgtcttgaaaaacaactaaatgtattgtcctcatttactttatattgctatggtaaacaccatgaccaaagcaacttgggggagaaaggacttttgttttcattattatttacagtttatagtccctcgggaaggaaagtcaaggcaagacctcaaggctggaatctggaggtaggagccataacagatggtaggacagaacctgcctactagtctgcccttgatagcttgctcagtttgcattttaacacaacccaggaccacctgccaaggtggaggccacaaagagccaggccctcccacatcaatcatcaatcaagaaaattccccacaggcttgcccacagatcaactcagctgagacagtttctaggttgtggttccctcttcccagatgatgttagcctgggtcactttgacagaagccaatcagcggggggggggggggggggtgtttctttttaaactactttactgcttcacactcggcttaaacccattctgctttctccttctcaaaacccgggccttgcatggaaattcattcccaacgttcttcttacttgtaaatttgaaacagagtctggccaacttgccagactgtccttgaactcactctgtagctcaggcagacaccttgaatttggggtgttcatgattcaatttcctatgtcgttgatgttacagacctgcaccacacataatttcagctcagctaaacatgattacattttttttacttcgtgtgaaaggtattttcatcttgtgtgaataagaccttcctctctaaatttcaaaatattcagtaattaattattcatctgaaagggaaatgtctttattgattgaaatttgaaactgaaaccttacaatcttaagcgaaatagttataaatcaactcatttcatcctggaattattgttaggcctcatgaatatatttttcactgctccaaatgatcgtgtttggcaagtggttgttggtttagtttatcatttttattttattattatttcattgtttgtttttgagacagtgtcagttagtccaggttggtctcctgaatttgacacttaatgaagactgctctggggctccggactctcctgcccctaccttccaaatactgggattataggcatatactactaggtcaagtctcaatagtgttttgtttgttcatttcaatttatttattaagtgtgtgcctctgtgtgtgtttgcatgtgtgtctatgtgtatgtgtctatgtccatatgtatgtgactgtgtgtttgtctatgtgtatgtgtgtctttgtgtatgtgtctgtgtgtatatgtgcgtatgtgtttgtgtgtatatatatgtgtgtgtctatgtttatgtgtgtctgtatgtgtgtctttgtgtatgtgtatatgtgtatatgttcgtatgtgcttgcgtgtgtgtttctgtttgtctatgtgtatgtgtgtctgtatgtgtgtctataagtgtgtatctgtgtatgagggtctatgtgtatgtgtgcatgtgtgtgtctatgtctgtgtgttggtttgtgtgtgtatgtgtgtctctatgtgtgtgtgtgtatgtatgtctctatgtgtgtgtgtgtgtgtgtgtgtatgtgtgtgtctgtgtgtgtgtgcgtgcgtgtgtgtcattggacccacactgaggtcagaggacaatttaaaggagtcagttctctctctctatcatgtgggttcctgggactgaactcaggtgcttaagcttggcagcagagtccttacccagtctcccatctcaccagcccctaataatgatcttttagtgctaactaggaggatatatgtgaatcggttacttgttttaaaattaacttttctcctggaggtggtggcacatgcttttgatcccagcactcagaaggcagagacaggcagatctctgaattccaggccagcttgggtctacagagtgagttccaggaaagccagggctacatagtgagaccctgtcttgaacaacaacaacaaaataacttttcatctgtttaacatttttgtgtttttaatgtgtcagacactgcgctaaatgcattactaatcctaattgatttaatctccgttatagccataggaagtaagacgcttgatctaatttctctgttggatccaaagaaattaccagacacagcattctaaggaattgctgtgtttgttctaagaaaaaaaattcaataaaataagagccttgttaatgaaatacagatgtggaaaaataaaggaaatccaagacacaaaatccatcagcttggagttaccgttagatagttcaaagcaatctacaggaaagagatcttctaccctttcatgggtcagagtttagatgtgggctataaatagttgtcagtaatatctgtaagaagtgttgagtcaatggtggtggcccacatctttaatcccaacatttgggtagcagaggcaggcaggatctctgagtttggtaccagtttggtctacagagagaatttcagaatatccaaggctaaacagaaaatatctctctctctctctctctctctctctctctctctctctctctctctctctctcacacacacacacacacacacacacacacacacatacatgcacacccatgtattacctagagtcaaaaggactccatttgagccttggatttccaggttagtaggtcacaggtgggtccttgcacatgaattctaccacttcccaacacactactttgagacagggtctctcctggaatttactctgtagaccaggctgatctcaaactcaagagagtcacctacctgcctttgcctcctgagtgctgggattaaaggtgtaagccatcactacccagctgactgtaggtaatgcttttaaaagtagacatgaaatttatagactactggttaattttttttttttgagactgtggcctggacctcacacactatgttgatcaggctgaccttgaacttacaacagttctcttgcttctgcctcccaactgcagggattagcagatgtgtaccaccatgcttgtctgtctgatcttgataaacatcaacccaagagaagctccaagtaagatagagaaaactcagatgcctgcaggtcactctaaatgagtgtagcgggaagtagctaagtgaaggctgtaagtttttgtctgttgttttgttttgatatagggtcttgggtagccccaactagcccagaattctcagcatagttgaagataaccttgaacactggacttcctacctctacctcccaagttttgggatcacaggtgtgcaccactatctttgccaaatatctagtgtcttgtggttttgagacaggatcttagtagcccaggttggccaggaactaagttgaagccaagggtaaccctgaagccctgacgcccctgcttgcacctctggggctgtgtgattacagggtttatttggtgttagtgatcccacacaggacccctgcagggtgggccagcacttttttttgtttgtttgttttcaagacagagcctcacaatcagctcaagatggcccaaaactcactgtcctcctgtctcagcctcccaagtaccaggattataggcagcatattttattttttcttgttattttattattaatgtgtgtttgtgggcacccatgctaccacatgctctgccatcagacaacgattatgtggagtctattcttcctttatgggggtcctggggctcaaactcagaacttttcagtcatcagtctttcaagagcctttactgaggcgtctcaccatctcctgtaactccactggacaccgttcaacaccctgttgcttgttctgtcactaatagtttcgtatctcaactgtgtgttgcaggtgacacccattctacggaatataagtaccagctaaagaggacacacacttgaagaaaaaggagacaatgaggtcttgtgaatgctctaatttttcaaagcttacttttaatgatggttcttaaacgctttaacctcccttctagtccaccacccaccaaaggtagtgaaaagaaaggtgattaggatacaggcgaagtgaacctgttcagacatggttctttggtgcacaacctagcaggaacatccaggtctcagtggaatcagctcaaatcagcatgaagaattaggaccattaggagttccaggagaagctctcagctctgcctctctggacaaatcgatgatcaggaaagacaaaagcgcgagaagcgttgcagagttagctgtacaagctagcctctctcacggtctgttgagtcctatttatactccctccaaacatcacatgtcctccatgggtcttgcctcaccgtgtgtcttacctcagcacatgaatctgtctcagctgatatcgctctgctaagcgaccaagtcggcagaagaggcaagaagccaccagccatcaccagaaggtttttggtgcatttctctctgtggagtgtcaacaaatgaagatcaactacacaatgtaaggtggaccaagtcatgcgtattgttagcaaagaatccatcatgtatcctttcacatgcttgctttgccaaaacatcctctcatttgtgtatgcttcagtgaagtttcttcccgtatctgccttattgaaacatctcttcacttgtctctgtttcaggaaaacactccttcctgtgtgtgccccagcaaagcacaattcaatgaaactgactttctaaagaaaccaaaagttggggctggagagatggctcagtggttaagagcactgactgctcttcaagatgtcctgagttcaattcccagcaaccacatggtggctcacaacgatccataatgagatccaatgcccccttctggtgtatctgaagacagctacagtgtactcacatacataaaataaataaaatcttgaaaaaagaaaaaagaaagaaagaagctagaagtttccacttgaattttgctgtgttaatgtcattttttaatttttgagactcactatgtagccaaggctggccttggactcttgatcctcctacttctgactccatagtactgatattacaggtttgtgccaccacatctggccatattggtttgattccttatcgattctaaggagacgtcaggcacacaagggtaaactgaccctaaaggctgtctttgaaacagtggagatgtctggactgtaggttccttctggtgctttgcttccttggtatagaaatagccttcgtgttttattttcagtgacagaaaggaagggcgggggtcatttgagcagactgaaccagaccataaccagacttgggtaggatgaggtggaggaggagccccaggaaatagagcaggcgggtgacagctgtgatggacagaaaagtgtgtgttgatcccttaggagccagctcgatgctagaaagtgactctgagggaggggcccagaagtgagaatggagctgggcgtccaactttgctgagagttctgggcccattgataaacattgtgttaaattatcactgttatttttttgagattataacataattatagcattttcccctttcctccttctaaactataccatatatccctccttgctcttcaaaatcatcacattctctttaattattgttatatgcatatctgtagatgtagatattcctaaatacgtaagtaccaactgcccagtctatatcatgtcacttgtatgtatgtttgcagcactggccacttggtactgagtaaccagttggtgagctcttccctggggaagactgtttctcccgctctcctgagttgcctgcacttctttgtgtaaggttgaggcctcctgggacttttttgttgttgttgttgccctccagaggtagaaggtaagtccctattgccgaggatgccatgtgcttcagacacaggccccaaaggcccctgagctggaactggcctgaatgtcctgtccctgaggactggctttcctggccccagaaagggtaaggttgcaagggagggaagcaatcaacgatcctaaccaactaggacacctacaagccacagcaatgaccagcatggcgtgatgatcctaaagatgcaaaagtggatgccattcatgtattggctgtaatcaatgggactctaattggacttaagacctgctgaacaagagggagctcacgactagtaccagacacctagccagctattcaggaatggtgaagaccgttttactaaaccagaataacccctaactactcacagataaggagaagaaactctttagctgtcaccaaggaaactcctctttgcaacaagggaccacaaccaatcaaaatgaagagctcaacattttaaaatttaattgaattttgtgttttcagcatgggtgtgttgattacatttattacgtctgcccatcacatgtgtatctggtgccatcagaggacagaagagggtgtcagatgccccaaaattggaattgtggatggttgtgagatgccctgtgggtgctgggaatggaacccaggtcctcttgaggagcagcgatgccctggatccactgaacatctctccagcccccagggtgaggtgggaatttctggtttctttggaaactcagtcatgtcacgaggtgtttttctggatgctgtctggggagaggctgttttactgaagcatgtgagagcctgtgatgttttgctgtcgtggacacttgagagggtgtgtgatatttggaaagaatgtaatcggaactccacgaacagtgaaaggaggttcttacatttcgatgtgtacaatgcttcactggtcttcgctggtcttcactctgtagagagaaacacaccaaagaacttcctatggtattctggctgattgtggctgcttccatggacttttgtccattcgacagagccttgtggtttgtgctggatcaaaccagcactgctgctttatgtttggtgcttgctattgaattggactgctggtaccctaacaacaatgaatggaattgcccccaaagaactacttctaaacaggtctacaactcccttttcctatagacctccttcttcctctacctctggttggtgggctagaagggaagttgaagaatttaagaaccctaaataaagtagatttagagaaaaacctcagcctacacagagtttaacatttttttagcaacttaatttcttttaatgtgtacaggtattttgcctgctcatatgtctatgcctggtgcccccagaggccagaagaggacatcaggagttaaagacagttgtgacccaccatgtgctatatgacaaacccaggctctctggaagagcagccagtgagtgctcgtgaatgctgagccatctccctagcaatcaaactggagaaatgatggcattgtgccaggttggattaggttaaataaaaatcgtaatcattggctagg

SEQ ID NO: 38 - DNA, 10545 bp, Mus musculus
gatcaggttcaactttaatgtcagcgaacatgctttataaagaagaggggaggcccattccccgtcacgcaaagttcctttgaagttgtcagatcagccttttagtaggaactctcagtttagtaggatcacagttcgcagctaactccggaagatcttggagaaccggttaagcctcaggcaggtagtggcatatcaaaggagatggatgagaagcagcacagcaggtggctccaactcagtggcggatggtctaagccagtctggctaggctggaaggaggttacagaatttgtctacatgctctgggcctcccatacccgaaggtggctgatggtcaggtttcccccccccccccacacacacaccctctgtggtctgaggaatgttaattagcctctcctttctagaggtgttctcttccaggaggggaagggtctggtggaattttccaaagttcctgagctgactcttcaacaccagaccatgtctttaatcccagcacttggagagaaaggcagagagatatctgtgagtttgaatttgaggtcaacctggtctacatattgtgttcaaggtcaaccggagctacataatgagactatgtctcgaaaaaaggaaaagcaaaaccagaaccaaaaacatggtaaaatcaaaaaaagtaagcaaggaaaagccacctggattttccttacaaactttactcctccagggccaggaatatgccatctttgacctctctgtcttcctacttcattacaggctctctgctgctattggcctcctatcacctgatgactggcagactaactgtcacctttaaaggttttgttttctttccatcagattctcctaggaagagttctgaaggcaaggagaaaagatcccatgctagaaccatcattatatgtttcccctctcacaggcaattctccctttatcatatatatatacatatatatatatatatatatatatagagagagagagagagagagagagagagtcttaatgagtctgtgcagcttgaaactgcacataaaagacaaaactgaggactagccggtgataggaattcttttaaactaagatgcctacagagcataactgtaggcaaaataaaaatgacaagtatacctacaataaaacaaaaggtactgtgcgtttcctagtaggagaaaggtgttgttcagcttggtcctttggaaagctaatggcaggcggtaaatgggaccactgcctgccatgctgggccttacgggactgttggcttcatttctttgtcctcttacagtcgcttagcaggcactggtcctccatcactcaggagtacaggctcccaagtttctttgcgccgcagctgaggaccagggttccattctccagtttttcatttcagaatttgtctgtgatgctcacacaatcctctctgacaacactgacaacacccccaccccacccacaaataactccatctccactaccacccccaccccacccccatacatatccagttctatctagaagtgtagtttaaacatggatgggaccaaaacagcaatagcccaaaccagggctcatttgtaatactactggaagcaccacccccccccccccacacacacactttttttaaatgacaaatggtactgtctcctgattacaagctaaatgtcaaatgaagatgtgaacccagccctcaccaccaccaacaagattgaagctctgactgggaatcccaagacatgctggcattccctgcctgctcaccctcccaaagtcagagcacacacagagcgttctctgttcactcagccctgctcccagccttggcctcttcaagagctagggagtttgcttctttagggccatatggaagaatgccaggatgaagtcgaaagaaactctcctcaggggaggaatctccaacctcctactcatttgcatagccacaggagccccaggctcagtcagctctggtttggtgttaatactaaagaactaaccaacccctaaccttctcaaccgggcctctagaccaatactggggtactgaggcaagaatatctggcttcataatcagctttccttctctgactcaaaagaaaggtttggtgatatgttttgtaatgatacagcaggagggggtgccttaaagggtccatgtatgctggggcacacaccccctccccagtaccagccatagtataaaatgaagtttatttgggggcatgagaagaaaggtgagaagggagtatgggaaagaaaggggacagagagggacagaaagagaaagagagaaagatgagaagagacctactaggaacagggaacatggggtggggaggacagagagggaaagggggagagggggggcagggcaaacagtcctttttatagcatgagagccagatacctgctgttgttagataactgttgggcggagcatagaagaaatgctaacacttggtttaagcaatgcctgcacatcaccctgacccatctgttgacccctgtccacagacgctcatctctgaggccctgccatgttgccctcacacagtgctcatattgaaaaactccacccctaagctcacctttggtagcctagtgacaaccactaaaatgcaacacatttccactgctgccaggagtcaagtatattctcccgatgcacatgagatataatgctttataaaagccagcactcaagcttcccactctttttccttccactcttcttgctcagaggcagtatttgtatacctccccacttctcaaaaaacctatcacttgagttctatagcataaagtgatctctttgcagcacatccgccaaggtgcttctgccaataaatcctaacattagtccactcagaaggatatcctggtccctacctgttccctctgataagttatttccctcctgttaaactgaaccaattcaaggcagattgaaacatatataaatacaggtttatttggaagcagcaggcaagttcactgtccccaaggaaggaggccagggaattcatcatggggaaggagagaggggagaggaaagaggggaagagaaagagaaagcatgcatgaagagagaaggaaaagagaggaggaggaaggaggaggaggaggaggaaaaaatgtctaggttatatagcaaagagcctctgggggaagggcagccagcccctgggccataaagtccagggttcagggctatataatagggactgaaggatactgggagaacctggaatccaggtctgctttgatatgtaaaatatgtaaaatacttcctgaagaatgcatgtaaatgaaatccaccaaactaacacagtacccccatccagggctgaggcatccagaccaggatccccagccgcttgtctggtgtctgaaaccaaataccctatgtaagtcacactgggaccctatctcttgtccccagtccacctgcaacagactcattttctagcttaaatgctgggcaccttatccaacactagcaattggtaagttttccctttggttggcatgcatgcttccctgaatctgtggaaatggctgttaagtgtctggcacccctctggtactcttggaggcagaagcccacccccaacaacagcctttaaggctatggttgatgctactcaccaactcccacccctgactatttcccttggatggggctttgtttttagagcatggttttcaccttctggattcattggtaagtccctggccctcagaactatgagctttcaactcctgttcctacttgtgttttcttcactcagtctaccaaagtccttgagatgatgcctcagacttcaggccttggacctccccttctacctctcctatgggaactacatcatcacctgtacctctggtcgtcctttgggatgccttttggagaacctctgacttctacatctagtacctgacttaaggtcctctaaacctatctacctttgcagtcaaatctgatctcaatataccttaagaaatcaatcaaaatgacctcccagtgcaccctacatcctgatattatcagagacctctacagctattgtcagtgatcacgggaatggagagaagttctctatgtccaagctttctcttatttttgctccaagccttccttctgtttttcctgttctcctactcagctccttccagctatgaggtctcaacaagagggcacttccacgactcttgatcctgctaataagtctcctttaccagcctcaacccacagctccttctcctcctacatctcctttggtgtcctcttttccctttccagcattaagttaataagttgctctaaccttcccattctggcacccatcctcaccccaacagcagtcttcaataccccattacttactcctgctccacagtgggacatcccctttatctctccccacctagcctaacctggcttcttttccttttccaggatgttgacagggtggacagcctggtcaaggtacatctctccattcctttaaatgaactccctcaaactgaaaaacaaaaacaaaaacaaacaaacaaaaaaacaaaacaaaaaacaaaaacaaaaaaaccctgggctcttatatctttaactcctctacatttattgaagcattccagtatattactaaattctacagtgtcaccttccaggacatatatgattctaactaaaaaacctacttcctgaagaatgcatgcaaatgaaatccaccaaactaacacagtacccccatccagggctgaggcatccagaccaggatccccagtgagattacagtacctcagggcatattctacctagacatcagtttataacttgcctcctggctagtctctataaggctgccctgaaaccagtaaagtattagaaactccaagatgtcatctaggacaaccataaaaacctgtctcaattcctaaaacaccttgcaaaggccctcttacagtataccaatctagaccctgaaaacctagaaggtaaacaactccttatgacttattttttcccagtttctctgacattagggaccctagttggagaaagggaccctaactccacaagcagaagtctgaactttaaggtataccatgggaaagatgaaaaagtccataaacagaaataccaagtgctagctaaggccattcaaccaactttggcaactatccaggctccctgtctcctaaggatagaaggccactgggtccctgctttagatgtgatcagaaggatcactggacccagacccacaggccatagtggccatatcatgttcaaagtgctattgagagggatactgggctgtagactgccctctcacctgagtccctcatgacatggaaatatcagacccagatcactctccagtcaacctcttgggcctagccatggacaactgaatggacttgggcttccttggcccaaccactgtcatctccaacaaggagctctgagtagtcagtatggtatcagggtgacccagctcttttctcctggacattgggaccatttactgggtcttgatggagtttggaggaacccacccctccttgtttccctattataggggtaaggggcagccttaccagccccaccagaccccaccactcaattgtattttcagaggtgttcctctcacccatttcttcctggtagtgccaacctgttccatccccttattaggaaggaggcttccagccacagtgggaacctctagttccttcactcctccccctatttgcctgaccccaagcttatcagcaagacctctcctccttcctagccacccaacctactggctccaacacatcatttcctgccagcctgccaggtaagtctgggatacccccaagccctctgttgtcaaacacctttccctgtcatcatccaattacaggaccctacctggtttaccaagctcagtatctactcttgctccagagcctcaagggacctgagaatatcatctctgacctctgaagaaaaaactacttcactctacatctttaacactcctatgtatgcagttacaaagcacgtggaacctattgcctggttcaagattgtgtagtggtgagttatgcacagatagcctggtccccagttgagcacaggccttgaagcctggtgacctagtaggtggcttctgcctacgagggactgcagatgtttggccacaccccttgggcccctggctcctgtcacagctacagcctcccacaaccccgcccccccccccccccacacacacagaggtatctggccatcagtcatgtaggagcagcaccaagccctcccacatgcaaataaggtttccccaaagctctcaggccagaccaatgagaagcacctgccgtcaaaccctgacccaccacaaaactgtatataagaattaaagataccagattaaaggtgtgcgagaactactctgtcctccaaaagcttctgtcccaagagctgtgacacttgggaagagatctgttctacctaaatgcccctgaagctccgctgcactcctcactggctagtcggcctctcctcaaccctgcccgacccaactcagtgcagggtggcgtggagtaactgagatggcatggaggagacagaggtggagccaactgcagcagcagaagtgacagaaactacttgccctccctgctcacacttgattccctttgcagaaccctcacactcagccaggccagagatctccatgggaagcctctggtacgcaggcccacacaagatctctggatcatcaattctgcagttgtcccatttacctatcctttcatggctaacccttatacattcctttcccctcaaggcccttccattcctcaggcctggacctcgagggctttcttctctattttctttgacactcagtcacaaaatatatttgcttgtacctagactggccctaatgttccccccccccccacacacacacacacctctacccaactcacctggactgtcctaccccaggagttttgagatagcccatacctatttggccagaccctggcctctgatctgttctctttgtccttccctaaatttaacttatacaataaatagatggcattcttctctgcagtccatccctcaaaattagccaaattgacttttctaaatttcttatccagctggggctatagagtctcaccattttaagatccaactttctacccctcaagtagcctatttggaaccaaccattatcatgacccacacagccattatttggatagaaaacatctaatccaatccctgtcaggcccatctaccaatgaggaaattttatcattcctaggaataactagcttcttatgtccctggatctcctcttacctgtctttgtctgtcccctatatgaggcagcacttggcccctcacatgaacccttcccacacccattaccaagccctttcataagctccaactggccctcctttatcgtggatggcctaggtgctgttgtattttaatgttaattgtgctttggggggtggggtgtctggaacagggaatgagtcacgcactcaggtgacttcttgtgaaccatcccctaatgaataaaggaatcaatcactgggagagtaggcgggacttctgggttagatggaggaagagaggaagcaggaaagagttagggatcttttggacggggatagcgagagggcaagatgtagcgactagtgtctcctggcttatatggcgaatccaccagaatttgccactgggggatttagatttaatatggcttacaagattaggattctagttgttgcacccagcaattgagttaccattgtttctcaactaaatttgtgtggcgttttccttcactgggcagttcaactgggttcaagagagaaaagtacagcatcaaagtgtgggtttgccagatgtgtaccacaaaagctgtgagggctttgaggcatggtgctggtgtggtagcaacttgccagtgggaacttagttcaatgggtggagagattttggagctctgagtgagagagtatccacaagataagaacaggccagccattgcctgccagggcagagagtagctgggtgtaatgtgggaacttgctgttcttttttattatttcccacaacaatccttcaggcccctgccctacacctctcagacctaactggtcccttctctgactatgtagcagaaagagagagatataggctaccagctgggaacttcctttgcacctgtggcatacctgtccaaaaagttaaaccttgtcacccagggatagacaccctgcatacacgcttcagcagctgctgagcttctcgtttctgaattcaaaaaaccttagaggaaccactgtcccacccctcacacatacaggagggcacattacctcaggccatctatccctagtacacagataacagttcctttctacaccagggggcctggaaagcaggtgatgccatagtgccagataccaaagtggttgagaaataggccctcccggcccacaccactaattagcagtctgaactaatagctctcacccatgccttcagatttgcacaaggacaatccctaaatgtccacacagactccaaatatgccttccacatcctcctatcacacactgccatctggaaagaacatgtactacttataacaaaaggaggaacaataaccaactcagaccaaatcatggccttgctaaaaaaaaaaaaaaaaaaaaaaaaaaaaaaaaaaaaaaaccttccatcttccaacaactataggaactgtccaccacaggtcccaccacactgacagttccaccatttcaaagagaaataactgagccaaagaggtagctagagatgtggcccttggatgcccagatctgtctcatgcaccacaggtcagccttacatacaactcacatgctgtcctagttgcaccagcttttttcattctaacagctaggccttgtctcactttgttaaggcccatctgcagcccacccttgaggatttgcgtttttaagggcttttgctatctcttgtaaaatcagtcaagtgtcagacccccaactccagttattgaagccccccttctcctactcactaggctaaaagctctctccctagaactgactagatgttcaactttatgcacatgtccacagtcaaacacatttagatacctcctggtctttgtggacaacttctcagggaaggtagaggcatttcccaccaccaacaaaagggctcattctccgacttcctcctcctggagttcattccccatttggaatccccatctccctctagacagacaatagtcctgagttcacctcccaaataccccaaatcctattcaaagccctcagacagacaggcaggcagactaaaagtaaaataatgttttaaaaaatgatacctgagctgggtgtggtagcacacatctttagtctcaatactcaggaggcagaagtagaggaatccctgattttgaggccagcctggtctacagagcaagcccaggacagagagagctacacagagaaacccggcgctctgtctctctgtctctgtctctctctgtgtgtgtgtgtgtgtgtgtgtgtgtgtgtgtgtgtgtgtgtgtgtaatagccttaacctagctatgcctgggtctcacatagaacctgttaaaatgcagttgaggtattggtgaaaacatcaataccttttaaaaacaaaagaacctccaggtgactaatttacagcaaggcctgggaatattttctggaaactctcatgggccccaagtgaaagtacagtagtgagcaacctacatcgcccaccaaaatagacagtcacattctgatggctttacctctccctgtcctgcttcctcagagaactgatgggacggccaggcaaagtccaacagccaaaggggtgagaacctgccagctttccaccagtctccaatggctccattctgtgctcagtagtgaagcctggagccagtgactccaggtgtatcaggaagatccagctgggactcttgtcctgcagtgaatttgcatttaagccttgccgtctgtcccctcttgtactcaatccttccttgggcagttcacagtgaatttgtttatcttcccagaagataacgtcgcaggaaggttaccaaatgaccttttatcccaccggctgggactagcggtaagcacatctgccctcaagatgctcagcttccatgggagatccctcggagtttcctgctttgtctgtgtcacccgcctgtggcagcccctcctccaccagcttgctatcccacctgctacgtttgcttcctgcttcctgcggtggaagtttaacttctcacacacccaaactggtcctagagctgtcccttttcctcagcatcttgcccttcactaatgccaagcgcggcagttgggccttttagaaatgcaggaactatttgtgttctgtgtctagcagacactttccacacaggcatcctagctgcagctgcagctcatctccctc

SEQ ID NO: 39 - DNA, 9565 bp, Mus musculus
aattaaaatataattccatgagaaatcagcattcaaatgtaaggaactcttcttctaactttccccaacagacatgaacaaatgctattcaccccaaatatggcactaaggacggacccctagaactagtgttacagaggtttcgagccaccaaaatcaaggctaaggttgcttgcaggatcacaagcaacttaaaagcttcccctctgagcactggttaactgcatctgtatcccgggaagggagtgatggtgcctttatggtacgggtcctgagtaccctcccaccttgaaagagtgttagtaggttcaagcttgcaagggtttctgggtttctaatatgtaatcacagtagctctgggttcaagacagctatgtccatactctgcccagaggaaaaagctccacaactccacactcatgttcaaagctttagctttcaaagtgaccacacaaatacagaatggtcccagcatcctggaacagtttggagagtagcctacggacaccaggtccaacacttaggaaaagggtgagcccgtgagtgtattcttcacggctacccctgcagctggagggctctactgtgtaggtttgaatttaacctatcccttctttggatgtaattaaccaaactcaaagcaagagaggacacacccgtcaccatttctacctgtttctaaggggtgagtaaaaagtcctccacccactccctgtgggttaccaatcagccacaagtaagagagtgttattataaccctaaccctgaccccagtgtgtgtgaaccctggcaattccatgaagagttaaatagagccagtcgctgaaggtcacatggtgtgtgatttaaaaaaaaaatgtccagaagaggcaaagctaccaagacagaatgtagattttggctgcaaggaacaactgagaaagtagtgatgtcccctgtgtggcaggtggcagttctaggcctgagagcaggtgagccatacaccaagtgtctcttcagcctccagacgacgatggcagaggttcattgggggaaacacaggaaaatatcgctgacccagatcaggtgcccaacagattgaactgtgtggcttttattcttcaagagtcactgcaagcgctggaaagatgacttagctcttaagagcacttgctgcacccacatggtggttcacaagcttctgtaactaggggatctaaggccctcctctggcctccatggtaaacatacacagaggcaaaaagtcattgcacaccacttatgtgctatgcagttacaggccccaagaatacagcagtgacccaattagaagggcctccagttttcctcgaggtcacatctttatggaaaggcaaggctgaatgcatgacttgcctagtaggctacaaagtttcgagtgcactgaggacacagagtgggtgaggacttggcccaggaaaagtttaggatataactcttaggacttcacatgtcagaaggcatctttccccagcaatagctgatggatagttgagctgggaatagaattctagtgtgtggagacaaatttttcattcagagctagagtgttggccagcattgtttttctttcaggggagctgagaagtccaagggagattccactgcctcaggttttgtgtgacttgctttttctcttggaaaagcgtagaatcttccgcctgaggtgtttccatgttttcctgagcgtgtgtcctagagtgggtatctctttccatctgcagaggaaactttaacttttggcaattttcttaaaacacactattggtggtcttccactttatgttctccatccttgaattttgcaacttgagggttgaggtactttcctgtcctcgtataggacatgcatatgccagatgtctgtcgccccttggctgactctcagattcagggctggttgtgtccatatttgagctccatcactgggtggtggatcctgaatgctgtcatcttgaggaactcatttggtctcccaggggatcttccagagagccactggaggagtctggctgtctctgcagctctggagaataaaccttgggatttttgctaacagaagagaaagacagttagttgctccatggggaagtgaaggggagctagggatttatatgctcatagcatactgccagtctaaattgctgattatagcaactcccacactcctcccaggaacatttttattaatcctgagtttagggtgctctatcctccagcccagggcaatttttctcttgctctctgtgttctctaggacttatatagacttcagctgtgattccagacccagctagttcctgtaggagggagtcacagccctgatactccagccccaacacaggcaagggaaggagcaggcacatctgtgaatatgaaacactgaagtgagatgtaacccaacggcacagagggatgtaacccaaaggcatggagggaaggtaacttctttgccctgtaccccaaatcttcttcaccctcattctggtgaaacagctctcagaggtccctgagtgatcctccccataaccacacccccccccccggaagttcttgcatctgggtctagaggacagagcccctccaggaccttgtggtgactgtctactccggtcttccagcctcctgcttcctgggcattctgaggagggcaggagacctcaagggaggagcctgggacaggggagtctcccagaccttcctcttgtcataataccctccttctgctttaactcatgctcagtcactacaggttttcatgtaggtcagggaacagtgctctcccagcaagcttctggcgtcttctgtcctacatgggaccctcatggatgaattcagcagctctggaagctgaagcagccttttcctgcagaggaaaagaaggatgataaagctgaagcaggcccctcctgagaccctcctgggtagagtctgggtcactctgaggctcactgtgattccagccaggtgtggtagggacactgtggttgggttgggggctatcttctctgtagcctctatccaaataaccctgtgatcccacacagtcacctgttgggtcatgctggactccctgcaaatgagccatggcagaaacagctgccctaggctccaaggcttttataggtttgccttaaagattttattccagaaaaaacccaaagcaattaattcaaattacagagtagtcgtttgcgataatatttgctttaaatatatggttttttcttaaaaaaaaaaaaaaacccctcagctgtgggccttgagtgagttcgaggtgaaggacaccttgaaataattacatttttgctcattttatgttgtgaaaacggcttagtcaatttgggaagaacgtaaagtgttcagctgactcccctataaaggctgtgctatttctcttcccgtctctgccagcgtgaccacactgggatcgttcgccctttcgcctcaaaggtggatgtcttccaaaaggcgcccaggcactggcccagctgcctctccgtgcagttcttggcagcagtgaggagcaaggcctcttctggaggtccacctgatgggtggcttcgggaagcctggagaacaggctctgtgtccgggagtccttgtgctgacccacagctggccaaccgttccagtggaggtgtgagggaataggggatccccctactcagtttgccccaagaatggtgataggggcttgaccagagaatgagtgtagctcagagcagggcagcgggcccagctaggattgtagccagtatgtgcctctggagagaggctcggagcctggaaagtgggatttcattaagacgaaactgtgttgaacagcatcagaatgtgggtctgctcagactgaggagcctgagtgatgctctcacagattatcaaggatcctaggcaggaccctcccctcccctctaccacaccaggcgcatgcgtggagtataggtaagttctctttgcgtaccgcttgccctttctctcaattgtttttggtattctgtggaattaaaatttttctttctattgttcgtatttaacatgtgtacatgtgggtgtgcacatgtcatgcgctcgagcagaagccggaagacagtttctaagagcttattctttccttctaccgcgtgggtcctggggattgtcatcacaccagcctggtcctggggaagttaatccaggtctcacaagtgctaagcaattactccaccatggaacttcaccctggcccatctttacattttctcatgtctttttaaaacaattaaaagagggtctcatgtagcccatgatagccttgaacctgctgtgtttgtaactgaagataactcacttccttgtgtttaggatcacaagtacacacaccccctccaggatttattcagtgctgcaggcagacccagagtttcccatcttctggacctgtaccaaccaagccacccctgctccgcaccgactcccccacccccgtggttttttttttttttaaggaatccacattttaatcacgccctacatttttttcacttacaaattgtttgcatttctgttacactttaaaaaatccttgcctaacacaaagccaaaacttcctactatgtttttctctaaaaatcttatgtatttatgtttagactgaaatatacatcaatggccccagctactcaagaggcaagggggtcacatgcacccggaagttgggggcaagttaggacagcacagcagaaagcccatctttaagacaaagttaaggggccggagcaatggctcagtggttaagaacactggctgctcttgatagaggtcctgaggtcctgggttcaattctcagcacccacatcgggtggttgtgtaccaactgcaaactccaggtccagggatctgatgagctctctgggttcttttgtacacagggtgcacactcatataaacacacaaacgtagtcataaacaagatctttccaaaatggaaaacttacggggctagtatttatgtgttgaaggtgctatttatttattaaatatgtgtgaaggttttgcctgctttgcatgtgtatgtaccccatgcccttccaggtcagaagaagacatcagatcccctggttggcctgcagcttgtagaccaggctagcctcatactcatggctatacacctgcccctgcccctgcccctgcccctgcccctgcccctgcccctgcccctgcccctgcctctgcctctgcttccagagtgctgggattaaaattatcccagctgtaccatgctttgaaatatagcatgtctttccaattctgtggggttttgtttaggctactgtgctggctagttttatgtcagcttgacacaagctagagtcatcaaaaggaaggaacctcagctgaggaaatgcctccataagatctgctgtagggcattttcttaattagtgatgggtcggggaggccccagctaattgtaggcggggccattcccacttacagttgtcctgagttttataagaaagcaggctgagggctggagagatggctcagcggtgaagagcactaactgctcttccagaggtcctgagttcaattcccagcaaccagatgatggctcacaaccacctgtaatgagatctgccaccctcttctggtgtgtctgaagtcagctacagtgtacttatgcataataataactaattctttgggcctgagcaagcggagttgacctgactggagtgagcaaaggtcctaaaattctatttccaacaaccacatgagggctcaaaatcatctgtacagctacattgtacttacatacataaaataaataaatcttaaaaaaatgataaaggcctgtgcctttaacaccagttaagagttcaaagccagttaagcctatataagcaagaccttgtctcaaaatccctaaaagaaacaaagagcctatttatgtagatgaaatgtgacctgtgcaaaaattctaaataatgacaaacattattgtcatcatggtcatcatcatcatgaggtcagtactaatctatataaaaggtcaacacatgaacacccagcacacaagtacataacacatatacatacaacacaagtatacataacatacatgtacccacaacacatactcagaacatatgatcagaatacatatacacatagcatacagtatacacacaacatgtatgcagagaatataatatgtacatacaatatacatagctgtttgtataacttccatatacaaacacacatatatacacatatacacacatatatatacacacatatatacacacatgtatacatacatacacaaaacatatatatatatatacacacacacacacacacatgtacatacacacatacaacacataccatgcacatagcacaggacatacattgaataagcccatagaaatcatgtatgtgtgtgtgtgtgtgaatgtgtgtgtgtgtaatgatacatacacataatatatacacatattccatagaatggctgcccaaggcagaggaggaatggaagaatgggatcatgaaaaatgacagaggcaggtgctgaggagtggcagccatatccatgagtgaggaactcaggtagctggactccttagttttctaacgggggtgggggcacagggggcagacacaacacctcaggcttggctggaagcgctcaattacccagcattaccatctgtctctgtgtctctttctcctcctgtgtgccttttgcctcccaaaatctggcattcctggagtcctgaaaggctgaaaggaggagggcatgtcctccctccccgtgaccaccccatgggtcgctcctgggccacagatcctgttaacttgcccaatgcacttgaccagtgtctgggtggtctgctacattgactcctccggaaacctgatgccctccagccagtgcatctgtctggtagatttccagtgggaggggcagggctacctccccgaagcacagagcctgacagccacaccacagcattcccaggctgcagcagggggatgccccctccagtctcagggtttaggagcagaaggaccagctggtcccagctgcagctcagcgggacagagaccatgagaagatattccccccaccccgtcctctctacctccctattccagtcctgtcttaccctcgtgctggaacccacaccagccacttcagcttcctccaaggtatgctgagggggactctagattcccgaagtggcttccacagctgaaggaaggagctggagctgaaacttgcctcctgctggccaccagtgtgctctttcattctcatgtgcccaccctgtcatctgtctctaagctgacttcttcctctcaacaagattttcacactgtctgtgttttccacacgaggagcttgcccttaccaaggtcacagagctgagctctgaaacttgactggtttgctgtcttggcacatggatcttagatgctgtctgtggtagtctgaggcatatgaagaaggggaacttctctgtggcagtgaggagacacagggagatgggtcaggggctcggaacaaggtcacctgaaggatgctgagtttgagggtgtcaaccagctctaattatgtcattcctgcttctcctgcccaacttagttgtcaggacctggggaaggatgccatgtctgagtgttcttggaaggaaatgaaagtgtaatctcttaagaggctgaaaccaccgctctgagacaatgtttttaatgggacaaccattttacttagctcaattcattgagaagggtgaatccaaaagacaaaatggagtcaagaccttttgggcagccaggagactaaggactttgccatggacatccactgtagatcctcactggaggaaaccaggagtctaaggatcttcactgtggacacccattgtacatattcactaactcctgagacaagaatcttagacatgttcacttcgtcctgttcatggaaagggacagctcagagtgtggagaacacagatctggaattcacagacgctggaaagggcctgccagataagtggtctctgagggacatctagaaagttctctttcaacctccttccttccttccttccttcctctttcttccttccttccttcttttcttccttccttttctctctctctctttctttaaaatattgtttatttaatgtatatgagtacactgtagctatcttcagacacaccaaaagagggcgtcagatcacattacagatggttgtgagccaccatgtggttgcctggaattgaactcaggacctctagaagaacagtcagtgctcttaactactgtgtccatttcaaagctaaagtttctactgacaggcttcaataacccttatcctccccatgtgacatctctcagtggggccattgattcaagtgagcctgttgtcaccgccctggctagactctgagcgaacaagggctgtgtttctctccctgacatgctcaggctagcacaggatggtgataatgatgggtggccatgtctccaatcccactgcagcatccattgactctggtctgagtggagggaggcactgctgttgcctctggatctccaaggaagaagccgaagctcttcacagtggtgatacttgagcagctgggagttgaggggagatctcactaccctcaggtccctcctgcaggccacttaagtgaaagaccagcaccagaagatgtcacacagggggcaaccctgcagcagcagcaggacactgtgatggaatggcttcaggtacctgagctgaggctagacctggggagagctgacagtttcccagcttagggtatccagtgagacaaacacactggtggttccttgctgccctgtgacaggactcaggcttctcataagatttataggaggaatggttggctaggggtgggcggcctcaatggagcaccacgaagggccattcagctggggtttgcatcagccgcttttctggttgctgtgattggaaatgacttactttggctcatgattcgagggtgttatccattccataaaggaagcacggaagtgcgagacgtgcggctgtggcatcaggaacagagggctgcttgttcatatctcagcggatcagggagcagagaaagcagacaaattccagagcttgtctggctctcctcgggaccacagttcacaggtgggtcttcccccacccttaatcctctccaaaaagcttcagtctcctaggtgattcccaaatgtaggcaaacagacaatgaggatcagccatcagccactcgtctcaggtccaaggccagttccaccatcttggtgtgtttcctgtgactggagtagaaatcccaagactgagtgaccgtggacatagaggctcgtttggcttccggttttggcagctgggactctgagaactggtccagcttctggcaagcagccatgctgctccgacctctggcaggaggcagggtaagtagagcttgcagaggagacggaccaggggactggcagcctctcccggcagctgccctcact

SEQ ID NO: 40 - DNA, 8635 bp, Mus musculus
gaaaaaaataactttatttaagtatgaagtgaggctagcatagttgcacaagcctttaatcccagcacttgagaggcaggcaggcagatctctgtgagtgtgaggccagcctggtctacagaatgagttccaggacagcctgggctgttaaacagacaaatcctatctcagaaaaagtagcctctgccctttgtttgtttgtttattgagaacttggggtaatctttccacgtagagtttactatacagggaagtgaagccccgtcctggtcattagcagtaacctgggaaataggaccctgtttgttcgtattagaatgtatttcatggtacccagcactcagtagttgcttgacaaatacttgttaactaagaaacttccaagtttcatctctggcagcttgattctttttctgtccccttccttcagattctaccagccaggaggtattatctgaattgagggcattatctaagaaactcagtaaggaaaaccatctatctaagaaacaaaaaaagagtccagcaaaggctgttgacctggtctgggaagaggaacctgccccagaggaagatgagcctctcttgctgcagaggccagagagaatgcgaactctggaggaactagaagagctaggtaaagaggacagccttccaaataaggagcgccctagaccttcagtagaaggggagcaggtgaggaggaacccacagaatcactccaaggggaagaacaagaaggaacaaatgatcagtctacagaacctcctgactacaagaactccctctgtgacgtcactggcgcttccgacaacagtagaggagttggtgagcaagagccagatctttggcttgtggtggggtagttgacagttgaacagaacgggtccttcttacacacagcacagtcagtacatgttggttttgctggaatgtttttcaggagttaagaggtacagatgaccatggcaccatgctgggcccaagtgtagatatgtggacacagctgagccacacgtgctgcctaaatcctgagccactaaagttctttggggtgactctaaacctgccttcaaaggagaaggcagtcactgaatgctctggttggattccaggcacaacaattcaaagatcagtgattgatctgccaaagctcccttcactaaattccagcacccagtgctcagcactccaccccaactccaaatcaagtaattaaaacgagtacctaggaagacaaggcaccctgtctgcttgggtatttaagctgcggcaagtccacattctggccaggaccttggagttcttgttactgacaccggccatcatttctgtgaccctaaaacttcttgttgaaagtttcaaattgtgtcatgatgacgagctgaggatgtttaccctagaaagaaagaaaaggaaattggagtatgattggctgattggttcctattgagaattgatcatcctttccacacttacccctagggggcgctaagatgtcataacccaggtttctgtcttgtcatgaagtactcttgaagacaagttaaagttcttgctctcatttcttcccaggaagatgaaggggcaagagaccaaaagcaaatgataaaggaagcttttgctggggatgatgtcatcaaagagttcctaaaagagaagagagaagctatccaggccaataagccaaaggctgtggatctgaccttacctggctggggagagtggggcgggatgaacctgaagcccagcgccaggaaaagacgccggtaagagaacaaaaaaaacctgtcagaagagcacagttccccgctctccccgaagtatatcccctaagcttttgactaaaatactccctttactatttggtttccaggtttcttattaaagcccctgaggggcctccaagaaaagataagaatttgcccaatgtgattatcagtgagaagcgaaacatccatgcggcagctcaccaggtgagggttagagtctctccactgtctaagctccaccgccagctctccttgcttgagagaactattttagcatcagtggtgagagggatgtgtgatacttgccttttttggtttgtttactttgtttttttttttttaattttttttttcttttttctttttttgagacagtgtaaccccaggctggccttggactccaaatcctctgtgctggctctgacccatacttccagtccctaatttcagcaccccttaaaaactatgtgtcaccatacctggccggcatgtctgatgatcaccaacagatcaaatttgactttttcactgcctggccgttagaagcgaagccaggcaggctgtgctattctaactcctgaccagggttagtctgaaaggaaaatctttgcaagcagtaacaaaacccccaagtcacaatttcggttgacatccccagattattgagtcttgtcaaagtaaaaactcaccattctgcagcaggcttgtatttgtagtcaagggaacaagcgatagcaaaccagtgttcaaaaaagaaagtattctaagtggagtcacttgttaataagcaagggatgagctttgtgtggtgacacccacctttaatcccaacagagtcaggtggacttctgatctacaaagtgagttagttctaggacagccagagctacatagtgaggccctgtctcaaaaaaagttatactactaataagcaagggatgtttgcactacagccggaaactagacagtgattgtgattccctagatatcacaagcaatatggaacactcttgggtacagtcacataaagtggaaaggttagaaaataggcagaagatccagagagaaattgggatgctctaggactgagcatgtgacccaaatgacattgaactccatagcctgtgtgttcccgtcagtccttattatgtttgcccctcgtgagtacaatattgaaatgtattatacttgcccatgtaaaagaggaatgaactatgtaatgggtacagagcagagatgagtgcattggctagaatacttgcctagcatgcacaaggctctgggctcagttactagcactgtgtaaagctcaacatgaccacacctcagcactctagaggtggaaataagaagatcagaagttcaaggttggctacaaagtcagttggaggctagcctgagatacatgagaccctctctccaaaaaattgtaagataaccattcagtcgtattgtttgatcttagcagaaactgtcatcactataatcccagctgagaatgtataacgagacaactgggtagggaaggaatcccctgtgaggactgctgcaatggccacgcaggatagtgttattttaatctgcaggggcccacattggaggaggagactgtcccaatgggacagctaaaaggaagaatcaggcatcctttctagagctcatcccatggtcatttactgttgtcacagcaaattgtgacttgatttccaggaatctcttgcttttgatttgtttgttgtttgttttagaggggaatcttgtgtctaatgtactcaggctttgaatttactatatacctaaacatggccttgaacatctgttcttcctgactcttccccagttcttcttttttttttaagatttattcattgttatatctaagtacactgtagctgtcttcacacacaccagaagaaggcatcagagctccccacggatggttatgagtcaccatgtggttgctgagatttgaactcaggaccttcggaagagcagtcagtgctctcaaccactgagccatctctccagcccctcttcccaagttcttgaattaagtgatccccaacatccccaacgttctttttaattaattagctcagctcagcgcttctcagccttcctaatgcttgtgactctttaatacagttcctcatgttgtggtgacctccagctataaaattattttcgttgctgattcatagctgtgattttgctaatgttatgaatcataatgtaaagatgcgatatgcaggatatctgttatgtgacccatggcaaagtgttcttcaaccccaaccactgaattatctaggtactgtaggagcaatagaatgaagtattacgagacaggggaggactcctgaaactgaacttatctttcaacccatcagtaacatatacagaaagaacatcggcccaaacaaaagatttccttagcctaaagggaaaggaagcctttttctttcagtactggggttggggaagtcttcctagaaggtaagtactctgctggaacggaactcaagacaagggccaggagtgcaagggttctattctctcacactactcttactttatttggagaaatcacttcccctttctagatgcctgttagtgctaagggggtattatctgcctggggcaaccagctctgcatcctctaatgccttaagaggatggagctgagcacaggcacctggaagcattcaggattcagattttgtttgtttgtttgtttttcgagacagggtttctcgtgtagccctggctgtcctggaactcactctgtagaccaggctggcctcgaaatcagaaatcggcctgcctctgcctcccaagtgctgggattaaaggtgtgcatccccatgcccagcaggattcagatttaaaacatcaaccataaaaaggagttgagtcgagcatgatggtacacgcctttaatctcagcagtcaagaagcaaaggtagaggaaagtagatctctagagttcaggccagccagggctccatagtgacactctgtctccaaaaagaaaaaggaaggaagaaaggagaaaatagatagcattaagagaaggatcggaatccataaggatgcacaactattccggggcttcttgcagtcacaagtgttgtatagaagcacccagtggttaacagccttgaaactggtgtggccagacagaagtgctcttttgggttttcagtcccaaaaccgtttgctaagcttgagagaataggtaccaaataacttcgaacagtttacactcctaagattgtatgagaacagttggctgttttggactcttaaaaagcttacccctctatggttgtcatataaaactgaactacttggtacaggctggccttaaacttgtgatcctcatgtctcagccatgcaaatgctgagatagcaagcatgagccactgtgccttctctaagctgcctttagagtattgcaccctaggccttacactgaatctcttctttccctgccaggtgcgggtccttccatatccgttcacccaccatcagcaatttgaaaggaccatccagaatcctataggatccacatggaacacccagagagcattccaaaagctgactgctcccaaggtcgttaccaagccaggccatattatcaaacccataacagcagaggatgtggattgccgatcttccccaaggtctgacgtgcctgtcatgcagagcaatccaaaacaacactccaaacatcaaaaacaacggaagaaaagctctataggttgaaatatctgaggagtgtcctctgcatggtctatgctgcaagatgaattccaaaactggtttaacactgtgtgtgtagttaagccatatctgagaaataaaggcatttttttttacctttataactcgactaccttctgtattatctatttccctgttgaatcttcaggggaacttcctttcattaccaagacttgttagctggtcatgaaaactaaggaaattatcccaagtctctagtttcacatatatcacccatcaatcatgatccagtgtgaataccaacttataatcaggggttgagaaagtactgtgtggtttaacctctgaatctagaagcatggacaaaccacagctggatcctacccttgattgatcatagaaccaagctgaagggagatctaaccccgaggagttgtaacttagctttttgcatctgtgtgctttccagcttgttcaggttgctgtacacagtgtcatttggagatgtagctcagaggggaatttggtttcctctgagaaataaacattctatcctacaggaagttccccaaacattaaggcaacaacacagaaaagcttcaggaactccctaaaactgatttcagcccttcagcacaccctccccatcccccagccagagcaaatgataaaagctgagagtccacagatggagagagacaagctgcaaagactaacttaagctagatgatcagctgcctggaagaggtttagacccaccaaggcccctggaagggactctctccagcatgttgagctgctttctggcagtgcagtgtgctccaggtccccagcattgtgagctgtcacccacccgtgctttggtaggctttggtaatacagctgggtttcagtcattttgctcctgtacacaagcccaataaaactcattggttcaccaagttgaactttggtggtatctgtacttgggtctctcttgggcttcctgtctggggtgagcagacttgtgtctccccagaaaggattttttcttacatgacaagtgtaccagcctatatacctacaaggcccaggtttgatccccccccccccccagcaacccctaaaagtagagccatggaggcatgtcgacagaaagctgaaagagcagtatcggttttttgtatgtcttcatagtaacaagacaggctttttcctcactttacagggacacgtatgcaatctcagaagtaaacgtgtttcctttctaactcacccagccagttcctcaccagggattcaagcaggattcagccatatggtcattaacgcggacttttgtatccatgggtggcaggctggtggtgtaatgcagtggcagcattagtgcttagcatgcccaaggccctaaaccacgctgcacctcgtgttctctaggggagactcacccctcagaaccttatcacaagatccaaactcagaatatgctggaaggtgtgaacccctctgagacacactatgctacggttgcagctttagacctttagatcaccggtcctattgctaccatggttttgggtctttacaaccccccacccacccacccattccatctggacctctgtcaggcatgctactactctccaaatgaattccaaaatggttagacctccagctgcctacctaccaataccttgatttccatacgataagatttcagagaatgtgataagtcccatgttacatggtgaatcaggaactagaaccttaggctaacttggaagtcaaaagtcatacaattttttttctcccagaatttctgagtggtaactgtgtgtgctcttaccaatagtcctcaggaagtacctgggactggctgtcaagggaaataaatataatgagtagtgttcaatgcccaaaggacattttttaacttatgcactggcttgagattgtccataatccgctccgctagctgtcacttaaatcggtagccagtgaaggggaatgaggaacctctacctcctcctgcctccatttaagatacctcaacattctttcactcttaagcacaaagctgccatctctgtgcaaaccagttcccaaatcgaagcaccaataagtggacaattccgggtctactttctcgggacccttctgcgcgatgtttgcgccatacaacactaaagtgatgcaagccaccccatccttcgaaggcgagggcagacgctggaacatgacataaacgacgcccactccccgttttccaagcccccaaacggattcaattgttgtttcgtggggctcttttttttttttttttccttttcttcctccgaacctccgaagtgttcttccttcctattggccaaagctgccccttgacgccaccccggctttgcttactgattggtcggctctggatgtgcccaagcctttttcccagggtgtggcgcccccctcccgcccccaacagggttctgacccctggctcctcccttcccccaaccccccctcccgttccgaatggtaccgccctggctcggctcccccatggcccggccgctgcccttagggcccccggacggggcggggcacattggggacgggcagaaggcggtggtggcgccttcctgccgagcccgaagccacccccgccacccttctacaaccctcttaggttccactttcccttgagcagttttcgccctccttagtagccctgtcccgtctgttgcagcccccactggtcttttggtcatcccaaagggcagctttcaatcccagccctccgcgcttgatacacgcccatcagcctccacccttgggttctcgaaaggctttctccccgagtctgtacacccttcccctccgggtccctctttctagcggactgtccatccatccccgggacctccctccctgtgtgtggccgttcctcccagcggcctccacttcacggtgtcccctccccttcgtggccagcgtggtggagcactcctgccccccccctttctctgtacccccgcgctctcttatgctgtcccttcacgtcccactctaagtccctcccacgccattccccccacacacacactcacacacccctccctgcgagtcgtcccctggcgcccctc

SEQ ID NO: 41 - DNA, 20824 bp, Mus musculus
aagtctgactgtgaggtcaggcttttaccgtgttttctcgcctctattctctcctgcgagcaagggctggttttagctcctcttgtttcgcaaagttagtgttcagaccgccagctgactcctgggaagaagcattaatggtgtgtgtgtgtgggggggtggggggtgggggggggtagtaagaattaagtgagaaaaagtttacgggctgtttggtatttattgaaagaaaactcgggatacctagcgctctttaggcggagagtccttcatctccatctccataccgcagctgacttctagagcgtggcaggtccttggcatactcgtgtgccgacgggttggcaggcatcgggctgcttgtcgcctctactgccacttggattcctttcaaacggatctaagagggtttaagaccatttaaaggaagcacactagtatcacgtctgcagactactcatcaaaacttagccctggctgtaggggacgaggatcgagaaacctcttttcttgagtcatatgcatgcgtacatgtgtgcttgtgtgtgccgcgggtgtgtgtgtggggggggggggggttgcgcgcgtgcgcgcctgggtacgtgtttgtgctcgcgtaatgtgtatttttgcctgtgcctgtggtgggcggggtggaagaatgggcgtggccatgccaaccctgaacctctgataattattagacttaagcttaagcaaaaataatttatttcaagtggaagagttttgagaaagcctgttttagattcaaccaattcagtgacgattatatatatatatatatataatcgtcacagaggtcatgaaaaacttaggcccaagctttcacacctttaatccaaagagacaaagccaagcagatttcattgttcaagaccagcttggaacagagcaagttccaaatagagaaaagtttaaatccagtcatggtagaacatgcctttaatgccagcattaatgatacagagccacacatatctctgagttcaaggtcaatattcagagcaagttccaggacagctaagcttaggctgggaaggagttggaaaacataaagttggtaatagaataagaaggggccacattccagcctcagcaagtagcagaactcaggtgctccggctatgtggctggctttagagtcaagaatagaaggcaccactaggacaattgatgctggctagctggagctaagaaattagcagtgattacgaagagatcaataccacagaggtgaaatcgtctgggagttgttttctgaaggcaaaagaagctgtgtttccgagatacccaagtttgtaccctgtactgcagctgtacttggtaatgtataagtgtcacccaagtggtagtggttttgaaggtatgaaggggtcatgaagagcagctgtgagaggccagggaagaccattggtgaaagtgcagcctcagttgttgatgggttaggactgaagaggttatgcaaaggatttgaggcgtggcaccatgaagagagcctatgagaggtgaaacttagttgcagctgaaggcccctaacatattggagatgccagtaccatagaatgatcaccaagaacaacagcaacagtggagtggagtcaatctgctacagagaatgctacagagggcagagctggagaagtgacacaagccctttggaagagcccagaagatcatgtgtggatcctagatactggaacaagaagcggtaatgtttaagttgccttggagactccaagatgttcaaaaatgccagagccatgggttatctgctgaggaaagctgctaacagggagtggaaccaacccaggagaaagaaatttgttgcagtcaacaaagatgtagaaggagttagagatttggctttttgacatcagactaggagatgcaggctttggagtttgccctgctggtttccagtcttgctttgggggttacagttaagtgagtggatgaatctcagaagagactttgaactttggacttttaacattcttgagactgctgttgactgtggggactttggaatgtggactaaaagcactcttttattatgctatgtctaggtgtggcccccatagactcctttgtttaaataagcctatgggagccagggagctgactgtattgttttgtatattcttgaccctgggagtggccatagtgggagccctgggagtggccatagtgggaggtgtggccttgttggagtaggtgtgtcactgtgggcttttgcttaaagaccctcattctatcttcctccaggaatttcctccagtattttcatagcaaccttcagatgaaagtgtagaactctcagctcctcctgcatcatgactgcctggggctgccatgttcctgccttgatgataatggactgaacctctaaacctgtaagtcagccacagttaaatgttgtcctttataagagtcaccttggtcatggtgtctgttcacagccataaaaccctaagacatcaatattagattttctaggctgtattgtttcccatgtcttttttttctttttttctccccatctcagactacaaatcagtacacatcaggccttctatagtgtttttttgtgtgtgtatgtatgtttcctacgccaatgattggtttggtttggtttggtttggttttttgagacagggtttctctgtgtagccctggctgtcctggaactcactctgtagaccaggctggccttgaactcagaaatcctctgccgccaccactgccactgccaccaccaccactgctgccaccaccaccacccagctttgttttgtttataagttccctttggattctttttttttttttttttttttttttttttggtttttttgttttttgttttttagagacagggtttctccatgtagcctaggctatcctggaactcactgtatagaccaggcttgcctcgaactcagaaatccacctgcctctgcctcccaagtgctgggattaaagccatgcgccaccacacccagctcccctttggattcttttaacctaaccttagtcatacattcttttgtttagatgtgtctaatctgctctaaaatgcacccatagtttttctgttttattatatttcttaatgttatcattcctatttttttttccaaatcttaaatgtcacattttagttttccagttctctgatacaatttggaagtttgacattttcttcaatattcctagcaaggacagtgatttttttttagactatatttattaagtctgtttcacttgtcttttgtttctgatagttctgacttattcctgactcttctttcatccactgtctttgattgcctttcgttttgtttgaaaaaataattataaaataattcatattatgttcctacagaggggcctcatatctctgatgctaaaacatcctagagtaattaatgcctgaggatattttagccaagtaggtgatactctggttcatattcccacttgggggctatggtccttacctcgtattgggttactacgttagttactttgtttgtttgtttattcgtttgttttattgtggtgctgagaattgaacccagagctttggacatgctaggtgaatctcctacaactgaactactctcccagcccaagaaagatgctccccttagtgcagactgaagtccagtcttctacctgactagcgaatgcccagcttttgctcttcctaagtccttaagtgtcaagagttagatttgtcaacctgatatagatgtagacgtacttggaaagaaggcatctcaattgaagaatcaactccatctgattggtctataggcatttctgtgggccattttcttggctgttgattgataagggagggtgacaagcgcacttggggtggtcctatccatgtggaagcggcctgggctgtataagaaaggtaactgaagatgctatgggaagtaagccaagaagcagtgtttctctgtggtctgggcttcccttggtgatggactgtactgtgcaagcgagataaaccggttctttccctgagctgcttctggtcatggtggttatcaaaacagagaaataactgcttcacctgcctgtactagtactgtatatattaaagtagtgcatacattttgaaacaacccatggtttaacctgttgctaagctatatctgtggcttcttccacaattttggtctcaccaatatgtagtcatctaatgctggcatttgctctgggtggaaaattatttgtggctatcatgatacaataacattaatttaaaagaaaattattgtgacttaaagtccctgggaccccaaattaaatacacaaacccaaagatttggttggaagccatatgtgagtgagaacagtgcttgtctttcggggtctgggtctcttcacttagtgtagcattgcccagttcgctccctctgcctgcaaatttcatgagtttatttttctttacagctgactgagattccattgtatacaagcaccacattttcattagcgatcatcagttgaaaaatggtttccaccacctagtagctaagggaacatgggtgaccatgtggtctctactgcaggaaatagagtcctttgggtatatgcccaggggtaatatatctgggccatatggtagacctacttctcgttttgttttgttttttttgaggaccctccccactgatctccatagtggctgcacagttctcaccaacagtacataaagggtcccatttcttcacattcttcccagcatgtgctgttctttgttggtgtttttgttttgtttttttccgagacagggtttctctgtgtagccctggctgtcctggaactcactctgtagaccaggctggccttgaactcagaaatctgcctccctctgcctcccaagtgctgggattaaaggtgtgtgccaccatgccctgcttgttttcttatttttaaacattctgactggactaagatgaaatctcaaaggagctttcatttatattactagggctaaggataatgactgctttgaaaagtatttcttatccatttgctgttcctcttttgagaactatgttcaaaaaaccctggattgttttcttgttttctcgtttagttttttagagttcctcctatatttcaaaaatgagtcttctgtcagatgtgaagctgacaaagatatctaaagaaaaaaaaaaggaaaaaaaaaaccattgcccccataggctgcctcttcagtcaattagcaattctctttgtagtacaaaagcttaatttcctgaagttctacttgttgattgtcagtcttattgactgggtgaccagagtgtgcaggaaacaagtgtcagtggagtgctcagccaccaaggggatatctgtgtcactcacacacacacacacacacacacacacacacacaggatgcacttttagggacggtcttaggtgagggagtagaaagactgtaaaagcttgtggttggggagaactcgagttttaaaatgtcttctatatgtgatgggaccaccccagtcagctcatagcacctccagttgcttgaacaagaccagcaccggatcgagccagccaacattctagcatggaaggtaacagggttcctaagcctccatccctaactgaggaactggggacaattgacggtttctgagggagggagagtccctttgctttaaggatataggcctctgctgattcaaccatgctgtagcacatggcctcacatccaggagtgtgcatgggtagcgcagattgcactcaaaggattacaaaagaaaaacctgaagccagtgggcgtctggggaagtgaagaagggtctgagatgatttaaggggagcagtgagggttaaatgtgatcaaaatactgggtatgaaattctcaaataattggtaaaaaccatctatgtagttttatttattttgagacaggttctcactatgtaaatcttatctgttctgaaattcaccatgtagaccaggatggtcttgaactcacagagatccacctgccaggtgctgttttaaaaacatgtaccactttgcccacttaaaatttttttctaaaaataaactttccaggtccaaggcctaagaggtgactcagccattaagagcagtagctgctcttgcagaggtcctgggttcaagtcccagcttccacagggtggctcgcaaccatctctaactcaagatatccaattcttcttcaggcctccccgggcattgcatacaccaggtgcacagacggatgtacaatcaaagctcccatacaaataaaaatgaaggggggagggaaatctataggatccaaactaagaatttttggagtatcaggtgttttcctcactgctgtaacaatacttgactaaagccactgaagaaagatgtggtggtttgaatgaaaatggcctccccaggggcatctattttcaggcttagtccccagatgataaaactctttggaaaggagcaggaggtgtggccttgttggaggaggtgtgtcactaggagtaggctttgagggttcaaaagcccacgccaggcccagtatctctctctctctctctctctctctctctctctctctctctctctctctctctctctctctctctctgcctgctccctgcggatcagaatgtaaaggtgtcactacttctccagcaccatgcctgcctgcgtgctgccacgcacccccaccacgatgaaggacgaagtctctgaaactgaggaagccccagctaaatgcttgcttttatacgagtcgcctccatcccagtctcttcctagcagcaggacagtaaggaagacagaagctaaggtttgttttgccttcctgttagagaggaaatgcatgaggatagggaaggcctggcagctcgatccagaggatgctcaatatatggtatctgcagtcagatagacgattaccacgagcacctgtgtgcagctcagctcttcctttttattcaggaccctggaaggtaccattcacaggtggatctccctatctgaattaacctaacctagataacgcctcacaggcacgtcccgagcctaccctcctgaatctgtcccaggtgtgtcctctaggcaagtctacatcctatcaatctttatcacccccatcctctcacccataattcattccattgaaatgaggctttcttaaaacatttctgcagagtattccagtagcttgggttcaggagaaacttcttgacaatcttcttttcaatgccataacaaaagaagatgttgctttatgttgaagatcttcaatttaactttaaagaaaaaaacaaaaaacaaaaaaaacctcatgccatgatgctgacagttctctatataatctacttctaggttttctgacatagctttacagtcacagcaggcataaacatataattgactctaattaagtcacttagaattataatgttcatttaggaggcaataatcagggcatttcagagaggttctccatatcttgaaaaaacgtgggcagagggagttgaatttaaattaggtgctctgtctcccaaccggtttgtctctcaagcttcacatattagaagtttggcctccagtgtgacaatgttagtccctggtggcacctgtaacatatgaccagtgagaggctaccaggacactgccctgagaacgttctctcatcagtcatctgttagaaaaaggaaccctgctggcctggcctgtttccttgcctttgctccctgtgttgttgcagattgacgcctccattgtgatgccatggggtcctcaccagggcagagccaaggcttggtgttacacgtttgagccttctaaatcctgtttcatttatagagtacttagcatccagtattgggaagtgggctactccagaaaggtgggcctgaggaaggaagttattgctataactatgcttgaaaacacagaagctattacagaacttaggaacatgtcaagaatggaaaagtttggaggaatgcttagaagtggcttagagtgttaagaggtttcatgggatgatggtgaggcaagaagtcaccccttgtcacactgctggaaaggccttggctgctttgtatccacgtcctgaagctttaaggaaggcctaatgtaagagcggtgagttgctttatttgtaaagtgtcaaagcgttcattatgggtcttgttgccgatttgggtgttttacggtaaaccttggaaaagctgtgtcagaaaacctaaaagtagattatatagagaaaggaaacagggccaaggttttgaacgagtgccttctgagagctttcaaatgtgtctaggaaggaagtgacacgcagcttatgacatcacatctgagctgctccttgctgaaggtattagcggggatagaaggaaggtgtcaggcatgagcttggggagagagtaagatggagccaaggagagctgtgaccctgcccccgctgccacaagtgccaaggcttttctgggcagaatgttccagaaataagactaatgtcatcttctatgcccttaaagtccagggcccacttgggattctgggctatatggtggcatgttctgaaagtgctgtccccctagtgctggttctaggcccatggcatataagatatggcttcatggccatggccacgataatttcaaaggagaccctgtgagactgcactgaggtttgccatagttgcaccaagacattagcaagctgcaaaaagagagaaagcatgctcagttcagacaaaggcaaatgtggaaggattaaagttacatcaggccaggcggtggtggcgcacacctttaatcccagcccttgggaggcagaggcaggtggatttctgagttcgaggccagcctggtctacaaagtgagttccaggaaagccagggctatacagagtaaccctgtctccaaaaaccccaaaaataaaataaaataaaataaaaattaaaataaatttacctctgatcgactacatctgattcctggtgagtgattgtcttgaaataatgttctccagcagtaaaatgactttgcttagggttgctctgctatgcaccagaaggaaaaaaaaaaaaaaaagctctttaaaaggttacaggtcaggagctagaaagagaactctgcagttaagagtacttactgtgcctccagaggacctgaattgtattctcagcacccacacggtggtttatgatagtctgtaacttaagtttcaggggatctgatgctttcttctagtctctgagggcgccagaagcacacatatatgtaaataaataattcttttaaaagctatgaatcactagctaaatataacagcacttgtctattgttacacttcttttttgacataataagactaaaagagagtactttcattttttttctagttcccctgttcgggcacagggcatcccttaagctaggttatcctgctgcctctgagttacacccctgaactttaagaaggcacccttacaggttcagtaagttaataacgccaggctgggatttctgatattgttgcccttctcccatgatgctgacagcggccttctcattaatgctgatttccctaccaacatttgtataatctgtgtatttaaagtaggaataaaggagagaatagtttagataggtaattaaggatattcttcacaatgatctagatttttaaaagaaaaagaattcagagcattaatttattctgtaatatagaggaatatctcattgattaagtgtttttgtttttcttattcactttatatcctgctcagtgcccccctcccagccaccccctcccgaagtccttcccccatcccctctcccatgatctagatttttaagaagactggtaaaagaatagaacaagacatgctactttaaatctttcaaagaggtgacaatttttagtttaggagaaatgattcactatccttgcttagcttaaaaaaccactaacatgccgggtgtagtgacgcacgcctttaatcccagcgcttgggaggcagaggcaggcagatttctgagttcaaagtcagcctctggtctacagagtgagttccaggacagccagagctacacagagaaaccctgtctcgaaaaaacaaaaacaaaagcaaacaaacaaaaaaaaaaaactcactgacaactggttaacctagaaaataatgtgtcctggttttacattgaaagtttaactcaatattttagtcattgacgtatgtgtgtcactgttctgagacctacagtgaatataaaaacaacagattcccaatccatttaaacaaggatccttttgtatcgcacgttctccttcttaaatcctgccctaggctttctcaggtagaggaaatctttatctaataaagaaacctctatgttccttaccaaagcctttctgagttactctacttcagggttcttttctgtccctgagggtaagagaaagaaggcagcgccatgcccccagtcagggcaatttagaaatgcctgagaattaagtacctcccatgctggcaaccttcgtccagtaaaagctttgttacacagataatccatcgttcttggctcggaggggcataactttgaggctcctatttgaggccggttcctagcactttcccatgagattatgttcaagtctttaccgtcggtagccggcttgctggcacaccccttattgactgccttcccaggtttgtcttacttccccaccttccactggtatttcctgaacctcttacatatatatactatctacactaaaaatccctgtctcggggcatttccaaagggcgtttccactaggttattcacctaatacctgccccttagctaaaacgctcagttttagtgtgtgggcgcttgattcaagtacagccagctggaatccttcccagggaattttgccaacgtggaagagggagctttgggctctcttgttctgttccgtctttggttttgtctcggctccattcatcctatatccaatggatcactgtcaggcacaaaggagaaacttaacgtttgtagaatatttaatgaaagaaattcttgaaattcctttgccgccaaccgacacaggtcaccatagactgtaaagattatgcaacaccgctgtttgagccatgccacagtatcgcagcatgtaaccgtagttgcatgcagggagtcctttgcttgagatttgagttctgccacatgtcagtttgtgttggctgttgtttatccagtcttgtactccatattcctcggactaccggtggcccagactcacttctcagttgatttccaggttacttctgctgataggagaataaaacacaaaaggagaacaggtcttctggctccaactaccggagacagtctggtggcacaaccatgttccgctaacctcagaagccccagatctgccggcttgggtaccagtctttcattttgcttttcctagtgctagaagcgtggctactgtctcttaacattaatatcaaatatgagcatcagcaattaaatgttacctctggataacaatagcttccgctccctttgcctttgacatttccagttaatttatcacggttccaccaataaaacaggtcgttgtggtctctgaaacacttaaagtgacttttgctttcttgggcgaagccaggctgatgcgggggtctccggcgagctcttgctcttcacctcagctgatctctagagaacagagagatattagtagtccgcttatctacctcataggcgtttttatgagggttaagtaaatactttgagggcttaaaacagtacaaagcgaacactgtcctttgaaacagtgaaatgaacgatagtatggatcgttctgttattaagtgtacgtagtgctgctggcccgtttataaactcctgtgtcccctcatacaagtatcactgtgtgcagtttgccctcacctgtcctgtcccaactgctcaccaccatcatttatatgcatcttaggcctccctcttctaagtttgagtgtaatgtgtccaatgtcttctcacacagtttagatataagatgggcatgttagaggcctgtaagctcaaggggttggtgatgttctgtatctggtgatgctggggtgggcatcaggtagcacggaggcagccatggcagtgaaagatagatttatttttcttttattgaagatagaatttttttccctcacataacacatccataactacagtttccccgccatctattcctcctagctctcctcctatcctctcctgtctggttccacctcatttctgtctctcagaaaacagcaggcttctaaagggaaatcaataaagcagaatagaataaagccaaaacaatggagttggacaaaacaaccacaaacaggaggaaaagagcccaggagaaggcacaggtatcagagaccccactcaccacacacgcaggaatcccacagagccctaaactggaagccatgatgtataaggagaggacctggttcagacctgcgcagtctctgtgagttcatgtgagctttattcgtgtaggtttagaggaccttgatttcttggttactcatcccctctgactcttaaattctctctgcctccttatttgagggttccctgatccctgaggggagggctctgatggagacatcccatttagggttgagtgttccaaggtctctaactctctgcacatcctccggctgtgggtctctgtgttcccatcagctgtggaggaagctcctctgatgatggctgagcaaggcactggtctgagagaagagcacactgactgtcattaggactcactttatgtaattcctgctcttctttcttttttctttttttctttttctttttttagaacactaatatttggttttgtgctaggtccctgggttatctagtctcaggttcttggtggaatgggccttagggaaaaatcagatattggttggtgtaacgcctattcctggttgtcagcgtgtatctggaatgaactacaatccagaaatggagggctcacctgtgatccagatcttgaggctagaagacacaagtttccgacctggatcttagcatggagatcttgaggcacagtggctatgaaaagcttaggcccaggccaggtagtacatgcctgtaatgccaggagactaaggcaaagagatctctgagttcaaagtcagcctgggacaaaacaagtcccagatccaggcgtggtggcacacacctttaatctaggccacaccttctgttggagatctacacgaggacattggaagaaggaagattcgattttgttagtctgcttgcatttacttgccagcacatctgttaagattctactagctggtggtggctggagacatggctcagctgttaagcactgactgctcttccagaggttcaattcccagcaaccacatggtggctcacaaccatctgtagtagaatctgatgcccttttctggtatgtctgaaaacagctatagtgtactcatataaatatagtaaataaatatttaaaaaattcaactagccttgtgggacataggaatttcattttgatcatcttcatgtgtatatatattttagaagcttctgtttgtagtaggtttaaatactacccctcaaatgtctcagcctgtgttacatctcctccccctccccacctaatcctcccattccagactcaaaactacctattcctttttctttcctaatgatatctatctgtcccttatagcccccccccccccgcactctataatgtaacctctgtggttctatagattatagtttgtttatcattgacttaacagctgataaccatacataagcaaatacatactgtatttgctttctgggtctgggttacctcattcagtatgattttttttttctagttccatccgttttcctgcaaaattcatgacttcatcctttttttttttttttttgagacagggtttctcttttagccctggctgtcctgaaactcactctgtagaccaggctggcctcgaactcagaaatccacctgcctctgcctcccaagtgctgggattaaaggcgtgcaccaccacgcccatctttttttaaaaaaatatttatttattattatatgtaagtacactgtagctgtctttatacacactagaagagggcgtcagatctcattaaacatggatgtgaaccaccatgtggttgctgggatttgaactcaggatctttggaagagcaatcagtgctcttaatccctgagccatctctcaggtgcaggtatatctgaatcttgagtagataaattcccatcttcccatggaacctctatactgatttccacagtggttgtacaagcttgtaagtactctcaccagcaatactccacatccttatcagcttatgagctgtcatttgttttatcaatcttagccattctgacagatgtaagatggagtctcaaagtagttttgaatcacatttccttgatgtctcaggatgttgaatatctctttaaagtattttccagctgtttgagttccttctttttagaactgtcagtttatacctctacctcactgtttaatcagattgtttcattaaatcttttttattaagccgggtggtggtgcacgcctttaataccagcactcgggaggcagaggcaggcggatttctgagttcgaggccagcctggtctacaaagtgagttccaggacagccagggctatacagagaaaccctgtctcaaaaaaaaaaatcttttttattggttattttatttatttacatttcaaatattgtcccccttcccagtttctactccacaacccccctttccccaccccacccccgcttttataagggtgttacccccacctacccacctattcctgtctcaccaccctggcattcccctacactgggatactgggccttcatggaaccaagggtctctcctaccattgatgccagataaggccatcctctactacatatgcggctggaaccatgtgtcgttccatgtgttctctttggttggtagttgagtccctgggagctctgaaaggtctggttagttggctcagcagttaagagcactgactgctcttccagaggtcctgattcaattcccagcaaccacagggtggctcacaaccatctgtagtgggttccagtgccctcttctggtgtgtctgaagacagctacaagtgtacttattaaatcttattaatctaaatttaattaaatctaaatattaaatctatttttgagtcctttaaatatttaggatattagttatcttttaccattcagaaggctgttgttttgttcaaatgacagtgtctttgctaagcagaaggttttcagttcatttgggtcctatttatcatgttggacctttgctaacagtgttctgttatggactttcttttattacccagcctatttggtgttctatatacttcttgtaccttgataggcatcttattttttaggttaggatattttttcttgtatgattttcctgaaagtattttctgtgctcttgacctggctttcttttctttcctttattcctgttattcttaaatttgttcttctcctagcatcccgtatttcctggatgttttatgccaggatacatacatacatacatacatacatacatacatacatacatacatacacatgggtccgtgttctgccctctgctggggtgtggcagtactgcaggggagacaaagcacgaagagcactagattgagttaaccttatgttgggtgctgggctttaaggaaatgcggagacactgctcaagggggtggaaaatacagcctaggatgtgggaagctgaagctggggttccttgactccctggaatctagtcaccactggaaaacctcacagaggagtggggaacgaagcgcggggagtggggggtttcacgggtccaagacgaggccgggaccaggggctaccaaactcctggacatgccggtgctcctgggtcacatggagttggggggcccgtgggctggggacagtgtcgaacccagggccagggaatgggaactccgacttaattcatctgccaaagtccttagcttagaggtggttttctgggagcacagagaggccttctaggagagacttagacaaagctgctcagtagttaaaggccttctccatgctccccatgactattcttgacaaaagagacagcccttggttctaaactgttatgattgctcattgtggaaaatgagtgcataccaccttctcagggtggaccagagattaaataccttttgcaggaaagaatgtctgggaagggaagcttattggatgaaccctcagactctctaaatacctcattattatagagaactctgttctgggctacatgattgacagtagggagtgtggtcatctggtctgggccagaaatcgcgcgcgcgcgcgcgcgcacacacacacacacacacacacatttaattttctttgaccgatgtatgcatgcatccatgtatttcttctatagtgtcttcaatgtttgagattctctctcccatctcttatattctgttgttggtgaggattgcctctgaatttcctgttcaagttcctacatttttcattttcagatttccgtcagtttggattttctttacttattctatttctacttctgggtcttgaactgttttactcatttccttccactgtttatgttttcacagatttctttaagggattcattcgtttcctctttgcggactggtatcagtatccataaaggctattttaaggtcttttgtcttggattttggctgttttgtaacactcagggcctgaggaagtggtacagttagtcgctgggctctggagacggattgccctgttactcattgtgtttctatactggtggatttgggaaattccatactggtttgggaagtttgcaattctaggtgctgatatctggttgtctttactgggtcggcattttgttccttggtttctgttgccctctctggttcttaggagagagaggtggctatgtgtggtttccctggcaacaaattcttcttggatcctgataagtgtggccaccaggggttccaggtaaaatgtgtttctatgtattgggagatgccacttaggaatggtgggctaggtggggtggggaatgacatggtccacaggagggaggaaagcagggtgttctatcaggatctgctcattcccctggaatgggaacagagtgtgaggagaggtcatagcaggaagtctgctacaaagctgggggtgataatgggcgactcgatttggaagattggagagaaaggtaaagatctgctgttgacctgtgtgctttcctgcctgaagggccctgggggttcccagggaacctgcagaagtttcaggcttggacagatgcagcattcggtctgttgctcagtgtgggatgagacaagggcagtggatttggaggagctgtgtgaggaagagaggtataaatctgcagtttgcctgcctgcttccctggcttggtgtgtgtgatagtttgtatattcttggactagggagtggcaccatttggaggtgtggccttgttggaatacttgtgacctagttggaatgggtgtgtcactgtgggtgtgggtataagatcctcactctagttgcctggaagtcagtcttccactagcagcctttggatgaagatgtagaactctcagctcctcctgcaccatgacagcctggatgctgccatgctcccaccttgatggtaatggcctgaacctctgaacctgtaagccagccccaattaaatgttgtttttgataagacttgccttggtcatggtgtctcttcacagcaatggaaaccctaactaagacagagtggcctgtgggttcccagggactgcctgccagagttgggggctgggataaagcaagcagtggagggaaggaagttaaggggaagatctctgtggtaattagggctcattagactctgaaactgaatccaaaatcttccgtgtagtactgtagcacgtcaggggctctgatgaaggaagggcttgataaatacggattgtgcgtgccacttaaagcttgtatggaacgctactactagcaaccataaagttatctcgttgcttcttcataactgtaattttgctactgttatgcactgcaatgtaaatatctaatatacaggatatttgctatgctacttctgtgggggtcaagacccacaggttgaggaccacagatctagagccttttgtatacaaagcaagcatggcactactgagctgaatcctcagctctagacttggctttggcttgaacatattcatcatttgtttgattgattgtttgtttgtttgtttgctctaggactggttgttctatttctgagatctctgagacccagcccaccaggaacacacaaatgtggaaccgagataggctgaggacttattaaacagaattctgctgttcctatcccagggttggaccaatgtgtagaaaattgcttatgggattctttgaatgactttttcattgcgggaaatattaaaaatgaacctgccaaccttccacactcctgcttctttcaagccaccaactcaagagatctgtctctgcctcctacgtgctggaatcaaaggtatgtgacaccatgccttgcttgtctttttatggacactgatttttatctacttttgatagctgctgaggtaggtttaaatctgagaatctgcctagcttttccatggtgacgatccattttaagttcttacaaataacaacagagctctactttctctgtgtgttttccaacattcctattacctacttttaaaaatcatagtcatcttaggagaagggttatttcgtgggtttttaaatttttctcttggggacctaggataagtttccttaagcaaagtgttgccaaatgacttctgcagcttctgtttgtcacacttttattctttgtttggttttgtttttgttttttgagactgtgtactggctggttttgtgtgtcaacttgactcaagctggagttatcacagagaaaggagcttcccttgaggaaatgcctctataaaatcccgattaatgatcaagggggagagtccagcccatggagggtggtgccatccctgggctggtagtcctgggttctataagaaagcaagctggcaagccagaggaagcaatccagtaagcagcacccctccatggcctctgcatcagctcctgcctccaggttcctgccttgtgtgacttcctgtcctgacttcctttggtgatgaacagcaatgtggaaacgtaagctggataaatgcaacttgcttcttggccatggtgtttgtacaagaatacaaaccctgactaagacagactgggtctgtacatacctctggctatcctggaactcactttgtaaaccaagctagctcagactctacttcccgagtgctggggtttaagctgtgtggtactatgctggctgtgggcctgtgtactgggggcttttcacggagatctctggcccagctgggcgcaaggcttcaggcaaaggggagagagtgggagcagggagagggagttgtctccactgcctccacagcagcagctggctccacctcagtcacctcagttgctccaagacactgctgtaccagtcaccctgcactgagtcaggccggactaagccaatgagaggctgactagccagagaggagtgtgtgagtgtgagtgtgtgtgtgtgtgtgtgtgtgtgtgtgtgtgtgtgtgtgtggcttctggtggtgtttcaggagaacagacctcttcccaagtggcagctcttatgacagaagctctcagacaatggagtagttctcacacacctttattcctcctggatgagacccttagatacagttttggggtgggtcatggtctgaaggcaggtacttcccattgggttggtctgagagtttgggaataccttatctgcatgtgggagggcttggggtgctgcccctatgtgactgatggccacagacctctctatggggggactgtgggggactatgtagctatgtgacaggagccaagggtccaggagcatggcaaagcacccacggtcccttgcaggttacccactgaggggtcacctgtggggtcaccagggttttagcctgggctggaccaggggctgggctgcctatcacagtccaccactccacacttggcaatatttttattatattagtatgtattatacatatattatgctaaatatatattatatatattatttatattatacatcatggtaaatatatataatatagtaatactatatttaatatagtaatactatatatatatttaccatgatatgtaacataaataatattactatattactattcatatatatgaagttacagaaaaaaaatgaacacagtgactcaatttctaaattatgtggcctcatttataccatgccatagacatatttgattaacaagaaaaacatctattcagattctcctttatattttctagtggctcctttgcctaagggaggaagactaaatttctttgtaagctgccagagcagcctcagcctcattcctgccttaagatcctgtaacagggtacttgtaattgttctcccaaagttctttctgcctgagcccctcccttcctctgcctaataaacacttcctgttcaaccgct

SEQ ID NO: 42 - DNA, 17967 bp, Mus musculus
gtcttgctctgcctcctcccacaccagaagtgagcatcaggtggtggcgagcgcgtagacagggtgaaaggtgtgagggttagcgacagatctgcgtattcaccttgctggtcaccggccaccaccacctcggcgccaatgaattttctgtcgcgagccccgctaacggcttgccgctgaaaactctgggaaatgtagttaggcgcgagcaagctgtcgttagttgcaggtctgaggcgggaaccggggctcctcatgtgttcgcggctcggttcagccttccacggtgaggattttcagccgggaaatcaggacaagacctgggactggatgcgcgggaagcccagccctgagccggggggtgggggtgggtgggggcgcaggccacctctccagtcctgaaacccccccccccccccccccggtgatgtgactctgggttaaccgtctagttccttcacgttgtccggaatagcagaatggatcctggtgatcggagcaattaggtgctgtccatgggctggggagatgacacaggggtaagagagcttttgcaaccttgagaaaccgctcgaatccccagcagggagacagggacacaaccaacatgtgggatcagagaccctagccgccagcctagtctaccttcaagttcagagacggaccctggctctggggaatgaagctgggagtaataacttcctgtggcccctgcagttgcacacgagctctcaagcatatgtcagcatgcatacaccacacacaataagtagtgatgggtgctgccacagccacagccctccactattaaagaagagggagctggggttagagtcgataaggtacccctcatccatggtctagctggggccgacagacacagatctgcagtacctagcagtgtttgccctcggaagcttcactgcttcctaagagcaaacgcgttgatactccagtaaatgacaaggctggcgggtgcttttgtttgattggttggtttttgttttgttttggggggattttgttgttttctgttttgtttgtttttagtctgatgtttgttttggttgttgccgtatgtatttagggggagggcatgtagtggtcagaaaactttctgggttcagaaattgatcctttccttttgccacgtgggtctgggggattgcactcatgtgatgcagtgagtgatcacatttacctgctgagctatctcaccacctatcttggttttgtttgaaataaggtctgtatatgtaaccctaggctggcttggaacttatagtcatcctcctgcctcagcttcccccagtcctgggattacagactttagggaaatcatgattaaaaataaataaatagccaggctggttgcacatgcgtgcgattccagtgctcacaaggtagagacggggaagtcaagactaatttgaggctagcctgatctacataacaagatgcagaccaggcagggctacatagtgaaaccttgtccccttccatcactaaaaaaaaaaagaagagtgggagagtgaaaggaccagccatgtaaaggtgcttaccaccgagccggacagcctgacgtcagagtcaatccccagcacccacacacggaacaaagcaaggtacagtgggccacacttgtcacccccacgtcctgctggggaagttggctggccaaccgccccagtcaaatgagggatcatgaattaggatatcaagagaccaggtctcacaaaacaaagtggacagtgactttggaaggtcacctaaggttggttgacctctggccaccacatgcacctgcgcaaatataaacaccagccttcgtttgtacatgggtcctgagtctcccaactcagcccacacccaaaccaaatgcgcttcctttacatgtatgcagatggcatttcctttaaagcgctctggtttttcaagctataatattaaattttgaataattttaatttagattacgtctgggagataaaatttggaaggatttttcctttatatcctcccctcccctttcagtgtaggaattgaatccagggactttcacatacaaagcaagtgttctactaaacctactggagccctgtctttaataatttatagaagactataacttttattattatttagtggtaggtatttgtagtatattaacatttactatctagccagaaagctggttttttgttttgttgtttggttggttttctttgtgtttttttgtttgtggttttgttttgttgagacagggtttctctgtgtagccctggctgtcctggaactcactctgtggaccaggctgtccttgaactcagaaatccacctgcctctgcctcccaagtgctgggattaaaggtgtgcgccacccctgctgggctgcttgtgctggagacctgagctcagatcccagcatccacactgggtggctgacaaccacttgtaactccacatccaagggatctgacgccctcttctgcactccatgggcgcctaagcacacatgcatatgttcacacaaacatacacataacataatgaaaaggaaatattcaagaaaaatacactgcagtgggggttgggagtggggagcccagtggcacactccttatcccaggagcacaagtgggaagttgacacaagttcaagatcagcctgactatcacagtaagaaccaggccagtaaaggctatgtggaaaggccctttcagaaacaacaaaagcaagctaagcgttgtggtgcacaccttttatcccagcacttgggagacaagaggcaggcggagctctgtgaatttgaggccagcctggtctatgtttggatctaacaagaatttaaaagaagcagcagggctggggatgtggtgcagtcagagtttgcctagcgtacacaaagctctgggctccacatgtactgggtgaaacggtgcctgcgtggaatccagcactgcagagtggaggtgagaggatcgggagtcacatagtgtgtgtgaggccagcctgggctacataacaaacaaaaccccctcagcgtcataagcctgtaattcaaggacttgcccagctaaatcatgaaagaggaggaaagattaagaggaaagggcggggaaagggccacatatccacctgatgacccttgtttcttctagagctcctgaagttctgccattccccgtggtctgcagttcaggaagcttctggaacatgcggcgcctctgccatggaaacacgatccgcgtcgtcagcttcagatgtgatcttggaacgctggtaagagcaggacccacaggagtctgtgcccgctttgccctaggctgaaagtcagttggaccctccacccacttcaaactctgagtctgtatggagcctgctgtggtcctcacaaaaggtcctgaggagatcaccggagtatggaggctctcctgtctgttagctttatgtggctgtgtcctctgtagcccctgaagagttgctttaagacctctattacactcttcttggttatcatccaatggcttcctagccaacccacgttgtggctcaggagcaggtttgtggacaacggtatctctcctttgcttcacagtgcctggactcagtgtccagtgactttcctgtgtgctagccagctcctttctaaagaatacacaggagagcctttcccagggagagagaggggttggggcttggacacagcagactcgagctggggtttcacagctgtgacccagcactttgggagtcaggtgtaagggcactgacgggaatctgaggtcagtttgacctatatagtgaaactctgtcagagacaaagctagatgagagccaccagagccgaaccctctcgggaccagcctgtggttcagcacataacgcagccaggactcttgttcagtgctgagcagcacgtgtactcgtcactgggtgtgagaaatctccagcttctcaatgactttagtgtcattgaccagaaccactgtctacctgcccagcccagtgatgcacagtcactagctagaatcgggctctggctccctgtgcatagcaggacacgctggggcaagttctggaacttctctgagcctctgtttctctatgtatgaatatcagataaaataacacacaaggattggggtgtgggtcagtggtagagcacctgcctagaaccccccagtgaggggctgggggcgtggctcagtggtagagcccctgcctagaatcccctagtgaggggctggggtgtggctcagtggtagagcccctgcctagtacacacaaagccttgggtttgatcttgtgcctagataatatattaaataagtagtaagttaaaagaactttctagattacagagtgcttaacgtacagaagttcttttttattatagtttatatgtgatttgggttttttttttctttttgtttttttgttggttttgttttgttttgttgtttttagggtttgttttgttttggaaacagggctttgctgtgtagactaggttgacccgaaactagtaattatctagcctcagctcctgaggcgtggggtcacgagcgtgagccacacactcggctcgttcctatgtatgatctgtatttgctctttgcccagcagcagtgtcaagcccagcttaccatacccaccccccttgcttgcccttgattgtcctgcagctgacccagacctctccacacggcagccacagcctctgccagagtcctcctaggccttgagcagtgctccaccctgtctcacatagctgctgttccctgacagcctaccaggactctgcccttggggatcactcaccaacaccccatcaggcagcctccccagcgcgtgccagccacaccttccactcagccgctagcagagctcaagttcttccacccaaacccctcacacctccctcacctcagacctctcctccttcctcatcccgtacccccccccaacctgcccccaccaggagtgtgaaaccctagcgggggagctctcccatgggtttaaaagaaaccaaatgaacctagaaaagaaaatgaagataagttgtaatctcactaagacttggtttacaacctgctttaaccctcagccaggtgtggtgctgccccagggttgtcctgtaacttgggcgataagccaggaagatcaggagttggaaaaaaaaaaagttcctggaaagacaactcagaggttaacagttcttatcattcagtcataaggaccagagttcagagcccagcacctaccctagccccatggaagggatcagagacagggggattgctgggacttgtcagctctcaacctagctgagacatcatgaaccccagaccctgcctctatacagacacccaggcacaaatgcacacaaatcaataatttagaaaagtagtctgtttctaaaaaggtatggtcgactgtgcctttaatcttagctctcagaggcagaggcaggcagatctctgggagttcaaggtcagcctggtctacctagagtggtccaggccagccaaggctacacagtgatgcctagtttcaaacaaacaaaacaagaaaggtgtccatcatcttttgctgtggctgtggcataggacggatggatcactaaatatctaagggctggggctatggctcaatcggtagagcgctgatccagcgtgagtccctgggttcctcctgtgatgcatgtaagcggagtgaggtggcacacacctgcagtccgagtgcaaggagtgggggctcaagatcacccttggtgctggacgtggtggtgcacttgggagacagaggcaggcagatctcttgagtttgaggccagcctggtctacaagtttcaggtaagtttcaggacagccagggctacccagagaaacactatttttaaaaaggaaaaaaaaaaaagcatcatccttagctgtagagagttaaaggccagcctgggctacaggaggtcttgtcttaaataaataaatacatacgccgggcatggtggcgcacacctttaatcccagcacttgggaggcagaggcaggcagatttctgagttcgaggccagcctggtctacagagtgagttccaagacagccagggctacacagagaaatcctgtctcgaaaaaccaaaataaaatacatacatacatacatacatacatacatacatacatacgggggctggagagatggctcagcggttaagaccgttgactgctcttacagaggtcctgagttcaattcccagcaactatatggtggctcacaaccatctgtaatgggatctgatgccctcttctggtgtctgaagacagcggaagtatacttatacttacatgcataaaataaataaatctttaaaaataaaaaagtaaataaataaacaaataaacaaatgaaccaacaaaaaccctgatcccttaagatgatacaactttgacctcattgttgtactgtatgcaacaggtactctgggtccaggggggaaaggcgggctcatggacctctttgttgaggtaacatttgaatcctctatgtttttaagagttcgccttggcagctgtctgaaagttaatcctgtgaagggacctgaagcagccctctgaggaagcctcgcgcacccctgccgaagaacatcgcagtgtgttcattccccttccgttggcctcaggatccaagcaggaaagaagagggaagaactctgaaggacatgagagggacccagcttacagtccaggtgagttccttgttccagtcagaagacccatcgtatgacagtgtgcctaaggcattagagggtctgagggaggggttctgttggacagcttggctgccaaagctggctctgcctctcaggggtactgcccctccaatgcctgggagagaaagcgccgagccacttacttccttcatccccgcagccagaatcctacagggctggtaggatggctcagtggttaagagaacttgctactcttgcagaggacccaagtttgagttccagcgcccacactgggtagtttacaaccacctataataataactccatctccaaaggatctgacaccctttttcccgcctttgaggtcacctgcacacacaatggcgcgcacacacacacatacatagaaagagagagatttagaatgtactgtctgacaggaagcagctaaagaaaggaagggtttctttaggtttgtggtttagagcagcagttctcaacctgtgggtcgtgaacccttgggtcaaatgaccctttcataggggtcacctcagatcatcaaaaaacacagatatttaagttacgattcataacagtagcaaaattacagttatgaagtagcaatgacagtaactttatggttcggggtgagtcagcacaccaggagttaaaggtcacagcattagcaaggttgagaaccgctggcttgaagggttcgttcggtccgtcataccagggagggcattacagagctcacagcaacaggagtacgtggcaaagacttctcacatagtggtagagaaggaagagacagaatagactgggaccagacgtgaggggaatcctcgaaggcctgcccagagtaacttagcacagaccaggcccctccaactgaaaactccacagccttcaatgtagccccgtaaggtgctggagatatgggtaggcagtgagagctcctgctcttgctgagaacctgaagttgattcctagcacccaccatgggcagctcacggccactctgatgccctcttctggctttctcaaacaccggcactcatgtgtcctagcacagaaaaataaatctaaaaacagcagcacaagccagggactgatcattcagaatgtgaggacgtctcagattcacacagtaagtccacagattgtgggaagtccttctcccctaatgctgtctgacccagcaggaaaccacacttgggagtaacccacggggtgctctgcacgtggaaaccccatgtttgtggtcagcccctggaaccccccattcacagtttgcaggctcatcagagggttgacttgaagctgcgcctatccgcagggagctttcagagagagactttatataaaagaccatcgccgtgctggatgcttaagagccgggtatggtgctgtgttcctgcagtcccagcacttgggagacagaggaaggtagatctctgtgagttcaaggccagcctgatcttcatagtgagttctaggccagccagagtggcatagggtgaccctgtctcaaagaaaaaaagagaaggaagaggaggaaaaggacgaggagaagaaggaggggggaagagagagagagagagattgattgatggaagccaggcataatggcagaccagagacctcagatgacaggactgcaagcatcagaagtccctgtcccttgtactgtacctggccctgtgccactgctggtccaccctgatggaagattgacccaagccctctgatccaagaagacgccctctgaatgaccaagctgatatgctgataggggctagcaagggttgggcatggaaacctggccttggctcccagttcccaaaggcgtgatgagactctgactcacttcacaatttagacttgagtctcagtgtacagctaagcttggacaagcttgtttcgatgtagcccttgtttatttatgtgttttatattcattctccccgctctctccctctcctctctcttgcacacacacatttctgcaacagcacttttttttttttttggtggggacagggtttctctgtagccccgcctgttctggaactcacagagctcctgcctctaccttccaagtactgggattaaaggctgtgccaccaccacctggctgcaacagcacactgtttatagtttacataatcatccctgtaactttgtaggaaaggcagcccctcctctcagcaggtgtgtgagctgaagggacccaaggaactaaccagagaggaccagtgggcaaccgtcagtctggattcccagcccccgagtagatttgtggccagcctggtgtggaaggaagctggaagccacctgaatagtggttcgttgccagcatcaaccggctcacattacagcagcctagctccttcctaggtacccccttgggccactgctctattgcttcttatctttgtgtgtttgggaggggtgtgtgtgtgtctgtctgtctgtgtgtctttgtgtgtttgggagggggatatgtgtgtctgactgtatatgtctgtgtgtctctgtgggtgtgtgtctgtgtgtgtgtgtgtgtgtgtgtctgtgtgtctctgtatatatgtgtgtgtctgtgtgtgtgtgtttgtgtgtctctgtatgtgtgtgtgtgtctctgtgtctgtgtctgtgtgtctctgtatgtgtgtgtgtctgtgtgtgtctgtgtgtgtctgtgtctgtgtgtctatgtgtctatgtgtgtgtctgtgtgtctctgtatgtgtgtgtgtgtctctgtgtgtgtgtctgtgtgtctctgtatatatgtgtgtgtgtctgtgtgtctctctgtgtgtgtctgtgtgtgtgtgtctctgtatgtatgtgtgtgtgtgtgtgtgtgtctctgtgagtgtgtgtgtctgtgtgtttctgtatgtgtgtgtgtgtctgcaggcttagcacatgcttgcttttgggagttgactctttctactgtgggtcctggtatcaaattcaggttgtcagacttttctcagcaagtgcctttgctcactgagccatctcgccggtccgtttttcttcttttttactcttgtattacatttcccctgttatgaacaaaagctaaaatattagtgtgagaaaactttttactgttgctattttacaagaaccatgggtggacatttgaatacctgtggaacacctgctgactagatgaacatgcatgtatgtgtttatttatgtattttccccgttgatcaccctagaggattctcaggccactaaaccctggcatggggttactagaaaagactatcagcaggcccagtcttgctcgtctaggcaatactgctctcagccacaagagggcgatatttgtccatgaatgtccctcacaaagcctgctttaaacctcaccagcttttcctgccccctccaggggacagaaagaaaccagtgagtgttttatccaggtcaccctgagccactccccactcagcctgctctctgtaccaataagaaaccaccttgggagtgggcatgagggctcatacagtgagatagccatacctgcttcctctgtgtcaacatgggctgctccacgcactttctggaaggctcttccctgcctttcagcagagaacacctttccagaagtctccgtggctttcatagtgtcagatcattctccccccgagctcccaggacccagcgcttgcagtttcaaaacactcaacaaactggtggcctgcctactagaaggggagccccaggagagcctgggtcaggcttgcctgttcactgccccagtgccacggcgcctggctccctcgtgaggctccgtgaggctcgggagaggtgtgctaagtgggtgcgtgaccatttcagccttgaccttcccattcacatggctttccgatgtccccagagtctctagaaacacatcccgagtagtggtgttaccagttctgccctttgtcccttgtggcgattgaaagaccatgtggtttagtctaaggtagatgcaacttcaggaacttccagtttgggctctgcctctcacaggctatgttgtgtctgctttttgttgtgttttttaaatagggcctcacataacccatgctagcctcaaactcacgacatagctggttgtggctttgaaccctgctcctcttcccaatacagtcctaaatgctaggattatagtcttgagccaccacatttgactgtacagcttaggccggcctggaactaagatcctcctgcctcagcttccataatgctggaatgacgggcctgcatcaccacaccccattttatttctgatgtgtagagagtccgtagctgagcttccagggaaaccaagcacagcctgacattgccagccaccaggcccaacttctgcagttctttcttctaaaccctttttggacacctttgaacacagggacccccctagaactccaagaccacctggccacttgtacttggcccttccttcttctttgtcttgtatcccagcaccagatagcagaggttgctctgacgatatttacaagtaacccatccactgcagcggcttctggaacacacagcggccaggccttcctgctgatcgcaggcaagcagagttcctggggatgaggcatcaggagccctcacaagaccaaggcaaggaactaaagaaagaacccagagcccggtggcggtggcacacacctttcaccccagcacatgggaggcagaggcatgcagatctctgagttcaaggacaaccagggctacatggagaaaccctgtctcaaaaaaccaccgaaaggatggagattttactgtgtaataaagaggagagagaggctatgaaggagacatgtagcccagcaggagaaggatgttttgggaagcacaggcctagattcttctcttatgtacagggttggagactcttagtggaccccaagggtcacctgtgcaggactgtgtgtcatctggagctctctgtcccaaagacactagtgtcccttaaacctagcctttctgtttccaccctccctgcctgcttctcgccctggctgtctttgtttactataaagtcccaggtgaccttgaagtcccagtcttccagatgctgaggtcacagggatgcatcgctgtgccaggtttatgtggtgctatggatagaacccaggacccagggagcctcatgggggagccaggcgctgtggcactggggcagtgaacaggcaagcctgacccaggctctcctggggctccccttctagtaggcaggccagtcggtttgtttagttttgaaagtggaagtgctgggccgccgggagctcaggggagaatgacatcacctgacaccatgaaagccacagagacttctggaaaggtgttctctgctgaaaggcagggaagaaccttccagaaagtgcatggctactttgaagctagcatgggttctatgagggtttgtagagtggtagacaaaacgctctaccaactcaactacattcccagttttgaggccggggttctaagtagcccaggcttggcccaaactcttttttatagtaattagtttatttatttacctgtactacttttttattacagctatttgtgtgggggtagggcacaataggtgtggaggtcagaggtcatcttgtaggaggtcatttgtggtagcaagtgcctttacacaccaagccaccaaagcagccccactcacccatgacccttctgcctcagtctcccaagtgctgggattgtaggcacacctggctctctgtgtcttgtctttgctgctgctccgagcatgggagccatcaagatgaccctctaagtctgtctcccctccactactgtcctgggggtgggggtggggacttctttggtatccgtcttgtgagataggagcgcccccggagcctcgtcacgtcaccgatgacgagcgagcatccaccctcatcccagccggaaccttcagctgatgaataagacttgatttgtcccctgagccattgccacccccgattcattccattcaaaggctttagctcccaacggctcatctgacgctgggtgcagtggggccccctcggaactccacttccacacgaggaggatgtgcgttttctccagggtgatgagctctgacgtgggttcgagcctattcaggtgctgtatccgtcctgtgatttgtctcctctcgatggctgttcgcctccatccaaggagcgtcctccctccctgcattcattgggagtctgcctctccagtatgaattatggagtgaatggaaattttcccttattcatagtgtacaaagattccctctgcggcaagaatgtgttggctttctgctgaatcccatccaatgtctgggtagagcctggcccaacgtgagaactaggctgaggcctggtttgctttctgttgctgtcataaataccatgactgaaggcaactcgggaacaaaagaggccatttgtcccacaggctcagttcatcatctagaaaccagggcagaagctcagtgcagggactgacacagcagccttgcagcaatgtggcttgccgcccttggtttcttcagctacctttcctgtctgcctgcctgcctgccttccttccttccttcctttctttgtttctttcttcctgtctctctctctttctttctttctttttttaagatttatttatgaatatgagtacactatagctttcttcagacacaccagaaaagggcatcagatctcattacagatggctgtgagccatcatgtggttgctgggaattgaactcaggacctctggaagagcagtctgaaccgctgaaccatctctccagccaccagctagctacctttcttatacagcccaggaccacctatataacccagactggtctcaaacttgccattcccctgcctcagcctactgattgctgagatgataggtaagaggcagatgtttcaagcctgcccaaagcccacctcttcctgaaagccctccaggattctgtgagcctatacattgacaagtttctgtgtggatttggtgtctacaaaagctctcttcacccatatccgcagcaggtctccaaggtgaacagcctctggcacattggaacaatgtagataaggaggtcagccaattcctcctgccttctgtttttcataaccctagctgtctcgtctgtctttatggttgtgctgtggaatgcacgcatgcatgcacacaccacagtggggaacaatcatggaggaggtaggcattgcattgggaagcattgtctgagagatgccaggaagatgcactagtgaaccagagagtttggatgtcaagccgtgtaatgcttcttaaaatatagaaaagttctaacaaagtaatatttaatttttttctccttctacttgttttcactccgtagaccaaggtggcaggctatcagcctttgtagaatgaatgtagcaggcttggcttggcttggctttgcttaacagacatataattttggttttggttttggttttgcttgcttgcgtgacgtgacgtgacgtgacgtggtttccctttctatccgtgcagggttcccagactgccctttgagaataaaataggaggccagaaccaaagtcttttggataaaacaccgcgactgaccacacactaacccatttggctgccctccttcccaaggcacagatcatcccagcatgtgaaggcctccttctctccctccctccttcccttctgacccattttcactcttccaccacacaatcaaaaataaataaataaatgaaaaaaaagctctcttcatctatggtctacttatacctgtttttttcttcttccctgacagacaatatttgaaagtgtcttttgcattctccacggagtcttcaagtgctgcaacactgagggaagggccgtgcctagtagctgtgtgtcactatggactctgtggtataggagatgggctctggccagttgcctttgaagatgaacttcgtttccagatagttttcacacagggcggtaggagatttcttactgctacaccttccaccctagccctgaccctcgccaccaggccgcccagccatattagctcagaagatccataaaggggctggagccccagtcccctcccctctgcttgaagatgttattaattagagttgtgctaggatgcaggaatgaccttgggaaggggcacttggtgactaagcaagaatgggcacgggtgtgctgactcaccacacccagcttgcaggggaggctgactgaggaccaccctcagggtgaccttggaggtctgcaggctcagctcccgcattgcctagtcctatacctgtcggggaaatggtaacttcggaacttagtaggcagacagtttctggaggtaacatagagacatgaaggggtacactgagctggtccccaagggggccccaggtgaaggtcacagcccttccttttcgcctacggctgagttctgggtcccaccaagaatagaactccccttcctcgttggctatgaaaatgtcttaatgtctctaaatcccaagttgccttatggccacagccctgcttccaaccttcttctaaagcaagtacgttaagagatggagatgtcgctcaattggtaaggtgcttgcctagcgtgcacagagaagccctggctcccttttgcaattcttcagaaaccaggtgtggtggtgcattcttgtaatcccagtacttgggaacatgtgggcaggccgcatcgggatctgttgtctccagtgtaccggacgctggctggaaattagttgctaggatgtaatctgtgctgagtctctaggacagtgtctccagtcggacctagaatgactgtcctgagccacattcaacaagaaatagcacaaaggggtagaagagacagaggtggagaaagtgcaggttctgaagggacagatgaaaggtaatccaggttcattctaaagtgggcagggcttccaggggccttctcaagacatcagtctagagacctgtaaagatctacacccttgctgatcttggcagcacacacctgtaaccccagcaaggcagggcacccaagagttcaaagtcatccttggctacaaagtgagtgtgagactagcctgggtatcatagttgaagtccttcctcaaaacaaacaaacaaacaaaagctgtttaggccccgggctgtgtttctcattgccctactccctggtctgaggttatcggcagggctcccagctgttgagccagctgtgtcttcattgaggtccctgactggcattctgtcatcccccatctgtgtgagaggatctctttttgggttttttgtttggttggttggttggtttggtttggttttttgagacagggtttctctgtgtagccctggctgtcctggaactcactttgtagaccaggctggtctcgaactcagagatccacttgcctctgcctcccaagtgctgggattaaaggcgttcgccaccacgccaggcgagaggatctcttaagtgtacctaatttgcaagtgctcacagtgacctgtgggtcccaggcagcgactcattgaatcttctcaacaagctttgaaataagtcttttgtggcctcctgttacaactgagggagatagatgtagagagcttccctcagctctctgatccacgcaactcctgagtggaggagccaggactcaaatctgtatcttccctgcatccatgacctaaaaagtcctagtgttgggttgcaggagtttcacttacatttgctaggataagcagcccgatttctggactctgtggccctttaaaaatcctgctgcttctacaatctcttctttagcctgcccaaacctatctaatgctttacaggaacatgtgtgcccgtgagagacatgagctaaggcaatgagaagctgtgacgcagattctgacaccagccctcagtacataccttgtgcaccccacatggtataaggagctgggtctaggtgctaaggccagcagctcacgggcaaagtgagtctcagcctgtaaagagaacaaggcagatgtgcctccagagagaaaaaaagaacacatggagatgaaatccgggcttgggggcaaagaggaaccgtttaaatgtgtgtgtgccttgtgaaagaattacactccccgccccaccatcaccagatgtgatgacagtacttacataaggtactgtatgtagattgaactctggacctcacacattctggaaagggctctcccactaagccacatccccagcccctcactgggattctgggcaggcgctctactgctgagtcacgtccccaactctcttttgacttaattttgagactaggtcttactgagttgcctaggctggcctgaatctcactctgtagcccaggctggccttggactcacatttttccccctgcttagcctgctgagcccctgggatcatagacttgcctagttatacccatttgctgctgcagctaatacctttaaaccagtctccccccaccccagaaaaccttcctagcttagtattatcttaaattcagtgaagagaacagcagcttttccctgttcctccacatgagggcgctacaccactcagccatggggtgatgtgttcaagcctctcccacaacctttatgggtgcatttcttttctgtgtattctctaatgagaagcactgggccacctctgcatggtttttcttgccaatttctcttgtagccctctctcccagcagacaaccacattcagcacacccctcacttgtgcactgccatggccgtccgttccttgtgaccagccagatgacttagataataggggagtttgaaatgaatgagctgatactatctgtaggttaggattctgaccaaaaggtcttcagggctctaggggaagggattaattgaaataccttcccgagcatagggcttttctccagtgtgaattctctgacgttgaatgagtttcatgaatcttgaaagccatcacgtggtcactgttgttggtagatttctgttgtgcaaaagtagccagggtgcttggatgctggctgcctcctcccacaccctcgggacactctcaggtgaatgttggagcagtgttaggaaactgctttgtgttcctaacagtcgatattggttcctgctgttacaactgttacaatgttaaataaataaacttgatccagactc

SEQ ID NO: 43 - DNA, 52743 bp, Mus musculus
ggggcagcggggctgggctccggccgggagtcagacgagggagcgcgcgcgcgctcccggacagttctccgcagccgctcgcccgagccttctacttggccaacacagctgcctctaccacctcgcgtgcccggttcgtgggctttcaggtaggaggcggcgcgcggcgggtcgggagtgcagcatcgcgccgaccgaggggcgcggcgtggatgtggggggcgggcaggagcgcccccccgtggacacgagcgcgcggggcagcgacagcggcgggctggttaagggcacgtacgtgcggggcggggcctgcgtggggctcggggcgcacgtgtcgcgggaaatggagtggacaccgggggcttcaggggaagacatccaaacgaccgggagtcacgcgtggactctttcgcgcgagggtaggtgtgcagaccggccaggcgagcctcgcgtccggcatcgcaagcgccggcagtttccttcttggttcttgggatggtgttttgcttctgcgcccgcgctggtaggagctatgcgccctacccgcctacctcgtgcacttgtccacggtagatttaaaccacacacgaattcgaaaaacaaagtgaaactacatccacgcccagtgggagatgaggtgaggagctgcgggggtgggccggtcccgcacctcacggcaggaacgcagacaggtaggccgaggccgcttgcatggaatccagaccaagcgggcagggtcgatgtgctggagctcatcagaggccacccgctgcgggagcctctctcgctgcagcgatgcaggccatgggctctcggtgccgaggtggcctccggggtaaggcaggcagcttttccctggcgggcctccgaatctcgagacagcctcacctagccgccccacccccaccccacccccagcctcttctgtttctgagaggtggttttttagtagcaatttaaagaactaccgtaggaaacccaacagcagacgtctgcctcttttctgaagcctgcctgtgagtgccgcaggagctagagcaagcagcagttcacagctcctctattgagaaatccccagaaaccagctgtagttgcacctgatgttctcatactcatgcgctggcatgaaataaggggtgagaactggataatgaagctacagctttaaccctgaaaggcctgggaaacacccactgagccctaacctagcctcacagtatcctagccactagtgacattgtcagccactctgatgtcccctagcacctgctgagtgatgctcggtcaggtgcaactgagaacaagacaagtgggggtggagggtgcaactgagaaggagacttgggggtggggcaaagggggaattctcttttcatagaggacatgtctagggaagattgcctccacccaggtggtcgccaacctgttcatcctgtcctctgatgaggtttttggtgagcagtgcccactgctggactgtcaacctgatggcaggaattccttggcttctgatagcaaatcccttctctctggtttacagctgttcttctcggcctgcaaggccttctttgcatgtacattctgcaaatgtgattaactaacccatcctttgttttctaccctgcttttgaaactcggcccttcttttcctgtcccagcgagtatacttaaattcgcttggtggcagaacctcccacatggaaccagtttccatccctgtgtcccgcttgaaccattttcagacagttgtactttggctcagatcgctagcctgggtcactcgcaggagcccggtggtgtactattcccaaatcattgaatcgcttccagcctttgcctttaccctctttatgccttcattttgatgagtgtctgtgaaggcttccacttccctccatgatttcaagtcccattatgcccctagctccctcacctctttcctgtgtaccatgtttaaaacaataaatgaatgctaatgtaatgcttatacgtccatgctttcctgaattgtgataactaatgaataccatctaattgagacaggaaagtcattacaaatctcaaactccatcactcttttagactaaggattcttctaggggcaggtgacaccaccagttcaaactgccataaaatgtttacttggtcattgcaaaatgcctagagtgtcttgccgtttaaggtacagcagctggacctgtcactaggacactagcctctcttttcaacttctggcttcgtattcagactgtttttatatgataccaatctttagaaggcactgttacctttgtccttgtaagaaacaggccccctttgtcaatacttgcagctcaaatttcagaattgttcttacacgagacagtttgagtcacatgtcagttgtccatgataatttttttgagatttctagctttagagctaaaatgcacctcacatggtaaaaccaaataaataacaataattcattgccacactctatcttttcaaaaactgttggaatcagtttttattttttcaatttttattattccagaaaggtggatagataccttggattccttaacattcatcaagtgataagaacaaatgaaatactgacttggagcaataaaatgaatcatttctggaatgaacagccatgtgcttaacttgtttcggccttctgttactaaaacactgttaagggactaaaaagctgctttggtaatccttgtcaatcaacatggtagaaagatttcgtgaactacagattacccataatgaatttgaacttttgttatccttagtattagctttaagtatggcctcttattttggtgaactcaaaggcagtttcctgggctgtgctctgaattcccatcctccgtgagctttgagaggagttaacaccagcctccccagctgtcatgctccaggcagccagcctgttggccttgcctttgccccagggagaacagcctgggaatgagcggcaggtccaggaaaggcagtattctctcacaggattcattccctttgttatatcaaaatgcattctccacaccaaacaggatttcatctctgtagcattggctcaaagagccagtcagtgctgatccctggaatctggttcatttctccttaaagtaaaagggaaggttctttattcagaagagcgtacatctagggtactaaaggccatttccaatcagctcctgagaggtaggtatcctccattggtctgttcctgaattactccgaagtaagagtcttttcagctctcttcctgttgcctgttcagacacaaatcagatgcaacattgttctttccctgaccaaggattagctttcaaaattaactttgtaactagacatcaggtcttctgtttggtaaaggccaggtttgtaacattttttatcttgttattaattttttatttaaaaagaatacttgtgatttgctcttggctctcatgttaatatcaggttctacattttcttagtctgagttctgaaagaaacactgttttcttaatttaaaaattgcaacacaattttcagaatgattaccttaggtattctgtagcatgtgaaggtaggaatttcatatgaaaattttcttcaaataaatgagatttcctttaaggtcacagggaaagatataatgtgatcctacagacctgctctggaaagaaagaaaaaatacacatatatgaatgaaacctaaaacaccagatgcttcccccaccccaaagaaataatgagctgttcttcatagttgattatggagacaaaccaaggtttagccaactgagcaggcacccagggagtgccagcagtttgtgaaatcaggcctccgtgctgcagtcagcagtgtgcaccgtttctcacttttgcctccagtgagaagactgctaagcaggcttcttgaaaagtgtggcaccggctcttctttctgcatgtttacctttatcctatgatcagaaggtagatgaaccctatacgtaccctgcacacacataattaataaatgagagaacttcaaacggatgatttgagtgtatatttcagatttaatgtgttagagagctgtttggtattgtcattgtgggtggctggattacagttttggaagagctatcttgttttattagctgggggctttggcacattccttcactgtgtattcatttacatgaatatgaagactttccatggctcagaaggctctccactaggtctttgagatggctgctaaccagagagattgttgaaccttccatccctcaaaagagaaatgaaagaaaaaaaaacctgagtggacctttaaggatggagaatgcagaaacatgagaatagagactatgtttttaaaactctgtttagaaaggaatatttccaaattaagtcaggggcacatgcatagtccttccaccccacgccaggcctcagtgacagatgcagaagccaatgagctccccatgtgtgtacccccccccctccactgagccagccttccttcccttgctcttgccctggcagccaacctcatgactttttggttggttctgcccagtggaagacagcagcaagaggtcataggtgggtgggaaagaggctgaggtatctgcctctactcttctagtgcagccagggggagtcggggaagtgaccctggaagatcctggctgtgctgtctccctttaataatcagctcctacctaggggccctgtctcctcccctgagtgctagtgtgctctgggaacactttcatcttctgccctaggccaggaggtctgtcagtctgcgggttctcaacatctgctaatgagttctaagcctgccaacacctgattggtaaaaatccatttcgcctacgtttcattcctttcttcctgtgatctcacaaatttgcctcagtatataaaatgttgtgtcctgacaaccaatacatttaatatacttcattcttaatgtaggagcattaattgtatagttatttttccagtgggtatggattaaatgcttacttactgcaagtttaggtcagctgcgtgacataccaaagctatacacttcaaatgaacaaattaagattatgtagtttttacgaatattaaagtaaaaatattaggaataatttaagtattagccaatgttgaatccattaataaagcttgtgtgtccccaccacatagacaggtattaatgtcgtgggaagtcataaagctctcttgtgtatttgaaatatggagactttgccaaatatcttcattgttggaaaagcatgacaattcttgctgttggtttttaagcttgtaaagttttatctgtgcctactttaaacaaataggattttattgtcattacataaaataggtgatgatttagatttttaaagtaagagctttgaagcaagccacaatatcatatatatcaatatttagatatttatgagtgaattcttttcatcagccatttaacttaattgtgtattttataactgctgcttacatcgcttgagcttcttgccaaaacagagagtgcaaagcaattaaaaagtaacctttgacaaataagctatctgcatgcagtagcaaaagccagaatcaattcagtgacgtcactactcaggactagcactcacaggcaaggagaacaagctggctgagctcctaatattctcttgtaatgactctgtaaataagcgtggatgtatcacagtttatctgattttcatgccatattagaagatttcctgaatgtttgtctaatctactcagttactatgaaactggtgccagtctgaaatgatgcctattcagggtgttagggatgtgttgagataaggtttctgtagccttttcaggtaagacctaaacttttgagcgccttagttcttaccgagtcatctgcctgcattttacagatggctctggagtgtaagtcctcagagtgcaccacacatggcttctctgtagtgattccaggagcagaatgtgagagaatggagtctctttcctgcgcttgctagactggcatctgatcagttgtcacctctcttcgagaagtaacacttgtctaccctaagagcttgtctgtgaagatggaatgagagagttcacgctgttggctaggcatagctgagagtggtcccccaacacctaacccaggttcatctccactgccccgtgcttgctgcatacctcccgaagccagatgagttgagttcactcttagcatatgaacgtccagacaatgtcttcctttagtattaatataaagtctttgaccttcaaatttaaaacaaagactacctgtgtacttagtaacagtgtgtacataactgacagttttgcaaactccaaatcctttttttctgtatttattcaagaaatgtgtattgactgccttccacagaacatctaatttactgggaggactgaacatttgttagtgaacaaacctagagcacgaggaaatatctggttttgttacagccatgttttctccttgtgatgtccctgcacaaatagtgaataggtcctcatcttgcaggtcagactgaccacctgatccagcctgcgacacaattatgacagccatacatttgttttcagccgaagcatccttaaagagatactttacaagccaagatttggctgttttgtagatgacatttaatttttttttttttttgccatttctaactagggatttaattggaaaatcagcattataaattttatgttgttgtttctatttttaagtttcaaggattgtggctctgctgcctgcaaattaaagatggagatagctgggaatgttgctcttgtacattctgccttttagagtggtttcctgggcttttgtctgtggcaaatatcattttaataaatttaatgtggcctttaaatattactttttaaaaaaaccttctatttaaaatgtgctctgagaagggaagatgatacctacgtttaaggtcaggagcaggatgcacggagatggctgcactggttcagctttcctcgtctctgactacattcagtcagagaacctgcctctctgagctctcagcatccctgtgagacctcgtgctcattatgtgtgtatgtgatcgtccatgtcccatagctgtggcactgcgtgatcttcttctccctttgtatagagggaccctcttagcctcaccccctcaccccatgagtgacagggaagcttggacataaacatagagctcactcatgtgtctcctgtttctccataaatgactttttggattatgctggaagagtagttctttaaatagaatgtcctcccatggaaattgcccacagtgctgagtataccttgtgaaaggtgaggctggaatacagggtgcaccctcagcagtgcccagaagcctggtgcagtctctggagtctccaaaccaaatttatagcagttcattagtgtatgggatcatgaaatccgcacattgccatcatcacggaggagaacaaagacctcagacaagactcggaagatggagccctgtggagggttctcccttgctctatagaaactcacgtgcctgttttgagcccagttttcttttgagcatatgtcttgctgagcaaccaaaaggatgtttatatcctagtcacttggcaaaagtctaacattgcttcagagagattcatttcaaacctaaaggatggagcttaaaaaacagatgaggttcagtagtcacaagaactggccccaccttagttttctctttcgttgctaaatggaaccacccttttttttctttcctagaacataaataggtaggcctgaaatcagtttgattattcccaccccattctaaatgaaaacaggcttggtgttgtccacagagatgagaagcatttgaaactccatgatatagctattgcctgaagaattatttctattatatcaaattgtcctatgttgctgagacaatttccaaatcactgctcattaaaaagtctacttgatactaaccaggatcatgatgcatttaaaggaagcacaggatttctgtcagctatttctgaaagaatgctggtagagtagatagcagcacgatgatcattgtcctaggctaagattgtgtcctttagcctcttttgtgattctggtgtctccactccacacagcaagtgtgtcttcatactgttttcttagatgcctaagtcatagggtttccttttaatatgttaacattcacataatgcccgctggtgctacccgggcatttgcccatggttttcaccttgcgaaccacacctgaggatactcatggaagtgcctcccaaaccctgattcaccacggaatcattcacaattagaagcggaaacccattcttcccatcacaaacacatctctttgaaaagcagttctcttgtggacggtgtttaacgtctgagaaactaggataaccttatttatgagcactgctcgaaccaaagcaatttgtgtgtgtgtgggggggggggacggacggacggactcaaggttccatgttttaagaaaagcatcaggggttaattccactgggaagaccatcttatccataaactgttaacacactaaagagacaccttcagagccagcacaggtccatgtttgcctgaatagaattaataatttataggattaattgagagtgctttttgatgccagagtctgggtgtgtagggttgatatggcagaggcagcacttgccctagtctttcagcttgcagaggtgggagggttttctgcctcagccctgcaaagtctgttcacttctcttacagcactgtccctcaagacagtggccctggctcaggcccaagtcctggctggctctcacttaccattaaacatgatatacccttttcttgtaagcagtgttgctgaatttgaaattcttttgttgttgttgttgtttgggggggtctcacttacgtagctctggctgtcccaggattccttgtgtagaacaggatgttcttgaactcacagagatccacctacctctgcctcccgagtgctgggattagagtatgtgccactatactcggtctaatctgaaaattcttaaagattataaatccctgttttcatttgtcttttttacaatctccactctcatctattgtcaaacaaatgacatcattttgttcctatctcggtataatgccttttccttagcattcatctgtggagggaaatcaaaactgattctgtcacttggtggtttgggataatgattccttaattgtgatacccaagtatctcagtgaaatattgactcagcgtccattgatcgttctgggctatatggtaactatttttgaagaacatccatgtatatttctatagtagctaattgacattcctatcaatacttgtgtgaaagggtcataaaaaaaataaaataaaataaatccctgttttcttctcattcgttcctaaatggtatgagagatgaaagatgagaggtgagaggtgagagatagagagagagagagagagagagagagagagagagagagagagattgggattattggcttgcccataccttccattcatttctacagctgcagcataaaaactgtatttctgatcttaggaatggttgctggcagggagctggggagctgctcagttggctcatttctcaagcaaaaggagctgagttccatccccaaatcaccggctaaagattttaaaagaagaggaggaggaagaggaggagaaaaccaacaggcttggtggtatacatggaggaagtggagacagttgggtccctgggacttgctggccagccaacctagaatagttggaaagttccaggctagtaagaggccctctataaatgaatgaatgtggcagtactatagtgtaccagttgaagttatcgtctgccaccctacacacatacgcacacacttgcagggatgcttagaaaaaagaggaagccagaggaataaactaaaagcagttagctgacccttttgccgtttgccattttggtggcaggggcgggggtgatgtgttactaatcctgcactactgtttaatatttcagctttaacctctttctgctcgaagactgaatccagaagctttaatctggccaccacttaatgagagggcatttgcttttcttgtagttctggagttcacacacaggaaatctctgggctttgtaccaggctagatggtagtgcctagtgatgatatgtgtgtgtgtgtgtgtgtgtgtgtgtatgtatgtatgtatatatacactaatatatccttttgtaaggcatattagtaacaaaatgagaagtgacttcattaaattgaaatgtttgatgtctcagtatgcaaagtgagtttgaatgtatacatcgcacacattgctcttcccaattggggatttcacagcatttgaggattaaggttgtgggtcatttcattttcctgccattttaaagacataccatttccaactgttaagttcccttttgttgaaatgtgcccgttttttgttttgttttgttttcctataacttagcggaaagctctccattatgcctcttcatccgccattactgctttgccttttggtatctttttttttttaattaggtattctcctcgtttacattttcaatgctatcccaaaagtcccccatacccacccccctagtcccttacccacccactgcccctttttggccctggggttcccctgtactggggcatataaagtttgcaagtccaatgggcctctctttgcagtgatggccgactaggccatcttttgatacatatgcagctagagacaagagctccggggtactggttagttcatattgttgttccacctatagggttgcagttccctttagctccttgggtaatttctctagctcctccattgggcaccctgtgatccatccattagctgactgtgagcatccacttctgtgtttgctaggccccggcatagtctcacaagagacagctacatctgggtcctttcgataaaatcttgctagtgtatgcaatggtgtcagcatttggaagctgattatgggatggatccctgcatattgcaatcactagatggtctatcctttcgtcacagctccaaattttgtctctgtaactccttccatgggtgttttgttcccatttctaagaaggggcaaagtgtccacactttggtcttcattcttcttgaatttcatgcgtttagcaaattgtatcttatatcttgggtatcctaagtttctgggctaatatccacctatcagtgagtacatattgtgtgagttcctttgtgattgggttacctcactcaggatgatgccctccaggtccatccatttgcctaggaatttcataaattcatttttttaaatagctgagtagtactccaatgtgtaaatgtaccacattttctgtatccattcctctgttgaggggcatctgggttctttccagcttctggctattataaataaggctgctatgaacttagtggagcatgtgtccttcttactggttgggacatcttctggatatatgcccaggagaggtattgctggatcctccggtagtactatgtccaattttctgaggaaccgccagactgatttccagagtggttgtacaagcttgcaatcccaccaacaatggagaagtgttcctctttctccacatcctcgacagcatctgctgtcacctgaatttttgatcttagccattctgactggagtgaagtggaatctcagggttgttttgatttgcatttccctgatgattaaggatgttgaacattttttcaggtgcttctcagccattcggtattcctcaggtgagaattctttgttcagctctgagccccattttttaatggggttatttgattttctggagtccaccttcttgagttctttatatatatattggatattagtcccctatccgatttgggataggtaaagatcctttcccaatctgttggtggcctttttgtcttattgacggtgtcttttgctttgcagaagctttgcaattttatgaggtcccatttatcgattctcgatcttacagcacaagccattgctgttctatttaggaaatttttccctgtacccatatcttcgaggcttttccctactttctcctctataagtttcagtgtctctggttttatgtggagttccttaatccacttagatttgaccttagtacaaggagatagaaatggatcaattcgcattcttctacatgataaccaccagttgtgccagcaccatttgttgaaaatgctgtcttttttccactggatggttttagctcccttgtcaaagatcaagtgaccataggtgtgtgggttcatctctgggtcttcaattctgttccattggtctacttgtctgtcactataccagtaccatgcagtttttatcacaattgctctgtagtacagctttaggtcaggcatggtgattccaccagaggttcttttatccttgagaagagtttttgctatcctaggtttgttgttattccagatgaatctgccgatcgccctttttaattcgttgaagatttgagttggaattttgatggggattgcattgaatctgtagattgcttttggcaagatagccatttttactatattgatcctgccaatgcatgagcatgggagatctttccatcttctgagatcttctttaatttctttcttcagagacttgaagttcttatcatacagatctttcactttcttagttagagtcacgccaaggtattttatattatttgtgactattgagaagggtgttgtttccctaatttctttctcagcctgtttatcctttatgtacagaaaggccattgacttgtttgagttaattttatatccagctacttcattgaagctgtttatcaggcttaggagttctctggtagaatttttagtgcaaagttctatcagaccttcaaagaagacctaattccagttcttcacaaactattccacaaaatagaaatggaaggtactctacccaactcattctatgaagccacaattactctgatacctaaaccacaagaagacccaacaaagatagagagcttcagaccaatttcccttatgaatatcgatgcaaaaatcctcaataaagttcttgctaaccgaatccaagaacacatcaaaacaatcatccatcctgaccaagtaggtttcatcccagggatgcagggatggttcaatatacggaaatccatcaacgtaatccagtatataaacaaactcaaagacaaaaaccacatgatcatctcgttagatgctgagaaagcatttgacaaaatccaacacccattcatgataaaagtcttggaaagatcaggaattcaaggcccatacctaaacatgataaaagcaatctacagcaaaccagtagccaacatcaaagtaaatggtgagaagctggaagcaatctcactaaaatcagggactagacaaggctgtccactcttgccctacctattcaacattgtacttgaagtcctagctagagcaattagacaacaaaaggagatcaaggggatacaaattggaaaggaagaagtcaaaatatcactttttgcagatgatatgatagtatatataagtgagccttttggtatcttttcttcagcaacaaagtagtggacttgacttgccctcccgcagagaactgtgtatcataaattccaacctgagcttcctaaaggcattttaagaatggtagttccccttgtgcagtgttcaaaattggcatcttaaaaaagtgtactgtgaccattggcattacacatagacgtgaacgatacacaagatacttacaagatggctttaggtatgttttgttcatcttgttttgttttgaaaatgcatctgctagctaggtatgttgatttatgcccacagccccagtgcttggaagactgaggcaggaagatgacaagtttgaggccagcttgagctacacagacactatctcaagaacacaagagctgagatgtagctcagtggtagcgctctggtctagcatgtagaaggccttggggtttgatcaccagcatagccatcaaagcagacaaaatacatctgtcccattttcatgtgttggcggcgggcacgctagcttggaagaaccatagtagggatacttttcccctgtgtgtgtgtgtgtgtgtgtgtgtgtgtgtgtgtgtgtgtgtgtgtatgtgtatgggtctttgcatgtgtgtggacatgtttgtggagacccaaggttgacattgcaaatctttcttcattgtttgccatcttattcattgaggcagaatctcacttgaaaccacagctcaccagggtggctggtctgactagtcagcttgctctggagagcccacctctgtcttctgggagctggacttacaggtgagccatcacatccacgtccacctggcatttacgtgggttctggagatctgaactccaacccttgcacttgagggctttaagttccgagagggtgcttttaagcaatggttactgccatcactttcatgtctgtgtaatttctagtttacatttttacttttgatgtgtctgtatcaggccactaggtagtgagccaatagtgtgaggagaagaaaatgacaaacgtgtctctgtatacttaaaccacatgatatgaaaatgaaacctaacataatgctggatacttttctctcattcagtgtatttttgccctacagaattctctgaactctgtaccaacaaacacaacactatagagactcttagttttaatataccttgaaagtgtatatctgttctgcagctagcataccagttttagcttctttatgacatatttaaaaaaaaaactttgtcaactaacacaatctggaatctggtgatttaggtgccattagaaccaaataattgagagttgcacctagatgttaggccttgtggcagctcaccattcactaagcaaggggtcctaatgaggctaagtactctctatatgagcaaaaagaagcagccatgtttacattgataaaattggactatagctttcaaaagggctccagactcctgcagccagcagaggttatcttcagtgtgctgaatacccatacaatgcgctatattttacatacagcttttggtagccaatgcaataaataccatgcttaattctctatgtgcgttgtttcaattaatcgtaggaataatctcatgaactaggtacatctatctcattttgcaggagaggaaatgaaaaacaaataaaatgtcttacatcccatgggatgtgttgagtagacattccagcatgttccaactctagagactgcgttcatggctagtcacaacacacaagcccagctgtgtccacatgcctccctcccccacctacttcacaatgcaaatagatggcttatattatctctgttgcaaatgacaaagctaaacactaaaggcttccagagacacacccaaagttgaaggcgctggggtcatctgtggtcttgacagtcatctgtggtcttgaccccttgataaagggggtccttcatccctgatcgctaccaccactcttttcttatggcctggagtatctaactatgttagctacagttctgtctctgctttagagtgagcactctgtggatctcattgatcgttgtcttctctccaccatgcaccactgcagaaggggtgagagtatgcctcctccacatgtggcctgtctttcttcccatccccattacaatagggagatctggcaaggcggagaacaaaggctttgtcttggtcaccgttagcttcccttctctgactgtacaagcacatgctttccagcccttttggttcattagtaccttgtgttctaaagcacctccccaccgtaaaaatagaaggcctgtgagtcatttacactttaggttgaatgtgctttcgtgactttcccaaggctatctgtgcttcactcctttcttccgattgcagagtgaaggtctctgggctatcctggctccttggacaggaagaaggagctaggagtcgttggcctgaacatcggaccactggagacccactgcctgtaaacgcttgcactgcagctgatgcttacctggcatccacagcagcctttgctcagcatcggactctgagcctgtgctcactctctccctctctgctcagcatcggactctcagcctgtgctcactctctccctctctgcttaagtcaggtggattcctgctctcctcttcttgccagttttttctgagaacatttttcatctttgtagtaatcacatcttggatttttcctgtgtcctgcagcatggtgacccagctgtccccaggaacagatacaggcttaaagtataccccttctgctgtctgcaaccacctggtacccagagaacccagatatgactggctagcgctctcacttaggctcattttgtgtgtgtgtgtgtgtgtgtgtgtgtgtgtgtgtgtgtgtggtgttcacatataccatgcatgtggagcaggaagcacctgtaagatatacattagctttctcagttgctggaacaaaatgtctgacataaataacctaaaaggggaaaatatttgtttagctcctggtttcaaaggtttcagtccaccacacactgaaagcacagcggtgcaatcacatcatggaggacaagaggcagagagaggcagagacaaagatggacccctagtgacctacttcttctaaaccctgtccctgtcctcccacctcccaatagtgacatcagctggaaccaggcaactaacacgtgcctgtgggagacctcagattcaaactgtagcctagtaaatgtctgagaaatgcccaggaaacctctgagaccttcagttcatctgtaaagtaccgtcaacacctagcttatgttgatccccagaaaccaaaagaagcaaggatccgagagcacagtccatttgagagatgatgccatgagatgctggtgaacgagagagacattaagcagaaaactcttggaggagtttggaaggtaggcagccttcaggctccctgggagtctgagatgcaggttggatgaggctgttaaccacaagctcccagcctttggtaatggttatttcctctcagtcccagcgcttacagtgagtcatccaagcttcctttgctttcataaaagtctttcagatgaaattgagagagagagagagagagtgtgtgtgtcattgcaggagcctgtggagtagcaagggctgaaggctgtggacggctcccatgtactgtctcccagggtggaggtggtgggagcagagcagatgttattgggagaccatcctcagtaagggtatctgtgcaacacgctgggaagaattagattatctgtgtctcctgagcagctcattatctcaggctttgttgtagcagggaacaacgagcagctaagaagaggataaaaaaactgccaaacagttcatttggctaaacacaggagtcctgcactcagtggtgtgaaccacttattattaatgctgattacaatgctgtctaataatgattacgcatgccattaagtatgcaccagattaactttgtcatgaaatttacaacagtaggcttgattcatacatgcagtcttcataatttattgctcatgtagcatggttatgacttcaaaacaatctccaagacagcattggtttgatgagtgtgttgctctccataggtacagttgctctgtgaatgagaaatgcctgctacacgtgtcagtggtcatcagctctccctccactgacaagacggtttcccttgtctaatcaggaagctcagaaatgccccacctttgtgactgcacttgccacaggtcattgactgatgcaagtggctttgatttgaaccagtcatatagcttgcactatgctgagttgaacctgattctgagtggtgtggatttagatgtgggtttgaaactgattctgcccttgcagctcatggtctagcaaagacttacactaactttatagaagattactgaagaatgaagtaaacataagccattaagtatgtagtagtgcatgcctcttttcccagcatctcacagcttcagagtctaaggcaagaagagtttgaggccagcctgtgcatatgtagtaagaaactatctcaatcaatcaatcaatcaatcaatcggtagcagactgaagcaaaagtaagggacttacttcatctcgcttacctcgttgtggaggaacaaaactgttgttacttggtttccagaaaaatgtctgtaaagcaacagtcattttgttttcagaaatgagtagcaccactggctgtttgctgcacggtcttagcctttgtgctgagaatgtcctaaagtcatttactggtaaagtctaagggcttccttttgctaagtggtagcactttgtgaatccaggtttaaaatgtcatcagctatgccacagaaagctaactagaagaacttcactgctacaacaaaggcaaattctctccgagtcaggcttagcattctcacagactgagccacatgtgttcctgaagtttacaatttcacatgaaaagaatgctccgggaagccatggttgggcacatctctcagaattgagcattgaaagctggagttatagcagggccgatgttcgtcatcaggaagagaggagaatgaagcttggcagaaaaagtcaaggccatgaataggacagagctagtcaaaggcagactgagggaaaggctagtgagatccagggacaggaacctgagtctctggggagaccaagtgtgggtagggtagataagcccaaccaggtcacactgagaccttcccagaaaaagatttgtgtggggatcatttaaagagcccatgtaccatcattcctagctgcctacctaggaacatgctaggtggccatgtagtttcaggctgtaataaacccttgcacataaagtggcccatgaatagcaggcatggtttaaagggacttaatccttgattctgggtagagcaatggtcagagacaaacaccaacttcaacaaatgagtgcctattattagacaggaccagggtatccctgaagtcatcaccctttccctcctatccaaactgctggggtattctttatatgtgtttctgacattattccacccacacttcatgctggaccttcagagaaccttgggaccaggtcatcactttaccatcaacatggctccaccctctcccccatctcagacctggacgttgcatctcagtcctgaagcctctattgtgactatagcccttcagaaaacccagcaggcttcttaactgtacttcaaagtctgttctctgaacctagtggacagtacccttggcacattctccctgcctcccaaggccctccattttcctgtctctccaaaggcaccatcattcttgtgatatactggcacaatcccatcaacatttctcatctgtgccttccctctgcctagatctgaaacatcccaagccattcctacaggacatacttgtgcctgaactccaaatgccaagagccatcaggatattcatcctgtcggttttagcttttgatttatcatcctgcatagctttgtagcacttagtgcagtgactgaaggtacaagagaggctcaaacaatggacttgttttaactgcagtgatttgggatattggacactgggctcagtctttatccattgttcttagcttcgagctgtataacagctgtggcttatttgagctggaaaaggaaagaggctttgatatcacagaaggaggagccaggcaagaaatcttttcagaggaccaactttgcccacttctgggtctgattctgtcactcactcatgagcctgactcttgactctgtcactccctctggacgctttcctttgctaccgtgttgtcagcaaaccccactcgacatgggatccttgtctgcctaaaattatgccaagactcaggccatctgatggttgagcctggatcacatctaagcccaagctgcaataaagctgggagagtgagcctctggcttctgtgtgattggaaatccttatcatgttcaaattaatcctaaataaaggtaacattagcaaaggatgggcaggccatggaagacaataagggacaggccttcagagtgaccactatagagcctctaaccacaagcctcaagagacaggaggacattctggctccctaatctggacatgggatgcaggggtgtggaaggggctgttttaagggacacggtccccagtcatccccctggagtaaggacaagagaagtggatatgctggatcccctccatttcctgaccctgctgaggaccccacccctcctggaggctcagaggccagtaagcccatgcttgctgccctactgacccacactgaagtaccaagcatgctgaccaagggaaagccaccaggagaaacaaatgcaagacagacatgctgcccttgagtcttgctgggattccacaggcactgttcttttcttttgtccagtgtctccgctcagggtgtcactttgcactttgagtaccccagaccccaagacagcattcttcaagtgttctggtgctgcatgttaagggtgtgctattcttaccccttgtttgaaacttagaacgttcttttgtatacctcagcagcctgcaccattaaaggtgagcaaaggtcagccaggcctatgttttctttcccaggattgtgagacaagagtgaactgtgtggcctgtgcagacacgatgtcaggaatcttgttaaaccttgttgcagaaatcccttctccatctggtcctacccatgtggtctcttgttgtcagcccactgctctgtattagtgtctagccttctaaagtggtagatataaggactgccattgcagtaagccccgtgtcactaacagaagttataaggcccacaaaggactcagcgactgtaactccgagtccagtgaagaatgcttgggcctggttcaccaccttcttcagaggcatattgtgttcttcacagagaatggaagccagctatagtcccatagactagtagaattaagtatcacgtgagaaatctagataaaagagcttttgattttcctacttaaaatgacattaatataattcttattttaaaacagcaggtgataaaaacaagtgcaaagagcaggagtgtgccctcttccacccctgcctcacaacgacatttgcagtgcggtagaaaaagatgcaatccgtgtgattacgtgttgtgatgctgtgtccttgtggggctgaggtgttctctctcccctctccctctccaagtgtgtgtgtgtgtgtgtgtgtgtgtgtgtgtgtatgacagggtcttgctatgtaccacaggctgtccttcaacttgctattcttttgtaagacccttgagtgctggcatttcaggtgtgtgccaccttgactatctgctgcacacacacacacacacacacacacacacacacacacatacacatacacatacatatacatatacaaatacaaagagagagagagacagacagctcactgtgctgcccaggctggcctagaattcaccaccttcctatctcccacctcagccccccacttaactagcacaaccaccacacccacattaagacagtttgaactctgctgctcttgcaaagtccaggccagcagctggtggagcagaggctgtgtctcactgaaaacaaacatttcaaagtactctgggctctgtccgatggcagccacctccaaggaccttattcccgagcagcttccgccccttacgtgttaattatacgcatgcggctctcctgccaacgtaggaatttggtttattatattaggaaacatttggatgaaagaatctgctggtgctgaatacttagaattccttctgtggcttctgtcatagcatttgtagacatcagttgcccgtttatttttgttagaagggggagtccaagaaaagagtgcgattggtacttaccgcaaacataagagtcacaggtttccagtaccatcccggacatatgaagagtcccacatgggtttgccaaacctcagcggctactcctgtgcttcaccctgcggtagggccagcttgggccatgttagtctcttcacatgatgttgctgcccctccttgtggcctaatcatggatcaccgtgtggtagagaagtgagctctggaccatcaggctcagaagggtcactgcaagcaagcaagagaattgttctgcaaagatgcaggtaagcactggctgagtccgtagccttacaagatcctaaccctctgattctatcgggctgagcccttagctctccttacttacgtgagcctaaccttcctcctcactatgagaaagtgtgagttcttccaaccgtcctcacttagtaaaagcttctgccactgttctcagtgagctttccccaagggcgtgtctgtggatcactctgacttacgcctctcctcaggactgctatagttagcacctgaacctttgtttgtgttgagcttgcctaatgtctgtcttccctaccggactgtgagactcatgagggcaggaaccagacccgttatatttagaactgttatagtcaccacgctgtcagcacttaacaaatatcgtatgataaatatttgttttaaatgcagggtcagaattagttaaaaggcagtttgagctgctcttaaatttattctagtgcttcagcatttactgcctgtgttaatgacttttctccctgctctgactaaatatctgacaaaggcaatttaaggaaaactattatctggcttaggtttgaaggtacaatttatcaccaaggggagtcgtggcagcagcaccctgaggcaactggtcacattgcatccaaagtcaagaatcagagagaagaatcctagtggccatgctttctcccttctgtctggaactcaagactatggaataatggtgggtctgccttgctcagttaaacctttctggaaacatcctcacagacacccacaggggtatttttatggttttgctgagttcagtccatctgacaatgaagattagccatcacactatgtaagattgtttctcctttctgttttgttgtaaaatttgctgaatcctacctgtaagtacaatttatacataaatgtgaatttctgtcaggtatatgcccttgttcagcctccctcaaatgcccagcttccatttacacacctcagcctgcatttaacagtggctaattcaaatatgcatggtcctttccccattgcacactctgcccccattttttatttcatttgtaaatattctagtgtttagctttctaggaaaataacccataattaaataataccaatattaatagcactactactaataataaactaacaggcatcatggcacagacctataattctagctgcccaaaaagctgaggcaggaggatgcaagttcaagatttacttgggctatagagaaatttcaaaatcacccaacttgcaacttagtagcttagcaagaccctgtctcaaaaaggaaattagtcaaagactagagactagctcagttgtggtcaaagactagagactagctcagttgtagtcaaagactagagactagctcagttgtggtcaaagactagagactagctcagttgtgggtgttcacctagcatgcaagaggccctgggcacaacctcagaaacccagaaagcagaaacaattatcttgccatcactccttaagcatcctttgggaaagcatgactcagcatcctaagactctgagtcagtgtttccatcctccggatcggcttgcgatgtcttacagtgtctattttcatgtaatacggtcacttatttattaggagttgtaaaaatgctcatacgcccttgtgagttttctctaactatcgtgttctgtcaggtaaagtcacacgagagaggacaagtctgctttttatttccctttacaaagtggtttcaaagtaatgagttgttctctggtacagttcaaaaatgatgaaggaatgaatgaacatgcttgcttttattctattgttagtcttaccagtactatgttttaatatttttatgcattggcaacatttatttctgtttaaattgtgtctctgcctattggaagtcgaaacacatcaacttgagtgcattttccaggaccataattctctctgaaagctgccttactgaagatgtagacagttggtagagtgcttgcttagcatgtataggccctgggtttcatctttagtaccacataaatccctgggggactgtgccacatgcccatgcgaaggagccaggagaatcctaggttcgggatcatccgaggctgcatatcaagttgaaggccagcctgggatccatgagaccctctcaccacacaaaagtccctttctctaaggcaaggttcaccgtgaacatattctgcctcagacctcacatttggtggccagatgagggcattggatcccctggagctagggtttcaggtggctgtgagctgcctaacatgggtgctgggaatagaacactggccctctataataacagcaagagtacttaactgctgagccccctctccagccccagacctccctcacagcctttagtgggaattttagtcatcgcagtcttggtagacagggactggttattatttacagtgaacaaagatagaaagtgtatagtggtgttttttttttttaaagagaaaaatgaatccattctgcaactaactggcgttagggatagtggtggttttacctggcttcacagaccttacatcctctcctataagggaaaccctgggtccaagtcctgccaaggcattcccagttggctgtccttggcactgctcagagcctccggttaatcgcatccagatgtggtcagcagtgagcctactgatctgtttgccgtctcctttgtttgtcaggcatcacctacagcagactgtctgtagccagaccaccgaccgtttatacagtgaggtccagtcctttcattttcctttgcagttttagtaattctttttctcaattttgtaattcttcataaatacaaaagtgtctacatgattgccaagtcaaatctataaagcaaggaatctatatagctgaggtctggcatctccccattctctttttgcatgaaaaaaatcattttaaagtataatctattctttttcttcttgtgccgttatggtggtacacactaggagtgtagtgtcactggtgcttgtaatcccagcactcagaaggcagaggcaggaggatcaagagttccaggccagcctgggctacatagagagacctggctcaaaaaccaaaacaaacgaatgtaataaaatgaagcctgctggtttctcccacctcccctggggtgagctctcacacacactctgtcccctgggtaatgaccatgccgcctcctggcctgcctgcctgccacctgcccttgacctcattagcctgttctcagctccacagctactaccactgccatgtcactccccccctcaaaaggccccacaagatcccatctcataaagtgagggcccatgtcctttccactgcatgggtctctcccctcttgttcctcactcccatatctctaagccctctcaaaccttcttcctctcctcactgtattctagcccatggtttcctggctgctcacctcagggccttcacactgcctaccatgagcagaattccttctgataattctcagctcccacttgcctccctcaagtcctggctcattggcaccttgtctcagagccttccctttcctatgtctactgtttcatccacctgttgccttagcctccatacctcccaccatgctctgggaaacttactctaggtacactggtgttctccactaagaggggacttccataaaggtatggacccttaccactcttgtccccacagcctgtacagaataggtgctccttaggtattgagtgaatgaatgaagactttgtgaacttcaactgaaaaaaattactgaatcatgagccagagtcacataatcatctagagcctcgctgagtgcatgatttcaggagaacaagtctctctttccatttaccagagcatggcttcttcctctcccatgtctggtggctctggaagtaataatgctgatatcagtctgacaacccaaaggtaatagtaatggctcatggcatagttgttctctatgttaatatgagctctacaggaactcattaaatcatatcaatgcaacaacccagcaagggtggcatgatgtccccgttatagaaataaaccaacaaagcataaacagtttatttttaattgcctgtggaaatatttcataagtgacacagctggagccagagtctcggtggagttcgtggacccaggccttgagccagtgctctgcatgactaggaagacgatgggtttaccccatgtgtgtggtatccaacttagtactctctaccagtggtgacttatcacttgacatatggctggttgccctcaatcccactttaattgtgtctagtcttaaccactttacatttaaacaagagcacactgatgctgtgttggaccactctactgcagagctttgtaaacaggcctggcagagtggcaaagtgccattcaagtcgtcacacagttgtcctgtaagcccaaagggacaacctgtttccaggattccaagaaatggctcagaccctccagcagtgtcatccacgacttggattggactgctctaatctccaacaacaacacaccagaagacagctgcctacatacgtttgttcctttttgtcagaagaaatgcttgaaggtgcaattctgcaaagccagcttgcaaagtagaggtaggaatgttggaagtttataaatcatccttagctgcttacaagttcaggaccaacctgggctaagggagaccagtctcagatagatagatagatagatagatagatagatagatagatagatagatagatgaataattaaatgatgatatctttactgtgtgtatgaatgtcaacactatttttataatgttaccactcgttacttctgagctccatacatgttgatacataagtcatgaaacatcagttttacataatataccatgtttaattaaccactccttggctgatgaatatttttagggtgtgcccagtttctcatacttctaattgtgacgagggactgtatactccagtgcatctatttggatgctcctcagaaaagataacttgagggtgcaggatgtgatcatcgtctgtgaagctggtactcccagtatcccgcatgctccagcgtgccattcagacgcccaccactgagtttacggagccttcatcctgccttccatcaacatcggctcccactggccaactaaaagtggctgagctgagataggtggctgtgatttccgtttgtgtcgccagggttcttagtgaggttcattgctccttattgagcagcaggacacctgagctttcatatttggtgaaattcttggatgctcctttgtgtgctgagtggtctgtgtgattgatttgtggggttcaatataatccagtcagcactcttgttcgccaactctgtggcaaatgtttacccccccccatttgcagcagacttttaaccattttgtggtttattttgtcttgatgaaggtttagaatttcatggtggcttctgagacatctctcattttttgttgaactgattacaagtcttatggagtcttctagaagagatagggctgacttgtggtgtcctgatttatcggttgattactatttctgaaagaataaaaacttcccttgtgcatatttatagcattttccgtaaggaacaaagttcatttttatgtcatcgtgaaatgccgtgctatagaggtaatgattttgtgatatcgaataataaaacgttgatggtggtaaagccttataatcgattttaaagcaggagttgatttgcctctcgtttcttgctctttgcagttgtttgttcatggtgctgcttcctggaggatttttaatataagttattgggatctgatatctataattacactaagaatgaatttcatatgtttaaaagtattttaaataccatctctcttcagtctgagattacaacagactagagtcacttcaccaaccttgaaccccagctctcctcctgcctgccccatgggaacgtgcaagccactttaacttactagttggtttccttatctgtaagatgggctacctgctgtaaccgtgcagacctcctggggctgctctggcagttaacggaactctgcctcatcagagcaccctaagcagcaccccagtatggaagcaacacaccacagaggccatggtgttcgcccatctggtggcttcagagtctcataagtgagaacaagcttggtgccctctggaaggtggctttagttaaggtgcagccaccatcactgattgcccttctgtgccatcagtgaatgaggaaagtcagcctgtcggggacacagcactgctgggtgtggctgtcttcccagagagacccattgcactcttgcagccacccaagctcagtgctttccaacacagtaaatggaaaatgaaggaaaccctggcaagatatctgtggggtggtgtgtgtgtgagtgtgcgcgtacgtgcgtgcgtgcgtgcgtgcgtgcgtgtgcgtgcgtgcgtgtgtgtgtgtgtgtgtgtgtgtgtgtgtgtgtgtgtacaagcacagagagagagtgtgtgtgatctcaaaataaagtccttcacacatgtgactgtgttgtatagctggctgagtaagatgtgtttggcttcatttcttccactagtcgacaagctctgtgtaaccccaggcagtatttagcatcaggttggcggctattcttttcttcctttcttttcccatatatttgtttgtttattcattttacatcccaatctcagcctctcctccctcctctcttcccagctctacccttacacacccctccccctcctcttcaccctctccttctcagagaaggggaagccccccatctttttgttgttaactgacagctaataattgtatatcttagtttatttgtgataaagcgtgacaatattttctgaattgctgataattaaatcacagtaacaaatgtattacctcctgtgtttattttttatggattaaaacgattttagatctactttttatcagcttttttgtttgtttatttgtttattggcttttaaatacactctgccttagcatttccgtcctcactctgcaggaacacattccaccttgctgaaagcttgtagcttttgctctatactttgtttcccctctgctctgactctggatcctgcacttctggtctactcctgagcttgctatttttcagtttcatgtgaacaagatgagacagtacttgcttttctgcgccttgtttatctcacttaatacgctatcctctaggttcatccaccctgccacacatgacaggatttcctccctttaaaggctgagtctagtctaccgtctgtgtgtacattttcttcattcacctattgatggatacaggttgcttccacatcttggctcttgtgatcaatgctgtagtgggcatggatagcaaatatctcttcaatatactcatttccattccttgggaaagcagctgtgttgggggattgttcagggttattttccacaatggctgtcctgattcacattcatagtctagcactgggcaaaggtttcttttcctacaacctcactaacagctgtgatcttccttggtatagtaaccattctgatagagaaaggggccccactgctgttagcaaacatcttgtcatttgttttgcacagttcctggctgaagggtaccctggagccttgtaggaggcttcccttctgccagctcagtcaggcacgggactcagggtgagaagccaaatgtcagaatcagggaaccctcctcccaacttccgcttctatttcttcagctctgaggaagaaaccaccattcaagttggagtgcggttaacatcaaaaggagaacggtgagaatggagtctccccaaaattactctgagcatcacagctgcgttagaacaacggtcagcatgcatacaaaaggacctaaaccacattctcctcgtcccggccggccgtcaccctagagcaagcacagttcttccttcagctcctctcctgctcaccatggctcagctgaaatcattgcctatgagataaccactcacggtttcccatcaccacagtgttctcatggcctgccaaacgagaacttgcaggcctagcatgtaaagggaccagggaaggaggcagagtggggcctgctgttgaggctggctgcttctgtgttctctgcctgtgccaggctgcgtatggtcttcacttgccgtctttgaactgagagaacctcagctgtaagtgtgttggtgtgcgggatgcttccccagagggattcgctctgctctgacaacactttgtcaatctcgggtaaaatgagacctttctcttaaagagaaggttacagctaattttctgtaagagcagtaaagttaagaagaccttccctgagggtagaaaaaccacaaaacccaggagcagggactgtcttctttcttacagtatttactatccccacccccacccctgctgccttgccataccaggcatgaaggaactagtcacttaagcaagaaaactgtactccagatcttaagaacctcaattctcacccttatcagtgtctttttaaatgaataataccgtgaccttcagctttgtcctccattatgggaggttgcttcgcagagaccgctccactttcctaaattaaggcggctgctgtctgtattccgctcagctctagtgttagtattgtcccaagtgtgacatttatgctctttcgcttcttccttataaataaatatcaaaggaggaagaccagtgtgaactccacaaggaataataaactacaataatacgccattgattttgtgcaggatgtctaagtgtgtttttatgattgtgtatgtttatagctttttcacacaagtgacatgaattctgggcaattaaaaaggacgtggatttcaaaacatttaggaaggaaatctgctctctaacggctgtgcgttatagcaagttggagctcctggtgaaaactaggtttcagacctccaccttaagaaaccagagttattgccattttgtattgttttgcaatatgattaccctgagactacatttggggactttattttggctgctacgtggatgtaaccatttaatcaggagctgataaagagtcttttgcccacagtgtatcgtcctgtgagctcccacctactgcgattcctagactgcagcctgagtcctgtgagttggagctcaaccttctcctgtggagagaggagagcacaccccctccctgcccccagaggcagaggatacctgtgagccctacagagttgcctaggactgggggagggggtgttccatgccagcagccttccaaagatggttttgggacagtcattgttgttaggaattcagtgaggtgatagaccctgcatctctgggcacctctttcccctctttctgcccttcttagagcgttcccacggttcccttcgacttcctggtgtgtggtttaaattactcaataatgcataaataccaaagccttgaaaaataactaaagcattacagagaacttagtcacttagactcctcccaagacagatcgctattccatctcctctgtcactccttccccttccgagatcagtgtctgcacttccatacatccaagcacagtgtgaaggcaatagcactgggcagctagatagatctgttctttaaaggtcctgtcccctctaccagtactgtctgtgtgtctttctgcaaccagccttttacatccttcccatgatcgttaatctgccggatccacttggttcccattcattctcacggcatgcctgggctgtagtttgcagagctcttctcccaccccaggccactggctctcccggatttctgctgttagaaacctctgacatctgtgatttctctagctgtgcgcctgccggtgggattgctgggtcctagaatatgcagagctcaccatataagaaagtgatgtcaacagcaaaccgctccaaaatggaggtttccgtctgtattcccacctgtttccctgcatcctcaccaactcttaatattatttagacactgaaatgtcgctaccttccatagttgccaggcagcatgatttgcttccgtgtatacttctcttattactgaagagaccgagccacttttcatgtttatcagctattgatatttcctacctatgatgtacccactcgaacactttgcccatttgctgttgggatgtttatcctacttatccgtggaagttatgcagagtaagtgtatgtgtgagtgtgtgtgtgtgtgtgtgtgtgtgtgtgtggtatagcatatgtggggtgtgtgtgtgtggtgtagtggtgtagtatatgtggggtgtgtggtagagtgtggggtgttagtatttgtggaggggtgtatcctgcattatgatcccatgtcagctaggcaagtcctaacctcttcccagatcacatctcctgttttagattcatttatgctatctcttgtccccattgatcttgaccttggctgtctcttcccgttcttattcttttacccaaactgccttatgaacccatatggcaggatgatcctacgtgggtgatgcctccaaatggctgtgctcatttgaagcttggagctgcgactgcagtgatgggtgctggaagcacttcctgcagatacgggatgcatctgtcgccagcacccattttcccagcccagtggcagaacagccgggcattgtgttagactttccctgtgctgacatataaacaactgaaaggggaagggttcctttcctcatgatttgcatggattcaatgcaccgtccttggctcctttggttctgggcctgtagtgaggcagaatatggcgtccacaggagcatgcagaggagagcagcctgtgactgaggaagctaccttcaaaggtgtcccccccacctgtggcctatttcctcctgttagacctccatctcctaacatttccagacttttctcaaacaccagcagtagctggagaccaagtgttcagcatgtaattctcaagaggacatctcacattcaagccgccagaagtggcagatgcctcccatacctgtgtctgagtcgcaggctggaggtctgtaggaagggtgtgtggaaatgatgcatgcattcattatacacgggagtctttgtgtgcgtgcgtgtgtgtgcatgtgcgtgtgcgtgtgcgtgtgtgtgtgtgtgtgtgtgtgtgtgtgtgtgtgtgtgtgtgtgattgggaaggaaaaacctagctcagcaatttccttgctgcctgcttttcagaaactgttccacactcccagagctatattccaggtttttattgtgcactttaaattgggatatatctcaacagttgcatttaattgggtgattattaaaaaccacgagcaagttcagcggctcagccagaaaatgctctggtgtccagcttgaagacttgagtaagaccaacctcctctcgggttcactgtcctgctgggacctgcacagtaagggggagtaaagataggcctataggtagacatgtcctcacatggggtttggaaattaccttagcaaggcctgccctaatgacagcccccacccatgtcattaaattacctacttctaatcataaatgaactgaaaaagttcaacccttattacagtcaccgcagaaagctatttattgtcatatataaatacacagtggacagagtgcacacagttaggagggtactctcatactctgaggcagggatcttgttttggaggcacgcagagtaacaaaaggtaatgttatataacaggagttcctgggagaacggaaagaggaatcccctgcttcctgacagactcagctgcagggtcaaaagccagtctgggaatgcactctcccacacttgggagcacacggcacaggcagtggctggaacgtctgtggaatcccaagtccgtggttttggagtaagtgcgtgcatatcccactgacgggcaaattctgacatcagggcgtagcttccctagtcagcttcccatcaatcatcctgtggtgaggaaggaaggctgactttagcttccagagactccagtctgtggtcagctcactccaccgccctctgccctgagctgaggtgtcacagcagggcacatgtgcgcagctcattgaccatctcatggcattaggagacattttggagttctttcagacaggtcgtgtgagtaggtttttagttattggcttatacacaggcccatcttctcccctggttacactcccaaaggcaggcagttgtaacccagtctatgtgcagacctgctgggttttattgatttatatgtaaaataaaatgctcacacttttacttagtagttttctacctttaaatgtctagaaacatttcccctgggtcaggtgggagcttatacaataccatcaccccttccgtttcttcttcttcactatggttttcctatggagacatctgtctgaggccactgtcgtcctccgcccactgtaggtgactcgattgtttctggggggtgtgggatttgggatcctctttgtatttctatgactcagaaattgcagtgatataaaattgcacacctcacttgtttgggtgttttaaaaaaaaatccccttcagtaagaagctacttggtatctgttgtgtgctgtaaggggtagggagaagacgggccactgtcttctcatggctgttatttctgcctggaaagcagcattatgtttaccgtacagattggcaatagcataccctgctggaacttgctgtgtatccattgcaattcatcaatctgtggttttattatttggttacaattggaatttgaggatcctcatttttaaaccttagggagttccctcagagcctatgctgctctctgatttataaaatccttctcgcttgtgtttcatggctaatgttttctataggcaatctacatgttcacgttcactgatgcttccctctcgaatctccagtgtgtgtgtgtgtgtgtgtgtgtgtgtgtgtttgtgtaatatgaatttgaagtgtgtgtgcacgtgcgtgtgtgtgtgtgtgtgtgtgtgtgtgtttgtgtaatatgaatttgaagtgtgtgtgcgcgtgcgtgtgtgtgtgtgtgtgtgtgtgtgtgtgtgtgtgtttgtgtaatatgaatttgaagtgtgtgtgcgcgtgcgtgtgtgtgtgtgtgtgtgtgtgtgtgtgtttgtgtaatatgaatttgaagtgtgtgtgcgcgtgcgtgcgtgcgtgtgtgtgtgtgtgtgtgtgtgtttgtgtaatatgaatttgaagtgtgtgtgcacacgtgcgtgcgtgtgcgtgtgcgtgtgtgtgtgcgcgcgcgcgtgtgtatgtgtgtgtgttcttaacattctgagcatgcctttgggtgctcactgggatgatttggtccatttgattcatttctcctcctgtgcatcctctcttctcctttcctcacttcgcatggtgttttttgttttgttttgttttgttttgttttgtttttagtaggggctgaagactcttgcccatttcttaaagacaccaatgctcatggaagcactggtaatgtttagctcagaactgtaattggttatccaaactcatatcctctaagtggacttcttgtggagtaggaagtgcatcttgttaattggaggctcactggagtgctggagacatttgccgagtgagtgggtgaggggtgctgctttattgggaatcaagactacaggtgacagtatttcttgatgtgttcacagggaaaggcagcttaccctacaggacatctctctttcaggctgcagctctttgggagctgttaacattagcacctgccctgctgctgtggcggggagcactttcacacgaatgctgtcatgcctcattctgttaggatcagtctgaatgtcacttgggggaatttatccttggtgatgtgtcctagtcctcttctaatctgatctcagtgtgaaattatcatggaattatgtaaaaaaaatgtctctccaactgtctatctttttgtttcatttttgggcaatttaattctcaaaaggatacataaggtccaatgtgtaattatatatatgtatacacatatatacatgtatacatatgtacacatatatacatatatatgtacatacatatatataattttatacatttggccttaagggtcagtgtatatacatatattgtacaatgtataattctcttaaggtccaatgtataatttatgaagacagtaggtgcattttaaggctgagttttctcactatttttcctttcccagagcattagaactgtttcatatgttgacttaatcttttgaatgttcagaacctgagaaattagagtaagaaagtcagaccatgccccaccccttgcttgaaaggcagtatcacacagtgaattcaggtcccatggagcctggtcgctgggagtgcagctttgctcctgctagccgtgtggtcttaggcaagaaaccccagctcgccaggcctcaggtgttctatctacaaagtgctgtcatcacagtgtctcttcgagccgttaagatgataaaactgactgttacgaaacaccatgaattaccctcttccatggtgagtgcagtgagcgttggtgtgagttcagaaagccatcagacaaaataaaaataaggtttgttccatccgtcagcattttatccagtctaccctttccaaggaggaaagaccccttctataagcattactatattactatgtattgttaatgacagtgttagcacgctgtgattttggaaagcagttgagtagtgaggaaagagaagccttcctggctgcctcctggccctcaggacagcagccgtgacactgcccccatgctgatctccctgggtcaccatcacctaaagtctacaccggtactagaatctcatttcagacaaaatctacagtttttctccattcagctttaaattctgcctccaaactgtcctcttcccagcccacagggctgctagagagcttgcaaagccacagtcatcttgtgccggagctgtttactgggacacttccacaccattagcgacgcttgcaaccttattctagcccttcctaactcagtacccctgtgttctgtagtattccagcttcacaaacatctgtggcatatagaatatttccaagttgttagggacagactcctgatttaccatttctgttccatttttcagtctgttttattagtgtttggaaattcttccctttagcatcatctgcctgggttgtcaccatcgtcacatgccatggttctgttattaagactataagccattgaaaaggtttaatcagagtgttttgtagctgtgacttggctaatgggcttttgaaatttatgttaacttactgtttaatttagtcattctcctggctaatttatgtcatcttgatacgttggtaagttggaatcatctgggaagagagaacctccgttgagatagcatccctaacaaactgacctgtgggcaagcctttggtgcattttattgatggataattgatgtaggagggcccaagtaacagtgcgtcacccctaagcaggttgttcacagttgtgtaagaatgcaagctattataagaaagcaagctaagtaagccatgggaagaaagacagtaagcggagtctctctgttttctgctttggttcctgtctccaccttcctacctttcttgcttttcttcaaggtagactgtaattaggacatgaaaactaaaataagcccctttcccccaagagttgcctttggttgcggtattttatcacagcaatagaaacactaagtaccatagtcatcttgggctagataatgttgtccatgggagacttctgtgcacattgtcacaacctaatcttatatctacaagggtttgtcaacctcacaagtaaatgaggcacatgagtctaaaatcaaaatttccccattaccattagattgtcaatatagaccaggcctgggccacaccagatatggcaaccgtcaaaagagtgtcaaagatgcactcaccccacctcccactctggagtatcagtgccctgcaggcatccatgacagtggctctgtgggtgtctgaggatgtggtttcagttgggcaggccacactccaccaaacagcagcctgagtaatcaaaatgacttgttgtaaaagtgaagattaagtaggggtacattgtgaccggtcacaatttctaaacaaatcttcctgactgattgaggcctgacactgccaaagctgctgctattactgagcatgtgggaaaaacaagacaagacaagacaagacaatggggttcttgagtgcctgccttagcgttgctggatctctctagagtgtgatggacgcaggcagggatgctgctcttaagatgcgccctaccatgtaaccaacagctgctgctgtgctcagaccccaccggttctctagtgtttagcaaaacagagagggtcttttatccgtgttgagtggtgggtttcgctggctctccagacattatctttcataagtgcttagctgtggtaagtgggaaaagaatgtttcttttaaatttagcaaagagcatttctgtgcatatgtgctctgccacagccacacttaggtggtaatagaaataccatggaaaagcaaaccctaggctttcagcatcgctgtggaggccggaggcttccttctctcatccctcctggggagatggttaggagaatgagaggtttctccggtctgagttgataagcttgcttgctgtaaaatgtcaattcttttttaggctccggatcacactataataaatgtgaatgtaagcaagtgtgcgagtgctttctaagcagtcctcgcatctacaatcacatgcattcttttatctagtaaatgccagtgaaagctggggaggaggcagtgccatttgcatgatgtacactacccagtgtggagtccagccactgagcaggcttgcatagagagtcaaattcagtctcctggagcccactgtgaccttccctggattacaagaccggatgtctttgagatagatgtaagatgagatttctacagccttgctaggacagtctgggcatgctggggatgtcggtgtctttgctacttgaataggctcttgttctaggatgttattcctgtgttgtcctggttgaccaatgaccaaatcaatgaagacacattcaaccaattatggcaggatttatgcttttcaaaacatttgattatcgagtcaggtaatagggcacagggaagaaagatgatatagagatataaaatgtgtatggggcctgaggaagccttgagtgagggtgtgctattgacatgagtgcagccatatcaagggcctgatgcctcagacccatgggagcaaacaaagctgtccctagggtgaggctcagagaaacccttcctctggtctgagttcgaatgtcagcagtatgtgcagaagctctcaaccatagcatcctcctcctaagtgactgcatcctgagcctgtccaactgagactagctaaccccgcccactgtgctgcacacgtgtctgctgtagagttggtgctgctccagcagagcttggcccacctgatcccagcttgtctctgcgcctgtgcgcctgtgtgcctgtgtgcctgtgctttcttcactccctcatccccagacaaatttcctggaccacagcatgcaggacacagctggtagggtctgctcacctgggctcaaacccagctccacttttctagtggcaccaggcgagtactcaacccctccctgcctcagctccctcttgtgtgaacagggacaccaagaccttcccacaggcttgttaagtgaattcatgcatataaaaacaacttgtacttagcaggaagtaatgccaacttgtggagtttttattttaagcattaagaaaaatatttttacaattgaaatatcaaaagaggtggagacactggggaattctttggctttagaaggtgaatcccaggatagaatgtgtccgagctgacagtcagataccatctgacattaggacgcttctatccaggcatgtgcacatctgcttcacctgggggagatgcttaaaggtaccaagagtttgggtgttgtttttttttttaattataataaattaaattctcatcccttccttcctgtcttggtatgctgctttctcttatgctgtggtctgtaaatgtatttctcttcctaatttgactctgtttttagatctagctgtgaattctttattctctcacatagacatatgacagtgggggaggagagcatgcatatttcctaaattttcacaagaaatctgtcttgctatctccaaagagtggaaatttagggaggagcatccagtagtctcagcttcctccaaatcgtactcagtagcatgtccaatatgccacatacatcagtcagacatttgtcctgagcacagtgaaggcttcagaggagtgaaatggggcgggcttgtgtggacagaggggattccacatcctcgggtaactctgggagccatcttagttgatacttcacccacatccaccgtgttttgtcttataggcttctggaatccattttgtccgtagagtggatagaagcccctgaatcgtatttctggaggcagccctacccagccactgccaggaaagtatgtatccagcaattctggaacatgtggtttgaggttgaccagtgctccctctgtgatccggcagcagccaccacctgtccctgtctcttctccctgagtttccccagcacctgccaccctcaaccaaccactcacttcaaagtgctccattctagatctcttttcgggcttccatcctaagactgtacacttcccacaacaaaagtcttaagtttggttttgccaaattcactgtggaccctaagttgccaagacacatttttgccaaactcctagacaaacattcggagctaagctcatgtgctcacttcggcagcacatatactaaaattggaacagagctaagctcatcatgagtacatacctattaatatgcagccctcagtgggagtggccttgggtcacagctacctgatccctccctgactcgtcctcctgcaatttgggatatccagtttgtgttcgaggaggagaggagaggagcttggcctggtgtgctcagcactgtgagtgtgtgctttctgagcatggctaggccccagtgtctacccctacctactttatctcctctgggtgggtgggcacgtgagtacttggtgggtctggtttggtttcttgagacagggactcgctctgtagtccagatgggtctggaagtcagtatagagctcagatagatttcaagctcacagaagtcctcctttcccaaaccacctgagtgctgagattagaagtgggggagccaccatgccgagccatctctaccattcaggcctaactaacacaagtctgaggctgagaaaacccttgcctccccacagctcccactaataggtaaatcaggtacgtttactttaaattaccttaagaaataagggtactccttgcaacctgtttcaggataccaccttgtcccttggcgttccaaggccctagtacacgtccagccaggtcccctcctttctcctccattgttgcactttatgctcacacacagaacagtgcaccagcaaaggatgtgactagatcagagcagattagcaccagggaaaaatgcaatcctcgtagaagacaatacgtttgattccacacaagtgtcctttagcctttgcttgtaaggcggttccttgaagtggcttgtttttgcttttgagactcacactgtctttgggctgcttggaagtctgtgctcagccacaagcactcagacaaagaagccacggccatgttcttgtttacagaggttgccgtctgagaaattaatgtctgcttttactctgtaattagggaaatttagggccctactgctccaaaatcctgcatttgaggttgtatgttatctgggttttcatgatcatttgttggatttctgtcattaataacaggcataaacccagcaagcagcagggtgtgcgttacatttaatcaatttgctatctgtattcatgatgcacgtcctccattttgagtcatgaaaaattgagaggccattgcaaacagaaagagcaccatggattacaaatgatgtaacaagagcagaagcactattaattggtcaattgtgcttgtcagcccatttaaagtgattaaggcaggaagattagaaaggacatgagcgtgcttgggaacgagagcccaggaacactggggatccattcagtcctcagtgcccagaagaatgcaacagaaccgaatgctgtttattccaattttactcaacaaataatggatgagcacactccatgtgccttagactgtggtggacacagcagaaagcattgcagaggccttccgtgacctcaggatgacattccagtgtgttcagggcagatggctgtatagtgtgatccccttagtatacagccacaaaacccagcaggaggctgcaggtgcatacgtgacagcttgggagaagctgtcaacatctgaagggaagttagaatgaagatctaaggatgcaaagctttgggtccagcaccccagtctccacccaccactgaagaagaaagagaattcctttgtagatagcacctgatgacggatggttttacttgggaatgtcagattttacacaggtgagggagggaagcatgtggtagaaagtcctttggtttaatcttttctccagctggtggaaggccccgccctccctcatgatgctagacagtagcagcggcccacagtcagccacataatcatgagggcacatgcatgttcggagcattttagatataagcactccacaaatcctataagatattaagcacttttgttaaaaataggctttgtgttggagatctcggcccagcattaggctaaggaaagctctctgtcattaagatgtgagccaggagtcctatagattaagagtattaaaggcattcctaaggtatccctaacttggtttattgggatgtaacccctacataaattggcgtatgagggtttggtttggttttagttaattatggcttaggtgaaactcaacccactgggatgacttcccaggaccagaaagcccaccctgtcacttatcttgtatagacccttctgtcatagctttttggtttaagtaaacacacggcctcatttgccactgtcaccacatccttcacactcaaccagggcacacagatgagatgagacgagactggcctctgcttctgggacacactaccctttcccagctttcatctcacctcaggtcatctgaccttaccccgaatctctgctgtctgtgatccttagaaatgcagtcctcagtgccccagacaccttctcagagagcccctgcctccagggatctcagcgttgctttgctttgctctgcttcgatgacatgctatctgctaacttggttctcaggatcgtctgcactgcgttctgagtgctgtgaaccccagcatgtgttgctcaaggtcagctttgtgtccacatgcctacaacatacctgccccgtgaagggcctaaggaagctggaacggatcagtgaagaatctgaagaggaaggctgggagctctgctgttgtgtgctatttaaatgttttccagggacccacatagaagaaaaggatattcattctgaccaggtggcattaatatttgtgctgtttggcttcacccagtacaatctattggcatacatttctaaaccctatatgaggtcttctcaacacattgacttgcttcaactgactaaagtgctgtggcactgtctttacaagatgagaccaacccagatgaggcactgcaattgagtaacactgctgtatgggcttgacagtctaggacttgctttgtgcagagcatctgagcagtttggcgaaggaggcgctggggtgggatggtacaagattccaagtactttgtgcatataactcacagtggactcatgagtctgtcttgttcctggccccatagcaggtgccagagaagccaaatggagaaagccatgctgctcagctgctggcaagagctggcagtctttgggagttgttcctgtccccacccgtatgttagaatcattggaaccaaagtcccattttaggtcagctgagtcaggatctctgggacagggatttcacatctgtccagaatgttttaagttctaagctctgcttatgaacagccaggttgagacccacaggcctgtcggaagaatggctgcagaagaccaagaccacaaaccaaccaaagaattgctgtcgatggctggcatgtttctttggtgtgtaactgtacacagaaaacagggtttgtagtataccaaggctagtcacacagcagataagtggcccacttccctattgtctacctccaaagaactgattttaaaattgcacatagcattcatcaaacaattattttccttctatggggctaagttgagtggccatggctttcttttaagccaagtattaaatgttggacacttcatcaaataaagaatttttattaagacagagactttcctaattatggaagcaagtaggcccaaagtgtgggtaggtgatagctgaatttatgttcttcagttggccatgagttttgaagatgaagatgactgtgggcctctgtgatagtccagcatagtgataaactgtgatgtttgtgaacactgtctgcaatccaatatgttcttcacaaaagcaaagtagcatgtgctaagaagttccatacacaggaggtatagccctcctcagccaatgcttccatcttttgaattcacagtgtcacctgtgacatcaaggggagcggtgctggattgccagctattcatcccactggtcaccttgaaagccacaggtatcaagtggcaggaaccataattttagagaaacctcagatgtaaattattaaagaacacagcattttaccaaatacaaagatgacccaggagggccataggaggaatgccatgtgtatattgcagccccttgttgggagtggaagcagccatcaagctagggtcacaggaagacaacctcagtacatgtgatcctgaggaagacctgacagttggtggctctcgaggccatgctcctccctatgaggtacagttctgagtattcagctgtctgtatggtgcagtcacacaggagcttaaaacctgcctgtaccgaagatgcttgggcagaaagtgggatgaagatggggctgagtatatgtgtgcttttggaagaactctggagtgaatctcatgtataacagggctaggaagtgctgatgtattccaggtaaatgactgaaatagataacaagggatatcacctgggacacacactcgacgaatcctagtatcacaaagggcaaggacccttagtggacttcaggggacaagatggacccaggcccaagcaaacatcccatccctttgttgacttcttgatccctagccctgcaggaattacacaaagcaggaccaggtagttgtggagtgaggactttatgtttctgcacacacttggctccctggtccttcctgagtcagaagctaaacatgtgcagctcaatcgcaagttcacctgcaggggagcttgagagcttccaggtttcatgtgctgtggtctgggctcactgcaacgttccttcacgtgctgtggtctgggatcattgcaacattccatgaagctttgtgtgtatcccaaaccacttgtgtgatatcatagctccatcttctccagagctctgaaacagatccataagggaggatggagcagccatgaggagaactgggaccacactccagggcttgtcctgacctggggtagctatagctatggagcagatatcccacccaagctgggaaggaagaatagagggacatatttgtgttccatgtgggttagcgtctcacaaccttgggctccgggaccagtgccccgaggagctgcctgtaggcagtaacacaccacacacaggctgagagtaagtacagagcagatcaagggcaccacggtctgctaggacagactatgtctgctctaaaagccaaacatgcctccaaaacccatcagctagcatctggatttccatgaacacagtacaccgtgggcttctacctcctctcccatgaggccatggtcctgtcaaggccctcctccacttcagtgtcatttccttttttcctctgatttttacttctcattaccaccagaggggaagtctagaacgtgagggggagaaagatatggtgaaggaaatgaaacaagaaggccctctttgtccttaactgcaaggggagatgctggtggtggtcagagacaagacagtctcctagcctcggggcctcagaatgggaggtggcctcaagggtgctcttgtatggctgtgcctgcccattgactttccttctgtctactgtggaggccattgatactgaagcagccctgacatatccttaggtgctcgtgttggaaagtcacaaggacataatctctatgactttacggacaaagtttccaagaccaacttgtcttaactttgcagcaaaggagggagttgcccatgatgtgacaccttcctacttagctgtcgaggagctgggggactggatgtgttctctgtcggccagcccctgttagaggaggtccttctccagctagtcctctccctctccctagcctgctgccagctccagacacatgaaggctggcattatggagcttatccttgcccttgctcttggtagtcgttacttttttatcactgtagaacaggtttctcttgggtcctggtttcaggggtatcagtacattatggtgaggggctatggtggaagtttgcatagtggtgggccagaaactggaaagagggcattcaggaaggactcaggtgacatatagtcctgaacccattccccagtgacatgcttcctgtatccaggccccacttcctacttgccaccacgtcccggtaacagcatcatgttgggacacatggtgttctaatcatctctggaaattcctctcatacatgcagtcatgctccactagtcctccaggcatctcttcacccagtcagctagacaagatcagccatcatcaaacctgaggaagtggctcacttgataaaataccacacaagcatgagggcttgagtttaatccccagaacccaggagaagcagcagctgaagaggcaaggaggaaggggaggagaaaggaaagaagcagcagctctatgtacctgtagtcctggggctaaggacgcagaggcagaggcagaggagcagagaggcagagaggcagagaggcagaggcagctctgtgtacctgtagtcctggggctaaggaggcagaggcagaggcaactctgtgtacctgtagtccttgggctaaggaggcagaggcaggaggatctctggggcttcctgtcctgacagtcttcaaacatccgtgggtttcaggctcagagagaaaacatgtttataaagtagagtagtcgaataataaacctgacatgaacacatacatatatactgcacattcactcgaacacacacacacacacacacacagggagagggggaggcagctgtcatttactcagactatagactgagttcaggttttaaagaggaagaagacagatgtggggtatgatctagttcggtttctgttgctgtgatcaacccacaacagaatcacaaagaaacttggaaagggaaggattttttgagctcacagctcaggtcactctccatccccgagtaaaggtggggacagaaacagaggccatggaaaaatgcgcctagtcctcatggcttgctcagcctgattgcttgcctttttgaaggtgatttatttttattttctgtgtatgcgtttgcccaacatggatgtgtgcgcatcatatgcatgtagtgcccaaagaggccaagaggaaacattagcttcttccctgtaatcgacttgcaggacttgcaggtggttgtgagataccatctgggttctgggaactgaacctgagtcttcagagacagcagctgagccagctctccagtcccttggcctgcttctttatacaacccaggaccacctgcccacggtggactgggccttcccacatcagtcatgactcaaggaaatgctccctgggcctgcctacagaccagtgtgatggcagtggtttttaaatggaggtcccatatgactctaccttatgtcaagatgacaaactctagctgtccagaaaaaaaaaaaaaaacaacaacaaaaggctacttactacctctctctaagagaggaacctacagaaggcccctgcctctctctaagaagtgctgcttgttcgaacccatttgaacattttttttttgtcttttactcctacatagttaccaagcatgtcctgaagatgaagatactctcagcctaacgtctccaagcaaatattgattcagcagtatccccaggtaggtgcttttgcttaaaaggggctttcctgttagcccttggcatttattgtgcttataagctgacaagacacatagatctaaacccacaggagccttcagagcaactgttggtaccgccctctgctaggcaggaaagaaggagccagagaggataactgatccaccaaggtcaccctgccagtgagcatcaaaggcaattctagtccacatagttaccatgacattacaggatgtttgtctagaacttaagccccaaatactatgcttaagttctagaccacacacatgtgtgcacacacacaagcacacgcgtgcacacatacaaacacaatgttcatttctccggaaatcctgaacacttttctaacttcaaagggtagcaacctagacgtgctgataacccaccttggcctctgccgtgggattctgccaagcagcccacttggacgtcacccttaatttaagccagcgtgatggattgtggtgcggtctttcttaactgtattattactcctgcttcattccctgagcacagaatgagggattctctctactgcgcctgggatgcatcctccttgctgggtataactggcctatttgctcagtaaaagcagtggggaaacaagtgtccttgaagcccagacataacagaattcctagctgccctccacccctgagtctgcagatccaggtcccccagacctgctcactttactcttataccctgctatgctgcagtgtaaactgccttcctgtctcaactgcagaagccctcctctggccgtatgtggcacagtgtcttttgccaaggcctgtgctccacccagacccctggaatctagttgcagggcattcaccatgtttattggcatcctaggtgtgtgtgggctctgcagcttgccttcaaccagtccccagctgctctttttctcctctcatatgatgctccccaccctcaagggccaacctggctagctgtgtttacttcaggtgagcctggctcccctatgtggcttccggtcctgcccatcctccacctgtatcccctttctacacaggttaggcccatatacccctgaaaatggcttagagtgcaggctctgtgtctagcattagagccttgtgtttgcccgatacctgtcctttaatggcatgcagccccagtgccttcatataattgttgctcacaatgctgtccagtggctgtgtccagagtaaacagtaagagagcaaggaacttgctgggttaggatcagatccaaacaggggctgaggctttctatcccaagctgctgccctcaccggggtcctcacccctgctatcctcaaggaacactgagaagatgaccaacccaccccagccttctctgcatctgtaccacagtacacagatccatgcatgctttcactcagcttcaacatctccttatccgccagatctttactgagcataagtatccccacagcaacacagagtggaacagacaagaggctgccctctggttacaggaagctgaccacatcaaatcacagacaagctatgtagccagaggttagaggtgcaggggacagagctccccatcagctacaacaaccatttcccttcctagcagagtaccagtggcattaagatatcaccagcttggctacccctaaacctacaagatggtatatatacccctacccataggtcctaggcaggcttcacagaacaaagggtccttacagtgcccaccccacccccacagtgcctcaagaggaaatgtggtactttctcaagccaatgaggcaaaggtaaactgctagagagtaaaagcatttctagggatagtatctgagatttaaagagaaagccataagaaaggctggtctctgggtgtggtggcgcacgcctttaatcctagcactcgggaggcagaggcaggtggatttctgagttcgaggccagcctggtctacaaagtgagttctaggacagccagggctatacagagaaatcctgtctcggaaaaaaaaaaaaaaaaacaaacaaacaaaggaaggaaggaaggaaggagagagagagagagagagagacagaaaaagaaaaagaaaaagaaaaaagaaaaagaaaaaagaaaaagaaaggctggtctcaacgcacagtggtggtgcacgcctttaatcccagcacttgggaggcaaaggcaggaggatttctgagttcaaggccagactagtctacagagtaagttccaagacagccagggctacacagagaaaccctgtcttgggggaaaaaaaaaggaaggaaggaaggaaggagggagggagggagggagggagggagggagggagggaggaaggaaggaaggaaggaaggaaggaaggaaggaaggaaggaaggaaggaaggaaggaaggaaggaagagaaaggctggtctctccttcctcagttttgtctcttctaaaagtgatatctagagcattgtaacccacaggcaaagccacaccatatatcagtgaacagagaaacaactgcccttctccgggcccctgtctgagaagctggagcatcagccctggagctctccggagcagtttccttgctcactgtccccagctgaacacaggttggtcagatctactcccgttcccactctgcccccatctctcccctctgtgcttgccaagcagtaagtagactgctcatatttgtggaatgagtagtgtgttggtgtccccagtagcagacctggcaatgagacttcatgtgccatatgaagggagtgttccaggggacaaaaataagggaatagagataggacaagggtgggtgagggggcagagcactggagttgggctgtccccctcacctccactcctaaacgtcagactgcagggttcttcaaggaacacagaaactcaggcatgtgtgccgaagcaatggcaggaagcaatgaggacctgggtggggtgcctgtgtctgtcagtacaactgtctggctttctactgctgtgatgaaatactgtgaccaaaagccacttgggtaggaaagaggttattttacattacagcttctaagtccaccactgtgggaaagccagggcagaaacctagagcagaaaccaaggaaacactgcctactggcctgttctcatggtttgcccatcctgttttcttataccatctaggaccacttacccatgggtgccactgcccacagtgagatggaccctcccacatcaattatcagtcaagaaaatgtcccacagaccaattctgtggagggacattttttttcagttgatggtctcttcccaactgattctagctgtgttgagatgacataaatagtagccagcataccatccaaacagacagcaaagccaaggcagccttcaggcctgctgtcacttcatcctgtccttcctaggaccagaggggatactgcctgctcaggaaagccaagaggagcctgcttctcctgaaatgtaaaaagtacactgtgcatatggaaagcattattgtgtttcactgtgcatcgccagattcttcttgcaaaacattgaagcttagctcataatttggtgataaaatattgattatttatccacagccgcatgcagaggtccaaagcacgtaaacaggatacccaccctgcattatcttatattttaagtcaatatgaagatggacattctacccctgagaccaatttcgatcaaatacttttgtcaataaaaagatactaatgtc

SEQ ID NO: 44 - DNA, 25054 bp, Mus musculus
agtctcgctgcagtacgtcactgataaaggtctcgtaccgcagcactttctcccccaccgtatccaaggcccgccgtttcgggggcgtcgccatgacgggcacctgggggagtaaaggggggggcacgttgagcgctctatttaaacttcacaaaattctctccagccactcaacgttggggatgacttctttcggctcgagctacggagttgcttctgcccaacccgattttggaactcgttcactcaccggtacaggagtacggcgtttaccgtagggccaccggcaataactgttagtatgagccgcggcttccgggtggcgcggatggatgatgtaatttccagcaagggagccaaccaaatcgatgggaggggcggtccggcgtgtgggaagatgcacttaggggaagggctgcaggcggggcctgagtgaatccttggaggtagcaggatcctatggatctagatgggcctggcacgccgcggtctgccagcaggcggatcgtcgcgagctggcgggagactggtttgggtgacgttcaatgagatttggcgggttctgagggagggtggacttacaggaaggtagggagagggagttaagtgtttataattagtaatttgaagtgtgtgtgtgtgtgcgcgcgcgcgttggtactgaacttataggcagttgtgagctaccatgatgtgggtgctgataatggagtttacattctctgcaagttttatgtgtttttaactgatgagccatttctgtattcccccctccttactcttacatttgttttcctattttatgtgttttgtctgcatgtttatggactacatgcgtgcattgcccacaaaggccagaagaagttgtgggattccctggaactggagcaaccaacagtttgtgtgcaccatgtgggtaatgggaatcgaacctgggtcctctataagactggccagtgctcttaactactgaggtatctatatagtccctatttttttcttttagaaacatttctattctttgagagtttcatagatgtatgcaatatattttcatcatctccactcccttttccctccaactcctcctagactcctcctaccacattttcctccaatttcatattctctttaaaacaaacaaaccaaatcaaaaccaaaagaactcactgagaccacttaagcatttaataattttaaaagcacaagagtgcctatagaccagcaaggattatggtactaatctataaggaaggcagtatatcctgtggggatctgtttgaaaaaaatatatgttgcacacattgtttggttttcaccctccataaagggaatgaataagagcacataaaaatgtttaaatggagacaaattttaagaaatttatcttgaatgaatttctgcttggtggcatgcagtccatgatgagggctacagagaaaccttgtcccccaaaccaaaaccaaaatttgatgttacatgtatttaaaagtaaatttgatgtgcttaaagcagatattaggaagctatataatattagttaatctttatttgctaaggagaacagtttagatagactagagttgggtctgttaagtttattaacatatttcatgtaatttttctttaatttaaaagatacttttaggttatccaaatggctcactggttaaacggtgctaaccagtctgacagcctgagttcactctgcacggcggcttgtaggttactgctgttcctgacatagagatagcaaacttcttttttacaatgggaggtagttactaaagaagattcataactggttcaactgcaaggaatgtgtctgttgctgtggtagagctgctcaaggtggtagaaagtaataatcacctatattattctaagtcttagagaatagaaggcaaagtgggaagaatgtgaaagctgcaggaagggagcattgtctcacgatttacactgttgggcatgaccattgctattttgaataagagcagatgtgatcactattcatcaaacatttaccccttccatacatagttctgagcattttacatatatcaactcattgtgttcctctgaggtgtctgactgtgtagcacagttacacatagtctggactgctttccccatgtccagactagaaagaaatataaccagggtttcattttcacacttcaatcttggtccatctagagtatggatatatgtaataaggtatgggcccaatttaatatttatctacagctttatttttcagttagagtcttgtcatatagccaggctggcattgaattcactgtctagtccatgctggccttgaacttaaaatcttttaccctagcctttcaacttctggcattgcagatgtaaggcaccaagtcaaacttaatctgtttgcaaacgtctgtgtttaacgggtagaatgatgtctagatatatagccacagaatatgtttgaaaaaattttacatatataattaaggatcttgaggtggggggtcattctgagttaaacaaatggccccaaaccaatgagaatttttttttttttttggtttttcgagacagggtttctctgtgtagtcctggctgtcctggaactcactttgtagaccaggctggccttgaacttagaaatccgcctgcctctgcctcccaagggctgggattaaaggcatgtgccaccactgcccagcgagaaatattcttataaaacaaagagaaagacataggagatggtgtgaaaactgaaaactggcagacattagggtcattgttattatttatatacgagatgtcttctctaaaggctcatatgcgttatggttgatccatcgcaggtgacaatattgagaagtgattgatcatgatgacttcttcaatggattaattcattgataagtttatagctgaattgctcataagaaatggagcctacttggatgaagtaacaccccaagggcatgtgtgtgtgtgtgtgtttataaacaaacacacacacacacacacacacacacacacacacatatattcctatatccatttttttctgttttttggctgccatgagataagtggcttttctccatgatgtccttctgccattactttctgccctgctaagaggcctaaaaggggggaaaaaaaaagaccccaaccaagctgatcttggaaatgcgatatctgaaatttttttttttttttttggttttctgagacaggatttctctgtatagccctggctgtcctggaactcaactttgtagaccaggctggcctcgaactcacaaatctgtctgcctcagtctcccgagtctaggattaaaggtgtacgccaccacacccggctaggatgtctaaaactttgtgatcataaaaaagtccttcctcatttgttcttttgttaagtctagtcacagcgatgaaaatgatactagcatggtaatatgtttataaattaaagggttgaggccataacttagtggtagaatgtttacctagcttgcatgatgccctggacttgatttttggaacttcaaaaatacaaactgaggcatatcaatgattgctgctgtccttagagaaggtaggaaagaggcatagaatagattttgagtagaaagggaatagaatacattttcttcaaaaaggcttggctctatgatctcatgagtttggacttacagtctccagaactataacagaatagaatttattggtttaaaccagccagtctgtggtaactttttactgctctcttaggaaatgagcatatttatttgaaaattcacctttgtccatcatgatttgagatggcattttagttagacacagacttctttactgacattttacacggtttcaatggcttatatattcatgggtcatgagtgcatggtcttactgttttggttggttttgtttttgaaatatagtattgctatttagtatatataggctatttttgaacttaatatgtagttgaggttttgaactagctaccctcctttgcctttttaaaaaaaaaattttgttttgttttgttttccttttttattagatattcattcacatttcaaatgctatcccctttaattgtttagtcccctgtacccttccccctccccctgctccccaacccactcactcccagcttcctggccctggcattcccttaactgtggcatataatatttgcaagaccaagggcctctcctcccattgatagccgactaggtcatcctctgctacatatgcagctagagacacgagctctgggggtactggttagttcacattgttgttccttctatgggttgcagacccctttagctccttaggtactttctctaactccttcattggggaccctgtgttccatccaatagatgactgtgagcatccacttctgtgtttgccaggcactggcatagtctcacaagcgacagctatatcagggtcctgtcagcaaaatcttgctggcatctgcaatagtgtctgggtttggtggttgttcatgggatggattcccatgggggcagtctctggatggtccttccttccatctcagctccaaactttgtctctgtaactccttctatggatattttgttgccccttctaagaaggaatgaaatatccacactttggtcttccttcttgagtttcttgtgttttgcaaattgtatcttgggtattctaagtttctgggctaatatccacttatcagtgagtgcatatcatgtgtgttcttttgtgattgggttacctcacttaggatgatatcctccagatacatccatttgcctaagaatttcataaattcattctttttaatagctgagtagtactccattgtgtaaatgtaccagattttctgtatccactcctctgttgaggggcatctgggttctttctagcttctggctattataaattagactgctatgaacatagtgagcatgttactacaagttggaatatcttctgggtatatgcccaggagtgatattgctggatcttccagtagtactatgttcaattttctgaggaactgccaaactgatttccagagtggttgtacaagcctgcaatcccaccagcaatgggggagtgtccctctttctccacatcctcaccagcatctgctgtcacctaagtttttgatcttagccattctgactggtgtgagatggaatctcagggttgttttgatttgcatttctctggtgattaaggatgttgaacatttttttcaggtgcttctcttctcagccattcagtattcttcagttgagaattctttgcttagctctgtaccccaattttttttttttgtttttttgagacagggtttctctgtgtagccctggctgtcctggaactcaactttgtagacctggctggcctcaaactcagaaatccgcctgcctctgcctccccagtgctgggattaaaggcgtgcaccaccacacccggctttgtaacccaatttttaataggttatttggttttcttgaatccaccttcttgagttttttatatatattggatattagtcccctatcggatttaggattggtaaagatcttttcctaatctgttggtagccttcttttcttactgacagtgtcctttgccttacagaagatttgcaattttatgaggtcccatttgtcgcttcttgatcttacagcacaagccattgctgttctattcaggaattttccccctgtgcccatatcttcaaagctttccccactttctcctctataagtttcactgtctctggttttatgtggcgttccttgatccacttagacttgagctttgtggcccatgcctaaacatattaaggtcctttgccttttgaatggtgaaatttcaagtatatgtcaccatacccagcttccaaactacttaaattatagaagctttatagaatgttcatatatttcatgaagttaatctctgccattgatcttcatcttttttaggggttcatagttattctcttgtgtttatttttcttttgcattttaggtgcatttctttcggaattgattcacataactattatgctatactgtttgaagtatttattagaaaaacatcagaaagaggtgagtaaccatctgttgggctgtgggagattgctctcaatttttcacttttctctgtagccataccttttgcccttaatgttttgattttggggtgatttgctttattaatagcaaagttattaaaaaaggagtagaggagatacggtatttttgagtctactccttggatttgttgtctggcttgccctcaatctctttgcatcattagaagaagacatgtgtcactgatatgtaccaccatgccttgcttgaagcatattctcttgaattaaagagtatgtctgtggggtcaatgcaggcagtaatccacaaagagatgagaatgaaagcttcgttctgattgacttcatcaacctggattagatttggggaatctaatggcaggtggctcattgtaagcatatttcaaacactgcaatttggaaaaaggtttccaggcaacaatcagcccaatccagatgcacagtaaagcttaaggtgtgactatatggaaactcatttgcaaagtatttgtgatcatgagagtgagttctatagctaaaaggcctagaatctattgtggtctctgaccaagatagcatagaggtcagcagggtataaaattcatgtggcatcctccttaaggataggttctagtatctgggaactagagaagaagtctgggataaacattctgggggttagggtgaggtcagcctccatagatagcaaaagctcactacatcattaacagtatccactcccaggcttctgggcaggaaaacaggtgttttatcttctcagttgagaagagcccgtatgtgtttaacattcctagtctccctagtgatctgtgggcataaagacatttgtacccctaacatcttgtcccttttttttttttttttttcgagacagggtttctctgtatagccctggctgtcctggaactcactttgtagaccaggctggccttgaactcagaaatccacctgcctctgcctcccgagtgctgggattaaaggcgtgtgccaccatgctcggctcccttctaatttttaaatagaaaaatagccaagatagaggccatgatagaatccattgcctccatggctggtctaaacagtataggtaaacctaagagaattataagaagacctaactgagcatgtgcccttcttaccagttggggcatcttctggatatatgcccaggacgctgacaccattgcatacactagcaagattttatcgaaaggacccagatgtagctgtctcttgtgagactatgccgggtcctagcaaacacagaagtggatgctcacagtcagctaatggatggatcacagggctcccagtggaggagctagagaaagtacccaaggagctaaagggatctgcaaccctataggcggaacaacataatgaactaaccagtatcccggagctcttgactctagctgcatatgtatcaaaagatggcctagtcgaccatcactggaaagagaggcccattggacatgcaaactttatatgccccagtacaggggaacgccagggccaaaaagggggagtgggtgggtcggggagtgggggtgggtgggtatgggggacttttggtatagcattggaaatgtaaatgagataaatacctaataaaaaatggaaaaaaaaaagacctaactgagaatcaagaaaagaggaaagacatcctcacttcacccatctcttaattcatttctgctaataattttgttgtgaacaaatgagtaaatatggtctattccacataaacttttatgaacaacccttagcatgaggagacagtatcataaacacaggtgtgttttttatctcccctgacaaaaggcatttggattatgtattgacaagagttaacatgcaatacagttaattaaatataacagcatcagtgtttcctcatcctgttgactcaaagtcctgatgtcctcccaggttatcagtatactctccctcttgggacatggcctcttgatgggtttgtcatctgcctttagatgttttattatctggtggccccttgctgtcttagtgtcttagttagatgcatcagatcaggagccatctgggacttcattcattttgtgaaaagacacaagcataatcttgcttgatgttaacattgggtctcttcattgattcgtttctagattgtttaatgtataatttaggttgtctcctttagggcaaaatgctttggggcagtaaacaaagcattatcctttagtatgtgatgatttaagtgggtgcatagaatatcctctgtttattagaatttgccagtttagtatttaatggtgtcattccacaagagcttgaccctgtggatactaagggttttcatgattaatattaaaaaattttcaaataatttgctagcataagtaggacaattactataatttagttgcaatggattttagaaaggatatgcctaaagggctatttgttaaagttaaggtccagatgtgatagagtggtgtttttggagctttcaaggccttatgccatacctagggctgtgttctgcagccagtttgttagggagaggcattgtgcatgcatgtactgtactttgaggacatacctgatagcagagaatgtccaagacacagacagacacccatattctcagatgtcaagctgatatccattcactactaattatgcgttagaagtttggaatactatataaaatttgtctttaagctgtacaaaataatgcttttaatagaggataggctcctgtgagcctcttttagctatttttctaggcaaattctgatcttttatcagacaaacaaacaaacaaacttcacttaattaacagtggtcattaacttttttgttgttgttgttgtttttcgagacagggtttctctatatatcccttgctgtcctggaactcactctgtagaccaggctggccttgaactcagaaatccgcctgcctctgcctcccaagtgctgggatcaaaggcgtgcgccaccacgcccagcggtcattaacttttaaagatttaaagttaaggctttttatttaagattttggatctttaaaatttaggacaattttaattatgagcttcttttaagaagtctattttattaggtaacttaaaagtacctgagaaataatagaaaatcctgaagtagaaaacaattggattttcccatataagcatgaaaatttatattgagtagatattgtatatgaagcaaaattgtgaacaataccaaaaaataacagtttcatggatggagaagttgctggaaggctctagtttttactatatttcatatgcagtttgatataacagattctcaggctataaccaagaataattttaggtgaaaaacttcaaaattatttagttcttactgagtgcattttttggttttatttctctttggcctccaaggaaattagagaaacatgtaattatgtttgcagtttttggtcactaaattacctagaagaaatatttttgaaccatttcttgattccaatttacttgtattttgttattttgtaaatctatcccaatcctgtttacattgttattttttaaatttggttttgtttatgttgtataaaatataaaaaaatggattcttagtaatcacaaatataaaggaatcagggtggtttgggtttttagtgaccaaaacacctaaattgaggaaaaaaaattcatttttgtcttgttttatgtttgagacaaggactctttatgtagtcctgactgttgtggaacttgctctgtagatagtttatttatatttcaaatgttttctcctttccaggtttccccttcacaaactctccatcccatcccccctccccctgtctctatgagggtgctctcctacccacccacccactcctgtcttcctgccttggcattccccacactggggcatcaaacacactcaggcctgagggcctctcctcccactgatgtctgacaaggccatcctctgccacatatgcatccagagccatgggtccttccatgtgtattctttggtttgtggtccagtcccaggagctctaggaggtctggcctgttgatactgttgcttcctccttggggctgcaaaccccctcagctccttcagtccttctccaacttctccatctgagaccctccgtgttaagtctgttggttggctttgagcatcgcctctttatttgtcagactctggcagcctctcaggagacagccatatcaggcttccatcagtaagctcttcccagcatccacaatagcttccaggtttggtagctgtatatgggatggatctgcaggtggggcagtccctggatggcctttccttcagtctctgctccatactttgtctccatatttcctcctgtgaatattttgttcccccttctaagaagcactgaagcattcacactttggtcttccttcttcttaggcttcatatggtctgtgaattgaatcttgggtattccgaacttttgggctaatatccacttatcagtgagtacgtatcatgtgtgttcttttgtgactgagtttcctcactcaggatgatattttcaagttccatccatttgcctgccaatttcataaagtcattatttttaatagctgagtagtactccattgtgtaaatgtaccacattttctgtatccattcctttgttgagggacatctgggttctttccagcttctggctattataaatatggctgctatgaccatagtggagcatgtgcccttattacatgttggatcatcttttgggtataggcccagagtggtatagctgggtcctcaggttgtactgtgttcagttttctgaggaaccaccagattgatttccagagtggttgtaccagcttgcaaatgccaccaacaatggaggagtgttcctctttctccacatcctcaccagcatctgctgtcacctgagtttttgatcttagccattctgactggtatgaggtggaatctcagggttgttttgatttgcatttccctgatgactaaagatgttgaatatttctttaggtgcatcttggatattcgatatccatcagttgaaaattctctgtttgcttcatcctttcctctcagctccaaatattgtgtctaactccatccatgggtattttgttcccaattctaagaaggagcaaggtatccacactttggtcttccttttgagtttcatgtgttttgcaaattgtatcttgggtatcctaagtttctgggctaatatccacttatcagtgagtacatatcatgtgtgttcttttgtgattgggttacctcacttaggatgatatcctccagatccatccatttgcctaggaattccataaattcattgtttttaatagctccataaattcattgtttttaaccagcatctgctatcacctgaatttttgatcttagccattctgactggtgtgaggtagaatctcagggttgttttgacttgcatttccctgatgattaaggatgttgaacattatttcagttgcttctcagccatttgatatttatcagtcaagaattctttgtttagcaccgtgccccatttttaaatggggttatttgattttctggagtccatcttcttgagttctttatatattttggatattagtcccctgtctgatttaggattggtaaagatcctttcctaatctgttggtggcctttttgtcttattgacagtgtcttttgccaccaaacgcagacactattgcacacgcaagcaagattttgctgaaaggaccctgatatagctgtctctcatgaggctatgccagtgcctggcaaacacagaagtggatgctcacagtcagctattggatggaacacagggtccccaatggaggagctagagaaagtacccaaggagctgaaggggtctgcaactgtataggtggaactacaatacgaactaaccagttaccccagagctcatgtctctagctgcatatgtagtagaagatgacttagtcgaccatcattggcagagaggccctttggtctcgcaaactttatatgtcccagtacaggggaacaccagagccaagaagtgggagtgggtgggtaggggagcagggtggggggagggtataggggaatttcaggatagcatttgaaatgtaaatgaagaaaatacctaataaaaaattggaaaaaaagagaatattctctgtttagctctgttctccattttaaaatagggttatttggttctctggaatctaacttcttgagttttttaaatatatattggatattagccctctatcggatgtaggattggtaaagatctttccccaatctgttggttgctgttttgtcctattgacagtgtcctttgccttacagaagctttgcaattttatgaggtcccgtttgtcaattcttgatcttagagcataagctattgatgttctctgttcaggaagtcttcccttgtgcacatgtgcgggaggttcttccctactttctcttctgttagattcagtgtctctggttttatgtggaggttcttgatccacttgaacttgagctttgtacaaggagataagaatagatcattttgcatttttctacatgttaaacgccagttgaaccagcaccatttgttgaaaatgctgtcttttttccactggatggttttagctcctttgtcaaagatcaagtgaccatcggtgtgtgggttcatttctgggtcttcaattttattccattgatctacctgcctgtcactgtaccagtaccatacagtttttatcgaaattactctgtagtacagcttgaggtcagggatggtgattcccttagaagttcgtttattgttgagaatagttttcactatcctgggttttttgttattccaaatgaatttgagaaatgctctttctaactctataaagaattgagttggaattttgatggggattccattgaatctgtagattgctttcaacaggatagccatttttactatattaatcctgccaatccttgagcatgggagatctctccatcttttgaggtcttcttcaatttctttcttcagagacttgaagttcctgtcatacagatctttcatatgtttggttagagtgacaccaaaatagttcatattatttgtgactattgtaaagggtgttgtttccctaatttctttctcagttcgtttatcatttgtgtagagaaaggccattgatttattcgagttcattttatatccagccagtgcactgaagctgtttatcaggtttaggagttctctggtggaatttttggggtcacttaagtatattatcatatcatctgcaaatagtgatagtttgacttcttcctttccaatttgtatccctttgacctccttttgttatctaattgctctggctagaacttcattttctatattgaatagatagggagagggggcagccttgtctagtccctgattttagtgggattgcttcaagtttctctccatttagtttgatgttggctactggtttgctgtagattgcttttactgtgtttaggtatgggccttgaattcctgatctttccaacacttttatcatgaatgggtgttggatcttgtcaaatgctttttctgcatctaacgagatgatcatgtggtttttgtctttgagtttgtatatataatggattacgttgatggatatccgtatattgaaccatccctacatcccttggatgaaacctacttgatcgtgatgaacgatcgttttgatttgtttttgaattgggtttgtgagaattttgttgagtagttttgcattgatattcataagggaaattggtctgaagttctttttttggtgggtctttttgtggtttagatgtcagaattactgtggcttcatagaatgaattgggtagtgttcattctgtttctactttgtggaatagtttgaagagttttggtattaggtctactttgaaggtctgataatattccacactaaacccatctggtcctaggctttttaggttaggagacttttaatgactgcttttatttctttaggggctatgagacagtttagatggttaatcttatccttatttaactttggtatttcatatctttctagaaaattgtccatttcatctagattttccagttttgttgagtaggtttaaagtaggatctgatgatttttttgaatttcctaagtttctgttgttatatctcccttttcatttctgattttgttaatttggatactgtctctgtgccctctggttagtgtttatctatctcaaagaaccagctcctggttttgttaattcttttttttttttttgttttttttttgttaattctttgtacagttctttttgtttctacttggttggtttcagccctgagtttgattatttcctgtcatctacgcctcttgggtgtatttgcttctttttgttctagagctttcaggtgtgctgtcaagctgctagtgtaagctctctccagtttcttttggaggcacttagagccatgcgttttcctcttagcactgcttttattttgtcaaataaatttgggtatgttttaccttcattttcattaaattctaaaaagtctttaatttctttgtttatttcttccttgaccaagttatcattgagtagagtgttgttcagcttccatgtgtgtgtgtgctttctgttgcttttgttgctttgaagaccagccttaatccttagtggtctgataggatgcatgggatcatttcaattttcttatatctaattaggtctgtttagtgactgattatatggtcaattttcgagaaggtgccatgaggtgctgagaagaagatgtattcttttgatttagtatgaagtgttctataggtatttgttaaatccatttgggccataacttctattagtttcactgtgtctctgttagtttctatttccatgatctgccattgatgagagtggggtgttgaagtcttccactattattatgtgcagttcaatgtgtgctttgagctttagtaaagtttcttttattaacgtggatgccattgcatttagagcatagatgttcaaaattgaaagttcttggtaggttttttcctttgaggagtatgaaatgtccttccttatcctttttgataacttttggttgaaagtcaattttatccgattttagaatggctactccagcttgtttcttgggaccatttgcttggaacattgttttccagccctttactctaaggtagtgtttgtctctgacactgaggtgcatttcctgtattcagcaaaatactgggtcctgtttacatattcagtctgttagcctacatctttttattggggaattgagtccattgatgttaagagatgttaaggaatagtgattcttgtttcctgttatttttgatatgatttttatgtttgtatggctatcttcttttgggtttgttgaaaggatattactttcttgctttttctaggatgtagtttccctccttgtattggcattttccatctattattttttatagggctggatttttggaaagatggtgtgtaaatttggttttgttatggaatatcttgctttctccggctatgataattgagagttttgctgggtatagtagtctgggttggtatgtttgttcttttagagtctgtataacatctgtccaggatcatctagttttcatagtctctggtgagaagtctggtgtaattcttataggtctgcctttatatgttattggacctttttcctctaactgcttttaagatactttttttgttttatgtatttggtgttttgactactatgtgatgggaggaatttcttttctggtccaatctatttggggttctataggcttcttctatattcatggtcatctctttctttaggttaggggacttttcttctataattttgttgaagatatttactggtcctttaagttgggaatcttcactgacttctatacctattatccttaagtttggtcttctcattgtgtcctggatttcctggatgttttgggtttaggagctttttgcattttgcattttctttaactgttgtgtcagtgtcttctatggtaccatctatgcctgagattctctcttctatctcttgtattctgttggtgatacttggacctatgtttcctgatctctttcctagggtttctaactccagggttgtctccctttgtgattttttttggttattgtttctatttccatttttagatcctagatggttttgttcagttccttcacctgtttgggtatgttttcatgcaattcttaagggatttttgtgtttcctctttacgagcttcttcctgtttacctgtgttttcctcctgtatttctttaagggagttatttatgtccttcctaaagtcttctatcatcatcatgagatgtgattttaaatcagattcttgctttggctcgctgtggtgggtgaactgggttttgatgatgcccagtgttgtgattatagaaagatatagaaatatatggatatgttctgtggggttgtggttaggtattggggaagagggtgcctctgggggcccatgctgagacatcccttccctttgagggaccagctacacaacagtataatatagaatagagtttattcagggcctggggaggggagttaagagggtagtagaggcagagaaaggcagagagagggagagagtagagaagtagaggccagctatgatcatcgcatggagagaagggggaagggaaggaggtagggaagagcccaagaatgcaagagagaagcaagtgggaagcaggagtaagagagagaggaggggcaagcagcccctttttatagtgggccagacctacctggctgttgtctgataaccctggggagagcatacttgcctgttgcgaggtaactgtggggtggagtttagacagaaagctaacatcaaatagccttgatttcttttgcttattttcttgtccttgcctctcaccttctggttatctctggtgttagctggccttgctgtcactgactgcagcttgtccctcctgcaaggctgtgtgtccgtactcctgggaggccagttctctccaggaggaatttgagcatggagagctgtggcacagggtcagctctggggtgcagacagaaaccagaaggatcctgtctctggctgttccttggttcctgtgtcctgatggcagacgctgggtgacagcagtttctggttcactgccagcgggcctcatggtgccttggtggtgtctgtggtggctgtagatgcacagctcggccagaggacttgtggcccctggggccggtgtgtctgggcagaaccgtgtatgtgggccagcctcaggcatgcgtgtctacgctactgtagggcgggacttcctaccagtagcggagtcgtggcccagagtacacggtgggcaggaaaagtaagggcccaatgtagcctgtggcactggcagagcatgagtgggctgagggagctcagcgagaaggggaggagggcagcagaatccaggcctggcctggaattctcagccaccagaaataaactgtctctgggaccatgcaggtggtcactctgaccagtgggaacggggacttgccagatctgggctagcgagcgtggttgtggctgagatgggatgcaaacctgtagagtttttggatccaagtcacaccaatgttgtgatcataaaatgataaagagggccgggcgtggtggcgaacacctttaatcccagctctcgggaggcagaggcaggcagatttctgagttcgaggccagcctggtctacaaagtgagttccaggacagcaagggctatacagaaaaaccacacacacacacacacacacacacacacacacacacacacacacacacacaaagataaagaggtattaatgtatgttctaaggtggtatgatgaggcgtgggggaaggggatgcctctgcgggcccatgccaaggcatcccttccccctgagggaccagccacaggacggtatagcatagaatagagtttatttagggcatggggaggggagttaagagagtagtagagacagagaaagaggcaagagagaaggagagtgtagagaagtagaggccggccatgaccatgtggagagagggggggagggaatagggagagaggcaggagcaagggggcaagaggtaagaatatgagagtaaacatccattttactactgtataattttttattctttaataacattaaaatcacttgcatgctgtcttagttttccctctattattgtgataaacactttaagcaaaaagggaggaaagggtttattttagcttataggtaagcttgtctttcaaaggaaggagcgatttacttgtgttttacccagatttctgggaaaggatgtagtttatgacctggtgatcttttactctctgtagggccaggcttcacccagctcccccagactgttatgtttgtttattcccgatgcacccccatattaagccatagatcccatccttatgagagatgccaggtttactttacaacagcctgagggatttctgtgtttttagggccatggcagtcttgaatcccacaggcatctttacctcattctctttcgaccctttgtgttttcctcattctccctagacccttttcttgagcattgtttctaagtaaacaaagcctatttttatggaagaagccatatgtactttttaaagaatttcaatgtaaacatgtcttcagctttgttgtatacactggaaggactgacttcatcatcatcggggacctttttccaaaattgtgctatgcttaaatatggataaaataaaccaattggagtaagactccataaatttgaaccactgactgctaactaaagttgtactgaaccaatgaccaagccagctcagtcagtcaacagagtctcaagggagggagtgaggattgaaaataaaaagataattagagctaaagtgggtttattttttcccagtcagcttttataccattctaggtacatccaaagaatacagtcagttttcagatcaaagacaaagtgatcaagcaaggcagtgaacaaagagatcacaccaggtagtagtcaaataaggcaataaacaaagccccccagaatccctggctctgggggcttatcaggattatcaagacaaaagggaagtcacacatatcttggctgggtttaccttgatccttgcattagcccaaatgcagtactcttgtctggtcctacttcctcctttgagcccagtgacaagtactcgtcaaatttctattagtggccccccagagctctgcacaaaccaagtttcattcttgccagtccttggattgtttcacagctggctgtgatgctttcagggacccccacaagatttgaagtcttgaagaggtaacagcccacatggaagatgatatttcagtggctcctgtactgtttatatgaaaactgtagatgtaaaacagattattatttcatgaatttaaaaccaccagtttcagcctaaaaacttctgaactggcagccattggaggtcagagtttagcatctcaccacctacagcataggttgaagtgctcaagattttcaggttattatgaagatgacaatgttcagttgattaggcataaagatatgtaagaatcattaactgtttctaatgaattccaaactgccatagagtagattacgttcatatagtacataaaatatcagacagtagctagtgaaaacttaacaatgttagataccacatccaaggccttacactgacagtttgtagttatcttcaccaaaattaactggaacaagatactcaacccaagattggcagagaaatacaaaatgcttaaaggctgactataggcatcttaaatgcacaagaaaaagggattcagtatgctgtggtcatatgataaataagtgatttataaacataagcaaaagagatattttgctagttaacaaagttaacagatttctagcttataatattgttttgatttttgggggggactgcattctctgccttgtaattttttgttatttctatttgtaaatctttaaaaacttctgttatatttaatatcagagagatctatcttaaagtcattttactgtttagaaaatgttcccagtactgaaatctaatttctaaaaaaaactttattctatgtgtatgagttttgcctacatgcaccacatgtatgccttgtgcccactgaggccagaaggtgtcacatcaccttgaacttgagttgcttgtgttgtgagcctccatgtaggtgttggaaactgaacccaggtcctcgacaagatcagtaagtgctctttctgctgaggcatttcttttgccccaacctgtttaatatatgcagataactcttaagttcctttttcctaccaccctacatatgtttcaaaacacttcaatagtttttactgcttcaccaactgttgtgacactctagctaagtagaagtcgcgtttcttttccttttcattgttttgatcatttctagcatctcataactagtttccaaagttttagtttaggatttggttccattttgggagacaaagttttctggaaattccatgatagcagaattcctggggaacttattttttttaaaagatttatttatttattttatgtatatgagaacaccattgctctctttagacacaccagaggagggcatcagaccacattacagatggctgtgagccaccatgtggttgctcggaattgaactcaggacctctggaagaacagtcagtgctcttaactgctgagccatatctctccagccctagggagcttatttttaaatacaaagtcttgagccacaatccctccgtgccaatgaatattttcatcttttttgttttttctcattgtgtcttccctgtctagtaccattgtagttatagatacctgcatttttggaagaggttttccatattatgtttctgttctttttaagatttatttacttatttcatgtatgtgagtacactgtagcagttttcagacacaccagaagagggcattggatcccattacagatggttgtgagccaccaggtggttgctgggaattgaactcaggacctctggaagaacagtcagtgctcttaactgctgagccatatctctccagccctagggagcttatttttaaatacaaagtcttgagccacaatccctccgtgccaatgaatattttcatcttttttgtttttttctcattgtgtcttccctgtctagtaccattgtagttatagatacctgcatttttggaagaggttttccaaattatgtttctgttctttttaagatttatttacttatttcatgtatgtgagtacactgtagcagttttcagacacaccagaagagggcattggatcccattacagatggttgtgagccaccaggtggttgctgggaattgaactcaggatctctggaaggacagttggtgtttttaacctctgagccatccctccagccctatgtttctgtttaatattgaagaagtggtgatgtactatggatatggtataaaatttgaaaatgcaaatgttgaaaaagtagtaggaatctggctttattaataaaatgataataatctttaatctttttcactgcaaattatgaatagagggaaaatttatctatttaacaaatatcacctattagaaaggcaaaataaaaaaatctttacagctaatagagtaataattgtgagaagctcaatgttttctctctaagactggaataatgcaaaactgtctgttgcttatggttattattatacacattataggttaaggagccttcacctgaaaaacctaaaatccacagtgatctgaaatcagaagcaacttgagtagcaacatagtactttcaacaaatatcggaacgtttaccagctgtcttagtcagggtttctattcctgcacaaacatcatgaccaagaagcacttggggaggaaagggtttattcagcttacacttccacattgtcattcatcatcaaaggaagtcaggactggaactcaagcaggtcaggaagcaggagctgatgcagaggccatggagggatgttctttactggcttgcttccctggcttgctcagcctgctctcttatagaaccaagactaccagcccagggatggcaccacccacaagggaacctccccgattgatcactaattgagaaaatgccttgcatctggatctcgtggaggcattttcccaactgaagctcctttctctgtgataactccagcctgtgtcaagttgacacaaaaccagccagtacaccagcataataaatcaagaaaaggaaaaaagtgtagagattagagaataaataaaactatcttttataggacataaatataccaaaaccccacggaatctaccaaaatatatgtaaaaattgactagatttagcaaggcaagaacagaaactgctaaaggagtatcaagttgaaaggtcttgttccccaaatatagtaatacataaaataataaaatggctcagcagataatagcactaactgtccttccagaggtcctgagttcaattcatagcaacaacgtgttggctcaggatcatctataaagtgatctaatgccgtcttcttgcaggcaggtgtacatgtagacagtttactcatttctttttttactgtttttgttttctttgtatgtttttgttgacgattctgtgtacatttctccagtatcttcagatcatatttggaaatgaaaaagaatattcatagaagtcacaaatgttacttcttatgttgtttctaaattatttaccatttctgtctaccttttagaagctgtttgttcttgctgtgttatgtcactccctaccctaccttggtgtctttttgaactcagttatttctgttttctattctctcttttttttgagatttatttttaatttatgtgtgaacccacactatcatgtaaatgctgggaactaaacctgggtcctctggaagtgtttttactgtctccgtccctttgtcttttttcttctctctttcttttttatcttctaccacctttttctttgtgttttgatttttcaagacagggtttctctgtatatacagcactggctgtcctggaacttgctatgtagatcaggctagcctccagagatatgcctgcctctgcctcctgagttctggaattaaaggcatgcaccaccacacccagctgtgaacatgaactttgaagtcagatagactgggtctaacttgtaatcactaatattctgtttcttcatatataaaatgaaaacacaaaaattattaatatgtaggtgaaaggttttgtgcacattatacaatatatttatgtgctttttgtataatattatacaggacaattatttcttatctggagtacttgtgatcagaaatgatttgaattttgtgtttctttttcagatttggaccactttcatttacatgaagaaatatcttaggggtgagatccgtatctataattgtgcttcttacacatttcaccctacattaaattttaacttgaggataatttatatagtatttttggcaaccttattttgatgatgattcttaacagtcacatgtagaattttgaatctctgtgtcatggcagtgttcaaaaagttttcaattttagtgactttgggactttgagatttgagtacctgctgctatgtgatctattttcattgtgccagtcttaggctaaatcctgtataaacataatctcattttcattttcacaaccacttgagatatctttgactcatttaaaagtgaaactcaagaaacgtttttgttcaatcacacctaaattttggcagagctaaaattttaatttgtattaatcttaattcaaatctcacatactttctcatatttctcttgtctactgtacagtatccagtaggttgaactgtactttgacactaccataaaatgtttagttgcaaatgttgtatgattctgacagtttcttttcaggtatctttgagtatcttctgacactagaagatcctgtaaactctacagacttcaacagaattgaagaacctggacagagcagagttaccaacaagagagcccagggatagcattaacatggtggttactcaagacctaactcagccagggagacataccaaggcctatgaggtgaagggaaaagaagggtgacccaaagggcaggaattttttatcctgaacttttgagccttatagaaaaacataatttgttgggcatgttttctgaccctcatacagtttttacaaccatttgaagatatagttctagctctagtaggctctacaggaaggtatatcaaactttttaacagaacactttattattttaaatatatgagtatttcacctgcataggcgcacagtacccacagagactagaagagggtggcagatctcctgagactggagttaatgcttgtgagctgccatgtggatgctggaaatcaaacccaggtcctttggaaggcaggcaggtgctcttaatcatggaagcatctcttcagctcctaccctagttctttaattttgttttaaatttttgaggtagggttttgctaagttacttgggctggccttggactagtaaccattctgtgtcagccttctgggattagaggtatgtgctagcatgtctagcatctttctatttctttggttttccttctaattaattaaaaaatacattatcttctaaatcttttattgt

SEQ ID NO: 45 - DNA, 5922 bp, Mus musculus
gcagatgagtatattttttattgaagacattaaaatctaacttaaaactccaaagtgagctaaagccatgaatgtaattcacaaaagaaaagatatgattagtcaacacatagtgtgtcagcaacctacttatgatataaaaagaaatcgaagcactcaatgaaacagagggctattatctttgcctacaaaactagctgagggtaaagaaaaatcctgaggaaatatgatgcccttctatgtaacaggaaatgactccttgatgcctctttggttcaagcactctggagacaagaaggaatgagagcaaagttttggtggtattaagatggtcactatgtatgctctctgaaaggtcccagtattgaaggagcagaccctagctggtgacactgttgagagatgagcaagccatggaggccctgacctaatcagtggttgcatggatatacccatcattcaacagcactagggggaggtgttaggagctcagagatgcagactgcttggagaagacgatcacagagagcatgctcttgcctcctgtcttccttctgtcttcctgtttcctagctaccacaacggcagcagcatcctctaccagatggtccaggtgtcctgatgtttagcatcatcccatacctaaaagcaacggatctagccaaccttgaccttgctcctccaagtcaggtctctggggctttgtcacagcatccaaaggctaacaaagggaagtgctgactttgtcaccaccaccactgggcagccttcagtcctcagcctgcgacaaaagaaggactggttaacctttccaggatgtttcaagcaagggctgtggcttctttgtctctacctatgactcagtgtggaggtaactccaaaagctgtcatgtctggactagagagggaatccatggtgacgaggggttggtttgcagagagaagcctacaggctgtgctttcccgagttctcaacctcagtgaggtcatttctacatccttcttctcccacacggtgaccaagtgagagaatcagccttcagtgtgctgccttcaattggccagggtgggcctcctctgctttgcaagagcctgtggctaacctttggtcagaaactgtgtaaaccgtctgctgcctctgaaaccagccaaggtggatttaaactaggaatctgaaaacactgtaaatcagatattttccttccttccttccttccttccttccttccttccttcctcccttcctccttccttcctctccgccttccttccttccttcctccttccttcctctccgccttccttccttccttcctccctccctcccttccttccttccttccttccttccttccttcctttctgaatagccagttgctataacttaaaccagttgtcaaacatctcccagctttggtgaaggaatcccagcctggattttgtccctaataatccagagaagtgaggatctgtcggccatcaatactgagcccacacaaatctcaccggggactttcccactgcccctgtttactgctccaggagagcttcctggaggcaactttgggattaaagggttttcagccccactctcctaacaaaattctgaggcctacttggagctagacactgtggggcagcctcccctgcatagctctgtctgggagcctttcagcagggaaagacagtcgtgtgtgtgtgtgtgtgtgtgtgtgtgtgtgtgtgtgtgtgtgtgtgtacatgtgtacatgtgtctgtttgtctacactgggcgagacagagctcagaaaaaggcacacttgcctctgaccccatccagaagctcaggcacaggcaaagaggaagccctgccctgactgccacaggggagaagaaagacagaaggaagtatccaggctttctgcagatgttcaagttcccagctagctcctctctccggctgcatttgaagctgggcaggaagaaagacaacttgcttccgccctgtgactctgcccactgccagaggggacccatgcgtgcccaggcctctgctcaatcccttctctcttcttccttctcttctttggaacgaagcaagaatgaagggtggggcagatggatggatgggcggagcctgaacccgaaggcctcttcagctgtcttgggaattattttcggtgacaatcaggatcaggaggactattcatgatgacgacgtctatgttttcatttctaaagaaaaataaaaaataaaaggtttgcaaccagacttgtttattgctgagctgtttataataggaataaacaactagaactcctacaaaagtctaacgtgaagggatgacatgacggagtggatttaatttaaatccgcaagcagattcaatacactgcagtggtcataagaggggggaaacccgtgccgggcagtggtggcgcacgcctttaatcccagcacctgggaggaagaggcaggcagatttctgagttcaaggccagcctagtctacagaatgagtttcaggacagccagggctacacagagaaaccctgtctcgagaaaaaaaaaaaaaaaaaaaaaaaaaaaaagggaaacccgcctgtgttacccaaccggaaacttagacttagggacttgcaagatggctcagcagataaaggcactcaccaccaagcctgacaatctccattctattctcggactgacaaggtgggagaaagagaactgacaactcctgacagctgtccccagccgccacgcgcacagcctgacacgtgtccccgtctcccccctgtaaatcgctaagtgagtaaaatgtaataaagcattagattttaattttgtattaaaaatgctgcatagtacaaaaaggccaaagcaaactaagccacaccttggctagaaactggaacgatatgccgaatgcccaccgaggttttctttgtgtggtaaagaaaaccacacaaagggtgaattttatgtctgcttttctctgtattttctaagttgcagttaataaacttaaataagaatggatatgatttattaagcattctctataccaggcttgtggtaggcactttcaccaatcatttcagttgaaattcctggaaccctttaagacgcatgcctcctttagctccagttacccctaggacactcagagagcttgagtcacctgcccaaagtcacacagctgatacatggagaggaaacaagattggaaccctggtctttctgattttagagccaaagccccctttcattccaattttcccaataagaaaagaaattagataaataatttatataaaattgtacatataaagaattacagattaatagagggggctggagaggtggctcggcagctaagggcactggctgctcttccagaggtcttgagttcaattccctgcaaccacatggtggctcacaaccatctgtaatggatccgatgccctcttctggtgtgtctgaagagagtgacagtattcatatacataaaataaataaatcttcaaaaagtttacatattgaaagaaaataaacatttgagtagtagacccacctctcaatgcttatctcattttggggaacttcgtcacttgtctctgaacccttgtgcggtatctgctacacttgtggacttttatactgttctgtgttgtctgcccctcctctcacatgcagggctcacacagacatatctcggaggttacagacaaaagcaataaagagcttttcacactaaatcgacagttactgggtttgagggttcagtggtttagagcatttgttgctcttgctaaggacctggattaaattcccagcacccacatcggggttcacaaccatatgtaactacagttccaggagtccaacatcatcttctgacctctattcacaccagacatgtacccggcttatgttatacatgtgggcaaaacattcatataaaatttaaaaataaataaattagtaaagatttactgggtcttcagtgtccacacaatgtatgtttacaccatgccatagcccatcaagtgtgtaatcatacagtgcctaacagtttaagcaagtaagataatcactatgaatcaccagagccttctgtgttggtggggatcttgacacagtgtggatggctactgtcttatcagggtggtggttgatgaaggttgaagtagctgtgttaatttcttcaaataacttgccagtgggatcctgttgctgtgatagaatgtctggcaacagcagtttcatgaaggaaggttcatttagacccatagtttacagccagccttgtaggacgtcatggagactcttccttttcacaacagacacttctgcagcaggcaatgttgctgtctttgttagggtttcatgcagtgaagaggcaccatgaccaaggcaactcttaaatatttcattaggactggcttacagtttcagacattcagtcccttatcataaccgcaggaagcatggcagggtccaggcagacaccatgctggaggagccaagagttctacatcttgatccaaaggcagcaacaggagactcttccacaggcagccaggaagaggctctgatttccacactgggcagagcttgagcatagccaacctcaaagcccagtgacacacttcctctaacaaggccacacctcctaatagtgccactccctgtgagccaagcattcaaagacatgagtctagaggggggtggggggaggcagcaaacctattcagaccaccacagggttagggttggctagctcattgaatgttacccaggctgaaactgctttcagtattctctcgggctctgttttagccgagcctacatcctatgatactgtctgcagtcttctgagctcctgtcagtgttggtattttgacattcacaatattatcttcaaagactctaatcacagagccccataacacgctaatattgatgaaaattttgaaatattatgagaataaccaaattgtaacacaaaattaaatgagaacatgccttatgggaaatggctctggtaaactgctttacgggaaatggcactggtagacctgccttggaagatgcacggttcccaaacctttcacttaaaaaaaaaaatcacaattttcaacctgataacaaaatctaggtaacactgtttctaaataagcaaattatctgaacagatacttttcaaaagaagaaatacaagtctggaactaatagaaaaaaatacttaccatctttagcccagagaaatgcaaatacaagccacaatgagattctatctcctctcagaatgactaccaaaaacaaaaaccaaaaaggtggtaagcatcaaaagagagaaggtagagaaacatatagaatgaatgtccattgtgattcttaatttttaagatttttaaaaattattatttattttatgtatgtgagtccactatagctgtcttcagacacaccagacgagggcatcagatcccattacagatggttgtgaaccaccacgtggttgctgggaattgaactcaggacctctggaagagcagtcagtgctcttaaccgctgagccatctctccagctcccattgtggttccctaaaatcttgatctttatatgacctagctttcccacttttgagtatatatccaaagacaactaaaacagagtatcaacaagatgtctacatgcccatgtttaatcatgacagtattcataatagctaagacactaagtgaccctaagggccctttaatagataaagaaaatgtgatctatgttcacaacaaaatatcattcagccataaataagaatgtccacaacaagatcctattgcagaaaacaccacacctggtagttgtaagcatgatgaaaccgagctggaattgagctggaatgtctcccctgacttgctctcttcaatagtgct

SEQ ID NO: 46 - DNA, 1611 bp, Mus musculus
aacttcccacataactcatccattcgaccagtttcctatctcacactccagagcagaggaaggaacaatcttagtatttggagggaccaagcactcactcagggtttatcctgacccacctgcagccttctgctcacacacacacattaaatcacaggaaaagacattcaaatgctttaattcagattttaacttatgacaataatcttacagagaatgtgggaacagaaaaatgacatatatggtttatataatatggtctgggggaaacctgttgggacctcaaaaaatgagaaccatggtgaaggttctcaaatctagacataacctatcaaaagaaatgtatttaccagagttaagtaggcagaaaagcttgccccagcttctaatggccgaggctgtaacagacaaaattttagcacgctgtatataataactattcagtaggtgcccccgctgattctcttctttcctggaagaggggaaaaaaaaaacaacacaaacatcaggttcctaaagttgacataccaaaagccttaggaatttaaatttttgtttcctgcatggtttgtctcctcagtcatggtccacgggactctgagaagtcgtaggaatatgcaggcgcagactcgaaagcccagcttcatctccaacgttgtggaaagggactgtacatcaccgggcaatgccctaagctcccgttcgccactaggacagagcccggggagagtgacctcccgggatatccacgttggaatgtctggttagcacccaaacgtttagtcaacttcaacaggcgactacaccccccccccccacacacacagtgtatatcactaataacgtacacatggagcagaaagcactaagccagcctcagggtgaacgtacctccatcaacaaagtacctgaaatcattgaccgggtctgcaagagaagactttaatcagtaagttaaacccttagagtactcggacgcacccccagattgcatgacttaaaaaactgtttcctgcatggtttgtctcctcagtcatggtccacaggactctgagaagtcgtaggaatatgcaggcgcagactcgaaagcccagctttatctccaacgttgtggaaagggactgtacatcaccgggcaatgccctaagctcccgctcgccactaggacagagcccggggagagtgacctcccgggatatccacgtcggatagtcatggtaatgtctttttttttgacaaaatgccacagggtccttttgccagacctccagctggaggaaaaaccccaaaaacgcctgtctccagagtgctgtgactacagacttcagccaccttttcagatcttgaagcaaacagaacacaacacccccatcggaaccaaactatccagaaattatctacctaaaaaagggtcctctgaaaaatgggagattaatgaacaaaaaactgcagaaatcccgttacaaggtgaagagaaagtataactgggaagcaaggcgaaatgattaagttaaaaccgaacgctggaaggcggctaacacttcaaatcacaaggcaggaaccaaagaccctgtcctcttaaagtgaacattaaaggaaagtgcgtagacc

SEQ ID NO: 47 - DNA, 22843 bp, Mus musculus
caaaacaaagcattttatttaacagcaaactaccccacccactcaaccacccacccacccacccacccacccatccacccacccacacacggactcattgtgacatgttggtaagcaacagttttttttttcaagtcttcaaaacacccaagagtcaacagaagttctgtattccgcatccgttcacaaagtccaggtgttttccatgtgttttttcacagttggtgggaagatgactccagtctttcaacaacagattggtacacagttcatttatgtgatcaaagcagatgatggtaggatgtgcttaattggtagcaatattgatggcagtaactgtgaaaggaaggctttcagttattttttcctttgcaaattccagaaatgtaagcccattcctacccatacaaagggatattactgaatccagccaatttccactaattaaaagctaatattagtaacacttttgatgcccaattgagttttaatgaaaatgaaaaaaatttgtttgaactcccagacctcttcaacctggctccatcttctctgttccttttcttttgcctgaatgtcctgattgggttactaagtaaagtctagatactttgaaagtatgcgtatgctacaatgaataagcttccttacagcaaattgtgacttcagctctaaggcaacttggataaagagatcacattgacttaatctgtttcattcccatttgactcaaggcttagctgatagccatttagatgaaaatacattttcagaaacatttagcgaattaataccaattttgtggaactgcattaaagtcccaacttagattccagatagacaggctggaccctttccttcactcggcctcctgtcccaccctctgtgagtgaaagaaaaatggaaagggtcaaagcacaggcatttttaatctttttcaagttctttcaatttggtctttcgttcctccagttttctgattgttgtcaattttattattcttaaattttatgcaagaatgttaaacattaatgttattttcatccactggcattattttaccatagcaagccaccttgagtatattatagtaaggagaacatttctaaattactgtgagcattagcatgtaaaaaggtaaaaggtttaacgaacacaggcaaaattggtcaatgtatttcaaagcctgctgcagctcaaaaatggcttgtttgccccaggataatgcaaagtagcctaagattgtggaacttagatggctgtcatccctcctgaccagtagtggtcacagtcatagctaaaatggcctagaaaattgagtttcttagcgtggagggcttctgtaactttagggtcaggcttgctacaaagcccagcttcccactcattgcagtggccggagaagacatgaggatgaggactcacattgcatattacttggggactaaggactaagtcgtgccactacccagaaaagagaccccccccccccatccagcacttccctatgtctatgtttcctttttccatgtctcaggagccaagtgaaggcctaagagacatgcaaatccttgtagaacaggcgaaccaataaagcaaatgaatgaataataaccttcctgtattcaacctctgaggcaaactgtgggaaatgaggaaagtgttcttcagtctagaaaacgtttgagctaatatttctgtttaataaagagcatccctctgctttccggggcatctgtaagtcacactgagtgcccttttggaacaaatgtgttgcacttagcatccagtagcatcttctgcaatgtgtggaaccgaggaaatagagaacctcttttattatttccactctaccaagcatgcccatgaggaggggagcaactttttatttaacttgcctcctctacaccttgatgtttttcccagctaaagtgagagctgtagtctcaaggtgtgactgcagtcccctcagaaactactgaggtaaagtacactttgggttgcatcctttaaatgtctttgttcttttcagtacttagaaattttagtacttagaactgcactttcatcacacttaagttaaaagtatgagtgtgatagtatattcttcttgctcacatgacgctgagccaggcaatgaacaaatacgtttagaattatcgattcatcttgattctcctttgaaacacttcaacagtaagaaaaggaaaatgggtaatgaattaaaggacagactttaagtctgtcctggcttcaagctaggccaatgagaaaatgacttttggagcttccttagctaggaagtctccagtttatgttgaaggaatcttggccttggttgggtttcgcaaacagccattatagttaaaatatttactcagaaggctggagagatgactcagtggttaagagtctgactgctcttccgaaggtcctgagttcaaatcccaacaaccacatgggggctcacaaccatctgtaatgtgatgtggtgccctcttctggtgtgtctgaagacagcaacagcgtactcatatacataaaatatataattctttaaaaatattattcactcagtaatcagatatattcttcaggctgggcatgggttaagcacatctgtaatctcagcacttgagaagctgtgacagtcaccaattagaaccagcctgggctttatgagaccatgtctcctatgatcagtgatctacactaggtccacctcacattttagttttaggacctaggttagcatattttatatacaatgtttcattaggtgttgtgttctgcatgcttggtccctccagccagtacatctagttcgagaggttctgggccacactgagtacatgccatcagatgctctggcctcttcccgttttgttccctgatacccatgctctgggattatctcactctggccctataaaactcctttactggcaaggtgtttgtaattcatctctggcagcagcattcaacaaacatttaagaaactggatggaaaaagttcctgtcattaataaaaccttttccacctcctcagtcaagccagctgggaagtatcctagacagcatagtccactcagtgtaacatttagcacactgccttgcacaaatccattttttttttctgttttcatttcctcattgaagtgaattgaagttttggtctagatttcactcctataagtgctacataatgctagaaagcaatctatgtgttcgctcaacacatagcatggtaaaattattattaggtggtgttaggtgataagcattatgattaagtttcagccattatgaaacttagaaagtaatcactgttcactgataaagccaacagttaggtcccggctttatagaactgtagacttcacaaagctccacacagatctgttgtgcatgcctgggataaaagcaaagtcattgcacaccaggcaaatattgcatatatacacatatatatggcagtttacaaattataaattaatctcatgcataatttctttagatacacaggacaatgagaatgctctttgcatcccagtgcctagcaagggcactgttttgtaataaatgactgccattcagtatgtactcatcaagtattgaatgcttcatatattcagtggttcacagttacttatttactttattttcacagtataataaatgtggcagaattttaaaagcctggaaattgataccaagtaagaaaatgaattgttacatttatatggtacctccgagttcataaaatgccaacgtacatattattctcaagtgtggacacactgaaatgtacgtctgtgtatctctccagtacccatgaaagagaatatacacatgggagacaatatttagcctccaggtttgagattgaccttatggtcttcccaggctagcctccaatttctgggctcaagtggtcctgttgcttcagctcagagcacatgctaccacacccagcttgttaactgtactcttcccattatgggctaaaaagtacaatgaaaattttgtagagactatgcctattttataggcagctttatttctatagaaaatttgtcttgtcttatactactgaactgctttatagttaagaaagtacccacaaccataatgtgacctgggcaaatgttcttgtattaacatgcccttatcactcaagttttgactgattaaattaagcattggctcattccttatgaatagtatggaatgcaaacattcttatttcatggcagttactcatgaatatttcatgtacccaaaacaatatcggatacatcagaggtagttagtagtcattcatttgcacacatggaacaattgatagctgtataatgctttatttaatgcattcttttgtaaattctagttctgtggtaatgtccccctttgttattcccagtgctgaacatgggtattcagaaattagaaggtgatcagaatagggtaatcaatcacctgcattagtgacctagtttgtagtttaaaatcagtttccatgtgttttctcttctgctacctggtataatataacttactgagcctcaccaaagcagaagaaacacactggccttaagtatatggactgttattcattcaagccccgttatgttcatatatttgtttttacaaagcatgttattcctagagcaatctttgtgcctatagcacacagaggcgtagacttcagctactatgtaatacatactcagcactgacttggaagttacagtaggcttcatggtttacgtattcatacgtttcctggttacctggtaatatcttgttacctgggggtgaccacagtgaagcatcacagccttagtattcagcacaaaaaatatgcagggaaggaaattaatgttactcagacattccctggcattcatatcagggcttgatcaagtacaggcaatagaccagtgtgcctttttcttaccttttgaaaaggatttgcaactaaggaatatgcaactaagaccatgaacccacaaagcttcaggtacttagtctgatgccttataggaaaagctctacactttcagataataaccatgtataattgccaatgtgctatgagcatgttactttttcatcctgtgtcatttaacttccctcttacagaggaagaggaaggcacgaaaaagattaagcccgttaagtagtccttagagtctctcatcattaattttaaaggtaggtattagacccaggagttcctttggtgaaatgcaccaaattactcggccactactatgagcagggagttcagacctcattttgtccccaaaccattattagaaaaccataccctgctcacctaagcccaaagaaagaaggtgacactggctggtgcttctcagagggttggcacatctgcatattgcttgtctaattcttctcattggtctggaacaactctttatattttctctagatagcctgacattgttttccccctaacaacctgatgctttccttttcttgtcagcctagggcttctgaggtagggaggatggcagtatgcatatctgtatgcatgcttattcctagggaagtttcaatagtcaggctatatacactggctggatttagttccgtctcaagtggagcagatgtgaagagaaatggaagttgtaaaacatcaacaatttaacaaatggctaagacccagtttaaaacagacccttgcacaatactatccagctaaaaacgtattcctttatgggcaatggcaacaatgaaaaattacatctcaagtgaagacagcttaaatagaaatataagaaatggaaagggatgctggggttggggggcaggtctcatcttcgaatttcccttcttggtcttggggatagaaggatagaaatatccttccagagttctgggccataggcctttatctcttaaatattctgtccatataggattgggtccttaggtcttatgcttggacttagctcaggttttgtgtcttatgacatacgtagttccccgctcttggaagtcacaggtgtcctgtagaaacagttcctcttctttgggttgtcagcattctgtccagccagctcaagacgggccatctgtgtattttggtccttttaaatctcaagtcgcaaaacttctgtcttctacttgggcgttcacttcagagccacttgaatcctgaccggacggaatgatgtattttgtcttagattatttctcagggcagtctggtgtgaggaacggctccacgggtgacattctggacctattgggaaggggctatgaagctcctctcacacatgacacacataacacacatgcacacacgcacatgtacatacaaagaaacatccaagaaaggattactttagaatacaagagagacacagacttgtaaagagatgaaatgctcaaagtgaacagaaaggaggaaagtagaagatagaaacacaagcaaacacaaagcaacagaatgatgctgagataagaaatccaccaatagcaaagagacacaaatacaaaagaaaacagagaaagtggcccaagaaaggcagggaagaaatgtaaacaagaattcactaaggatagaagcagcagaaagaaaactgaaatggactgacaaagagaacttgaacaaagaacaagtggggtgagcacaagaaaaagagagggatgcatgcaacatgtgacccaaaggggagtcacgaaaggcaggagtgaaagaaaagctaagagaaatagcaaccagatagataaaacagagagccatagctagtgaagacaaagcagaccacacaggcaccagagaaagtgaaacaaagctcaaagctctgcaagaaagaacatgcaggagaaacatgggaataggtaagacacactgcagacagaaaagacacacaaaggaaagaaggagacatgcaaaggaaggaagaaatagatgtaacaaagaattagacacacaaggaagaagtagatacacaaaacaaggaagacatagacacacaaagcaaggaagacatagacacacaaagcaaggaagaaatagacacacaaagcaaggaagaaatagatgcaacaacgaattagacaacacaaggagacatagacacacaaagcaatgaagaaatatatataccaaagaattagacacaatgcaaggaagaaatagacacacaaaagcaaggaagaaatagatgtaacaaagaattagacacaactgcaaggaagaaatagacacacaaaagcaagaaagaaagacacacaaaagcaaggaagaaatagatgtaacaaagaattagacacaactgcaaggaagaaatagacacaaagcaaggaagacagacacacaaagcaaggaagaaatagatataacaaagaattagacacaatgcaaggaagaaatagacacacaaagcaaggaagaaatagatgtaacaaagaattagacacaactgcaaggaagaaatagacacaaagcaaggaagaaatagatataacaaagaattagacataatgcaaggaagaaatagacacacaaagcaaggaagaaatagacacacaaagcaaggaagaaatagatgtaacaaagaattagacacacagaccaaggaaaaaatagatacataaaacaagaaatagacacacccacaatacacactaatgattgatagtaagcaaagaccaccagaaagagggtaacaagaaacagggaagggcaaagaaaaaaattgccattagtacactgtaccaggctatcaacgttaaacttaaggtttccttaacataggaccataggacacacccgtcaactcttccaaatggcctagtcatgcaactccagggcatatttgccaggctctgtactcaacactttccattcatgatttcatttgaccttcacaaacagacaggtcttagcagaactaaattgccaaagggcatacatctaggggatattacatttaaacacagaatgaacatctcaacattctgttacatggattaaaagcttctgtaagcagcaaacactataagcgactgcatatttaattgtcagcttcactctcctcttctattaaaaaaaagggggggcttggtttttacatccttcacaagtctaatggctgcttcacagatggagataagaaataaactatttaaagcttttcaatgtttaagtctgtaagaatggtagggcaccaagccaaaacaaacaacaacaacaacaaaacctagaagctaaattcctcttgtgatataactggtaagcagataatagtttgagttgctgctgtgaggccatttgataacgtgaaagcctgttcatcttccatcgtgtacatggccctgcctcacattatcacattagatgctctccacccagcaccatcttccagcaaatgcaaatcctcagaagactgcaatgctagtgacttacctcattctattgcttttaagatgctgcagtcaggcatgttgatcctcgggtcatttataaagctgccttccttttgtgtgttcacattgcttgatcacgctgaagacccagttttctgtgctgctttggggaagggtaatatttggtagatggcactacaaagaacaaaagaagctgtatgaatgccaggaaagaagtactagaacatcctggctctttaaattctgcctaatgatagatacttctgtatcaattccagccaggtttccatttgtagttagaggcattcatcatcagtaatgttagtgatggctcagtggttaagagcacctattgctcttccagaggtcctgagttcaatccccagcaaccacatggtggcgcacaaccatctgtaatgagatctggtgctctcttctggtgtgtctgaggacagcaacagtgtactcgtaaatagctaggtaggtaaataagctactcacttgtgtattatatggcatgagtagggtagcagtgcatcttgaagtatgtaaacagctggcaaagctttcctagcttctggagagagaaccaaatagagcagaatggcttcctcgaaggtcagtgccactattgcagcagcttttctcctagaagaaacatttgcactgtttagttacatttcccagatgtgggaaaaagataaaatttatgtatatatctcaagtaaaaggctgactttaatggaaaacaagatcaaagttaaaattattacactgttgcagaaaacttacctactttgatgtagggtggcattctttgagcctttgtcttccttgctgggttcaggaaagcgtctcactgaaatctgggctaggcctgttgcccagtggtggtgagctattcccctggaggatcctcatgccccatctccacctagggatcgtcaaagggaataggtcgccagcactgcaaagcagcaagcccacaattctggggggagatctggaaaagaggtgaaagaaaagccaattcttgaaatcaagaatactgggaaagttgtctcattatgtagtaaccagcagttgtgttaaatcatggggaggggcttggagagtgaacccttcacatttgtagatcttagtgttaacttagagacatgagaattgctccatccaagttctttctggcttttattctgtcacctaccaatgagagatcctttagattataggttgtgttaaagtccttgtacttcaaatactctgggaataaaggggttaaattattttcttcttttaatttgtgctttaaacaataccatgccagaacactggcaaggtgaatagcattgtttggctcagtgcttatggtgcatatgtccctagaaactggtgtagcattggacctctgagtttgaggatattcagagaccagaattatgacaggcctacagaatgtgacaacagccatatctacttactctatcaagtacaaaagactagggtgtcagaaactggccttcattcctctgataacctaccttttaggcatttcagagcagaaatgttacagattggtcataacatggtggggatgatttcaaggcctcatcataaggcaaggatctcattggctaactgactatgccaggggaccaggagatggggagtgctttattgacttgccccctcattctctgatgaactggagatcagatagaaacccccaaatagcaaattctccaaagtacctttttttctccatgtggcctgtaagctttttgttcagagtagcgaggacttgaagagaagttctgctgagatgtaatgtagctgtataggctgctggcagtccttgagtctcacatagggattgtttgtccctgtgaagaaatacaaggctatcattagactacaaaaattgttgaaaattccacatgaaaataatgaggtatttacttaggaggtataacttgacacattagacctttaagggaagatactatctcagtcaaccaagtaacggaaatacctttgggctctctccagcactcttcactcctctaaatccaggcaatccttcttcttgaggcaggagcacaaaacagactccaaattcatccctggaaaacaaatgataattatactaaactctacaaatgataatttgattactagcaatacaatcttcatatgcacatgtcagcgttttcaattggtggtaagaactcagggtgaggatatgttctcatggaacccctagttcttaagagatgtgaaaacagcctttaaaattgaaagcatgtctacatttcaaaggcctttcatttcttttccctttttgtatatttgagtactctatctgcatgtatgcctgtgtgccagaagagggagtcagacgtcattacagatggttgtgagccaccatgtggttgctgggaattgtactcaggacctctggaagactaacagaaccatctctccagctctcgtcttaagtgagctttctcttttcctgttttatttaaaattaacaaaactttcttatgactacacaaatagagccatcttcccctgggatgagccagaggactaagtaaggggcaggcagaagaggttcactggactgggagagagggcacaggttggacagtggctaggttatatggcagtatgcatacaaagacctggtctggttctgccacagggctttgtaaaatcagctggcaaaatccactacttccacttcccaccacttaatgaaggtgtacattctcaaattcacttgttctacagggttctttgtttacaaactcctaagtctgggtcaagccattggacagcttggaagaaagctcattcttctttttttttcaagacagggtttctctgtgtagccctggctgtcctggaactcactctgtagaccaggctggcctcgaactcagagatccgcctgcctctgcctcccaagtgctgggattaaaggctcgagctaccactgcccggctgaaagctcattcttaatgtatacagttcaggcagcctgaagatggtgatggcgagttggtggctttccattacatgattactgacagtgagggctgggtcaggacactaatttggggaactctttgtattccatcaattatggggaccaaagatggcctccagatggttttgtgtgatggcacctcctaatggacatttcaatcacagacaagctcatgttccagatgtcctactacaaataagtgtgtattttacagtgccgtggaggtcatgtaggactaggttgccatgacagaattggccctgattaatgatctgcctgctcacacaacttgatcatttcaatagggaactgtcagtgatagtgggtttactgtgaatagcagcagtaccagcttcctccaggccactaactggagtctgagtcctaatctctatttaggtccataggaggcaggctgaaagctctaggtgcctaggcaagcctgggggggggggtcactttgcatgtactggggtgggtagccaatggtgctaaggtgagaccgaagctttagctaactgtcttagtgcaccaaacacattctttagcatctcaaaaagctttttttccttgcaaatgtttccttttgaagcagttacttgtacaacaatggtcctagtttcctaaaagactcaatagttctagatgtattatcacctagagagccagacaatgctaagcctttggagttgggggaaacctgctgcgaaggaatttacagtggacttaaaagggttaaagtactagagggtcatttgcacgtacaaaaggcaaatgcaaaaaaatgttaagtgttatggacaaggatgttttttcagctagaccattttctacacaggagtcaagtatttgttgttttaactgaaagtatctgttgaaaagtgctggcaggggtccagtgtggcacccacccttaatcccaacactctaaactggaggcagaggcgggcggatctctgcgggcggatctcttgagtttgagttccaggatagccagactacacagagaatccctgtcacaaaacaaaacagagaacaaaacaaaattaattgattaattaatgaaaaagaaaaatgagcaaggagggtacataaagtagtccatagtaaaatttgttcataaaacttatccttctttgcacttttgtaaaaaaaaaaaaaaaaaaaaaaaaaaaaaaaaaaaaaaaaaaaaaaaaagattgtaagctatgaagttctctgtctaagctgttagtgccgtccagtggtctgttctgggcagaaatgcagtaaaaatggttgaaagaaccaaattatcaaatttatattcccaattcctacacaagctcatctcttgctacccttggcgtacagctaagcataatgcatggagtctttcactcttaatattctttccatgcttccaagaggtagatagaaacagatggcattcagataaaccaaccagatggtactaatagtcgtctggaccaacaaggcaaagtaagcacacttccctctttaagaagtcaaatttcaaccccagtagacttcctaaaatacttaaacaattcacacaggcagtacatttcctaaaatgatctcaagtgtgcttatattacattaagtcttaaataacataatcatctcacggaagaaattttgtaaaatatcatcgcttctcattttagtgtaccccagcataatggcgattgggtacacaatgtgttaattctacaatttcgttggcatactatgtgttgtgtatggataagctgagaagagctagtgacttattagtcactttgacttttcagtgggtggcacagaaagaaactcgaatgagaaaaagatagcttagtagctaacaaggtagtacttactgtagtctaaacagccagagtctgatgtaacggaggagcagtagttcaagcaggatcctgcactggatgagttacttgaacatcctcctcagaaaaatagtatcatttctcagtaatgctgggagaactgctgttgtgatgattattttcatcagcaatgtcatatcaaacactcagcagcgggatggcaagatggcacgcggagggtaaaggcacttgctgccaagcctgatgatctcactttgatctccaggacccacaagatagacgaaccagctcccattgttgtctgagcaccatgtgaatgaatgactgcgcgcagcaacatgcatgtacacacacacatacatacactcatacacaatagctcccaaaaaagacctaagtactcggcggctacaaagcacccttcacactagagaaagctcttttcttactaggaaaatctctctttgaagtgtacgtttaaaggaatgattagatcctggcagacatattttaaaatgtaaagtggggaaacaggttctatcatctctaaaataaattcccactttaggaattttcaagctacttcaaattattgccagagtttaatggtggatagaatgaattaattaaatgtgatggcctatataattttcaaaggcgacttgacatgttctcaaatttaatccatccagtcaccttttaaaaataagcaaggactggtgaccaatgtcagacaaaatataatgattagaaggcttaggtcatcttccaaaaagttaatcatactaaaggccacacaaagattgactttttcgttttgttaaacttgtagtaaagaccaagcaaagatacttgtcttaaacattctgcaatagttgcactgatctttccacagactcatcaccctcagtacactgagacactgcttagtcttcagaaacatgacacaaatggctatttttacttcacaaaagctaatgatctcacagtcaatccaccttgcaatccaaatgcctttcttaaggaataaaattatcaataacttttctggcagttggtcctgtacagtagcaatatacaaaatcgggcttaaagtttcttaagcagacagttggctccttcctggaggaagaacggaaagaaaagtgctaagcttccttctcaggaagacaattttcagttcatactgtaaaggaaagccccaagtaaaaggtggcaatccaactccctgagctacttgcctgcaatattttgcacaataaagcattaataaaggtaggcaagaatggttcctggccctagaatgtgccagcagttggaattggaataatttagaagtgcaagttaaagattgaaggctcatccacctagttttggcctgcttttgctattcagtgtataaatacaccaaaatttattaatgacacatagggtgtttggggtaattaacattacccagaataatgtaagaattcgaggtgtctctgttcagtgggagcaaggagaaggcaactgagacactgtagccatatgaagtgagtaaactggtgttgttgactttaagtcaagagaagggctttgcccagtcaatactgttcaaacaaagaggcaaaagggatggcatgatggaattgagaaagggcacaaactcttccttaatgatgggtttgtgagaattagtgattcagaaaagtggtcaatggacaaactagaggccgggcaaaaggaacactataaagtgtgagattgtgactatttaggattgtatatattaaagcaatgcaaaaagggtcgaaatccgggtcattgttgggtgtacatactgctgtactttattatatcattgggaaactagcaggggatttgctcaagttggagtagaaaataaaccatccagaactgccattgtgcctattaagagtcccaaaatcagtttaaggaagagagcaggtcattcgtcagagcccctgtgctcattgacagtaccgggtagtttcgggggctcagcaacctctgcaataatgtaaaggggacaaaatattccagacattcatagttataaatacgcataacttagcaattaattctgggactcagtagccttgatggtatgcaaagagagcacacaggtccttgacatttttgcatagtaatcatccaaatgctgaggttactaatagttactaccactcagcagccccagtcaaaaggtaggcatttcagaacctttgctgccgcacaggtcatatgtgtaagggtacagattaatattgacaagagaagtgctcagaaataattaatatgcctctggtgtcaaaagagtacaaggatgtaaaatccaactccaaaggtaatgatggacaactaactgcattaatgcacttaagtccaaatgaagagcacttcgtacaaccctctttctgctttaaagcggagaagagggtacagtagttcttagagaagtgcttagacatgtgaactttccaaatgaaagtcttgagcttattatcacttcctgctgaaggtgctaaggaagtgagtgggatcctttcaagtgcacagagcaggtggcagtgcatacgcatacatttaatatatgataacagtccaaaagaatgcggccttgttgatcagcatatcctgatatagtgcaaatgaaaggcgaaggagtatggcctttgtttactggcaaagacaaaggaagattcactgtatattaatggtccactagcagggaccttgggagataaacggtatcccttgcaggagtgcaagagatacaatggtccgaaaagtaataaggttgtggataagtgtaattttacacattaactggccaagtatttttattaaaatgaatggatcatgtccctgttatatacattaatgttcaagggacatgttatcaattaaaaaccccatcctttatgcaaatattaagtctttaaagtaatagtcctggaaattaaagagtggaaaggaggggacagccttatccagtgtccaggaagatgaagaagccaaaagattagtgacccttgctgtactgcaaaagggtttgagagtaggatcgtatccaaatggaatgagatgtgtgcagtaaatgcatactaatatgcaaggtacatgtttatggccattacagttttacgctgttcaggtttccttctgtagtgaacagaaaaggcctactacaatcagtcattattattagcaagccacaaaatgggaccttataggtcaacaccacttctgtacttcaaagttaagagtaaaattgatcctactaaaattgccagtatgtacataaatagtttgaggaaggggtttcaagtgcacagcacatacataattccataaagcaaagaggatatgaatgatcagagacagaagtcttaccttgaaggaccattgaccgtattggaatcgtttcaatctatagtctcatgaaagaagctttatattagtgagcctctttgctttgctaagtacaggagtcctgatctaaaaggcacaactgtggacatgagaatatgtacaatagagttaacactgtgcacatttactatgttaaggatcttaaatactgctgcaatacaaataagtcttcaccagatgcagattactacagtgaaatgacatatgcacattcacaatatgaaagactgcatgcagggcatagtggtaggaaccagatatgccaacacttgttaaacgcaggctagatcctgagctcaaggctagcctgggttatatgctaagttccaggccagcctggaagttaaaaacaggacagatcaaaggtcttcttgattaccaacaaaatgacttgacttagtttggtttctttatccaatgcttaggaagagggacaaatgcagctgtgcacacaacaggcacaaatatgtttacattacaggtggcaatgcctgtaagtcccgcccagcccaggctacataagaggctgttctctcaaaccaccacacggtggggctgtagctctatgacagtgctttactagcgtacacaagactcaaggtttgattccccagcacagcagaaagaccagaacagagaagtggtctcattggttggcacccttgattgtcacccattagggtatgagggtatgggatcttggttactaacagaaggggacttgaacaactgcaattttgcacaattgtgtaagaggcattaagtaatcagcaccctctttacataaagcaagggtagtattaggaccttgagaaaagactcaattcctagtcaggattatccacataaaatgttccagtgcagaggtttttggctgaaataagaaagcatgtgagactagtatacaatatcatgagcaaataaatgtatctccatcagttagaaagatgtgacctggggcgatagcacccatgacagcatgccaacagtatatagtattctaccccctttaatggccaatgccttgaaaattgggactgagcactttaactgtctgataacagacctgtgtttgcccctttgctaaatgcacacagggctggactagctaaagtctaatccaatggacaaaatatttctgacagaattattcagtactcaaggtaatacatgagaaaagacgactgaacactgcttagaaacttgggactgtgactactacagcaatgacagaatggttttctttccttaaaggaaaggagacttgagagatgatacctccatggcaagtctctgatataaaactcttgtttgattggtgtatcttgattaacatgaaggacaagagttctttgtttacttgtccatggacaagtaaagtaggactgtatgcaaagtgaaattccatgactctggaagtcagtatggagggggtatggggtatagatgggctcagtcttataggctgagtgatgggcactgcattttagcaatacgattctatgcattaagtgaaattccatgactctggaactcagtatggagggggtatagatgggctatctcagtcttataggctgagttatgggcactgcattttagcaatagaaatctatacattatgtgaaattccatgactctggaagtcagtatggagggggtagagggtatagatagggatatctcagtcttataggctgagtgatgggcactgcattttagcaataggaccgtatgcaaagtgaaattctatgtctctggaagtcagtatggagggggtatggggtatacatagggatatctcagtcttataggctgagtaatggacactgcattttagcaatacgattctatgcattaagtgaaattccatgaccctagaagtcagtatggagggggtatggggtataaatgggctatctcagtcttataggctgagttatgggcactgcattttagcaataggactgcatgcattaagtgaaactccatgactctggaagtcagtatggagtgggtatagatgggctatctcagtcttataggctgagtgatgggcactgcattttagcaataggactgcatgcattaagtgaaattccatgactctggaagtcagtatggagtgggtatagatgggctatctcagtcttataggctgagtgatgggcactgcattttagcaataggactgcatgcattaagtgaaattccatgactctggaagtcagtatggagggggtatggggtatagatgggctatctcagtcttataggctgagtgatgggcactgcattttagcaataggactgcatgcattaagtgaaattccatgactctggaagtcagtatggagggggtatagatgggctatctcagtcttataggctgagtgatgggcactgcattttagcaataggaccgtatgcaaagtgaaattctatgactctggaagtcagtatggagggagtatggggtatacatagggatatctcagtcttatagactgagtgatggacactgcattttagcaataggaccgtatgcaaagtgaaattctatgactctggaagtcagtatggagggagtatggggtatacatagggatatctcagtcttatagactgagtgatggacactgcattttagcaatacgattctatgtattaagtgaaattccatgaccctagaagtcagtatggagggggtatggggtataaatgggctatctcagtcttataggctgagttatgggcactgcattttagcaataggactgcatgcattaagtgaaactccatgactctgtaagtcagtatggagggggtatagatgggctatctcagtcttataggctgagtgatgggcactgcattttagcaatacgattctatgcattaagtgaaattccatgactctagaagtcagtatggagggggtatagatgggctgtctcagtcttataggctgagtgatggacactgcattttagcactgaatcaatgaagattcgaatttctctaagtagaagtgggcttgggataggtctgaaagtatctgggcctggggctaggactgggctggggcagggctggactggattgggttggttgggtggggcaggggcaggggcaggggtaggggctggggctggggctggggcaggggctggggcaggggcaggggctggggctggggcaggggctggggctggggctggggcaggggctggggctgggcctggggctggggcagcaatagcagcagcactatttgctgagtcttgaggagaatctagatgccataaaggcaagaacacacagaaagttgaaatgtaggccttaatattactattataacagtaagtctgatagaggacacagagcattacaattcaaggctcttgctgacaagtaaaaccattagtcaatatagcatcaacaatagcaacaaaagcaaagcctgaactggtatagaacctcaaatactcctgacatccagtcataatgttcactttacattaacagtatctgtgttataagacttaaaaatttgaagagtagctcggtggatgagtttgaaagaaagtacatttaagtgccaagtaatttgagtatcatctgccaaaaaaattattgaaaactttaaggactccaaagtaacaattcactaaaggtaattaaaatgaattcaacaagtaagcaaatcgtaaatacattttgaaaacaatcacttcggttttaaattcaaacactagcaaagcacactatcagacgtgtcgttggcatccaaaatattcattgaaatcaaaatgcaaccccagcaatagtcatggggtagattttggaagaaggtaggattctacctcttcaccagtgatttgtgatccactatgactctggccaaagtcaccacttatacccagtaggcttagagaaccgcttgagatcagtgctggctaaatcagaggccaaggtgtaagtagactagccactgaacaatacaaaggaatggaacgggctgagttttagtttgcaccgccacgtatagagcactgtaagagactatgaacgcaagcggatgagtcaaatgtccttgaaatggccttagatacttttctttcttttaataggtgaggtttcaatgatttacatcgaccaagaacccgcagcctcggtctctcgaatcggatccgacatcatccaacacttcagtgttagaattgcaagcatgcgctctcccgacctgggcaggcacttcgaaaaaatgatgactaaagacacacgtgaagtaccaagcgaaactcacgtccttatgggacagtgactcatcacagtctaattccatcctggccaccaagcaataatgcacatttctaactggaagtcaagcaaacaccaacactttcacacttgtgcccatttctgacgagttacgtcaagtggcaaccaacacttccacttagccttgcctcagcttcgagtggcacaaggtaggaccaaccacaccctaccataatgcaccaagtgtaccctcgggcaaagcccgccaagtagctaaagcccgccaaaaaaaaaatcactgaaagaaaccactagagggcaggtcacatgacttccgccatcttagacacattcaagagcatgtgccacctctccaggctaactcagacatgaagctgacatgtgacacacaaagccctttgcgttataccgcaccaagaacttgagccgccatcttttcctgtacgacctaaatgtcctataatccattgctacacaccagaacaaagattgggctgtcgagcctcgggtggagcccccgagccgccattttatagacttctgagcagcccttaaagccacgggggaccgcgccaggggtccatatgcacacacaccctgcccaatccccacacccacgctgagccctatcccctagtcctctgcggcttccgcgcaacaccgcacactaatacgagcactccttggctttctacttccggctagcacaaccccgcaaatgctaccacaaatcaaggcgaatcccgcaaccccgcacatataaagaaagcctttagctagcgcagcgcaattggttgcttttatccagtccgctgtgctcctcggtgtcctaattcttggcgtaactggctcgagaatagccgtatcacgcagaagccataatggcggacgcgggctctccacgccctgaacacccactcagtttaagagcaaagtcgtttttctaagccataggttcactcacacagcaccaaacgatcagcagcaacagtacacgcaaataagaggcatagatattccaggtagtgcaataactcacaaaaccatatttccatccaccaagcgccccgttgggccgtgaaaaaaaaaatttaaagcaggtatccacagccccgatgggcaaaagaaaaagaaaaaaaaataataacagcaggtatccgaggccccgttgggcatgggaaaaaaagactaaacgcaggtatccgaggtcccgatggaccgagaaaggtttttttgtttttttttttttttttacaaaaagcaggtatccatggccccgatgggctaaggagaagaaaaaaagaataaaagcaggtatccacagcccagatgggcaagtttagaaaaaaaaataataagaaaaaaaaagaatgaaaaggcaggtaagtatccaaaaccccgttgggcatggaatggcggggaggacacacaggtatccgtggccccgatgggcaagaatatataaacaatgaaagaaaggtaagtccaccatacacacacaagtatcaaccaaaaggcacaacaaagaaatattccttaaaaatgaaaaattgactgaaaatattacaaatatcaaaaagtatggaggacatgtcaaaaaaaaaatcttaccagaacatatcaaaacgtcaaaaatctcgtggaattttgatatgttttcttaaataagccataaggcttggtggtaggggaactaaaaatgttcccccaaagctccttagatggagagaaaccacggaagaaccgcacatccacgggaaacgagcaaaca

SEQ ID NO: 48 - DNA, 18283 bp, Mus musculus
gcattcacagaaaagaagtttattcaaagacagggaaacccagagaatcactgggaagttagagaacagtgaggcaacaagcttggtcactttagtgcttaaaggtctcctagacctagccagtgagagtgtctgtggtggttgaagagatatggccccatagattcctgtgtttgaatgtttggccatagggagtggcactgttaggaggtatggccttgttggagtaggaagtgtgtcaatcagagcctcctcctggctgccttcagatcaaaatgtagaactcttggctcttccagcaccatgtatgcctgcatgctgccctgcttatcaatataatgataataggctcaccctctgaaactgtaagccagccccaatcaaatgtttgcctttataggcactgccttggtcatggtgtctctccccagcaatggaaccctaagacagctctcatgactcatctgccagtactaaacacggtggaggttactccccttgtccggccagccactgctgcattaggaatccaccctatcaggggcctttaacacaaactggagtttagcagtctccctcccttaagctaataacattcaaatcactgcctgcaggtaaagccaacgccaaagatctggaaacagttttaggactctccttgaggaagcagctcgtactgtgtctttttcttctcgccactatgataatacacacggacaaaagcgcctcacagatgaaagcatttagttttgctctcagctccaagtgcagtccactaaggtgggaaggcaagtcagcagaagcttgactgaagcaactgctccacagtcagggaagatggagccaagtttgcctgtgcccagctcactttctccacttacacaatccagaagccatgccagggaaggaactacccacagtaagaagggcttcccacctcaataaagtcaacacaattctcgcccagaagcctcctcccatccccaccatgctaggttctatcaagttgaaaattatccatcgtgctatgtatagttagaattccctaaacaaagaaaaacacatttttaaaacactggatcctagaaaatgttaagatgttcatgacagcaaagaattacttttgcttaagagtacatgttaaacattactgctttaaattatgggttttgttagacacaaaacagatactatgatgactttcattatggggaaactgaggctcagaaaggttatttagtccctggccattttgctggtaaaacgaagaatgaagattcatattcaggccatttccattcactgtcttgttagttttgcaggtaactctaatttctgttttcccatctgtaactcatgcagaggcagagggatgccaaacagtgcactggagagtggtgtggatacatcagctttgggagatgaaacaagaagtgtattatctgcaagaaaatgtaaaagtagttataaagtaaactaaatagatccactctttagaatcttgtggagaaatatcaatactaatcaaggtgagcagtaaaatagcccttcttcttgactcttccccatttgttggtgtaccaatgcatgtaaaaagtcttcaatattttttttgcaagtttgtaggctagggatgtaggtaacttgcctagaaaacacaaaaacttgtgtcttattcactggaagaaaagggggaggaggggaggaggggagcagaggcattacatattagaagactaagaatgggtttagacagaaagcagacagagattaaaatactgaggcatttgatcttaaaaaattagatagaaggtagggactagggtgcctagcctacctcagacagtagaaatttaggccctgaggattatataaatagaaagcctggaaataggctcatatggtaagtagacagagatattaaatactttaggccttaatctcatgaaggttggggcaggggacagtagaagcactgtcttcacagataatatttctttagattgtcttatttgctttgaattgtttcaattatcaaaatgagtgtgattttgagtttggtggtcatattaaaattcctctgggagagaggtcaagctaaacgtttaatgatttctggttactgggccaaggatttgctattttgggagaaaggctctgcatttgtgttgacaggaaaggagagtaggctctggacctcttccagagtgatatggatcagatatgacagggggagaacccctgaaaaaccataaaagttcaagaaaatcaaacaggacaggtaaagattcatggtgccatctttcacatggcatgaatgaacttcttataactggttattaataagattaacgcataaaaaagacagttgtcttccacctgctctaacaaggaccaaaatttcagccttaattgatctgtgcattttgcacaatctatacaaatatcttaatggtattgaaattttggttgtaagattcatatattacagaatgtacagcttttttgagattcatcctaaaagatgttgaactgatggcttggccccctgcttctggctgctgcccaaaacagctttagtgattgacactgattccaggttgccttgcctcatcaaaactttcagacaaatccagtcagaacttcagtcaagccctgagccttgtaagcatacagagactggataacagatgttaaagctaggtttcttaagtctaaattttctgatttttctacccctttctaccccttcaaagaaattttcatccccgctattcagcaggaagaagccatggagaatcatcagccgaattccctgggtggggtgtctggtaatgggtattttacaaattatagaaaagctgtcattttaagggacaatttaggaatggtcataattttgaacagcgaggaaataggtgggattactgaattttatccttgaacaaagcattgtgtagccataatcttaattggtagaaatctttataattgatgcaaagttgaaattataattcccttacattggtacataatttattttgatacagatttaaggttttcattggtatgaatttcttatattgatacaaaatttgagattaatattgtcactcttagataggcattgtacctatgcaactcatttaagaatacaaagcttagacccagtcctcctaataactgctattacaaactatttttagatgattaagctatacaagttaagggccagatagcaaactcatggttatgttagattcttatttaattataaaagtgtgttttcaatatattccaattagaaatactaagagtagtcaaggtttaacagttcagattacctcatatatagagtcttcaaaagcatcagaaatccacaaaatgttacatttaatgttatttcatcatttgacaatgagacatgtctgctcctgacagcaccgccttcttggttcaaagaagaaactgagcatcttcacctccaggcgaggttgtttatcgtagcaaggaagtcactgggcagaaattgcctatttcatctgcagacaaaacataaacggacacattatgtagaatagtcgactgttagctctgccaaggcaaggtaaacagccattcataatcctgctttgcaaaggtttgtcagatgaacctgggccagaaagctgaagactgatgctccaatgatttgaggaattagggggctgtccagatagtcagccatctctacagtttgtttacatttgagaagctatgtttggtgcttcctataaatccaggtaatgtttaagtcattctcacatttctgacagggttgaggactacctttagtctcataatcaaactccagttatttaaaattgagagagaggttatagagtggaagacatggttttcagatggtgttacaggctaaaatctaaacgtaatccaggggtagaatcataattctttaagttaggaatgatggtagagtactttatctaattgacaaaaatgatggacaggatgacatttgtatatcatactatgtaatttacataattgttatggttttgttcaatttatgtctgggagaagagggttttactatatttttttattggacagaaaaggtgaggtgcaggggtggttctgacgctaaggttctgttcttcaattggttcttgatctgtcagtaaagaagctgtaggccaattgctgggcagaagggataggagggacttctgggtccctgggggcaagagagggacccagagaaaagagctttctccatgcttcaaagagagaaaagccaagcagccatgtgggaatctcaagaagagtggcagactgtgaccactcctacaggcgggcgctaggggatgtttagcaggactaaatttagctgagcaactaaagtttaggctgggtggagaggtgcagagctgagaaaattgatggggttacactttttcaggtggggataggtagcgcccagcaactgtgtcaaaaggcaagttgaaaatgaacaattgtgtgtgtgtgtgtcttttattcatggattcaagggaagctgagtggagactggtagtgcggcctattcccagagctcagaccaggtagcaaagctacatgcaacagctcttaggatttttttttattcaaatataaacttctgagtgggtaagaaaagtatacaaagtatagttagtgtaacatcaatgatatattgcatttacataagaagctatctgaaaacaacatggcattgagagaccagatcttgggttcagattccatcttagaaaacctgacctgaggttgaactcaaggtaactagcagtccagtacctagcactagtttccaggttacccctaacaactgtgcatccagcaccagcttctaagttattccccaacaaatttgcacctccaggttacaagcctggccctgacacttcacttcctaccaatcaccagtcaggaggaaaacagaagttaagtttatgggttggctcccagcaccaaccaattatgttgaagatcataatgtctcctctcttctccccccaccccacccccatcagatatataccaggctataccccctacttgtctctgtaaatacttgtctgaaactaggcttagaattccttcccattctcctgtgtcagagatggtggtgtggcccaagctcaagcttgaataaagagaccctaatgtgattgcattggaattggctccttggtggtctttttggggttcatgaacatttcccagaacaacagcatattatattcatatttactaaactaatttactaaacagaaacaatagtcatttgtattaggattttaaaaactaatagggtgtgtgtgtgtgtgtgtgtgtgtgtgtgtgtgtgaaagtatctagagagatacacatatacatgaatatggagaggagagaaagggagattatattataaggaattggcttgcacaatcaagcaagccaagaaatctcaagatctatatctggccatgtgtgagattaagagcctacagtcctagtctgtgcctggaagtctgaaagtcaggataggcaatggtgcaaattccagtctagctccaagtctgaacacagaggagcagtgtggaaatatcaaaagactggagaattgggaagagtaatctctttctttccatcaccaatacatgtcagtttcacccagaaacaacagggtggacatattccaagagatgctttgccatacaccctgtgatccagtcaactcaacccctgttcactgcactgtgttttaatatggcatatgattgtaaggggatagatagagtgctcttacactttgcatgtggaagactatagaacaaattaaatgactttacaagggagcaggcaaataccaaatgtgataatagaactggactttgaagtacataaagggtataaggtgtggtgtctgggtttgttttcaattccaaaagtgaaaaaaaaattaaaaattttaaaaaagaacctaaagtgaagtggaaactttaagggtttggtggaaagtcagttgtgttggatggtgtttgctgaggcaaatacgtgaaggaacagtttgatgaagcagacacacgtaaaaaaaatgttctgctaaagcaagcatgtgaaaggacacttgatgaaggattcttcactaatgaagcaagtattggtccaccttacattgtgtagttgagctccatttatcaggactccatagaaatgaactaaaaaatttctgatggtgtgctgtggcttcttgtcactttcaaggactcaggcctatcgaaagagtgatgtcaactgagacagactcatactgacttttcctaagtcagattcacatgctaaggcaagacatgttttgaggtaagacctgttgacgtgatgtttggagggagtataaaaaggactcattggactgtgagaggcttgtctaggcttgtgtgtagagctagctgtgcaacacttgttggtctcacatcttcactgatgtttgctttgataacagaggcacagccaagaacttttcctgacattcctgttagccctggtccctcctgctgacttgtgcctattcgacggaagcctggctgttgctgctagatcatgccaccactgctgatttgtgtttactatcctgactctactgaactggactgcttgtgtatctgggaagtgtttgcaagtgaatcgagctgctgatgctgatctatgaagtaaattgatttcctgacaatgcagattggatttgttcccgtttctaaacaggcccacttctcccatatcctttctttctcactacttcttgtgggtagtgggctgggatggaggtgttaaagagtttaataaccatcattaaaaacaggttttgaaaaacatgtggctaaggaaaaagctgagtagatgggacaagtgcatgtggccaagtctgacaggctctgagcctcctggttaataggaggaggaaggagccgttgcacgtgttagaggtcataggaagtccacatatctagaaatgagctctggctagactaaggctttctgatagttagatcaaagctcacagaagcttgtgaaactggttcccatctgccaaaaggagactttcccctcacctctgacagagggacgtatggctacctgtggcacctatcagcaaatcaaagcccacactgactttcagagtccaccctagcatcctgtccctttcctcccccaagatattcaccttccttataatctgcatgattttcccaccctactccctttatcctgctatcctccctcccttctctgtctcttcctatccttttgttctcatggatgctctagtatctttctctatctccactgctctctcctactatctagcttacctagccctggccatgtccagactcattttctttcctctctggatactgtcttcctcttatgcacactaaaatcttcccccactaaccatggagcattgatgtcacaaacaccccttcacaaaaacactatgtttcttttgtgtctaacaattttattcaaaattctaaagagaaataactgactggtaatctagatagttcccctattggtttctttactaaaagatttggctttgatgactggaaacctgtttatcactcatgattcattttttcacaatgaataagacacagtgttgtagacaatttatttcctaaacatctttcaaatatgcttcttttcctttctggcctattcaaaccctaatagcatttacctagacaacatttacacattgctagctggtctccttttctgtgggtcatttaagcaagacattaagaaatttacttgcttaacatctacagtgtaaactcttttgactgaatgcacagaaagagggaaacccagagaatcactgggatgctaaagtacagtgaggcaacaagcttggtcactttactgcttaaaggtctctctacacctggccagtgagaatagttgttgctactaactgaacaacactaaatatggttgaggctattccacttgtccagccagccactgctacattaataattcagctgtaattcccaaaattgacctgtaaagtccacctagccaggaaccaggtaactttttggaatgctggtaattgtagttcttggtaaataacaaagcctcatggtggcctatagatttgtccttatacgttcctacaacatatagctggaatggaatccattctcaggtggaaaccttcggggaatgttcctggccaaagtccatcccctggtcagtatttaacattgaataaatcttgcttcaaaaatggtccaaaatggtggagctggtttttctggtgaatgtcaggattaacgtagcctcatcaggatttctagcaattatgaaattattatggacattacgacattgacttgcctaagatctgcaactcctctactagcaaagctttcttaaagacacagctccatcccacctctccagttgcatccctaaatgttttcaaaccacaacaccaaagtaatgtaaagtttgcaagtttaacccataacattagcttaggccttctttgtagtgcacacactgctaattgagctggctagcccatactcatttccctttccaacactcaaacagcattaagtatgccctgctgggcattctgttttatagtacaagaggaactataggaaggaattgtctcatctgacctgtttgtaagctattattaaggcagaggctacgacttttatctttgaaactccaacacttatcaaaatttttggtgtaaatttatgtgatcaacatttttaagataaaagccaggttccgtggtatatccattgagagagcctaggtaaatcaaatacctacaaccaaaacagaaggtacaggatacgacctaaagaagaatttcaggactttttgttgttttaaggaaagaatgcttaattccagttttaggatataatggggggcacacaactgaaaaaaattaaaagcatagcaatcaagaagaataacaagtgggattttaatacttagagatgcccccaaattgaaggaggagtttaggctcctatattgcttgtatacaatgagtgtaatgtaagactagagagtcatcctactgagcatgtaatagaatactggaaaaagctgacgcaagctagatgtaaatgctggctaagaggatatttcatttagaaggaactccagctttgtaaaaggcagtaattaggagaagactattccaataacagtgccagtccaggtagggggaggaggtgatttttcacctttcccagtcagtgacgtgtagacatgcagcagactgcgggccaaatactggccctgttagttattagtgaggcaatcgtgatcgtgtcagttaaccttgctaagtctacatttcctcatttattacatttatataacgagatttttagtgttcaaataaacgagtgatttatttcagctgcaaggaataaaatccagatcaaactagcataactgaattgttaaaaggctactgactaggtcagtggaataaaacagaaataaaggtccctaccaacgtagtaactgatctttgataaagaaactgaactacaagggaacaaacccattttttcccatacatgcatctgtgtatttacatgaataaatgtagacactggacataaaaattttacacatattaactcagaatttatcataggcttaagtcggaaatgcaaaattataaaattgctggaggataattggggggaaaaaacgctacaaaacctttggcttagtgatatctttttagtacaatatccaaagatggagcatggaagagagaaaaaagcaactggcagtttagtttgcttcacaaaagatagttaaagcagtggcgactgagaggaagtctctgcaaggtacttactttccagtacaggactggtatccaaaaagaagtaaaagcactcacactgaaacaagagaagagataacccaaatttttaaaagggcaaaatctgcacaacaagtggattagggagtgggctagaagttgttggtgtcacattttccctgtgtccctagaacttcagtgaaggtcaactcagaaggaatggcctaaggatgtaaagatggctccattcgtaaaagcacttgttgcacaaggctggcaacatgagctcaacccgttgtgtttagaaaaactcctagaagctgtcctccgacctctacactgtaaatatagcatgtgtgcacctgtacctacagcacgattgatcatgttttgcagatatgaaagatccaagagtaagaaggtgagaggggcctgcacaaaagttccagaaagacaatgaagtcatgcaatgtgtgacaggcatggattccctgcaagaagaccctgaaaacccattgcataaaaccaggaaagagaagcataagttacggctacgtagacccaggatctctgcaatgccaagaacatgaacgtctgtcgaggagcgctgctcccgtggtatggaggtagactaagagagcttacttatgctctgggtggctgcaggacttcatgtggccccctggggcccagatgattctgccataagccccagatgtcagaaatggaactgcagagtgtggcatttgctctgtttcatgtcagtcttgccttgatctggcatttctttgctatgcctctattgctcccttttccagtgagtgtgatgctgtgccaatgcacattggggatatgtgacttttaaaatagggctcatggagattgcctgagtctagagagggactttggacttttgaacagagttgaggtttttagactttgtagacttctgaagtcataatgaatgcacttatattatcagatgactgtacaccactagggaccagtgctagaatgctctggtttaaatgtgaaatatccgcattggctcccatgtgtgaacactgggatcccaactggtggtgctgttttgaaagcttgtggaaccttcagaaggtggaatcttggtgaaagaactgggccattccaggagggcctggagaatttacatcctggacctcttctatgcacttttttcttgactgatgacacaatgtaatcagccgggtcacactcctgctgccatgcctaattcactgagaagaactgtatctctcttaaaaccgggagccagattaagcctttcttcagttttcttttgtcagatatcctgtcgtttctatatatggaaaatctcttcaatattttgaaaacctatcaaatggcatcagaagcagttctatcactcttatcagccgtgtgagagtcacctagtagcgcatgagcttcacagctctcatgtatcattgtcaacacttgcgacatagtgtttaactgcatccctactctaaatgggaagtgaagcttcagtggttttgatttgcatttccctagtgtctaatgttgagtacatgctaacatgattcttgtccattgactgtcttctgtgaaatgtctgtgtagatcctttgttttgaaacctgccttgtcttcattattaagtaccagggatttttttattaatgcattttgatatatttcttaccaggtttgcaatttccccatattttattttattttggggattgtctttttcatttttgactagtagtatatgaaataaaaagctgttgcatttagctaaaattaagtttgtctattttttcttttgattcttttttatttattattgtttacaaaacattggcttattaatggatatgattatcattgatgatgattattcctgattttctcaagattttttgttttaactaatacattcaaatctaatttttatattcatcattttgaatgtagtacagaatggagaggacttctgtattttgcatgtgtctattcaggtgtcccaacaccattcattaaaaacttttccttcacactgaattatcttgccacctatattgaaaatcaatcgactactactgtaaagttggtttctagaatttgaatcacattttgctgttatgtgtttctgccactatgactgtagacacctcttcgatcaacacaggactgcagttttgaaatggaaaattgtgagtcttccaacttttattatttttagcaagatggattaatgtgcatctcaggaccagcaaaacaagtgtggtgatattttaatgtggattgctctgaataaacagatcaattttgaaaacaagtaccagcttgaataacataacatctgattcactgacactgaatttctatgctttctttaatttttaaatagctttgcagcttttagtatgcatgttctatatttctttcattaaatgtactcataaatgtgtttttactagagtaaataaaatttttattactttatttttggattttccattaccagtgaactgaaaaacacttgattgttacatattgattttttaacattgctcaactcatttatcactttcagtaggctcctgaagatttttccatatacagtatcaagccatctgcatagatttatgttttcctctccaatctagatgcctttttccttttgtaattgctctggctaaaacttctagcatgatactgattagaagctgcaagagcaggcatttttatcttgttctgatcttagggttaaaatactcaatctttcaaccatgaagtattacattagttgtaagtttttcctaatgacttttattagtttcaggaaattctcttctattactagttttcagaatggttttcatcttgaaagtatgctagtttttgccaatatttttgtgtgtctattaagatgtctatggtatttttagttttatgatattcatatggtatagaatattgattttcagatgtcaaaccatcttagagtcctgaaatatatctctggaatccaggaagcaatctctttcttgctgtcctcttgagatagggtcttactatccagcttggttgtccttatattcatcatagtcttccttcctcagtatcctgggcactgggattatagttgtgctgtaggaagccacatgtgctgttgcagggtggcactggcttccgctggccaccacgcatacataggcagtaaagttattttgccaagatgaggttttgagaattaatcaaaattaaccaatcagatgagagacaagttaaccaatcggatgagagagaagttaaccaatcagatgagagagaagttaaccaatcagatgtgagacatgcaaatgaggtgttaagcataacccattcataaccaatccgggtgtgagacacgcctctcctaggcctatataagcagcaccagttctgggcttggggtctctttgcctctgcaatcaagctctcctaataaacgtgtgcagaaggatcctgttgcagcgtcattcttgctggcgagtcgggcgcgcgcaagagtgtgcaccatcacaacctagctattaaatcccacttgattatgatccagaactcttctttacacattgttggatttttttcctgatgatagtattttgttgacaacttaagtttttaattgattatatttttcttgtcctttaacagcaagtaaagataatgtatgcaaatactattagttaaccattatgcaggatgtttcagtgagtgataatctgtttaacattgatacacatgtattgggaattggttctaatgctttgaaataatctgacccccaaaatcaggatgtccgaacgctgaaggtccttgtccccatttggtttttgattaatcccgctgaaggtccttgtccccatttggtttttgattaatcaataaagagccaacggccaatggctgtgcaggcagactgaggcaggacttttggatttgcacaggctagggacaggaagagaggaaggagagatcaccatggcaaggaagaagaaagaacagacctacctcctacccgccatcacatgacaatcaggcaaagtggccacatgggctacttccctaattgtgtttagggtagcagagatgaaagatagattttaaaagatattaactcagaagtaatgaaggggagtgtttgttagcagcaaggagaattagaactgtccagcctttgagctaatcaaggcatatttaaaattaattagtgtgtgtgtgtgtgtgtgtgtgtgtgtgtgtgtgtgtgtgtgtatgtctttcattcatgaatccagatagctctttggtgggtgagtgcatgtttatcgctacacacatgatttatattttaataaaatgtgtgttcaacaggaaagcaaagtgtaaaatttgtcattttagctaatgaaacttaccaaaatatgctttcaaatccctaaatggatttattctctatcttcactccatttagaatgtttggggcaaatttatatgctagagtgacatatctcatttattgtctgtttttctcaaggtctagtttcagtacagaggcttcttatacacacaccactgccaccaccgccaccaccaccacaaccactataactaccacagccacccccacaatcatcattcaaaacaaagattaatttaaaaaaattaagtatttggtagaacatcaactgggattcaattaaatcccatagtttttccttctctgtctcttagaggaagccacatttaaagatcttatctctttctcttcatctcctggtcttacatatccatttgtaatcttcaaccagaaaagttaaatatttgtagcctatgaaccaaatctgacttgtgcaaacatttgatacaaaattaatttaattgctgtggagagcttttagagccgcttgatagaaatctgacattggccaaggacaatggaatgggcttcaggcaggaatcttacgttaggccaatgactgggaaggaagttcagtcaagaatctgatttcaggttggaacaaagaagtaggcttcaggcaggaatctgactttgggctaggacagggatgtaggctcagatatcttggtcatcctgttaagcccttagaaacagtgattgtaggagtgaccacaggactttattgccttgcttgttccttgactatttgtgtttattagcttgctgttcctcaatctagaactaaccttattacttgcatgtaattaaaatggtataaaagcagtttgggaaaaaataaacccacctcagcctcagaactggctggggtcacgatacaatgttgtccaattgtctcttttctttttaatcctcactcctgctctggagaacctgttgactgactgggctggcttggtcaaattacatatcaacagttataggttagcaagcaataaacatctgtgtatctgatttatccagataaagacttgaaattcgggcagagcattgccttcatcttacagctgcctcataatgaagagtgagctacttcttcagttgtgacaaatcccttagtttttcaggctttcacttcctgttacatgagataggccagttttactactgattacgataaaatggcttcattctctttctgttgtcctttatgatgaacttagtctttctgggagtccttaaagtttcaacttttttccattatattgaggagcatggtgctccgaggactcatcaggaaacattctgagaactgagaagaagccagatatgggctgtagaggtttgcacactaccaacaataaaatgccaactgaagatcacaaagaactagaaaagaggacattttactcaactgggtatagtaactttgttcttgtaacacctcttattgagttggaagtctggttctgagaaagactaaaaggcaagaaagtagagtccacttgtacggatgattgtagaaagatcagaatcatcagggttgattttgtgggagaagatgaagatgagagaaaatattatggtaataacaaggaaacatataagaagtagctacagagtctatgacatagcatataaacaacacccatacctttaacgacgaattgagagagatgctgctttcccaagaacatgtctcctgtagggcagcagaaatcttggactggggagtggggcgctctccttacttcagcttgtttctttgctcttcggttcttcttttgtatttctcaaaggcctcaattatcttagagatactaagcctactttgagatatttagcatttgctgcaattacttttttttctaaacacaagtacttcctgttctcttcagcatatgattatttcactaatcagtcaacctgaaaaaacaaaaccacaagaatcaaaagctacattagcaatatacacccacatttggacttgtagactacagcttaacagtcctagaccctgggaaaacatgatttgcaaaacaaaagtgaagatcagcttccttggtgtgattctatcctgacctctgcttctaaactagctattttaataaagcaatcaatctactttgtggtaggaattaaataatttattcttggtttgtatcttacttttctattgctgtgataaaacaccataaccgaagcaacttataaaagaaagtatttaactgtgggctcatagttccagagggttagatagagtccatgaccctcatggtggggagcatggcagcaggcagacatggtgctagtgtaggacatggtgctaatgtagtagccaagagcttagatcttgacctacaaggatggaggagtagtgggcaaacttagaatggtgtgggctttcaaatccccaaaaccatccccagaaaaacacttcctccaagaactccatacatcagagcccttctcaaccagttctatgaactgggaactaagtattcaaatatgggtctgtgggggccattttcaatcaaaacacctcagttacatttattatgtcagatagaatctaacagtttttgtcaaagtaattggtaaagcatacctctataaagacactaagaaaatgtacagagcaattatactttgttaacaaatacaagaaatttaaaattagaataaggcttgggatatgacctagttggtaaggtgcctgcctctttccccaaagcatgggggctgaattggatccccagcatccacaaaacagagaacccagtagctgggaagttagaaacaggcaaaccattgggggcttcttggctagcccagtctagcctaatccatgagcttcaggttcagcaagatgctgtcaaacaataaactaatcaataaaaaattttaaaagatggagtgtgaggaatgtactgtgatacaaaaaaactgctctcaccttaaagatgagccacatatcagttagctcaagttttacagtatcaaaatagaaaatattatataatttaagactttgaaaataagataacagacagaaaatttctgctataggcctctaatataagtcttagcttctgggctggtggaagctaagctaatacatttcaaaggtttcatctgatactcactagtatgctggctgtttaggtacacaggttagctaggaaaggctattaattaaaagagcgaaagacagctcaagataatttttaatcagggtttgaacttacaacataatttctccccagtcatttaagttctaatcagctaatcactcctgcagaaacttcaagtttcaacttctttccaggaatctcctttacacccaaagtcacttcaagcccacagcagcaaacagatgcatgtgcgtgtccgatgtgcacacacaatgttaaaacaagattcacttttcccacctttagcataaatttggcccagtcctatttctacacaactttaagtaagaagttgctatttccacgactttcctatacttttcaacgtggtttcaaaaccctaaatcggaaattcgataagctgtaaacacccctacagtaaatgtgtgaacaagtaggccttttctctatcttccctaaggtaagtgtccagctctctctctctaccaactaggaatgtgctagacttggtgtggagccagaaattccctaactaggtaacttcgggacataggggattcttttcattctgagcaagtacaagactttcagaaccattcttctttaccttggactaaattaacaaagacacatcttcaccgtgaggatgaacctaccaaagcttttatacagaacccgaggaaactctgaccctgagcagctgctgctgtgcatgggcccaacctgcgggctcttccacgtccgttcgaacttccc

SEQ ID NO: 49 - DNA, 4017 bp, Mus musculus
cagctggcccagtctgtgtggaggtagaaaactcaccctaactctgggctaccccttctagtggcagcccacacaaaaggacatggagacttttgcttcttgcccaggcatcctcttgctgagacatcccttctctggtattagaacctacttcttcatgtagattgaagatcagttgagacatcccttgtggactaaactactgaattcttgactttcttgttggataccaattgttaggctatcgggaccacaccctgtaagccactttagtgaatttccttttaacatatacatagctcattctctgttgttctctgggaaaacctaaatgtattagtactcaaaaactttcattcttcccggacacctgaaatctcagtaagaacaaggcttcttttatttacctacttgttttataggtttgtggagacaggatttgtgtagccctggctggatgttataagatagtttatctaaactacaagactgttccaggggactcctttatctcacagatggtggaacgtgtgaaatccagtcaagctatgcaaactcctaagtacaaaaggctggtgccaccacagctgctgtggccaccttacatgggcacagcgccaccttgtggtcagtcctaaactaaccacttgttaccagggcaatcccagccaggctgtaggggattttagagggggaaaggaaaccattatatttattctacaggaaactaaggcactcagggtgttttcaaacattcagacacattctggtcacttttataattttattgttttttttttctcttcacatcttttaaaatagaaatagcctatgaacaacagtttcttctcccaaaacctcaattcaattgattgcctcagaaaggctgtcagaacatcacttggaggcacaggtcagtggcacacttaatgcctttgccctggggtcaatccccaacactggagaggggagagacaaaaacaaaaaactacaaatcaaaacttaaacactgccatctcactccctgcacaactactggactcagcaggcagcaagttcaaatttctgcccacaaaaatcagctggtcagtactaaatctgttgtcagccagacttctctctgctcgtctctttgcagttcttccatcagcgaatcccaggctgatgggcatctttcagggcacagtgaaattagaaggagcagtagtcagtcaggttctagtcacctctcctccaccagctggccagctgggaaactatctccagcctcgctcccggctttatcttcttcttccttaagacattgctcgcagttgcacagaacaatgactacagtgtccattaacctgagaagtggtttgagcctgacatctttcctgagctaaaaatgagaaaaagcagagctacggccttcctgccacagggtcaagagagggaaagctctgaagggcagcgctgggaagcaatgaactctcctcaagacgagggacaagagggatgtgctgcagccgagggtacaaaacagatagacagcctggggtcaaggacagtggaggggaaggacaggtttattttccccttcggaacttccccgctcccccagtctttgctttcttcttagcaggccccttgggttctggctccttgcgcttagctgaggagagtgagcctgtcaccttgaagaaatcatcgaggcgtccctgggtgctgccctggcggctcttactcagccgcttgaccccactgcgaattcgctcttcagaaaactgcttttcaccacacataaatttgaccaactcttcttcatttggctcgctccacttcagctccacagactctgggtccagtacttctggctccaggaagagctgctgggcttccttgtggagccagttctctggaacggggtacttgctggggtccagccgcctcacgatctcctcgatgctcttatgtttctggatgagatccacagcccgcttgggcccaatgccacggatgctctcgcagtagtcgctacccagcaggatgcacagatccacaaactgctcctggttcagacccagctcctgcaggacgcggctcagatggaactcttggatgggcagcttcttggcctcactggcagttaagtgtcgcattagcacggggctgccaaaagtgaggcagtccatgtcctccgtggccgcagcatagactttgccagcctttgccagggcagcacagctggcctctgcctcgctgggtgcatcaaggtaagggatgcccatgaggctcagcaggtgtttgcactcatcattgtgttgcttggtgaccttcacgagcctcttggtgaacttctccacctcctcctccatcccagcctcctgagcctgctgcagttgcttctcagcctcggcgcgcctctcactgcgcttggccagctcgcctgacttcagctgtggtggtttgccatcaaagacgtacacaggcttgatgccattctccatcatgcggatggtacggtagaacatgcccatcaggtggctggtggtctcaccctcctcgttctgcagcacatccccaccctgacgaacagcaatcaggaactggtagatgctcatggaggcatcgatggccactttgcgaccaaagtagctcttgatgtcattctcacggatggcactgggggccacatcagcaattagtttggcaaggccgtgaattcccatggtagcacaggagcaatggctaaaacaaagaaagaagagtaagaggaggaacttggaggatacaaaaggaacaaaagttttaagtggcaacattcaccagtctcatggttcatcaaacttaacatgagacacagcaggactccaagccagcagagcagaagaggcaaaggtgaacaagatccaccattctcaagcaggcctcctgacaatcagaagctgttctgggcgcttcaaggaatgagatctgggatgttcttttgtttttgtttttttttttggttttccgagacagggtttctttgtgtagccctggctgtcctgaaactcactctgtagaccaggctggccttgaattcagaaatccgcctgcctctgcctcctgagtgctgggattaaaggcgtgcgccaccacacctggcatgggatgttcttgaataacttaagggctctgaataacgcaatggcaccatctgtcacagagtgacttcaactttaacctgcattaaggatcacagaagacagagtgcttggctcagcttgaagggccctgagatcatcaaggcagacgtgaaccctcaggagcaggtaagtaccagctatgcgaatatgactatgtctgatttattgcttctccacagatgtctaaccgatgcagcagacctgaggggtacacctctgcataaggacaggtggccacctcactgctgctactcttcccttcccatctcccttagcacttgagggtgtttttatcaggatgccagaggagttttaagtcctcctctttgtactctcttcccccctaagtctgaacgccatgacttcccacagatcctgaactgagggctggcatgctggattcacacagtccaatactgcatgcacttctgtagtacttccatcaaatcactcctagggaagcattttcaaaactaccctcacaatttttggctcctccaattgaaacattaattttccttttatctaattatttttctttaaatggactttcaagaaaaaaaaattgggggttagggggcaaaaaacctagttgtgagtgatggtgcatgcctttaatcccagcacctggaaggcacagtcaagtggatctctgagttccaggccagcctagtctacatagtaagtcccaggccagccagagttacatagttgagaccctgtctcaaaaacaaacagaaaattaagttgggaaagagaatccattttaaacaaaaatatctgcattgtgtcagtcaagtcatattaatgtgttaaatgtacaataaaaggattttctaatatgcaa

SEQ ID NO: 50 - DNA, 7770 bp, Mus musculus
ccaaattcctatgtaatttattcccccaacttgtttctccagatggttttttaaaaaaaatggatacagagggctggggtgtagctcagtcggtatagttcttgcctagcatgcatgttgcctagcaagcatgttgtcctggattgacgccccagtgctgcataaaccaggaatagaggcgcacacctgcaatcccagctcttgggaggtggaggcaggaggatcatcttagctgtatatctagttcaaggccagcctggaccacgggagactggatctcaaacaataaaaccaaaataaacagaagagaggtaatcctgtgtcagtttgcatcaacctgtgcagatcttgtctgctggacctgacgctgaagacctgaaagaacgggcggactagagtgtgatgctgtagacaaccttacttcagtttctgtgtccttttatacacaatgtaacaaagaaaggaatgatccaaggaaggctgtttgagttttgaaaaaaaaaaaagtgatcagaaaaatatgcaaattagcaccagtaagctcatactattaacagggcagctctttcccagaactttctcaggtcagaccagtttaaacacaattacctggaaagtactgtagactctacctgggaaagcacaaaagcaaggcagaaggccacatccacattcagggtacactgaccagattgggttctatagctatgtccagacatccaacaagaataaacatgccttacggcttgaacgtcaatgtttaacacaggaagcacaaaatcacgtccaagaacaatccaggaaacaagacacccctgagataaaaggccctctgccttttctcctggagcctttcccacagttccccaagacattcactgttcaccgcggctcgttcttctgtgctctgacagtgataggtatagatgcacaagggcagttagtccatagactggcccgtgtctacgagatcgcttggcgcaaacacacagtcgggttgtcccttgtattcagtacttttctgccgctgcgataagacacaccatgaccaaggcatcttaaggaagacggtcttgttgttatgttgtcttgtggtcccagagggttagcacccataaaggcacggaagagacagcaagcaggcaggcatatggaccaggatgctgggagttcacatcttgaaccagaagtacaatgcggagagaagggcaaactgggaacagtgcaaagtctttggaaccgcaaagctcgcgcccaataacgtacttcctctagcaacactacactagctagacctcctcaaatagcgccaccaactgggatctaagtgttcagatgccagaacccttgtgagatgttaacttgttagcattccttctaggctccgcccatcagttacctagcaacagccaggctggcctggcatgctataaaaaggactgtttggcttctgtgctctccctgatccctccctctccccctccccctcctccagcccccagccccctccccctccctctcccgtctctccctgtctctccctgtctctctctgtctctctctgtctctctctctctgtctctcttcccctccctttttccgtccctccttcctccctctctttctgtccctctctttctctgcctttattcccttctcaacacccccctcccatgccccaaataaacttcattttatacgagacccatcgtactgctggtacctcagggtgatagggatgcctcagaatgggcctgctaagcccctctcctcaccccgacagcacaataccatgttttacaaaacatatcctgagaggtttctcatcgaaaccacccagccctcttagacatctgaactagaagtggatgaaggggagagagagtgaggcgcagaggctgaaccaggctgtgagtcaaccgccaaggtctccagcagactgcggactcccagtaattgacacagtgaagccagccagttgtctattctgtcaagcaagggtgagcgaaaggtcacgtgaaagtcaaggtcattgaaaagggcttctggctagtctccaatgcctcccactgagaccctggaagtcacgcattagtgtggagctgttacagacagaagagtctggggtctcagagcagatgagcatccctgctgactgtatatgaagaagaaatacatcgacgaggtttgaaacccaagagtggggcagctaatggttaattatataacacagcagcaaaacacgttagtgtttgcatactgtaattattctcctgatggcagcgcaggaacctgtagttaaagagaaaccagtaagtctggaacttctgttcctacctggtgtttgccctaaccctggcattgctggcaccatctcatagggaaagtttctcacatcttgtcttgtttataggaaaactgcacatcctatgccctttaaccacagtgacggaagtgtaaattatagagaagccagagagagggctcagtaggtaaaggcacttgtcaccaagcctggaggacctgagtttgagcccttgtacccacatggtggaaggaggtataacctaagcctacctctgacctctgacctcctcatgtgtactgtgacatacatgtgaaaacccctccacatgcacacagaataaataaaactaaaaaaaaaaaaaacaaaaaaaccttcaactctggcagtggttgtggcacaagcctttaaccccaacacttgagaggcagaggcaggaggatacctgtgagttctaggccagcttcccttccccctcaaaaaaattaagtcaaaattacaaacctggaacttgatctgtagaccaggctggcctcgaacacagagatctgcctcggccacctagtgctgggattaaaggcgtatgctacagccacccagcataacatgcatttttaaagatttccttttttttttttctttaatgtgtgtatgtgagtttgcctccacatctgtgcctgggcgctcacaggagctcccctaaagctcccctaaaatggttccgtgagccactagccatgggtgctggaaactaaatttgggctttctgaaagcgcaattaatagctaagctttcactccagcccataaaatgacatttttttaaagttagaggttggtgttgagaggaaattttttatttatttgttttatgtgctacagctcatgtgtggagttcagaggataacctgtaagagttgattcttcccccttgctgaggcagggtctctcttgcttccactattcctaagtaggtactccaggcttgctggcctgatggctgccggatggctcctctgcctggacaacccctctcactgtaggagagtgctgggttacttacaactgcatcccgcttttcatagtctgcaacttcaaggaatccagctcaccagggaaggatttctctctctctccttcgctgctattttttcctggctgaagaatctacaacaaaagtcagattcagattcaccgaagaaaaccacgcaagctgtgtttcggtttcctagatctaaagaggtgaggccacttgtgaacgtccaagtcggaggaagtgagtggtgttggggacagagatgattagacaaacaggtttgtcatgagcccatgataaccttcggagagttcggctagtctggctccttctctctgtcctcagcttttggtaacaagaacgttcctcttctctaattacagggtgagcacctctcacagtctggatttcatgacctgcttcaggggaaggtctgagaattctctcaaggctcgcctggaggacggggagaagcctggaggacggggagaagcctggaggacggggagaagcctggaggacggggagaagcctggaggacggggagaagcctggaggatggggaggagcttccctcttcttctaggttttctttttcctttctatcttccttccttcctttcttttttttcttatctccccttccctttctccctcttgctctggcccatagtttctatattatttgtttctccttatggatggttgtgagccaccatgtggttgctgggatttgaactcatgacctcgggaagagcaatcttaaccactgagccatctcaccagccccttcttccaggttttcaaatgacacgatgctgcctatggagagcacatcttaaactccatcatcagagccaatatagcaataggtaaaatccaagacacttgctctctacaggaagttaaaaaaaaagatagaggctagggaggtagctctgttggcactgggcttgccaagccggaggagctcagccagagtcccagctcccgcaaaaaaaaaaaaaaagctcgctacccttgccttactcgctacactcccgaactacgctggcgggccaggaaacctggtcccaggaagaggtcattctcaaaaaaacaaggtgggtggcacagactcacacacacacacacacacacacacacacacacacacaccctcatacagacatacatgcaggcaaaacaccaaactggagtcacagacagttgtgagctgccatgtggatgctgggaatccaatcaaatctgggccatttggaagagcatccagtgctcttaacccctgagccatctctctagcccctagcctacttagtttattatccaataatatataaaaaacaatctttacatttactgttaatcatcgcataaagtacacccttgctaaataatataaaaaagagacctgatgtgtaaacatgccttcctttagagctgctagaggtgaaggtaagaagtaaaaagatttaaaaagtgtttatcatggaactagaaattataagttgactgataaaagagcagagccactaacttctaggacatgacttgatttggaagctaaacaccggtcaagttattctcctgaaactgacctccgagtgtaacagtttaatattgaaaacaatgactggacaacctctaaaggagctgtcttcccgcccagcttacaacgtgaatttttatgttgtcacgttttgaggcgaggcctcctgtatctccacattttagtcgctgttccgttgctgtgacaagacactgaaggctgcaactcttataactggggcctaaactcacttaattaaactcacttaattaaactcacttaattggggctggcttacagtttcaggggttcagtccatcatcatcgtggtgggagcaggcaggcagctggcaggcagacatggggctagagaaggagcttgcagcgacatcctcatcttcaaaggccactcccagtgacatgcttcctctaacatggctacaccctctagtcctgtcaaatagcaccattccctggtgaccaagcattcaaatctctgagcctatggagtcattctccttcaaacaaccttgaacttctgctcctccacacccaggctgtgcactcaggttaaatgcagtattggggatgaatcccagggttgcatacactctcccagcccccagcaaccaacttgcaagttgagttccgtcctcagatcccatcaactgcttggttaggccccaaggtttgtttttattattgttattactactattgtcattatagttagggttgtttaggtttttgttttttagatttgtttagttttatgtatatgagtgctctttctgcatgtatacctgcctgactgaagagggcgtcaggtcccattacagatgactgtgattgctgagaattgacctcaggacctttgggaaagtggcctgtgttcttaactgctgagccatctctccagccctatagttagggtttctatttttgcaatgaaacaccaagaccaaaaaacaagttaggaagaaaggatttatttgtcttaccttccacatcactgttcatcatcgaagaaagtcaggacaggaactcaaacagggcaggaacccagaggcaggagctgatgcagaggccatggaggggtgctgcttgctggcttgctcatcatggcttgctcaccttgctttcttatagaactcaggaccatcagcccagggttagaacacagtgggctgggccctcccccactgatcactaactaaggaaatcccctatagctggatctcatggaggcatttcctcaatagaaattccctcctttcagatgactctagcttgtgtcaagttgacctaagactagttcagggcacttaccaatatttaaaagcataaaaagagaacgatgtctactccaccctagggaccctcaactctagtagcaactggcttgagctgtttgatgaaggatgaaggtaaggcatgaatgctttccaactgggatgcaaggtcaaatgtcattaattacgtcccctgataatatggctggctggtccaagaggtctggagtgggggtggggtggaggtggagttagaccttcacacacccagtcaccccaggaatgtcaaggatggatcacacatagatgaggtgaggaagtcatgcctggaatggtgaggatggatcacatataaatcaaactgttaggtctcaaacccaagacaaacagctaacagaggttactattaccatatcaaagctgaccctggccaccaagttttcccaccatccctgagtctctacccattccagggtcctcctggctggcatactccaccccataccctaaacttctccagccacgaggctggactgggttttcccttcccccagcctctctggctcctatacaattcagccatttcggttacattatctcttagcccaggctacccctctttgttagtgtctcctttcttgctttccctgcctctctctctccacatagtccagctcagtctggcaatgttcactctgcactctcccagatgcctctttttgtccatattctgtattctctcttatgtctgtcacaaaccttctcctccaccatacctaagaacatcctgagctcctcccatttctttctctttttttccatccataaatcatccccagaatggtgaagatgtgtacggttagcactctgtctaaattccatcttacaattacctggcaacagccaggtaggcctggcccactacaaaaggggctgcttgccccctcctccctctcttactccttcccggcttgcttctctcgtgccctcttgggctcttcccttcccccttcccttctccctctctccctgtggtcatggccggcctctacttctctgctctctctctctctctctctctgcctttctctgcctctactatccacttaactcctctccccatgccctgaataaattctattctatacaatataatagtatagaatgtggctggtccttcagggagaaaggatgcattggcatgggcccactgaggcacccccccctcaccacacccccatagaacatgttcttatacctctttgtctttttataatcacattgtgtgccacacagatgaggtcaccccaggaatggagggtagatcacatatagatgaggttaccccagaaatgataaggatgtatctcacatggatgaggttactccaggaatggtgaagatgcatcacacatcgatgagatcaccccaggaatggtgagaatagatcacacacccagtcactccaggtaaggacgagttacacagagatgaactcaccctggaaatggtgaacgtgagccccctacagagagggttagggcatttgctgaaaatccctgccaccgagatcagagaaaacggaaaag

SEQ ID NO: 51 - DNA, 12161 bp, Mus musculus
aggaaacccaaagctcttttttttttattacgtattttcttcaattacatttccaatgctatcccaaaagttcccccccccccaagctcttaaaaagtaaatttattcaagaattccctctggaaagtcgtcaagattcagtctgattccagagttggagtctgtaattactgatggatcactattgaggtggaagggtactgattggacggtgagatgtacaatcttattaatatagatgcccactgttagacgtttcctactatccatggtgtcaaaagcaaagtgtacattagtgcgaaagggacgtatgaagtgttggggatgagcaggaagcacgaagaacagtcagccagtctgcccctctcttcctcccttcctcactctacctctccccctgcctctggaaggctcggaagacagaattgccacattagcgcaggcctgcagcgccagcccctcctggaggatgcccagcacccactccgcaggacgccaccgcatctccctgcccccagcagccaaggcttgcaagagggaggagggctgcagtggttgccacggtttatgcttctccagagcttcgaagcaagatttccccaaaaagcaatattaaataaataaaaggaaattcagcagatgggaacacgaatcaatgaaaactcccatatgagtgcgaagatttatgtcaaaaaaacaaaacatcaacatctaggagctgccgcgtctcctcttggtttttcgtttggaatggattcttggtgtcgctttccccctctttctggctgtgagagaaggcaggggggagaggaagaaaaaaaaaagagagaatgaaagccattttaaaatagtcgttttaaatcagaaacgaaagcccgcttccccgccccccgccccaaggccagaggggatgtgatgcagtcgggggagctgtgggagcttgggaccgagagccccctgccggacgccttggggcgcccctgccaccggaccagggcagctcgcggctgcagcccgcacggctgcggcgaccgcgaccgcgcgcgtgcacgcgcactaacgccctccgcactgcggtcgcatcccacgcgggtggaagcccaggccagtgattctgtgacagcttctccaggcgatcaaccccaccgccggggagcttatccctgacctgcggtcgagatggtcgcccgcttgcatttagttctttggctggaccacaaagggatttttgtagggaaggtactgagtcctgacgtctggattcaaatcttagctgctacagcacgcagatcgcctttgagcagatttaccttccggaggcagcgtgggaataagagtaccgggctcctagaggattgtgggtggtaaatgacaaaagcacacaaggtgcttagcacagtgtacatatatacaaaattgaataaatgtgagctattatccttaggacagaggctcatgtctctcagtggctctgcaggattcgttctcccagctctgcagccttgtagaaggaagccttcatttaccctgtcactgggctccaattgcagcaaccttgtcttttgcccaacagccctgttcccttctgccagaggctttctgtggaggcctttcgtcttctgtttccacacagccttcgcatcattcaggagactcttagtgcttcctccctccccaaaatgtgctttctctattggagctggggcttctttttccttgcaaggctcctggatgaaatctaccctcagattggttatgtgcttaatgtccatcaatctgacagtttgctccagaaggtccgtagtataatctactgtggtccttgtgggttttcttggcccccaggccaagccagtggcagtagcttcttcaagtgcagtgaataaccagaatggagggagaaccactaaagccagatgaaattttgaggacaactccccccaccccttgactcctccatcacctctgcctctcctaccccctgtccactttcccttcttgagacagggtctcactgtgtaaaccaggctggccttgagtttatagagatctgcctgcctctgcctccaaagggctgggattaaaaggtacacaccaccacagctgggcttttcttcttttattgttttatgtatacaaatactttgcctgcatgtatgtgtattctgtgggcgcctaatgcccatgctgaacagaaaagtgtgtcagataccctggagttgtgaatcactacatgggagtttggaatcaaacctaggtcctctgcaaaagtagccaatgctcttcttcattgccgagccttttctccagcccctgtatcctggatcttctatactgtctcacgaattccttccaacagtaaattcaaattctgattatcaaatatgccaggccctgtgctgggcaccaagaacacagactcatacaattttacctttaacttagtggaacccaggccaaaggtgggaatggacatccaaacagagggcaacgggggaagcatcacggtaaaagctcaggaccagcatgaaggcctatcgttatccccgctgtacagatgaagcagaagaaagttaagtcgcccagggccacaaagacagtattggcagcaggggggttgaaatgggcgggttctgactcagagccagagccgtgaactacttagccaggctgccagggagcaaacagctgtgaggctgcgctccctgccccacccccacctctgtgctggtgagagtgggaagtgcagttccagacgcaggagtgccaccacccaggagcaggcagggagagagagagagccaggctgttggacccgaggcagccgagcaccctcctccacacatagagcctcgtgagaaatgctctcgagggtgcagaggagacctgccggagcgcagcaggctcgggagcacctctggtttctggctgccagcacttgaggaaggctttggtctgagcctggcacaatgtcaggtgcagcactcctcacctcctgcaagtgctgccgatctcactatgtctcttcatcacccccgacgtctttaaaggcaggattcctgtgctctgcactgctgtcaatggcagccacacctagatccctcagaaactgtagcgcaggctttgggagctgggagggcaagcctgcctcaggctcttctgagctgaggcctggctgaagccagacagggctctcttcaaggagcttctgagaccacctgttcttttcaattttcccctcccccagcaccagaaacctgcatcctccctaacatctgagatgccttttttttattacattttttgagtgtgtgcgtatgtgtgcatatgtgtgcatgccatatgcgtcgagaacagccttcgtctggctttctatcacccatatatgggtctccggtatagaactctggttgtcaggtttggtggctagcacttttatgtgctgagccatctcaccagcctttctttcttacttaaaagaaatggttttttaagccgggtgtggtggcgcacgcctttaatcccagcacttgggaggcagaggcaggcggatttctgagtttgtaggccagcctgatctacaaagtgagttccaggacagccagggctacacagagaaaccctgtctcgaaaaatcaaaaaaaaaaaaaaaaaaaaaaagaaatggttttttagattgattttattttatgtatgagttattttgcctctatgcaccacagcgtttttttttttaagatttattttatgtatattttttgtatatgactatgctgtcttcatgcgcaccaaaagagggcatcagatcctattctagatggttgtgaggcactatgtggctgctggggattgaacctgggtcctctgcaggaacaaagagtgctcttaagccttctctctagtagaacagctgtgacctcagatgtccggcgtctcagggaaagtgacacaagagacatgtttaagtgcctaatgtgaaaggatgagggtgatttttgcaggacctggtgatcagctgagtgtgggagtgtctggcacctttgggtgtctgcacagatcacaagaaatccacatggcaggctagggaagcaactcaatctgttagatcctgaacccacgtttctggtctttcttgggtccaactctattctgctcttaggatttgttaaggctcccctgccctccaccccagatactgatatggtttttacagatgctagtttcagcgagtcccagtattgacaatgacaatgcaaactagcatggaagagaaaggtgctgagtcaacccagagttcaaggttgctgctttcctggatcacttggagaaatgcagacagaaataagaaagtgggatggagagtctttggaggtaagattgaaggagtaatggggtcaactaatgtgccctagcggctggtaaggtgggctctgatcaccccactgctgtccagggcagtagagagacagagatggaaggggatgacgtggttaaaagctgggattcatacagaaacaagaggcagcatttgggttgagagatttggcaatggagacaaagaaacagactgataattgaagaagcagaaggatcaattaaaagtcttggccaagatagggaaggcctgtgtatatttcataggaagaaagcaaatatgtagtgaagagatgcatgctttgctatgaagatcaggataattatagtgacaaagttgtagaagagacaggaaaggaaggggactgagaacagtttgtcttagaacaaaaaagctcgaacttctcaaactgagcctgggctcttgtcattcctactaagtcacagccatgccctatatttatttgtatggtgtgtgactaagtccaagtatgttcacagtagctctcaagtttcctccatcatcatcatcatcaccatcaccatcatcaccatcatcgagtatcattcagtgtgtttccttgtgagatagttactatctatattagtcccatgatatacgacaaataagagaagtgaaggaaaagataagaattaacctattgagataacaaggcggtcagtgggagtgctgttggatagcatgcaaccactgctcttgtgcacaacttccttcttgtgcacacttcaaagagttgaaaatggccacctccagggagccagaccggagggtagggagcatgaagcagaggtccgctgcttttgatataaccctttagtactatttgactttttcactagagtagaaactctcttaacgaccttctttggcctcttccacattgccttctcagtggtaatgagaagataatttcaatgtcatctatctttttatctgaggtcagtggcaagctccctgctccttgccagcaggctctccctcagcacgcttcacaccccaatataaattgtctggtcacctgaccaacccgtgtccacattcctaccggacagcagggttcctgcaaaatgttcttttaaaattaaacaaagcaaaacatttgtaagaaggagtttgcgttaaaaaaaaaaaaaaaaagaaaacctgagagtaaaaagcaaaaggaattgatatcaatgttgaggtaatgacttagccttcagtgacaaatgtgaggttgctggctgagaagggacagggtgacaatgaggacttaatctctttcctagatccaatctagccctctataccacacagacacgacactatacacacacacacacacacacacactccctagtctttttttttttttgagatagggtctcatgcatcctaggttgacctccaatttgttctgtatctgaggctgactttgcgtttctgattctcctgacttcacttccctaatgctgggattacaggcatgtgccaccacaccttgtttgtggagtaaccgagcacaagtgcttgcattctaggccagcactcttcaactgagctacattcccttagcctcagctctatctctagttttgaaagaagtcaacccatggagactgaagagatggtttagtaggtaaaagttgccatgcgaacatgaagacgcgagttcaaatccccagcacccatgtaataaactgtgcatggctgagtggtagtgccatacgcctttaatcccagcactctcagaaggcagaggcaggcagatctaagttcgaaggcaacctggtatatagagcaaattcctggtcagcaaaagctgctcaaagaaaccctatcctgaaacaacaacaacagcaaaaagctgtgcatggctgtgcattcaagtaacaattccaacatgggggtggaggcagaggcaagcaggtcctaggaacttgctagtcagagagcctacccaaatgggaagcttcaagtttagtaaaagaccctgtcttaaaggaattaaggctcttcctgtaagcggccagaagtcacctgccaagatggttcgctactctcttgacccagaaaaccccacaaaatcatgcaaatcaagagggtcaaaccttcatgttcactttaagaacacccgggaaactgcccaggccatcaagggaatgcatatccgtaaagccaccaagtatctgaaggatgtcactttaaagaagcaatgtgtgccattccggcggtataatggtggagtcggtaggtgcgcccaggccaaacagtggggctggacacagggtcggtggccaaaaaagagtgctgaatttttgctgcacatgcttaaaaatgccgagagtaacgctgagcttaagggtttagacgtagattctctagtcattgaacacatccaggtgaacaaggcacctaagatgcgccgaggaacctacagagctcatggccggattaacccatacatgagctccccctgccacattgagatgatcctcactgagaaggaacagatcgttccaaagccagaagaggaggttgcacagaagaaaaagatatcccagaagaaactgaagaaacaaaagctcatggcccgggaataaattcagcataaaataaatgcaaataaagttaaaaaaaaaaggaattaagatagaaagagataaaggaagacaatgtccttctgtggcctctggatgcatgtgcctaggtgtgtgcatgtgcacacacactcacatgcatacacatagaaaatggaggagaaagagaagagtaggaggaggaggacttgtcactgtcattctatatggggctcctgcacagcctctactgtagaatctgctggtctccaaaggacactttcccacattcatagcctggtggccacccttctatgctattttggggctggccctctaactcactttgcccaacaacctgtgatagagaaaacagtgcaggctccaggcccagtttttgagacacccggcagttctccttgtgtaccctctgagccacgatgtaagaagttcagtggcctagatggagaggccatgtggaatcaagaggccctgagaccacaagcagaagatgcccagcctttctgtagccccagtggtcttcatatgactctggttccagatggcctctaactccagcctcatgagggattccaagtaagaccagcagtatcacccagccaagccccatcaatttacagaactagaggaaaataacgactgtttttagccataaaaaatctggagtatttgttgtgctgtaataaataactaaaatgccattctgtattttaattgcttgttggctttgcttgcactgctacgctgtttcctcagtgagggtaggggccatatccttctctttttataaattatctctgctcttgagaatttcacacatatatataatgcaatgagatcatgttcacttgtacacactgcccacttctctctccagcttcccctgtatcttctcagcacatctccttttcaatttcaaatctttttcctttgatagcggagttaaattaacactgcccatgcatgggatggcccacaggcgaccacatcctcaaaagaacaattcccctctcccagcagcttcggctgccaatagttactcaaataaggggtggggcctggaaagggccccactcaactctatcagaattttaactggcttgctcttgtgcaggtaaccacagtcactccaagttcatgaatgggatagccatgtggtgtcctgaagacagcatctcaccgcatccctcgaatcctctggctctttcttacattcttcctgcctcctcttctgacaccttctctaattaggccttaggggttggaaggcgatcgtttaagggctgagccctcagtcgcttctcagcactttgaccaggtatacacctcttcattgactgctgcccactatacaagcaagctgctttgatctgctttgctgttgggactgggtctcctaggctgcctataattcatcatgtaaactcggttgccctcaaactcatgacaatcctcctacctcagcctcccagcctccagagcgctgggtcataggcaggtgccaccatagcaggccacacacatttttttttccaggttgttaaatactctgggcattctttagcactgaataaactctcataaacttgattagtacaaattaaaattgtctacaaaaaataaaggcaacaacaaatgtctacagtagtccctgttgtgggaacagaatggctcagatacacatcaggagaagtgatttacttggtatctagacaataggttcttaatgacaacagctggtctttgaaggactgaatcaacttgattttgggccatggtccaaaaacagagtgaggacagcagaagaaagtggctgaggttaaagtcagagttgctcccacagtgttactgtgagtggccctgagcaagcgaatgcatgtgaggattcccgagacctccgagtctcttgatatcccgaagattctgggaggaaaatgttccttccttcctccccccccccccgccccccatgggaaacccatcagtaaccacaccctcgaaaacacaagtttcccctctcccagcagatatcatccgcagacagttcctcaaataagcggtggggtctggagagtgcctctttgagctatttcagaattttagctggcttgctcttgggcaggtaaccacagctgctgagctcatggatgtgatagccatgtcgctgtcctgaagccatgtcatgtcctgaagcctactagacagtgttttagtaattatctgtctggccttgaactctcttcagttgaccaagtattaggattactgagggtgctgtgcccccacccctgaacatgatgccattttgtaaatgggggcggatacattattctccctctcagatcccttcaactaactgcatacaggctggaacctaaatgcaagtatgtagaatgaacacgttttttgctcaaatcagtaattccacaattagggtctggtccttctggctctgtgtggctaagagacgctgtgtaaacattttgtgggctgacgtgtgggacataagtcccgtgtgggaagatgccacccctgccctgagggagagaagtggggagactacacttacacagatgagataattaactaacaggacaacatataattactgctaaactgtgtagtaaaaattaagtgctacagggattgggaaaagcggagaagtgaggctccagcagttggggagtcttcgttgcagacctgagatctggctgagccttgcggaaggaagccagctagagacaagctgagaggaagaagaacacagaagccccaggagaacagagccaagccagcacacttgtgggtttatttcaggcagcacatggcctacgaaaggtgtcccaattccccaagaaagaacatttacgaatagttccccacatcacgttcctggacttcattgggtttcctctgctcaaaatgcctttccccgtctcccaataaatttgtgtttaaaggcccaactcaaaggcaaaccacacgtctgaatccttccacgatacattctccccacctccacctttcaggcttctactgaaatactatttacagttccctgcccacaccttccacttctataattaatactaatttatatttcttgagcactttctatgtcccaggacttatgtagacatttatgttgttttcactctggaggctgcagaaggtattgtttttccctacatttcagataacgggcttagtgtgtgtccttaagaaccctgcaacagtaacaaagctaggaaatcagaaagctggtatttgtgggactagagcccttttgcttttcttcagtgctacagactgaccttggccctgtgaaggactggcctggcctctgacactgagctataacttcagccctacaacacagttctttgttttctgagacagaatctcagaattgcctggtctcgttatgccttgaatctgagctcctcctatctcagcctccccactcttggaactggaattataagattccactccttgagacaggatctcatgtagcccaggctggcctaggtctatatagctgaggacaaccttgaactaatgctcctgcctccacatctaaagccgtatgtcaccacaccctactttagtctaatcttaacgtaacggagccattttcaaagaccacaaatgctctttatcaatctgtcttctcttagcctagaacggtggctgacatatggcttgagagcgttttacagataaacacaactttcacaccacatgcctgggtctcagactaggtacatccagtactcctttacccaacacttccacccacctaaaagtcacatactccgggggaaggagagaggaagtctgaacaccttacggttttgttttgttttgtttttccataggactccagagtgctgaaagtgggaccagtttacaaaaaccaccattgactgaaactgaactcgcagctcagactgaccagggcctgtgaatccttgaaaggtattttgagaggagcagcctctcaaaggcttcagcccgtggggttaggaacaagagtcaagagtactccagctgaccctatccttgcacagagacccaggcaacagagtcagctgtaaggaccagggaaatagcgttaagctgtaacctgctactctgttactatcaacagccagagttcgaattttagggactttgactcaggccaaaccaggattcctggtttagaggattaaaaagaatttcaggactagccactgtgaagaagagctggaggttttaatgaagataacttaaacataggcatacacaggaggtgtagaagatgcacaggaaacaaaagcaatacataccaacgtgtaaatacggacttctcgagagctgccatattagccagatatctctttggtggttaagttacatcgcaaaaggttgctaagaaccactccacttctctctgttaagtgaacttatagagtggttcctaggatggaattacaatgtgatcaagtaaaaccaggcaccacaaggggctgagtactcggccttcacctgaaaacgggtttctggtgagattcctaatgaaacaacagtttgtggctgagaagcggggtggggagaaggcctctaacgaggatttcctctgcctacagcttaaatgtaaagagaaaaaaccgggccagagctagaacctggggcaaagggtgctctaggttcaccaatcagccaccattcggattcgcgcaccctcgcagctcctgcaatggcgacagaggacaccttggccgtggcgccgcttcaagtttggagctctcacctcgccagcgccaagcccgccctatccgatggccacttccttcctagagcgtcatccttccggcagggctccttgctgattggctggctggggactcggccgctggggacagcgcagcggccactctggtccctgtcccgtcctttgggcctcgatccctcggctgcaggctctatggtgctggccacgacatgtggcgcctgacagggatcctggggcgaggtaggggccgtctgcaaggcgaagtcccgcaggcgatggactcatacctgcagtgcgccgcgatccgcgggaaggccgccatagcgccagtgggtgggcttagatctgggaagggcgggacagagggagcgaggctccattcaggcgtccggagccgttgggattt

SEQ ID NO: 52 - DNA, 79578 bp, Mus musculus
tcagaaggaaactcaagaacaattttattagtttagaaagacattcccaggatagccaaggtataaatctctcagttacccagagagggtgagggaacaaaaagggttgagtcaagcaggtaggccctggcagagctgcacggcatgggtgtggggccaaagtctctaacaccacggacgggctttctaggaaggaaaagcacactatctcagtaaagggtactttgagagatgttggaggggctcaaatactaatgtgaggcccccctcagggggtgtctacaggaagagaagataattaactagcacgtggtttttatgttagaagagtgggactgtgtctgtaggttcccatgcaagtgctgaagtcttgaatgaactaaggtttggaacactgtatctacccagcattctccttatcaataataataataagaagaagaagaatggctttttaaaacacatctcacatagacttaagcctaatgtctggcaagtaagatatatatatatatatatatatatatatatatatatatatatatatatatacacacatatatgtatatacatacacaatttatgtttatagaatcaaaggtaaaaatttatatatttacaatagttaagttacatctattttaacctttgagtatactttttgctggcttaagtacatgcagctggccaaaatttcttttttttctttctttttttaaaatttttcttttactgtcaaggccagttgagtttttgtcctcaggagccgttggggcttggaagcaccctttgactcttttctctttagtatcttttctcccatttttgaaacatccaatgatcttaacataggatggtttctatatccttttaatatttatgagttccctctacttataagttcctttatttcctgccttactatcatagtaactaacatcttattaaatagttgaatctgagctatatgaatagcataatataataaattaagattactgtatgtatattgctaacaatgaggccttgtaaactcccaggcaaatctcataggaaacacaaaggatttttttatatatattccatatggtccagagaatgatgtaacatacctatgcctttggttttgtatgagtataggtaccatatagagaaaggtaacagacagcaaaacaccaaaaaatatttaggttatgatttataatagcaaaattgcccttatgaaggagcaaggaaaagaatttaatggttggggcttaccacatgatgaactgaattaaagggttacaagagcttaaaaggtttagaaccttctagaccctgaagaagtagcctaaattagcctctgtcaaagataatactacttaggaccacaacctgaaatcctcaagtatgaaaaggccacagagctcctcctggagataaattcgtgctcttggggagcctttgtctactacttagtcccctggaagacatttgtaagctttccgatggaattactatgctttgggagtttggagttcctcatagcttcttcagtcatagtaaatcagtcatttccaatggaaattcagtggtcatggatgagcttgctaagagactacagagggaataattgttatgagaccgtgcttggggttggaggaatgagtaagctttatgcactgctcttgaggccagagatggttcctatcatccaagaggggttggtaggtacttaagcttgcacagatatatacatatgattagaaaatgataaaaacaataacaagtacaaaataagtaactgtttttttaaaaaaagattcattttatgtatatgagtatactgtagctgtcttcaggcacactagatcccattacagatggttgtaagccaccatgtggttgctgggaactgaactcaggacctctggaagagcagtcagtgctcttaacgaaaagccatttctccaaccccaataagtaatttttaaaaatcttttaaaaagcaaactgtgaagttctgcccctccacttattcttcatgtacctcaggacaactatacacttggttcgggtcctgtttactaggttatgtatcaagactatactaatgaatggctgcagggtacccacagaaataatgtaatgtttagcagagtctgcaaccacttgagcacccatagactcagttttaggggcttctagggccttgtgtggcagaaattatctatatactggaacttgtgccataagagaacagtattggcccatcatcaaggatcttgctctgctcctaccattccaacctgaggaaacaacaaaacatctgcaatagacccaggcttcagctttttgttattccgtcttaagagtgagcagatacaagaactaaattttcggtttccctttgctttcaatagtatttatattaggaatggctagaatctcatcccagcaacaaaaatatgttaaagaaaaggaagtgagatctaaggcacccactctcatctatcatctcatctttttgaagaagtcagaatccagatagccaaggcctctgatttctgtccatccttatccaggtgccttctatcaagtgcttctctatttaacaaactttctggtgatcctggtggcaaccctaggggatccagacctaggaaagaaaaggaaatgcagaaacatcaagatttgagaagcgccaatagtggttctcattcacactgacttctaacattctccacattctgacctaggccttttgtgcctagggatcaagctgacttaactttttaaataaacttaattacattgtattttacttctaacaagccctactttctggacatttcttgacacttttaaaaactagcaaggtctagaatgtagaaaataaaacattcatatgttgatataacgaccacagttctcaacttaaaggcaataaggattgtttattctggatccattttgagtcaccatgtcctgggaacacaggtttagattaccccaaattccatgttccaacgtgcaagcagtttcacaggatttttatacttttatacatcaaacaaaatcataaatcagggcaattttaaaagacattggtggacacatgggagaggtgggtgcaacttgatggggaaagctactctattctgtagctccaagatgctacctggtgacattcttagctcttgagtaggtggaagctagtggtctgctaagttaatagcttttaaggggattttatgtattatcatgaggcattagttcacatacagagtgagtgggacaaagaatgaatggctgtcctaaaactagcccaagatacaggaattttcttctgaatccacaaaatcccaatctctccacaggactatgatttcatcagcctctgaagacagagaatccttccaggattccttctttcatcttccttttgttcattgcctttgttttgtttttcgaaagagagtttctctgtgtagctagccctggctatcctggaactcactctggagattaggccggccctgaactcagaaatcctcctgcctctgcctcccaagcactgggattaaaggcatgcgccaccacttccaggtttttactcacagtcacatacagctgcttcttaggaatttttttttgttcatacacagaagtctctttttattagatttattcatttttacctttgtattttccctgtatgtatgtatgtatgtatgtatgtatgtatgtatagcactcccatgcttggtgcttacaatggttagaagagggccctggatccttggaaactggcatgatagatggtggtcaatcaccatatgggcactggaaattgaacgagggttctctgtgagagcagccagtgctcttaactcctatatctcttcaggacccaataaaagtcgtcttgtagtttatttatggcaaattattaaggtttttatttatatttattcatctatagataaaagtacttgaatgtattttgtgtataatacatataaaattaatatgaggaatcacatataaaaatgtatagggaggaatctcaaaatcataactactcagaagttatgattttcttagtgtttttgagagaagatctctacataatttttgttgtttaatgcttaactttgcatatctataataccagactgagagagaattgccagttataggccagcctaggtggactttataagtatgactattctaaatagaaaaagcaaaccacatcttcaaaatccattaggaaaaagaaaacctcaacaaaagatgtttaaacctggcttctcaaatatagtctcacccagcagtgctcactgagagctttcggtacatagctacagcattctcatacactcaagattttcatgaacacccctttagttattaaattataaaatagatatgcatgttgcccataaaaaacattctaacagtcgtcaacattaacagacatagctttacacaaagtctttgtcatcaccttaaactgtggcatatattcatattagtatatattttgaatttatggacttctgtattttacttgagaagacattaagatacgataaagtaaactgtatggagcttgctactatgtcttatatgaaattcaattttgttccaattacacatcttcaaaatgttcatatggaatctatcccccccagcccccccccccacacctttgctctcgtggatggaagcataattctttgccctgtgttttgggtcccccattccttcacacagttgggtacacgtcaggccttttccaaacacctgtgccacctggcactggcttgtcctggctggtcttaccctgccgcagttctggatccagcaggtatagtactgtgggagcagtgacggtacaatgaagttctgcttctagcatggacaagagcaagaaacacacagaaacacgcacacgtgcttcgtatactgccatgcctctaccccacaagactgccctttataaaacttcgttctttgacacaaagtcttctctctagtccaggctgacctggtgctcacagtagtcctttcctaccttctgaacactgagattacaagcaggagccatcttgactgcagagagtttgcaattgtcttttgagttatttcccatttttaaatgcaagctgggaacagcagtttgagaatccctgatcacttgtgacccacttcaggccactcgcccttcaagtcccatgaggatttataccagcttcctgacatctcctggtgcctgggaagacaatgagcttcaggtcaaagtccagccctcctcctagcaagggcctatgggaaagaaactgctggtgtcctgtggaaactaattcctcttgggggcagtagagctctagacaagctctacactgccttcttacaacctattcccctgcccatttggtctggaaaaaaaaaaaaaaagacaagaaaaatgcctgccttctctcctctgcagactcaggcaattagttttactaggaggccattttacttttatattcgcaattcaaagcaaagacctcaaaccactatccttcaccatcaggatgcctctcttttgtctagataaattccctctgaagcctgtgtgctcaggcttgatgttctcagtgatatttgcccagtaggtgaagagaaaagtagaaagcaagcccgtgaatcacaaatccaagtgctttttactcatttctttacgtatgaatttatgcagtgtcctctggttgacaaccaccctttgtggtactgggattacatgtacgcctgggtacctctgctccatctccagcaccctctttgaaggacataaacaccacctctagattgtccttggaccttggcaggcacactgccgggatacacaagcacctacaggtattcaatagcctatggtattcaatagcctcattgctgctggtccatgtcaccctctagttctgcaccgatgtccaggtagggttcagttctctcctcaggttgtagaacaaaagtaatgcccaatccttttccagaagcctaatggccagggccctgatgggaaggaaactggaggtaccaagtctgttgaaactatgtcctcatggggacagcagtgcagtagaggagccattgtgtacccctcctctcccacccacctcatctgaaagaaatcattttccatgactaaaaatgccagcaactaagagccatttaaactcagagccagcttgtaaggcagccattttgtttctgtattaccatctcaagactcactgttcacacaaaactacaacccctgcctccaaagggattagagatactgaagccaaacatgagtgacattcacttaggactgtatatctacgttaccccaacttatatgctccaagaaggtggtaatgtaatgaagtgtttatggtaacagaggtaaaaaagtcacaatccaggccaaaggtctgtactgtaaagccgagtctggaggaacaggacatcttatctaagctcttctgagactgacctgggcttcacctcaaattcaacactgcctgggcaccaaaaagactatctggtgaaaaaaagaaaggaaggaaaaatctggactaaaatatcattaacatgagtctaatcttaacaaattcttataacttcttcagtgttttttatcatctaggccaaacgtggcatctcactgctactcctttgatcaagaggcaaaaataaggggcacaggatagccaagagttcaagcctggaatattacattgggacctgttggccaaagaaaaggaagcagctgtattacagacaaaatgtagactgtatattctgatactattaaagtggaaaattgggtgtttggttgtcctggtgtttcttctaatgttacccacagaggacaaaagggggtgtctgaacccctggtgctaaacttaccaagcagctctgagcctaatgacttgggtgcccacaccaaactcggatgcttctggaagagcagaaaatgctcttaatgaatcctctctggagcccttcttctcatgttcttgtcctaaattcataccatccagctttctatttcaagttgtgctgcagcagcttccctgtgattcccacagtagagatgtacaggcaagaaaaataagggttgctgaagagaaggggcatagcaaatccacagctcatttacgacatagacgccatgagcctttctgcgaatgaataaaataaaaaaccatcagaggccaatgtgtaggctggccaggttgttcgaggcctcggggctaccgtgatcctacactgagtgctggggttacagggatggatcacgaaaaccacaaagctcagcttcttcaattacctttccaatcttcacatcaaggatgaacaaatgaaaactttattgtaaatatcattacccaaagcaagcaccattaacagcttggtatatgtgtgcatttaattggaaatgaaataaagcagagattgttcatgagagagaacacttttaaaggacatataggctagccaatgtagaactgtatttctgcctttgggtgtacatagaaggagaggagaaaagagggacactaggaacatggagtggggtttagtgacagagaggagggggcaacactaaaaggaaggagagaagcccatgaatgcttttctacaattccatcctgatcacagcttactgccatgactggttttgggggtttttttgtttggttggttttacaatattaccactgagaatttccctgctgcataattatgtatgacaaacagtgcccatttcagtcctggggagcaaacccaggctctaggatacggtaggcaagggttgttagccctcagcaataccaatcaccctgcatgaaaaaagctttcctttcgaagctcctagactacctttcctgtgtgaaaattgtaaccaatgaataagactagacaatcaagagcaaaattaagtagctaaaaagggtgagtatgaacagctgtagaaaaggaaatggcctacaacctagggtagaatgaggactcagaatgacttcagaaggaaaacaagaaaacaaaaaaacaaaaacaaaaaacaaaacaaaccatccctgaaccgattcgaggacaggcaaagttcaccgaaccaatcttccttggtacctatattctccttgataatttttcacacaggaagcggggaggggggggaaacaatcaaaagatcttttgtggagcacaactgccatcatgaggaaaatagtttcagaagtcacagcaccacatgtcctccttcccatgattcctagcaatggcagaagatggcagccaattacagacagcatgatcagctgtgagtgccttgcagggcttccttgacttctcttcaagccccgaaagaaactgggactgcagtgttttctcatcagaacctggagagggaggcaccctgctgccctaggacaccagctagtagattagcatggccagctgaggggggttgaatctgcccatctgctttctgtccctggacctcagcacagctgcgcacttggtactggacctctgtcacgaaggtctgcattaatactctgaagggtcgggtgatgccagtctgcccacagtaggagagaaatacagtaaaatgggcaagcttcgccattcatgaatccccctcatcctccctgcttcaaaatggctgaggagaagcaggatggaggaggggtgtgtgcctcagctggtctacagaaaacattttcccatgatggcagtgttgccccagagcagggaaggtgtcctggctgcagctctctgtccccgccttcacagactgaaaaaaatgtcaatacagaggtagtgtccactaactgtgcagttctagccttccttgtctgtgtcagaagcttgcaatgctgtattcctagaatttagcttctgttttgcattttatatcaatgccatatgtaaggaggctggacctgcttttgtactaaataatcatatggataaaaagaaatataaaagcataacaagccaaaaagagaggaaaggaagccttgaggcccccaccttcctcattccccttctcctgggaagaagtgtgtgcaggccatggtcaagtcctgcatggctcccatctgggtccagcagcacccggcctccagtgcttgctcctgatgtctcagtgaactcgggtcctgagcagcaaatcccaggggccggttctagggagaaaaagaacacactgtcaccacagtgcctcaacagaagcaaacctaggcgtcaggtcatggccttgttacccagatcacagcttggctacattgggattctctaggtcttagtaagaagacatatcttaaaatgtgtagcatgttgcacatgctacaaagaggtggagacagaagtctccatccagagcctaccattttcttccctggggtttctacttgtcatgccccagatagaaagaaccaaaggcctggcccacaacttcctgtgtctgtggggagccgtgagcaattgccatcatgagcctccgatgtgcctaactggtaaacaagtaatatgcacaggtgcaagagtaaattcgtgccaagtcactgcccatcctggggcgtagtagtggggtgatgagtgagcagctaatcaggagctgacacgtcacatggaggggtatataagcagcatcattttcctcgttcgggtttgttgttcttcttcttttgcctatgcaatcaatgctctcccaataaacgtgtgcagaagggtcccgttgcagcaccgttcttcctggccagttgagcgcgtgcaagatgtgtcagcttgtccttagaagatctactgttggactttggtcttccttttcagctccaagccattactggtgcccacacttctgctctaaaggaaaaacactgggtcccagtgtgaaacccaaactatcctatgtggcattgtttcaccaatgctaggactcatgggaatgaggctgtaatggctctgcactgtagctctgcctgcaggatggccacaaatgccagccttaactactgctctcccaagctcaatcctgaaaataaataccataaccaacatccagagacaaaggcccaggatcctggatatctaggcctatgttactgtttttcagcagtaattctccactgtcccctctccattcaggcctggtatacttcccttggactgacttgtccttcaaagggcaaacatggtggatgaaggcagacagaggagaaaactgagaagcatgggcatcgcctttgggatataattgtcaactgaccagggtttttttgctgacattatttaagacaaggtaaaacctgctcctgtctgctgggcatggtaaaatggacctagatattctggaactctgaggggaaaaacagaagcctccaggaaaggcccaggccagcctgcctcatgtagttcacgaggaggtgagctgagcatagtcctgtgcttcgaaatcacctagcataattttaccatgtaaaacctatacaaaattaatcatgctaaacttgaagaccattaactatctggaaagggtaaaaatccacttataaagacagaaaaaggaaataaccttcataactgaagtaaaagagttccaccacctagggcctcagattggcctaacaaggaatggatgacaaataaaataccttttaaactactcaaagttgggtaaaagttaggacagccatctttggcgttttttcagacacaaagggcgggggagaagcactcacaagctattgtgtggagctctactgccaccatgaggacacggtttcagaactcacagcaccactgtcctccatcccaggattcctagcaatggcggaagatggcggccatacagacagcaggagcagctgtgagtgccttgcagggcttccttgacttgtcctcagacccaacagaaactgagactgcagtgttttctcttcagaagctggagagtaggacaccagctagtagattaccatggccagctgagcggggtggaacccgcccctctgcttcctgttcctggacctcagcacagctgtgcacttggtactggacctcagtcaccaaggtctgcattaatactctgaagggtcgggtgatgccagtctgcccacagtaggagagaaatacagtaaaatgggcaagcttcgccattcatgaatcccccttatcttccctgcttcaaaatggctgaggagaagcaggatgaaggaggaggggtgtgtgcctgtgttggtctacaggaaacattttccacataatcgcagtatggccccagagcagggaaggtgtcctaactgcagctctctgtcccctccttcatggtctgaaagaaatgtcgatacacaggtagtgtccactaactgtgcagttctagccttccttgtctgtgtcagaagcatgcagtgctgtactcctagaatttagcttctattttatactttatatcaatgccatatgtaaggaggctggacctgattttgtactaaataaataattaaggatttatttaattattatatataagtccactgtagctgtcttctgacactcctgaagagggcatcagatctcattacatatagttgtgagccaccatgtggttgctgggatttgaactcaggaccttcggaaaagcagtcagtgctcttaaccactgagccatctctccagcacaattaataattaaatggataaaaaaatataaaacatatcaagccaaacagaaaggaaaggaagctttgagacccccaccttcctcactccccttctcctgggaagaagtgtgtgcaggccatggtcaagtcccgcatggctcccatctgggtccagcagcaccggcctccagtacttgctcctgatgtctcagtgaactcaggttctgagcagcaaatcccaggggccagttctagggagaaaaagaacacactgtcacctcagtgcatcaacagaagcaaacctaggagtcaggtcatggccttgttacccagatcacacttacacttccctgggtatcatgctctgtgtgagatccacacaagagccccagacataagacactgtgtgtcctgtggcaggctcacttagtggctctgtaaagagcatgctgatacctgtcaacactgaatgctatatacatgcctacttgaagacacacaggtctctccaatgactaatttccaaaaggatctctcactgattttcaatcagggtttctttagtacatactggaacaacaacgtaagaattttctacattacaggccgattacagtttcccatagcttaattatacacacgttattgtctttatactttatatactttcagtcttattatactatcccttggaaaccaagacaaggacccttgagaggagcatgggctatataatgtgtggcaggactgcttggttacattgggaatctctaggtcttaataagaaggcatatcttaaaatatgtagacgttacacatgctacaaagaggtggagacagaagtttccagcaagagcctgcattttcttccctggggttttttcctgtcaaaccccagattagaagaaccaaaggcctggccaacaacttcctgtgtcagcttgtccctacagctctgctgttggactttagtcttccttttcagctcaaagccattactggtgccaacacttcgcctgctctaaaggaaaagcactgggtcccagtgtgaaacccaaagtatcctacctggcattgtttcaccaatgctaggactcaggggaatgaagctgtaatggctctgcactgtagctctgcctgcaggatggcaaaaggacaccacacgtggccaatagtgccagccttaactaacattctcccaagctcaagcctgaaaaaaaatgccagaaccaagatcaagagacaaaggcccaggatcgaggatgtctaggactttgttactgtttttcagaagtaattcttcactgtcccctctccattcaggcctggtatacttcccttggactgacttgtccttcaatgggtaaacagggaggatggaggccgagagagaaaactgggaaataaggacatcctctttgtgatataattatcaaatgtgaagtgtttgtttgctaccatggaccagtagcctcctgaaaaggccagggccagcctgcctgatgtacttaactatacccagggctcagcattgtcctttgcttataaatctcttagcataacattattgagaaaaacctacacaaaattaagcataccaaatttgaagacaactatctggaaagggtaaaaattcacaattataaagacagaaaaaggagataacctacataactgaagaaaaagggtccaaccatctagggcctcagaatggcttcacatggagtagatgacaaaaaaaaaataccatttaaaatactcaaagctgcataaaagttaggacagccatctttggcgttttttcagaagggaagggcaggggagaagcactcacaagctcttgtgtggacctctactgcccccatgaggacgcggtttcaaaactcacagctccgctgttgtccttccaatgattcctagcaatgaaggaagatggagggcgattacagaaagcatgatcagctgtgagtgccttgcagggcttccttgacttctcttcaagccccgaaagaaactggaactgcagtgttttctcatcagatcctggagagggaggcgccttgctgccctaggacaccagctagtagattagcatggccagctgaggggggttgaatctgcccttctgcttcctgtccctgcaccgcagcccagctgagcacttggtactggacctcagtcaccagggtctgagttaatactctgaagggtcaggtgatgccagtctgcctacagaaggagagaaatacactaaaaaaggccaaatttcgccattcatgaatccccctgatcttccctgcttcaaaatggctgaggagaagctggatgtaggaggaggggtgtgtgcttgtgtgggtctacaggaaacattttccccatgatgacagtgtttgtttccccagagcagggaaggtgttctgagtgcagcaatctgtccccaccttcacagtctaaaaaaaaaaaaatgtcaatatagttgcagtgtccactaactgtgtgattctagccttccttgtctctgtcagaagcatgcaatgctgtactcctagaatttagcttccattttacactttatatcaatgccatatctaaggagactggacctgattttgtactaaataattaaatggataaaaaggaatataaaaacatagcaagacaaacagaaaggaaaggaagctttgaggccccccactttcctcattccccttctcctgggaagaagtgtgtgcaggccatggtcaagtcctgcatggcgcccatctgggtccagcagcaccggcctccagtgcttgctcctgatgtctcagtgaactcgggtcctgagcagaaaatcccaggggccagtcctagggagaaaaagaacacactgtcaccacagtgcatcaacagaagcaaacctaggcgtcaggtcatgtccttgttacccagatcacacttacacttccctgggtatcatgctctgtgtgagatccacacaagagccccagacataagacactgtgtgtcctgtggcaggctcacttagtggctctgtaaagtgcatgctgatacctgtcaacactgaatgctatgaacatgcctacttggagaaacacaggtctctccaaaggctatgatttccaaatggatctgtcactgattttcaatggggctttcattagttcacactggaacagagacacaagaatgtcctacattacagtctgatttccggttcccgtggcttcactacatatacatgttattgtccatatactttattataattccagtcttgtactttcccttggcaactaagacatgcatcactgagaggagcttggactacttaatgtgtgccagggcaacttggagtaaattaggagtctctggtcttagcaagaagacatagcttaaaatgtgtagcatgtgtaacatgctacaaaaaggtggagacagaagtttccagcaagagcctgcattttcttccctggggtttcttcttgtcatgccccagataggaagaaccaaaggcctggcccacaacttcctgtgtcagcttgtccccacagctctgctgttggactttagtcttccttttcagctcaaagacattactggggcccacacttctgctctataggaaaggcactgggtcccagtgtggaacccaaagtatcccaactggcattgtttccccactgctaggactcatgggaatgaagctgtaacggctctgcactgtagctctgcctgcaggatggttggaagacaccacatatggccacaaaggccagccttgaccaaagctctcccaccctcaagcctgaaaataaataccataacctagcaaacacagaagtggatgctcacagtcagctattgaatggatcacagggctcccaatggaggagctagagaaagtacccaaggagctaaagggatctgcaaccctataggtggaacaacattatgaactaaccagtaccccggagctctggactctagctgcatatgtatcaaaagatggcttagtcggccatcactggaaagagaggcccattggacacgcaaactttatatgccccagtacaggggaacgacagtgccaaaaagggggagtgggtgtgggtgggtatgggggacttttggtatagcattggaaatgtaaatgagctaaatacctactaaaaaatggaaaaaaaaagaaaaaaagaaaaaaaatgaatatcataaccaatatctagagacaaaggcctaggatcgtggatgtctgggcctatgttactgtttttcagaagtaattctccactgtcccctctccattcaggcctggtatacttcccttggactgacttgtccttcaatgggtaaacatagtggatgtaggcaaaaagaggagaaaactgagaaccatggacttcatcattgggatataattatcaactgagcagggtttgttggctgacattatttaagacaaggtaaaacctgctcctgtctgctgggcatggtaacatggacctagatattctggaagtcccaggggaaaaaacagagcctcctggaaaggcccaggccagcctgcctcatgtacttaactagaaccagggctcagcacattcctttgcttctaaatctaggataatttaatcctgtaaaacctacacaaaattaatcataccaaatgtgaagaccattaagtatctgaaaagggtaaaaaatcaacagttatgaagacagaaatggcaaaaaccctacataactgaaggaaaagaatcccaccacctagggcctcagattggcttcacagggaacacatgacaaaaaaaaaataaaatactcaaagttggataaaagttaggacagccatctttggcggttttttcagacacaaagggcggtggggaagcactcacaagctcttgtgtgcagctctactgccaccatgaggacaccatttcaaaactcatagcaccactgtccgccttcccatgattcccagaaatggcagaagttggagccagattacagacagcaggagcagctgtgggtacctagttgagcttccttgacttcttctacggccccaacagaaactgggactgcagtgttttctcttcagaacctggagatggaggcaccttgttgccctaggacaccaggtactagattatcattgccagctgagcgggttggaacccgcccatctgcttcctgtccctggacctcagcacagctgtgtacttggtattggacctcagtcaccagggtgtgagttaatactctgaagggtccggtgattctagtctgggtacttaaggagaaaatagacagtaaatcgggcacatttcgccatccttgaatccaccagatcttccctgcttcaaaatggctgaggagaagcaggatggcggaggtgcgtgtgcctgctctgctctacaggaaacattttccgcatgatggcagtgctgccccagagcagggaaggtgtcctgactacagctctctgtccccgccttcacagtctgaaaaaaactccaataatggacagagtccaacaactatggcagctttccttaccctttaccttcaaaatgaagaagattcatctatgggagagtttacctcccattttcatttcaaggtagcgactcagccagagcatccatctgtatcttcaccagaatccaccaccaaatccagaagaataaactctgctgtaagaaggaaattgcctggaatttatgatctaagcaggaaggaaagagaaggatggaggagctttgaggcacccaccttcctcatgcagcactgaagatatcagtgagtggctgctcaatgatcaagtctagtctcttcttcacccagcagcagtcttctaccccagtgcttgtggtatggaagttaaatcttctggtccagttctaggtaggaaagaaaatgttgccaagtcagggtctggagaagatcaaacctaggaacccggcaacatgggtctctgcctgattcccttcacagactccctggtcaccttaccccatcctttcttacacaactggccttggggggatgtccagccaatctgactacctgcctgtaatgatgatctaggtaggtctcaggagttaatgctctatagcatttggggtgacaaagctatggaaatcactataactcccaatcacatagatcatggagtatgtttgacctttaaacaaaagtgaacattcaataaatctgtgtttaaactgtaatctattatgaataattcctcatccctttattttgaaggaagaggaagaagacgattgaggcgagagggaggggaattatagaaggaaggaaggaaggacagacaacttgaactgggagtcctttcaatttctttgactgtttgtgtgtgttctgaaaacaaagttttaatttaatatcagcattccatacagcttgttagacaactgataacttttggatcttttagtgtacatatatatttttatatttagggtctctaaaagtatcctgcagcatacaatgtatacatatatgctgtagtttaaataataccaagtgcacatggtcccaacatttcgtactgaatatatttaaacagtcaatactttaatctgtaaatctcattaatatctacttgcctttataaaactgatatatatgtgtatatgtatgtgtgtgtgtgtgtgtgtgtcttttatttgtttgaatgcatgtgtgtatgtcagaagacaacctgcaagaacctgcttactgctacaattagatttatgggtatgaaattcatgaattcatatgctgggaagcaaggacctttatcctctcaccggattcagtgttttcctttaaataaatacacaaatatatggcagtgattgtacaatacaaaatattataccatgattaacattgaaacaagaccatatgcatgtagatatatttgagtatgaaggctatatttcaggcaattcagtacacagtgaatgcagtgggtaaaattgagactgttttaataatttccccactaagatgtcttgcttggccaggtagtggtggcgtgtgcctttaatccaagaacttgggaggcagagacaggcagatttctgagccagtatggtctacagagtgacttctaggacatccagggctacacagagaaaccctgtctaggaaaggaaaagaggagaggagagggagagggggagggagagggagagggagaggagaggagagaagagagaaggatgtcttacttggactttccattgatctgtacacccacccatgtttcaattttctttcatctattatagctcaaatacctcatacgctacttaggcattctcaatggttgtcctggatattctgacatattattaggggctggattttggttctttacaatgattttcttatacatttgtataaaatctagttcttcctgtatgccaggaaagcaccctgagctacaaaaacagcatcaatgaatgctaacttagtttcacattttatgtgtaacatcgttctccaccaagaatgaaggtacaccactgggtgccattccaccaggaagttaatacgaattttatccctggaattggagttacacatgggtgtgagtcaccatgtgagtgctgggactagaatatgaatgcactgaaagagaaaaatgttcatttagccaataagagatctcttcaggcacggaagactgattttaaaaatatattcttctaccttttgatatctgtcaagtatttcctgctttttacactatatatctgggtataataataataccattagatgaaaatcaatgccagacctaagggacaaaagtaaaatggaaccatatcttgtatcttccaaggtttctaggttctactacaaagatgtttgcatgcttaatgctgcagtacggatgagaatagacatatagaaaatgaaaatacatatggaaagtgaaacttagtaatagaaacacatggaacatgtacagaacaagaaaccacaatgtaaagaaaatgtcagattcagcaagacagatacaaattgttctccatcatatgcagaattaaagttgcatttacgtgagcatgtacacacatttgtctatgtgtaaggaggtgtaactggatcgtggaattaaaaaggggatcatgagagcagctgaaaagctgtagagagaggggaggctggacagtgagcaatggaataccatgacatgaaagagaaaggagcagagacagggagaggggtaaaaggaatgtaagcagggggtgagagagacaggctcagagggagaaaaaccaagaaaaacgtggattcaaaaagtgccttactggaacctagtattttgtattctacttgaaaaaaatattaaaataaggtcctgcatgagatacatcaggaattaatgaaatattaaaaaacaaaattacagacccgtactacaggaaagtctttgaataaataccacttgaaaacaatttcctaattacgcatacatattataaagctatcaaaacttgcagaagcatatatggcttattaacatatgatatggtaatgtaatacatgagtttgttttacataagacgtggaatattgaagggtccatttaatctgagatactgtgaaatctggtgctgaagggaaacatgaaatcactgaaaatacgttaattctcagtgaatgtccttagcctgcaaaatagattcacccaactagaaaacattcgctaaaaatgactaagaaaatatcacaactaaataattagctctcatattaatctcactaattcttacctacaaatccaccccaataatattacaaataagatttactgtcacagatatttctcaaagcttttgaaattggaaacttgacagttatatatctacccatgaattagctgcacacacaagttattagggatcaaaccaaggacctggggcatataataaccttaacattctacccctctgctatatgatgtgtccacttcagatttacctcctcctaaactcatagcaaacttgtattgcatagaaactacaagaaataaatagcaaaaacagtttaaatgaggccagtctctcacacaagtgaaaatgagcgaaactgggaatacactctacaacacaatgaggaccctaggacttctgctaatccaggcttcagattggctgaaatgtgggaatcagtacacacacaaaactttttcacacactcagacataggcaaaaaatcttccgagatgcctttatatacatgtagcatattttcaaataagaagggaaacaaaactaaaatactgacaaaattattccaagatccacaaaaccggagcaacaatcttcttgggtgcatttgtctatgaatagcatctttatggagaggaaatatcctatgtaacagaaggaaaagactcccaccacctagggcctcagattggcttcacatgaaacatatggcaaaaaaataaataaaatacagctgaaaccgctcaaacctgtataaaagttaggacagccatctttggcgttttttgagactggaagggcgggggagaagcactcacaaggtcttgtgtggagctctactgcccccattaggacgtggttccaaaactcaaaagggccactgtcatccttcccataattcctagtaatggcggaatatgctggccgattacagacagcaggagcagcttagggtgcctagttgggcttccttgacctcttctcacgccccaacagaaactgggactgcagtgttttctcttcagaacctggagagggaggcaccctgctgccctaggacatcagctagtagattaccatggccagctgagcgggttggaacccgcccatctgcttcctgtccctggacttcagcacagctgtgtccttggtattggacctctgtcacaaaggtctgcattaatactctgaaggtcctgtgatgccagtctgcccacagaaggagagaaatacagtaaaatgggcaagcttcgccattcatgaatccccctcatcctccctgcttcaaaatggctgaggagatgcaggatggagtaggggtgtgtgtctgtgctggtctacaggaaacattttgccatgatggcagtgttgccccagagcagggaaagtatcctgactgcagctctctgtccccgccttcacagtctgaaagaaaggtcaatacagaggcagtatccactaactgtgcagttctagccttccttgtctgtgtcagaagcttgcaatgctgtactcctagaatttagcttccattctacactttatatcaatgccatatctaaggaggctggacctgatttttgtaaaaaataatcaaatggataaagaggaatataaaaacttagcaaggcaaaaagtagaggaaagaaagccttgaggcccccaccttcctcattccccttctcctgggaagaagtgtgtgcaggccatggtcaagtcctgcatggctcccatctgggtccagcagcaccggcctccagtgcttgctcctgatgtctcactgaactcgggtcctgagcagcaaatcccaggggccggttctagggagaaaaagaacacactgtcacctcagtgcctcaagagaagcaaacctaggcgtcaggtcatgtccttgttacccagatcacacttacacttccctgggtatcatgttctgtgtgagatccacacaagaggcccagacaaaaggccttgtgtgacctctagaaggctcactttagtggctcggtaaagagcatgcagatagctgtcaacactgaatgctaaatacgtgcctatttggagaaacacaggtctctccaaaggctatgatttccaaatggatctgtcactgattttcaaattgggtttcattagttcacactggagcagagacacaagaatgtcctaccttaaaggccaattaccgttttccataatttaactatatacacatgttcttgtctttacactttatatactttcagtcttaaactgtcccttggcaaacaaaacaagaatctctgagaggagcctgggctatataatgtgtggcagggcagcttggatatgtcgagagtctctatcttagcatgaagacatagcttaaaatgtgtagcatgttgcacatgctacaaagaggtagatacagaagtttccaacaagagcctgcattttcttccctgtggtgtcttcttgtcatgcaccagataggaagacgcaaaggcctggcccacaacttcctgtgtcagcttgtccctacagctctgctgttcgccctttagtcttccttttcagctgcaagacattactggggcccacgcttctcctgctctagaggaaaggcactgggtcccagtgtggaaccgaaagtatcctgcctggcattgtttccccactgccaggactcatgggaatgaggcttaaagaacatgcgctgtagctctgttgcaggatggtaggaggatatcacatatggccacaaaggccatccttgagtacccctctcccaccctcaagcctgaaaataaataccataaccaatatctagagacaaaggcacaggatcgtgggtgtctgggcctatattactgtttctcagaaggaattctccactgtcccttccattcaggcctgttatacttcccttggactaacttgccctcaaagggtaaacatggtggatgaaggcagaaagaggagaaaactggtgtagtggctattcctggttgtcaacctgactatatttgaaatgaactacaatccagcattggaaggctcaccagtgacccttatctacaggcttagaaagagaaatttctgatctagatcttggtatggagatcttggggcacagtgactatggattactgaagataaaatttcggagttcaacgtcttctgggatgaaaggtttggtagaacacatttaatctagggtacaccttctcctggagacaatataaggacattggaagaagggagtctagctcttgctccttcgcctacttgctgtgtgagaatgagtaactcctagatccttggacttccattcgcagctactactgaaacattgttgggaattgggctgcagactgtaagtcatcaataaattactttactatatagagactatccataaattctgtgactctagagaaccctgacaatacaactgggaagcacggacatcctctttgagatataattatcaactggcaagtgtttgtttattgatattttacttaagacaaagttaaacctactcctgtcctctgggcatggtagcatggacttattctggaactaccagaggaaaagacagaaacctactggaaaggcccaggccatcctgcctcttgtagttcactaggaccagggctcagcatagtccttggcttctaaatctgctaccatatctttatcatgtaaaactgacacaaaattaaacatatcaaaattttatgaaaaccattaagtatctggaaaagaaaaaatcaacagttataaagatagaaaagggaaaaacactacataacagaacgaaaagagtcccaccaccttgggcctcagattggcttcacatggaacatgtgacaaaaaaataaaatacagttgaaactactcaaagctgggtaaaagttaggacagacagcagggcatagtggtgcacaccattaatcccagcactccggaggcagaggcaggtggatttctgagttcgctgccaacctgatctacaaagtgagttctaggacagccagggctatacagcaaaaccctgtctcgaaaaataaagaaaaattaaaaataaaaagttaggacaaccatctttggcgttttttcagacaggaagggcgggggagaggcactcacaagctcttgtttggagctctactgccaccatgaggacacggtttcaaaactcacagcgccactctcctcctgctcatgattcctagcaatggcggaagatagtgaccaattagacagcaggagcagctgtgagtgccttgcagggcttccttgacttcttctcaggccccaacagaaactgcaactgcagtgttttctcttcagaagctggagagtaggacaccagctagtagatagattaccatggccagctgagcggggtggaacctgcccctctgcttcctgttcctggacctcagtcaccagagaatgaaggaagatggcggccgattacagacagcaggagcagctgtgagtgccttgcagggcttccttgacttcttctcaggtcccaacagaaactcagactgcaatgttttcataacctggagagggaggcgccttgctgccctaggacaccagctagtattttaccatggccagctgagcgggctggaacccgcccttctgcctcctgtccctggaccttagcaccgctgagcacttggtactggacctctgtcacgaaggtctgcattaatactctgaagggtcctgtgatgccagtctgcctacagaaggagagaaatgcagtaaaatgagcaagcttcgccattcatgaatccccctcatcctccctgcttcaaaatggctgaggagatgcaggatggaggaggaggtgtgtgcctgtgctggtctacagaaaacattttcccatgatggcagtgttgccccagagcagggaaggtgtcttgactgcagctctctgtccccgccttcacagtctgaaagaaaaatcaatgcagacgtagtgtccactaactgtgcagttctagccttccttgtctgtgtcagaagcttgcaatgctgtactcctagaatttaccttctgttttgcattttatatcaatgccatatgtaaggaggctggacctgatttttgtacaaaataatcaaatggataaagaggaatataaaaacttagcaagcaaaaggaaaaggaaaggaagctttgaggcccccaccttcctcattccccttctcctgggaagaagtgtgtgcaggccatggtcaagtcctgcatggctcccatctggatccagcagcaccggcctccagtgcttgctcctgatgtctcagtgaactcgggtcctgagcagcaaatcccaggggccggttctagggagaaaaagaacacactgtcaccacagtgcctcaagagaagcaaacctaggcgtcaggtcatgtccttgttacccagatcacacttacacttccctgggtatcatgctctgtgtgagatccacacaagaggcccagacaaaaggccttgtgtgacctctagaaggctcactttagtggctctgtaaagagcatgcagatagctgtcaacactgaatgctaaatacgtgcctatttggagaaacacaggtctctccaaaggctatgatttccaaatggatctgtcactgattttcaatgggggtttcattagttcacactggagcagagacacaagaatgtcctaccttaaaggccaattaccgttttccatagtttaactatatacacatgttcttgtctttacactttatatactttcagtcttaaactgtcccttggcaaacaaaacaagaatctctgagaggagcctgggctatataatgtgtggcagggcagcttggctacattgagagtctctatcttagcatgaagacatagcttaaaatgtgtagcatgttacacataatacaaagaggtagagacagaagtctccatcaagagcctgcattttcttccctgtggtgtcttcttgtcatgccccagataggaagacccaaaggcctggcccacaacttcctgtgtcagcttgtccccacagctctgctgttcgccctttagtcttccttttcagctgcaagacattactggggcccacgcttctcctgctctagaggaaagggagtgggtcccagtgtggaacccaaagtatcctgcctggcattgtttcccactgccaggactcatgggaatgaggcttaatgaatgtgcactgtaggtctgttgcaggattgcaggaggacaccacatacggccacaaacgccatccttgagtacccctctcccaccctcaagcctgaaaataaataccataaccaatatctagagacaaaggcccaggattgtggatgtctgggcctatgttactatttttcagaagtaattctccactgtcccctctccattcaggcctgttatacttcccttggactaacttgtcctcaaagggtaaacatggtggatgaaggcagaaagaggagaaaactggtgtagtggctattcctggttgtcaacctgactatatttggaatgaactacaatccagcattggaaggctcaccagtaacccttatctggagccttgtcggtagaagtttctgatctggatcttggtatggagatctaaaacatagtggctatggattacagaagattaaatctccaagttcaaggccatccgggattaaaggtgtggtagaactcttctgatggagacaatataaggacattggaagaagggagtcttgcccttgctccttcgcctacttgctgtgtaagactgagtaactcctagacccttggacttccatttcagccactactgaaccattgttgggaattgggctgcagactgtaagtcatcaataaattcctttactatatagagactatccataaattctgtgactctagagaaccctgacaatacaactgggaagcacggacatcctctttgagatataattatcaactggcaagtgtttgtttattgatattttacttaagacaaagttaaacctactcctgtcctctgggcatggtagcatggacttattctggaactaccagaggaaaagacagaagcctactggaaaggcccaggccatcctgcctcttgtagttcactaggaccagggctcagcatagtccttggcttctaaatctgctaccatatctttatcatgtaaaactgacacaaaattaaacatatcaaaattttatgaaaaccattaagtatctggaaaagaaaaaaatcaacagttataaagatagaaaagggaaaaaccctatataacagaacgaaaagagtcccaccaccttgggcctcagattggcttcacatggaacatgtgacaaaaaaataaaatacagttgaaactacttaaagttggttaaaagttaggacagacagccaggcctggtggagcatgtctttaatcccagcactggggaggcagaggcaggcggatttctgagtttgaagccagtctggtctacaaagtgagttccaggacagccagggctatacagcaaaaccctgtctcgaaaaataaaaaattaaaaattaaaattaaaataataaaaataaggacagccatctttggcgttttttcagacacaaagggtgggggagaggcactcatgagctcttgtgtggagctctcctgccaccatgtggacacggtttcaaaacttacagcgccactctcctcctgtccatgattattagcaatggcagaagatggcggccgattacagacagcaggagaagctgtgggtgcctagctgggcttcttgacttctcctcaggccccaacagaaactgggactgcagtgttttctcttcagaacctggagagggaggcgccttgctaccctaggacaccagctagtagattagcatggccagctgagcgatggtggaacccgcccttctgcttcctgtccctgcacctcagcacagctgtgcacttggtactggacctcagtcaccagggtctgagttaatactctaaagggtcctgtgatgccagtctgcctacaggagagaaatacagtaaaatgggcaagcttcgccattcatgaatcctcctcatcctgtttcaaaatggctgaggaaacgcaagactgaggctgaagtctgtgtgtgtgtatgtgtgtgtgtgtgtgtgtgtgtgtgtgtgtggttctgtaggaaacattttcttcatgcgggcagtgttgccccagagaattaaaggtgttctgactacagctctctggccctgcctgtgcaaactggaataaatggcagctctgatggctgtttttcttttgtgtgaggaaaactgatctggacactcagcttccattttaattttacatggacaccacatctgtcggataaggtcctgtatcagaagtcaagcagcaaaagacagagagacaggggggactgaaaatgtgtctgaagcacccacctcccgttcttgtgcatcctctctgaagacccgggaaccacaagtaacagcatagacaatgacaagcctgcacttcttctcttcctcaggcagcagtgttccagctccagtgattgctcacggtacctggtggtcttgggatcgcgggggcatgtctcagcatccagttctaggtaggaaacaaaaaaatacagctaagccagtacctggattagagcaaagtgggccaggaagccaggatgtcagccagattccttgttccctagctttcatactccaaatagtgatggatgtaataggcatgtatggacagcaggccgtggtctgtaacacgggatctgtgactgctgaagattaatgctgcaagagcccgagcattttcagtgttcgagcacattcaacagtccagcaggttcccctggtttcactggggatcttattctccatcattctttttcagttgagcatcgtgtgttatctttcctcattgagatgtaagatattcaccataggcaggatccagaaaacgcttccattagacttcgtagtaacagtgatgaattctccacattgactccaactcacccaatgactaactagactcatagctcattatagataatgaagcactgattaactgagcattgaaattaattatgctgcacaatgattttcatgtctttctttttaaaggttggaggttattatatataatgtggccaaggctaaggaaccgttatagcatagtttgaggttagcatagtctagtgaagatatgttagcctggaaactaagaagaaaaacaccaaaccaaaaaaaaaaaaaaaaaaccaatgtattatttaatgcattggtaattttatattcatatataatacaaacatttaaagtcggaatacaagttgataacctcatgatttctttgaagatttattttatatgtgtgtgtatatgtatatgttcatgtgtatgaatgtatgttctgtgtgtgcaagtagccacaaaggccaaaaggggtgttggttcccctagaactacagttaacaggaaattgtgagcccatttacttaggtgctaggaagccagcccagaccctctcggagagcaggaagtgctcttaactgatgagccacctctggagccaggcttcttcctgtttctgtcctaaattctaactttacaattttatctttggacctgtgcatgctggggtttatgtgtgattcccaccctagagatgttcaggcagaaggatcgagggttctgactagctgggtcaacatagcaagctcaagaccctagccttctccagcccgcatgctccccaccactgcaaagcttcatgggagatcgggctttcctggcaactctacatccctgtggtgttactcatgtactggctgtggtccaaacaccatcttagtgcccttcctacctgagaaacatcacccagagaaaaaggtgccacggaacacaagggttttgactttgacttttgaaaggatcttctgaagggtctaatttttgttttgattttctacctgaaccaaagtttcagcaaaagaatgaatttcttagaaatcaaatgtgcccctgcatcctctaggcagtgttgctcacgcatccgggcctttatttgcccagcattctatgtcctatactattccactgtatcagatctcatatcaaacataaggaacgttccaataaaaagggagaagactggtttggaatttaatattggtgcttagaggaaggcatctctaatagcagatctcagctcagagcctctacagaagattcttctattcactcaataatcctcggagactaatggatttttatatacaccccttataaccaagatacacatattgacaaaaagagcaataaaacccacttcaacagcttttaactgcattctactgcttctttagcaggtgaggttttcctttgtctcatgagatagggtctaaaagacccatggtagcccattatgactttaaagttctcattgccctgcctccaccttctacttccagggctgcagctgcctctattgttgataaaatgttcagattggtgcaaacaaaaggcctcatgcatggtacaagcccagggatactttcacagcacaccctcaagattatcctctcattagttgctcaaatgatcatttcatatatttttgtgcatggattgaaaagaaagtacttttaaaaaaagggaaactgtggagattgaggggccacagtgaataagcagtcaagcattcactcttaaggcagctactactacttatctttctgtactcaggagcaactcaaagattctgatggaaaacagcatagactattccagacagtaagcagaacttctcgataactgttaagagcatagaggctctcttacggcctcagaggaagctatggaaggccagcttctagcactagcttctccacacctctacagaccaaccttaatcccagtcagtgcttctccaccttcctaatgtgacccttacaacagttcctcatgactacagttccgcatgctatgctgacccccaaccataacattactgtcattgcaacatcataactgtaattttgatattgttatgaatcataataaaaatatctgatgctgggctgtggtggtgcacgcctttaatcccagcacttgggaggcagaagcaggcggatttctgagttcaaggccagcctggtctgcaaagtgagttccaggaaagccagggctatacagagaaaccctgtctcggaaaaccaaaaaataaaaataaataaaaataaatatttgatatgcaggacatctggtctgcaaaccacaggttgagaatcactgctctaaggagaggccaggaagctggagtggcgctgttttgaaactgttccctcatggtggcaggattggattacacacttatacaagcaccactttgtaatgtcctctcccacccttcttgttggaaaaaaaaatataacaaaaaacacccacaagaaatatggctgccttgtccattgtccaattggaagggagaagatcaaactatcgtgctctttgtctagtgttctccataaaaccaaactttagtctcaccaaccaccacattgttcatattttctcatgagttaaatcaccttcacattaaattctctgatctattcttctggcagatcttgtctgaaatgttgtactcagatccgacactatagttcacctccatttttcatactctggtgaacagttggcagctctttgcttaaagacctaagaggcagagacagttcacagcagactccactttctaaactgtgttccctgcatgcagcatgaattgccacttggacatagacaccttgctgatccttcagttctctgcttaaagtggaatgaaaattcattcctttgctatgaagtatttttcctttctttctaattgaaataacttttcacacagtatgttctgatcatggtttccccttccccactcatgtcctctaaaccaccctgcaccctgccccccaactcaaggtttcctttcttacttccctttaaaaaacaaacaagaagcctggcaagtggtggcacacgcctttaatcccagcacttgggaggcagaggcaggcagatttctgagtttgaggccagcctggtctacagagtgagttccaggacagccagggctagaaaaaacaaaaaacaaaaaccaaaaaacataaaaaacaaacaggagcatatatggtggcccactcatttaatcctaatatttaggagatagagaaggcagacctttgagttctaggtcagccaggactacagagatcccatcttatttatttatttatttatttttaaatgggggtggtggtgtaaaatacaaacaaagcagaatttatttttttcttttcagtctttcgagacagggtttctctgtatagccctggctgtcctggaactcactctgtagaccaggctggcctggaactcagagatccgcctgcctctacctcccaagtgctgggattaaatgtgtgcgccaccactgcccgggcagaaatttttttaaaagaagcaaaagcactgttgcaggatacttaatcgcattgtgaaccccaagactgtgacctggcaaaaccctgtcgtggtaggactcagccctagcacacagcttacagagtgagaacaaactagacagagatgaagacagaaggagcccagggattcgaacagatcatcagtgttagtacgaggcaagcacagaaactcagtcagaaacctagagaaaagccggattgaatcagtcagctgggagaggagtgtgggccagaaaagcagggttaagcaaccagtcagagctcagaaagagatagggaagggtgagcttagtcagcagcaagtcgcagaggcaggaaacactctagacctagataagactatagagaggcctaaagcttccaggactaggcctaggtttgcagactgaaggctctgagactacaattatatcacgtgaataaaagttacctttcatgaagcacaagtattacacacagattcacgtccaaacacaaaatccatagaactataaaaccagaaactataacataaacatacaaaagacctataaaataaaaatacccgaaagaaaggtttacccataagtgtggtttaatacctaatgaaactccattagagaaagaatttcctttgcaagtgggtgtcaattaaagatcatctcagttagaagtgggagtctgtgtccatttgccactatcagggctggggtcctatctagctttaagctgtgtaggcaggcccagcaaatgctaggaaggagcctgagagctccgatgtgtgtcagtcctgttgtgtctagaagacagctgccttggggttacccgtgccctctggctctcacaatcttaagggctactcatctgctttcgctccctgggccctgaggagagggccattcctcagcaagtgttccacaagactctcactctctccacactgtgcagttgtgggtctctgtgttacttcccaactactgcaagacaaagctgacaaaacacttttcaaaccctttgcctttcttatggtacatatgtttttgtgtgtgtttctgtgtctgtgtgcactaactggacatatagaaatatatacagtcagtaagggaatacttgaatgcaatatggagttactaatagaaattaataaatgtgggcttcaggctggccaatttttccccttagacattactgaaaatatttataattggatgaattttcccagcttacagactagagacagacatggaaaaagtagtctgtaaaaatgacttataagacaggccgtagtgggtggctcatgccttgaatcccagcactctggaaacagagaaaaatgcaggtggatctctgttagtttcagaccggcctgatctaaagtgagttcaagaacagtcaaggctacagaaaaaccctgttttgtttaaaaaaaaaaaaaaaaaaaagaaaagaaaggaaaaagaaaaagaaacaaagaaaataaaacaaaatatactaataaagtggtttcatcagaataatgggttcttattattaaattcaattattttcttcatttccatcccagtcatattataaatcagatttaatgccacagatagttctcacactactaggaagtgagaaattccaaggcacacaatttggaaatgaattagttcctcacctctagtagtgaggatcaaaactaggagctaggacccataacccaaaaattgttcccctcatgtattacatgtgttcacctctaaatctcatagtgcatctttattgcataaacattaaaagaaagaagggtaccaaatttttaaataaaactaggcacctggacaaagtagaaacaaaggaaaagggaaacaccctacataacagaaggaaaagcatcctatgaccccttctaaatttgggctttagttgggcttcacctgaaaaacaagacacaaataaaaaacttttcaaagtacccagaactgagcaaaactcatcacactcctcttccttggtaactttctgtctcaatggcatttttttgcaggcaggaagggcaggaggcaactgtgcataagctcttttgtggagctctactgccaccatgaggatgcggtttcaaaattcacagcgccacagtcctccttcccatgattcctagcaatggcggaagatggcagccgattacagacagcaggagcagctgtgagtgcctagttgggtttccttgacttttcctcagaccccaacagaaactgtacttctttctcatcggaacctagaaagtgccttactgccataggacagcggctaatagattaatactgcaaactgagcagcatgaaatcccgcccccctgcttcctgttcctggaccacaggacacctaatgggcacttgtctctcagtcaataggactaacacttagactctgcaatagcccatacctccaaactgcctataaaaagaggggttgggataggacgagcttggtcatttaggaatcctctggacactccaccttcttcataatgtctagaagcattaagatagtgctctgtgcaccagggaaaagaagaaggggaaagagtccaaacatggataactaatacctctcagaccaagctcagtggttcagtggctaagagcacttgactgttcttccaggtcctgaattcaattccatggtggctcacaaccatctgtaatggggatcgggtgtgttctgattgtgtctgaagacagctacagtgtgatgacatacataaaataaatgagtaaatctaatacctctcagaccatagccttccttcctatttgttagtccaccatagagaaagagacctgcattcaggtatgtatgcaatatgttccgcacgatggcagtgttgctctacagaagaaacaaaaaccagctcacagcagcctgctcccgcctttccgattaaaaaaaaaaaagcaactacaattggagtccagtaatggtggtggcagccttgccttcctccttccaagtgagttgaggaagcctttcctgcaggcccccttctgctttcattttacatgtatgccagaccaactacaactcctcctgacttggaactccaaaggacaaaagaccaaaaccagaacaaagcaagaaggaaagagaaagccaagtgagacctgaggcatgtacactcctcatgcatcttctctttggataaagtcagcatccaggcaatgacgaaattctgcatttctgcctttctccatccacccagcgctgttcaacctccaatgggttctcaggacatatgattgtcttctgctcttaggatctagttctagaaagaagaaggaaaatgctatatggaacctcagtgtctgcattagagcaaatctaggcaccagaaccctggttctcagccacattccttgggcaccatgcaccatatcctgacagacaataacaggctttgtgtgtgcagtgggcggttgactaccatcatataaggagaagataagtactaattctgaatgctcataatccaagggggacaaatagattgcactgcctataaattccaattggataggtaacaatatcttattactcttctattcctgtgaagagccactaggaagcatctaactggaggccgcttaacagtttccagtaggaaatcagtgtccagcgtggcaggagcacagaagcaggcaggcacgctgctggagcagtagctgagagcacgtgccctagcaatcatatttgctgcatgatttcaagattatgtctccattaactgttgagctcatcattttaaatatttttctgcatggattcaaaagataaggaagttattttttaaagagaaaatacataaattaagggatcattaaatgagcaatctcaaagcatctactactatttattttgatgcactcaggaacaattagaaccttcttattgaaaacagcataaaaatattccaacagtaaacataaccattccgttcattataacaccaagagttctcctagggccatattgaaagtcaaggcaggcccgcttctccaggcctctacagaccaacccccactctaagaagaatgcaggaagctgcaatggtgctgtctacatcgaagctaattcctcatgggggacagtatggttctacatacttttaaaagcgccatttttttatcctttttctccctcccctcttgtttttttaaaacaaaaacgaaacaaaacaaaacaaaaaaacacaccacctgcaagaaaaatggcagccttgtacttggcccagtctgagaggacaagcttacactgctgtgctcttggtcaggtgtttgttccctgtgaaaccaaaatctggaaactttttggcataggtcaaactgttccctgcatatagtaagtgggtgtgtttcctatctatcaccaaggatttcacatctcatcaaattatctgccctaactgcttaggtgacccctgtgtgaatgaagagtgaagtttgggccataaggaaacagatggaggtacccactaactacaaacccgaagtccccacatgctaccctgtagctcacctgcatagatcctactctctgttgaattgttgacaggcctttgcctacacacctaagaaaaagcagggacagcttgcattggtcaccactataacctgtgctccccgcagatggtatgagtttccactaaggcacatttctattcttcaggtctcagttaaaaatcggaagaaaacacatatctttgtatgaagtattttttcttttctaattgaaaacaatttttcatacactataatgtgttcttgctttcctagttatttcctcatggatcctaaggacaaacaaaccagaagcaaaaatatataagacacacagagagagagagagagaaagagagagagaggtcctaacaagacaaactcataaagtgtaagatactagcaaaacagctgacagtttaagaatatgcccagagcaaacaatatgagaccaaaaaaaaaaaaaaaatcaacaaaatataagcactgcgtttgctttgagatgggcattacctgaaaggtatgaggcctatccttaagtgtgtttacatgacgacaaacaactgaagaaaacaaaagcttcccttgccagtgggtgtcaactgaagcaagcatcttggttaggggtggatttgtgtccactttgcactgtcaatatcacagtgacatctagctaccgcctatataggccctaagcatgttggtgcccggtctcagtgggttataatgtatcagtcttgttgtgtctggaagatactgcttttatggtctcaagcattccctctgggcttccaatcttactgtttcctcttctgcacagctccctggatacagaggggagggacatagtgaagagatctcatgaggacccaagtgttccaaagtctctcctcactcctgacacattgtccagttttgggtcactgtgttacgtcccatctagagaagaggaaggtcctggagcatttcaacttctttgaatgctatgtttgtgcgactgcatgtgtgtgcccctgacacaactgataaatggatatggaaaagtagattcccacacgcaaaaaaaaacacctttcaaagtactcagccaaacatcctcatatctgctttgactttcagtaggcaaattttcagacaggagagacaaaaattaaaatactaaagaaactattcaaagtcagggaaaatcaagataatcatattccatggtaacatttatacttgaatggtgttttatttttggttttggagaaggagggcacaagaaatgaaaagttcttaacgcttctttcctggagctctaatactgtcatggggatgcagttacaaaccactgttgtgttttataaaaagacactcaactgagcttccttcccatgattcttagcaatggcagaagatggctgccaattaccgacagcaggagcagctgtgggtgcctagttgggttgccttgacttctcctcaggccccaacagaaactgggactgcagtacattctcttcagaacctggagagggaggcgccttgcctgccctaggacaccagctagtagattaccatggccagctgatcgggctggaacctgcccttctgcttcctgtcccagcacctcagcaccgctgtgcacttggtactagacctctgtcaccagggtctgagttaatactctgaagggtcctgtgatgacagtctgcctacaggagagaaatacagtaaaacgagcaagcttcgccattcatgaatccccctcatcctccctgcttcaaaatggctgagaaaaagcaggataaaggaggggtgtgtgcctgtgctggtctacaggaaacattttccgcatgatggcagtgctgccccagagcagggaaggtgccctgactgcagctctctgtcccctccttcatggtctgaaaaaaatgtcgatacagaggcagtgtcctctaactgtgcagttctagccttccttgtctgtgtcagaagcatgcagtgctgtactcctagaatttagcttccattttacactttatatcaatgccatttctaaggaggctggacatgaatttgtactaaataaataaagagataaaaaaatataaaaccataggaagccaaacagaaaggaaaggaagctttgaggcccccaccttcctcattccccttctcctgggaagaagtgtgtgcaggccatggtcaagtcctgcatggctcccatctgggtccagcagcacccggcctccagtgcttgctcctgatgtctcagtgaactcaggttctgagcagcaaatcccaggggccagttctagggagaaaaagaacacactgccatctcagtgcctcaacagaagcaaacctaggcctcaggtcatgccctggttactcagatcacacttacacttccctgggtatcatgctctgtgtgagatccacacaagaggccaggacaaaaggccttgtgtgtcctgtggcaggctcactttagtggctctgtaaaaagcatgcagatagcagtcaacactgaatgctatatacatgcctacttggagaaacacagttctttccaatgactgtgatttccaaatggatctgccactgatgctcaatggggctttcattagttcacacaggagcagggacacaagaatttgctacattacagtctgatttccagttcccgtggcttcactacatacacgttgtctttatactttacttacagtcttatactttcccttggcaactaagacatgcatctctcagagaggagcttggactgcataatgtatgccagggcaacttgggagtaaattaggagtctctggtcttagcaaaaagacatagcttgaaatgtgtaccatgtgtaacatgctacaaaaaggtggagacagaagtctatagcaagggcctgcattttcttgtctggggtttcttcttgtcatgccccagataggaagacccaaaggcctggcccacaacttcctgtgtcagcttgtccctacagctctgctgttggactttagtcttccttttcagctgcaagacattactggggcccacacttctcctgctctagaggaaaggcactgggtcccagtgtggaacccaaagtatcctacctggcattgtgtccccactactaggattcatgggaatgaagctgtaatggctctgcactgtagctctgcatacatgatggcagaaggacaccacatatggccacaaaggccatccttgattacccttctctcaccttcaagcctgaaaataaataccataaccaatatctagagacaaaggcccaggatcctggatgtctaggcctatgttactgtttttcagaagtaattctccactgtcccctctccattcaggcctgttatacttcccttcgagtgacttgtccttcaaagggtaaacatggtggatgaagtctaacagaggagaaaactgggaagcatggacatcatctttgggatataattatcaactgccaagtgtttgtttgctgatgatatttaagacaaggttaaacctactgccttcagatgggcatggtagcatggtctgagatattttggaactcccagagcaaaagacagaagcctcctggagaggcccagaccagcctgtctcctgtacttaacaagaatcattgctaagcttagttctttacttctaaatctcctagcatattgtcatcatgtagaacctacacaaaggaatcataccaaattttaggaacattaaatatctgtacagggtaaatatcaacagttataaagacagaaaaaggaaataacctaaataacagaagaaaaaatgtcccactacctatgaagtcagattggcttcaaagggaacacatgaaaaaaaaacaacaccctttaaacaactcaaagctgggtaaatgttaggacagccattttttgtgatttttcagacaggaagggcgggggagaggcactcaggagcacttgtgtggagctctactgccaccctcaggccacggtttcaaaactcacagcgccactctcctccttcccataattcctagcaatggcggaagatggcgaccgattacagacagcaggagcagctgtgggtgcctagttgggctgtcttgacttctcagaccccaacagaaactgggactgcagtgttttctcctcagaacctggagagtgaggtgccttcctattcaagacaccagctaatagattatagtggccagttgagcgggcaggaacccgcccatctgcttcctgtccctggacctcagcacagctgtgcacttggtacaggacctcaagtcaccagggtctgagttaatactctgaagggtcaggtgattctagtctgggtacttaaggagaaaatagacattaaaacaggcacatttcgccattcatgaatcctcctgatcctccctgcttcaaaatggctgaggagaagcaggatggaggaagaggtctgtgtgcctgctctgctctacaggaaacattttccacataatggcagtgttgccccagagcagggaaggtgtcctgagtgcagctctctgtgcccgccttcacagtctgaaaaaaatgtcaatacagaggcagtgtcctctaactgtgcagttctagccgtccttgtctctgtcagaagcatgcaatgctgtactcctagaatttagcttctattttgcattttatatcaatgccatacctaagaaggctggacctgattttgtactaaataaataactgatcagaaaaaaagaaatataaagacataggaagtcaaacagaaaggaaaggaagcttggaggcccccaccttcctcattccccttctcctgggaagaagtgtgtgcaggccatggtcaagtcctgcatggctcccatctgggtccagcagcacccagcctccagtgcttgctcctgatgtctcagtgaactcaggtcctgagcagcaaatcccaggggccagtcctagggagaaaaagaacacactgccatctcagtgcctcaacagaagcaaacctaggcgtcaggtcatgtccttgttacccacatcacacctagacttccctgggtatcatgctctgtgtgagatccacacaagagccccagacataagacactgtgtgtcctgtggcaggctcacttagttgctctgtaaagaggatgcagatacctgtcaacactgaatgctaaatacgtgcctacttggagaaacacaggtctctccaatggggctttcattagtttacccaggagcaaggacacaagaatttcctacattacagtctgatttccggttcccgtggcttcactacatgcacgtgttattgtctttatactttattatactttcagtcttgtactttcccttggcaactaaggtatgcatctaggagaggagctttgactacttaatgtgtaccagggcaacttgggagtaaattgggagtctctggtcttagcaagaagacaaagcttgaaatgtgtagcatgtgtaacatgctacaaagaggaaaagacagaagtctccagcaacagcctacattttcttccctggggtttcttcttgtcatgtcccagataggaagaaccaaaggcctggcccacaacttcctgtgtcagcttgtccctaaggttctgctgttgtcccttatttttccttttcagctgtaagacattactggggcccacactcctcctgctctagaggaaaggcactgggtccaaatgtggaacccaaagtatcctgcctggcattgtttccccactgctaggactcatgggaattaagtgtaatggctcagtactgtagctttgcctgcagaatagcagaaggacaccacatgtgtccacaaaggccatcctggatactcctctctcaccctcgagcctaaaaaaaaaattatcataaccaatatctagagagaaaggcccaggatggaggatgtctaggagtttgttactgtttttcaggagtaattctctactgcaacctctccatgcagaccttgtatactttcctttgagtgacttgtccttcaaagggtaaacatggtggatgtaggcagatagaggagacaactgggaagcatagacatcgcctttgggatataatttgataatatatgccaggtgtttgtttgctgatgttacttaagacaaggttaaacctactcatgtcagctgggcatgataacatggaccagaagcctcctggaaaggcccaggccagcctgcctcatgtacttaactagagccagggctcagcattgtcctttgcttctgaatctcctagcataaaattatcttgtaaaacctacacaaaattaatcataccaaacttgaagaccattaactatctggaaagggtaaaaatccacttataaagacagaaaaaggaaataaccttcataactgaaggaaaagagtcccaccacctagggcctcagattggcctaacaaggaatggatgacataaaattaaaataccttttaaactactcaaagttgggttaaagttaggatagccatctttagcagttttttttttagacatgaagggcagggtagaagcactcataagctcttgtgtagagctctactgccaccattaggacgcggtttcaaaactcacagcaacactgtcctctttcccatgattcctagcaatgacagaagatggcgaccaattacagacagcaggagcagctgtgggtgcccagcagggcttccttgacttttcaagccccaacagaaactgggactgtagttctttctcttcaaaaccaagagagagacaccttgctgccctaggacactagctagtagattaccatggccagctgagcgggctggaacctgcccttctgcttcctgtccctgcacctcagcaccgctgtgcacttggtactagacctcaatcaccgcagtctgcgttaatactctgaaaggtcctgtgatactagtctgcctacagaaggagtgaaatacagtaagaaggacaaatttcaccattgatgaatccccctgatcttccttgcttcaaaatggctgaggagcagtaggatggaggaggtatgtgtgcctgcgctgatctaaaagaaacatttgccgcatgatggcagtattgtcccacagcagagaagatgtcctggctgcaggtctctttccccgccttcactgactgaaaaaaatgtcaatacagaagcagtgtcctctaactgtgcagttctagccttccttgtctgtgtcagaagcatgcagtgctgtactcctagaatttagcttccattttatactttatatcagtgccatacctaaggaggctggacctgattttgtactaaataaataattaaacagaaaaaaaggaatataagaacatagcaacacactgatggaaaggaagccttgagacccccaccttcctcattccccttctcctgggaagaagtgtgtgcaggccatggtcaagtcctgcatggctcccatctgggtccagcagcacctggcctccagtgcttgctcctgatgtctcagtgaactcaggttctgagcagcaaatcccaggggccggttctagggagaaaaagaacacactgtcacctcagtgcatcaacataaactaaccaaggggtcaggtcatgcccttgttacccacatcacacctagacttccctgggtatcatgctctgtgtgagatccacacaagagccccatacaaaaggccttgtgtgtcctgtggcaggctcactttagtggctctgtaaagagcatgcagacacctgtcagtactaaatgctatgaacatgccaacttgtagaaacataggtctctccaatgactgatttccaaaagatctgtcactgattctcaatggggttttcaatagttcacactggagcacgacataagaaattcctacattataggccaattacagtttcccatggcttaactatatacacgttcttttctttatactttcagtcttctactttcccttggccactaagacatacacctctgagaggagcctgggctacataatgtgtgcttgaacagcgtggactaattagggagtctctgtgtcttagaaagaaggcatggcttaaaatcctgcctacacatgctacaaggagcaggagaccgaattctccacaaagagcctgcatttttttccctgtggtgtcttcttgtcatgccccagataggaagacccaaagacctggcccacaacttcctgtatcaggaagctctactgtttgccctttactcttccttttcagctcgaagccattactggtgcccacacttctgctctagagaaaaggcactgggtcccagtatgaaacccaaagtatctaacctggcattgtttccccactgctaggactcatgggaatgagattttaatggctcagcattgtaggtctgcctgcaggatggcagaaggacaccacatatggtcacaaaggacatcctggactacccctctcccaccctcaatcttaaaaaataaataccataaccaatatccagagacaaaggcccaggatcctggatgtctaggactttgttactgtttttcagaagtaattctccactgtcccctcttcattcaggcctgttatacttcccttggactgacttgtcctcaaagggtagacatggtggatgaaggcagacagaggagaaaactgggcagcatggacatcgccgttgggatataattatcaactgcccagtgtttgtttgctgatgttacttaagacaaggttaaacctactcgtgtccgctgagcatggtaacatggaccagaagcctcctggaaagggccaggccagcctgcctcttgtagttcactaggaccacggctcagcatagtcctttgcttctaaatctcccatcatatctttatcatttaaaacttacaaaagttaatcagacaaaattttaacaccattaaatatcggattagggtaaatatccatagctatagagcgagaaaagggaaaaaccctacataactaaaggaaaagagtcccaccacctcgggtagaagtatgtgtcagattggcttcacatggaacacatgaccaaaaaaataaaacaacttttaaagtactcaaagttgggtaaaagtttggacaaccatctttggcgttttttcagaaagaaagggcggggaagaggaactcacaagctcttgtgtggagctctactgccaccatgaggacacggtttcaaaactcacagtgccattctcctccttcccatgattcctagcaatggcagaagatggcggccgattacagacagcaagagcagctgtgggtacctagctgggctgccttgccttctcctcagaccccaacagaaactgggactgcagtgctttctcttcagatcctggagagagaggcgcctcgctgccctaggacaccagctagtagattaccatggccagctgagcaatggtgaaacccgcccttctgcctcctgtccctgtacctcagcacagctgcgcacttgataatggacctcagtcaccatggtcagcgttaatactctgaaaggttctgtgatgctagtctgcctacagaaggagtgaaatacagtaagaaggacaaatttcaccattgatgaatccccctgatcttccctgcttcaaaatggctgaggagcagtaggatggaggaggtatgtgtgcctgcactggtctacaagaaccatttcccgcatggtggcagtattgtcccacagcagagaagatgtcctgactgcagctctctttccccgccttcactgactaaaaaaaatgtcaatacagaggcagtgtcctctaactgtgcagttctagccttccttgtctgtgtcagaagcatgcagtgctgtactcctagaatttagcttctgttttgcattttatatcaatgccaaacctaagaaggctggacctgattttgtactaaattttttaaacagaaaaaaaggaatataagaacatagcaacacaaatagatggaaaggaagccttgaggcccccaccttcctcactcccattctcctgggaagaagtgtgtgcaggccatggtcaagtcctgcatggcgcccacctgggtccagcagcacccgacctccagtgcttgctcctgatgtctcagtgaactcaggttctgagcagcaaatcccaggggccggttctagggagataaagaacacactgccacctcagtgcctcaacagaagcaaacctaggtgtcaggtcatgcccttgttacccagatcacacttatacttccctgggtatcatgctctgtgtgagatccacacaagagccccagacataagacactgtgtgtcctgtggcaggctcacttagttgctctgtaaagagcatgctgatacctgtcaacactgaatgctatgaacatgcctacttgaagaaacataggtctctccaatgactgatttccaaaagatctgttactgattctcaatggggttttcaatagttcacactggagcacgacataagatattcctacattataggccaattacagtttcccatggcttaactatatacacgttcttttctttatactttcagtcttctactttcccttggccactaagacatacacctctgagaggagcctgggctacataatgtgtgcttgaacagcttggactaattagggagtctctgtgtcttagaaagaaggcatggcttaaaatcctgcctacacatgctacaaggagcaggagaccgaattctcctcaaagagcctgcattttttccctgtggtgtcttcttgtcatgccccagataggaagaaccaaaggcctggccaacaacttcctgtgtcagcttgtccctacagctctgctgtttgcctttgtctttcttttcagctcgaagccattactggtgcccacacttctgctctagaggaaaggcaccgggtcccagtatggaacccaaactatctaacctggcattgtttccccactgctaggactcatgggaatgagattttaatggctcagcactgtagctctgcctgcaggatggcagaaggacaccacatatggtcacaaaggccatcctgcactacccctctcccaccctcaatcttaaaaaaataaataccataaccaatatctagagacaaaggcccaggatcgaagatgtctaggactttgttactgtttttcagcagtaattctacactgtcccctctccattcagacctggtatacttcccttggagtgacttgtcctcaaagggtagacatggtggatgaaggcagacagaggagaaaactgggcagcatggacatcgccgttgggatataattatcaactgtccagtgtttgtttgctgatgttacttaagacaaggttaaacctactcgtgtccgctgagcatggtaacatggaccagaagcctcctggaaagggccaggccagcctgcctcatgtagttcactaggaccacggctcagcatagtcctttgcttctaaatctcccatcatatcttcatcatttaaaacttacaaaaagtcaatcagacaaaattttaacaccattaaatatcggattagggtaaaaatccatagctataaagtgagaaaagggacaaaccctacataactaaaggaaaagagtcccaccacctagggtataagtatgtctcagattggcttcacatggaacacatgaccaaaaaaataaaacaacttttaaagtactcaaagttgggtaaaagtttggacaaccatctttggcgttttttcagacaggaagggcgggggagaggcactcacaagctcttgtgtggagctctactgccaccatgaggacacggtttcaaaactcacagtgccattctcctccttcccatgattcctagcaatggcagaagatggtggcagattacagacagcaggagcagctgtgggtgcctagctgggctgccttgccttctcctcagaccccaacaaacactgggactgcagtgctttctcttcagaacctggagagggaggcgccttgctgccctaggacaccagctagtagattaccatggccagctgagcaatggtgaaacctgcccttctgcctcctgtccctgtaccgaagcacagctgtgcacttgataattgacctcagtcaccgcggtctgtgttaatactctgaaaggttctgtgattgtagtctgcctacagaaggagtgaaatatagtaagaaggataaatttcaccatttatgaatccccctgaccttccctgcttcaaaatggctgaggagcagtaggatggaggaggtatgtgtgcctgcactggtctacaagaaacatttcccgcatggtggcagtattgtcccacagcagagaagatgacctgactgcagctctctttccctgccttcactgactgaaaaaaatgtcaatacggaggcagtgtcctctaactgtgctgctctagccttccttgtctgtgtcagaagcatgcagtgctgtactcctagaatttagcttccattttatactttatatcagtgctatacctaaggaggctggacctgattttatactaaataaataattaaacagaaaaaatggaatataagaacatagcaacacaaatagatggaaagaaagccttgaggcccccaccttcctcactccccttctcctgggaagaagtgtgtgcaggccatggtcaagtcctgcatggcgcccacctgggtccagcagcaccggatctccagtgcttgctccctatgtctcagtgaactcaggttctgagcagcaaatctcaggggccggttctagggagataaagaacacactgtcacctcagtgtatcaagagaagcaaacctaggcttcaggtcatgtacttgttactcagatcacacttacacttccctgggtatcatgctctgtgtgagatccacacaagagccccagacataagacactgtgtgtcctgtggcaggctcacttagtggctctgtaaagagcatgctgatacctgtcaacactgaatgctatgaacatgcctacttgaagaaacataggtctctccaatgactgatttccaaaagatctgtcactgattctcaatggggttttcaatagttcacactggagcacgacataagaaattcctacattataggccaattacagtttcccatggcttaactatatacacgttcttttctttatactttcagtcttctactttcccttggccactaagacatacacctctgagaggagcctgggctacattatgtgtgcttgaacagcttggactaattagggagtctctgtgtcttagaaagaaggcatggcttaaaatcctgcctacacatgctacaaggagcaggagaccgaattctctacaaagagcctgcatttttttccctgtggtgtcgtcttatcataccccagataggaagaaccaaaggcctggcccacaacttcctgtgtcagcttgtccctacagctctgctgttggactttagtcttccttttcagctgcaagacattactggggcccacacttctcctgctctagaggaaaggcactgggtcccagtgtggaacccaaagtatcctacctggcattgtgtccccactactaggattcatgggaatgaagctgtaatggctctgcactgtagctctgcatacatgatggcagaaggacaccacatatggccacaaaggccatccttgattacccttctctcaccttcaagcctgaaaataaataccataaccaatatctagagacaaaggcccaggatcctggatgtctaggcctatgttactgtttttcagaagtaattctccactgtcccctctccattcaggcctgttatacttcccttcgagtgacttgtccttcaaagggtaaacatggtggatgaagtctaacagaggagaaaactgggaagcatggacatcatctttgggatataattatcaactgccaagtgtttgtttgctgatgatatttaagacaaggttaaacctactgccttcagctgggcatggtagcatggtctgagatatttttggaactcccagagcaaaagacagaagcctcctggagaggcccagaccagcctgtctcatgtacttcatagctcagcttagttctttgcttctaaatctcctagactatcttcatcatgtaaaacctacaaaaacctaatcatgccaatatttaaaaatactaaatatctgcaaagggtaaaaatctacagttctaaagacagaaaaaggaaataacctacaaaacagaaggaaaaaagtcccaccacctagggcctaagattgccttcacagggaacacatggaagaaaaaaataccttttaaactactcaaagctgggtaaaccttaggacatccatcttttgtgttttttcagacaggaagggcgggggagaggcactcacaagctcttgtgtggcgctctactaccaccacgaggacgtggtttcaaaactcacagtgccactgtcctccttcccatgattcctagtaatggcagaagatggcgaccgattacagacagcagaagcagctgtgggtgcctagttgggcttccttgacttcttctacggccccaacataaactgggactgcagtgttttctcttcagaacctggagatggaggcaccttgttgctctaagacaccagctactagattatcattgccagctgagcgggttggaacccgcccatctgcttcctgtccctggacctcagcacagctgtgtacttggtactggacctcagtcaccagggtctgagttaatactctgaagggtcaggtgattctagtctgggtacttaaggagaaaatagacagtaaaacgggcacatttcaccatccatgaatcctcctgatcctccctgcttcaaaatggctgaggagaagcaggatggcggaggtgtgtgtgcctgctctgctctacaggaaacattttccgcatgatgacagtgttgccccagagcagggaaggtgtcccgagtgcagctctctgtccccgccttcacagtctgaaaaaaactccaataatggacagagtccaacaactatggcagctttccttaccctttaccttcaaaatgaggaagattcatctatgggagagtttacctcccattttcatttcaaggtagcgactcagccagagcatccatctgtatcttcaccagaatccaccaccaaatccagaagaataaactctgctgtaagaaggaaattgcctggaatttatgatctaagcaggaaggaaagagaaggatggaggagctttgaggcacccaccttcctcatgcagcactgaagatatcagtgagtggctgctcaatgatcaagtctagtctcttcttcacccagcagcagtcttctaccccagtgcttgtggtgtggaggttaaaattcatcgtccagttctaggtaggaaagaaaatgttgccaagtcagggtctggagaagatcaaacctaggaaccaggaaacctgggtctctgcctgattcccttcacagattccctggtcaccataccccatcctttcttacacaactggccttgggtgggcgtccagccaatctgactacctgcctgtaatgatgatctaggtaggtctcaaaatttaatgctccatagcatttggggtgacaaagctatggaaatcactataactcctaatcacatagatcatggagtatgtttgacctgtaaacgaaagtgaacattcactaaatttgtgtttatattataatctatcatgtataatttctcatacctttattttgaaggaactagaatgtggggggggtaagagagacaactggaattgggggtccttttgggggtgatacttgtagaaatctaatacattacaaactccttggaatctatgagagtaaccctagtaaaatctcctggtaatggaggatacagagcctaaaccaaccatcatttataaccaggcaagcctcctagcctttggactgggacacctacccagccacaaaacatttgacttatcatgtcctatctgcaagacttgctagaacaatggtggccaagaacttgtaaaagtagccaacccatgactggtctaacttttggcccacactgccaggagaggggtcccatggctgacactgcctggatggccaggatcagaggaaggacagcctgagacccaggatagaaccaatcatgattggcaaaaagtatccaaaaaagtcaaggaagtgattcctaatgatattctgctatactcacagatccacgccacccaagagtcatcagagtggtgttatccagcaactgatgtgagcagatgcagagacccacagccaaaaactaagtagagccaggaaacccattaaagggaggattgtaggagtcagattgtttgggaaccttgaaaacacagggtacaaaatctactaaatagggctcatcaggcctcacagagactgaaacaacaaacatggaccctgtatgggtctgagctaggtaccttgtggttgtgcagctgggtgttcttatgggactcctaattgtgggaacgggaggtcatgtgtctctgaatctttccctgtgcttggaacccttttcataccctgtgggaggagtccttgctgctgctctctctctctcttgcactctctctccctctttccctccctccctccctcttcccttttcttttctcctcctttttgtccttctcttattttgacgggtatagagcagtagttgatctggcagagacaggacatggggatacggtttaagtgacaggaggttgaaaatggtacagaagtaatacattaaagaagaataaaagttttctaaaaaaaaaaaacattaataatccaattaaaaacgggctacaattttagatggagaattctcaaaagaagaatctcagatggtgaagaaatactttaaaatgttcaacatccttagctttcagggaaatgcaaatcaaaactactttgagatttcattttacaccaatcaggaaggctgagatcaacaaaacaaaggatagctcatggtggtaggatgcatggtaaggggacactcctccattgctgggcgtgcaagctttacagccactattcaaaccagtgtgatggctcctcagaaagatggcaatacctcaagattcacctagccagtcttggatatatactaaagactgtttcatcctactacaaagatactcaaccatgttcattgctgctctatttggaacagccagaaactggaaatcttgatgtctgcacatgaatgaatgaagaaaatgtggtacatttacacaatggaatattagtcaaccactttgcaaagtaaaaatcatgaaattcatgagtaaaagggtagaaagagaaacaaaatcatcctgaggtaactcagaccccaaaagtgggaatttttttttttttagttttgctacacagggtttctgcgtagccctggctgtcctggaactcactctgtagaccaggctggcctcgaactcagaaatccgcctgcctctgtctcctgagtgcatgtgccaccactgcccggtcaaaagggaaacattttatgtgctcactcacatgtgaatgttagcggttaaatcacagagaagcaaagtacagttcatataacaagaggttatgtataaaggacctatgggggacggtttgataatccttccaaggggaacataagaactgatagttatggaacacagagtgggggaatggaatggaggatcaagtaaggagagggaggggaaagggacaggagggaggtaatatggggaggaatcaaaagggtagaaacatctccaactagactcctcttgtcactaaatgaagccttcagtactgggggtgaattacttcaaatggagattgggccaatccaggctattatgaaggctatttgtggcccttcataaactgacagcaaggccaaactgctgaagacgcatggagcacagagaaggttactagcacctactctataaggactaggactcatggaaggagaaagaagcaaaccttacaatctgcagaaacaccagtggcacaaagcttgtgagagtaaccaaccaatatctgattttgtgtgacctgagagaccataagatgacaaccgaaagacctggctagtatttcacactggagaccttccactaaggttgcgtaaaacctacaaaaaataagtatatcaaactttgatataccgtggaaaaataaatggttataaagtaagaaataggaaatatcctgcataacagaaggcatggagtacaatgacctagggaagaattaggcctgagattggcctcatgtggaacagaagacaaaaaattaaaatactcttaaagccactcaaagctgcataaaaggtaggacagccatcttagactttttttcagacacaaagggcgggggggaaaagcactcacaaagtcttgtatggagctctactgcctccatgaggatgcggtttcaaaactcacaactccactgtcctccttcccatgattgctaacaatggaagaagatggcggctgattacagccagcaggagcagctgtgggtccctagttgggctgccttgaattctcaggcccaagagaaactaggactgtagtgctttctcatcagaacctggggagggaggcgccttgctgccctaggacaccagctagtatcttaccatggccagctgagcgggctggaacccgcccttctgcttcctgtccctggacctcagcaccgctgcacacttgataatggacctcagtcaccagggtgtacagtaatgctctaaaatgtcctgtgatgccagtctgcctacagaaggagaaaatatatagtagaacaggaaagcttccccatccttgaatcctcctgatcctccctgcttcaaaatggctgaggagaaacaggatggaggaggaggtgtgtgtgcctgtgttggtctacaggaaacattttccgcatgatggcagtattgtcccagagcagagaagatgtcctgactgcagctctctacccccgccttcactgactgaaaaaaatgtcaatacagaggcagtgtcctctaactgtgcagttctagccttccttgtctgtgtcagaagcttgcaatgctgtactcctagaatttaccttccattttgcattttttatcaatgccaaacctaaggaggctggacctgaattttgtactaagtaaataattaaacagatacaaaaaatagaataaagacataggaagccaaacagaaaggaaaggaggctttgaggcccccaccttcctcattccccttctcctgggaagaagtgtatgcaggccatggtcaagtcctgcatggctcccatctgggtccagcagcaccggcctccagtgcttgctcctgatgtctcagtgaactgagcagcaaatcccaggggccagtcctagggagaaaaagaacacactgtcacctcagtgcctcaacagaaacaaacctaggagtcaggtcatgtccttgttacccagatcacacttacacttccctgggtatcatgctctgtgtgagatccacacaagagccccagaccaaaggtcttgtgtggcctctagaaggctcactttagtggctctgtaaagagcatgcagatagctgtcaacactgaatgctatgaacatgcctacttggagaaacacaggtctctccaatggctatgatttccaaatggatctgccactgatgctcaatgggattttcattagttcacacaggagcagggacacaatgatttcctacattacagcctgatttccggttcccgtggcttcactacatgcacctgttattgtctttatactttattatactttcagtcttgtactttcccttagcaactaaggtatgcatctcagagaggagcttggactgcataatgtatgccagggcaacttgggagtaaattgggagtctctggtcttagcaagaagacatagcttaaaatgtgtagcatgtgtaacatggaacaacgaggaaaagacagaagtctccagcaacagcctacattttcttccctggggtttcttcttgtcatgccccagataggaagacccaaaggcctggcccacaacttcctgtgtcagcttgtccctacagctctgctgttggcccttatctttccttttcagctccaagatattactggtgcccacactcctcctgctctagaggaaaggcactgggtccaaatgtggaacccaaagtatcctacctggcattgtttccccactgctaggattcatgggaatgaagctgtaatggctctgcactgtagctttgcctgaagaatggcagaaggacaccacatgtgtccacaaaggccatcctggatactcctctctcaccctcgagcctaaaaaaaaattatcataaccaatatctagagagaaaggcccaggatggaggatgtctaggagtttgttactgtttttcaggagtaattctctactgcaacctttccatgcagaccttgtatactttcttttgagtgacttgtccttcaaagggtaaacatggtggatgtaggcagatagaggagacaactgggaagcatggacatcgcctttgggatataatttgataatatatgccaggtgtttgtttgctgatgttacttaagacaaggttaaacctactcatgtcagctgggcatgataacatggaccagaagcctcctggaaaggcccaggccagcctgcctcatgtacttaactagagccagggctcagcattgtcctttgcttctgaatctcctagcataaaattatcttgtaaaacctacacaaaattaatcataccaaacttgaagaccatttacgatctggaaagggtaaaaattcacttataaaaccagaaaaaggaagtaaccttcataactaaaggaaaagagtcccaccacctcgggtagaagtatgtgtcagattggcttcacatggaacacatgaccaaaaaaataaaacaacttttaaagtactcaaagttgggtaaaagtttggacaaccatctttggcgttttttcagaaagaaagggcgggggagaggcactcacaagctcttgtgtagagctctactgccaccatgaggacacggtttcaaaactctcagtgccattctcctccttcccatgattcctagcaatggcagaagatggcggccgattacagacagcaggagcagctgtgggtgcctagctgggcttccttgccttctcctcagaccccaacagaaactgggactgcagggctttctcttcagatcctggagagggaggcgccttgctgccctaggacaccagctagtagattaccatggccagctgagcaatggtgaaacctgcccttctgcctcctgtccctgtaccgaagcacagctgcgcacttgataatggaccttagtcactgcggtctgcgttaatactctgaaaggttctgtgattctagtctgcctacagaaggagtgaaatacagtaagaaggacaaatttcaccatttatgaatccccctgaccttccctgcttcaaaatggctgaggagaactaggatggaggaggtatgtgttcctgcgctggtctacaagaaacatttcccgcatggtggcagtattgtcccacagcagagaagatgtcctgactgcagccctctgtccccgccttcactgactgaaaaaaatgtcaatacagaggcagtgtcctctaactgtgctgctctagcctcccttgtctgtgtcagaagcatgcagtgctgtactcctagaatttagcttccattttacattttatatcaatgccatacctaaggaggctggacctgattttgtactaaataaataattaaacagaaaaaaaggaatataagaacatagcaacacaaatagatggaaagaaagccttgaggcccccaccttcctcattccccttctcctgggaagaagtgtgtgcaggccatggtcaagtcctgcatggctcccatcaggatccagcagcacccggcctccagtgcttgctcctgatgtctcagtgaactcaggttctgagcagcaaatcccaggggccggttctagggagaaaaagaacacactgtcacctcagtgcatcaacagaagcaaacctaggcgtcaggtcatgtccttgttacccagatcacacttacacttccctgggtatcatgctctgtgtgagatccacacaagagccccagacaaaaggccttgtgtgtcctgtggcaggctcacttagtggctctgtaaagaggatgctgatacctgtcaacactgaatgctatgaacatgcctacttgaagaaacataggtctctccaatgactgatttccaaaagatctgtcactgattttcaatggggttttcaatagttcacactggagcacgacataagaaattcctacattataggccaattacagtttcccatggcttaactatatacacgttcttttctttatactttcagtcttctactttcccttggccactaagacatacacctctgagaggagcctgagctacataatgtgtgcttgaacagcgtggactaattagggagtctctgtgtcttagaaagaaggcatggcttaaaatcctgcctacacatgctacaaggagcaggagaccgaattctccacaaagagcctgcattttttccctgtggtgtcttcttgtcatgccccagataggaagaaccaaaggcctggccaacaacttcctgtgtcagcttgtccctacagctctgctgttcgcctttgtctttcttttcagctcgaagccattactggtgcccacacttctgctctagaggaaaggcaccgggtcccagtgtggaacccaaactatctaacctggcattgtttccccactgctaggactcatgggaatgagattttaatggctcagcactgtagctctgcctgcaggatggcagaaggacaccacatatggtcacaaaggccatcctggactacctctctcccaccctcaatcttaaaaaaataaataccataaccaatatctagagacaaaggcccaggatcgaggatgtctaggactttgttactgtttttcaccagtaattctccactgtcccctctccattcagacctgttatacttcccttcgagtgacttgtcctcaaagggtagacatggtggatgaaggcagacagaggagaaaactgggcagcatggacatcgccgctgggatataattatcaactgcccagtgtttgtttgctgatgttacttaagacaaggttaaacctactcgtgtccgctgagcatggtaacatggaccagaagcctcctggaaaggcccaggccagcctgcctcttgtagttcactaggaccacggctcagcatagtcctttgcttctaaatctcccatcatatctttatcatttaaaacttacaaaagttaatcagacaaaattttaacaccattaaatatcggattagggtaaaaatccatagctatagagcgagaaaagggaaaaaccctacataactgaaggaaaagtcccaccgcctagggtataagtacgtctcagattggcttcacatggaacacatgaccaaaaaaataaaataacttttaaattactcaaagttgggtaaaagtttggacatgcatccttggcgttttttcagacaggaagggcgggggagaggcactcacaagctcttgtgtggagctctactgccaccatgaggacacggtttcaaaactcacagagccactctcctttttcccatgattcctagcaatggcagaagatggcggccgattacagacagcaggagcagctgtgggtgcctagctgggctgccttgccttctcctcagaccccaacagaaactgggactgcagtgctttctcttcagaacctggagaggaaggcgccttgctgccctaggacaccagctagtagattaccatggccagctgagcgggctggaaaccgcccatctgcttcctgtccctgcacctcagcacagctgagcacttggtactggacctctgtcaccagggtctgcattaatactctgaagggtcctgtgatgacagtctgcctacaggagagaaatatagtaaaacgggcaagcttcgccattcatgaatccccctcatcctccctgcttcaaaatggctgaggagaagcaggatggaggaggaggtgtgtgcctgtgctagtctacaggaaacattttcccatgatggcagtgttgccccagagcagggaaggtgtcttgactgcagctctctgtccccgccttcacagactgaaaaaaaatgtcaaactgaggcagtatccactaactgtgcagttctagcctcccttgtctgtgtcagaagcttgcaatgctgtactcctagaatttaccttccattttgaattttttatcaatgacatatcaaaggaggctggacctgctcccatctggatccagcagcacccagcctccagtgctttctcctgatgtctgattgaactcgggtcctgagcagcctggttcatgtagttcaatgcaactagggcttcatagatagcctttcacacacacacacaaacacacacacacacacacacacacacacacacacaaaacctcactgtcaacttcaattctctcaacatcgtatatagttccaacagtgattaacccgttcatgtagtcagagtccactggatctgaacacctgttctcacatcagtattaacgcgtactttgtgtcagtctttcctacaaaggaattatgcaataccagcaattaagccacaggttggttaaataaacaaaatatctcacaggcctgctctggttgcccacatcgataattatcccaagaaggaagatcactgcaaattcccaggccagctagtactagagatcctagctcagacaaaagcacctcactcgatctatagttctaaagtaattttagagcgtttttaaaacattgcttttataacatcatggtgataagcaaaattgacaacattcctgtaatctcattttcctcaagtctttgtgaaatataaactgatctgatccaaactataatgtacctatcccatccaattttagtataaaatatatatgcatgcatgtatatgtgaaatgatgtgcacatacatactcaacaagattatcacttgctttgaaacaaatgttggcactactttacagccagcatgctgtctttcggagtgctgtgaaagtgtcattcttaacttagtaatgagacatcatacaagatacagcaccagccaggtactggttttgcacacctttaatcccagcacttgggaggcagaggcaggaggatttctgaattcgagaccagcctggtctacagagtgagttctaggacagccagggctccacagagaaactccttctcaacaacaaggtactctatctaccaaagattaggaaacaatgtctcctatgcaccattcccccaataaacatcacagtaagtgatggaacataactcatgacattggaatgtactgaattctcatgggagaaaatgacagaacccagagtgacttcggatagacactgttaagtgctcagtagagcagtataagtgactgaggtgtgggaatgcctgctgcaatcctccttctctgatgcctcaggccaatgcgaaaccacaaagcacttcctcctgcctaggagagtaagcagtgcataggctatttgggcgaggcatgatagaacaaacttctaatctcagacagagcctagataggccaggagcgggagacttgggagttggtctcacaaagtaagaccttgcctgagggggaaaaaaggaaagcagggtgtccaacaagggaaagatttgtaattccacttactccagaggctctggatcttacttttcagagcagccggatcaacagagtaaattcctgggcaagcgaagcaacactgggaggccttgcttcaaaaggaaaatgcccttcatgtatggctctgtggtagaggactcacttccccacctcagggaaggccccaaggcctgaggccccaagttcaatctgcagttcaaatatgtatgtaaaatcatatggttatataaatgcagtaattatataatcatatagttgtatatgtatatatagtgtgtgttatatattatctacataaaattatataactacaaatatatacgtaatatatacatatatgcacatatacacacatgatctaaagttatagcaaatgagcctgcctaatatactcatggatctgggttcaacacaaagaactaaaggggaacttaacttgtgcactgacttacgaaatgtcttcccttttctgcctttgtccacatcatttacagcattaaaaaggcaacggctaatgtattggacatgaaccactctgggaaagaaatcacactttagtgaacaaaaatccagtgacaatttacctagggaaaccacaaaagtctgaacggagcaggtggttttagcccttaagctgctttgcaaaagaaaacaaaagcaaaatggctgctgttaactagctccactgattttcacaaaacggagggcagtcttcctcagcactttttcctgtcagagaacagtttggttttttttcaaacacagaagggcgggagtagaggatgcaaagatggcggcctgtggtatctggagccctactgccaccacgcggccagagttttgaagaaagcaacacacgtcctagcagcttccttcccatgattcttagcagcatgcaaagatgaggcccgaggggttggaaagccctggcctctgctcttagctagacttccttaggcataagcattattactagggcccgggttatgatctgaagcctaaaacttccgttgtgcagatcctggagctggagaggccttgtggacagggacctgcagcttccagggcacacagactcaggaagtgatgaagtaatacctctcttctaagacttgcaggactttggagataaatccaggtttttgtgggatattttcctctgagtctcgtcctgtggaccaagaattagctttcctgcagtaatactaggctttggagttctcttagtttctttcagagtatggtggacaggacagtaaagggcagcttacaagcatgagttatgtatttgatctgtgaatgaatgtcttggccagccagccaaaggtggagggagtgctcaccgtgacagtgctgtctgagccagagcaccaaagaaagctgaccctttcagtggggctcacagttcagagcaaactgggaggagtggcgatcctgccccttcacttcctgtgccggtgtcttctgacagctcttggtccacagagagaatagaatacatcagggtccagagccatttgcataaaaaaaaaaaagcaagccaagtctgagtgcaagcctctgagatctccccagaagcaggattagctgctagaacatgggaatgacgtcttcatgaccctattcttctttcttcagatgaagactcactatgcagacctgaccagtctagaactcaccaaaatatgccagcttcagcttctcaagggcctagattactacagctattagcaccactgaaacaatcgccttgtctttttcaaaatgaagctacttccgcaagatggcagtaacgttccaggtatgcatacaaatgccctactccttccccgcctttccaagctataaaaaaaaaaaaaaaaaacgaaaacgaaaacgaaaatgctaaccaaaagcaagagcatcaggaaacatggcagctgctttatatttgccctgcttggacaagccacacagtaaacttgttatttctgtctgaagccaaactggggactatggtaatcaccaccattctcagcacgacccttgatttcttagtactatactactgctctttgtttcatatctttggcaacccaaattattgtttgctgctttgtaagcaaatcttcagaagcctggcctaagggaaataaagaaattcagaaaaatcaatgacagaggtaggcatttctaagcaacctcacttgacttattactattgttgataaaattagatattgttaaaacaaggaagactcgaaataaaaaactcgggcagggtgtggtggcacacgcctttaattccagcactcaggaggcagaggcagaaggatttctgagttcgagcccagcctggtctacaaagcgagttccaggacagccagggctatacagagaaaccctgtctcaaaaataaataaataaataaataaataaatctctcaacaagggagaaataaggcaggctcagtcctgaagacagcaaaggctaacagggacttacagccaaggagttaagaagtggggaaaatgagtgtatgggaaatgtcttcccaatggggcagtatcaacaggcttcttatagccacctgactagctctactgtccaaagatgagtctcaattatttaaattaattaattactaattaatggttcagacgcactggggtatacatgattgaataaatgaataaactggggggtggggagagaaggagaaacccacaaaagcttatttcttttaagataaagtctagccaaggagactgctaccattggaggctatagatagtccttctctatttactgggctagagtaaatgaaatggaaggtacctatttgctttggattcctagaagacgtgctcagctatctttctttggagccatgtcagtatctcattttgagcagtaaatttctcaaacatacatacatcacaaacagcagctgctcagactttgtgtcattgactcatctcttaacacaagtcatacatactgaagtgaaaaacggtctttaactggctcgtcatatctgcattaggaaaaaaatcaagatctatttcagatttttggtggtgtttctggttggctctaaaacttagtctccatctgccactactgaaaacaagatataatattgagagagaaaagtatcgcttattctctctcatacgtaatctaaaggggatacaaggagctacaaaggtagatgggggtttactacagaaaaggaatgttccttcactgaagttaatttggaaaaaaatttaagttttttttttctcttgtactttagtgtgaccggagatttttttttttcttatagggatttgcattcttttgcattcattatataaagaagatacctaatagtttccttggaagccttgactcggtgaaggactgtctcaaaacaattaattcaacagggagttggtggtggcgggtaagactttcagttagtttcttttttttttttttaaagatttatttttatttattatatgtaagtacactatagctgtcttcagacactccagaagagggcgtcagatcttgttacagatggttgtgagccaccatgtggttgctgggatttgaactctggaccttcggaagagcagtcgggtgctcttacccactgagccatctcaccagcccttcagttagtttcttaagctgtaatgttgcttcagtaaaaggtgaaccagtcagcgggtgataggcagctagctgactctaggctcaaggcttccgcagccaaagtcccgcctcccagcttccggaaagtggcgggcagctcctgccttcaacactggatgaaatgttttcctgtcagcatcaaacttcagctcagaacgcctagactaacttagaagggaaacggtgggccattttgatgttagggccgggtagtcttctttacggaatggagttggaaaaaccagaagtgctctcgagaattcgctaataactgcgcgctgggatttgaacttacatcctcacgatggcagtagtgctccatctagacagacagttcaggctgcgcgcctttcttctcccgcccatcgcactcgcaaaaaagaaagaaaaaggtaccagcaagcacaactaacaggatcatttaaaaaacaaaacttcttgtctgtttttctaaacctaaaaccagaggcagaaaatcattgtgcccatcaagcattaagaaaaaaaaaaaaaaaaaaaaaaaaagatttgaaaagatttttaaaaaaatattaaaatattctaaattttagattgggtactcctttgatcgcaggaggcagaggaaggcaggtctttgtgagttccaggccagcctggtctacagagtgagtcccagtccaggcagagctctgttgagagtccctaacagtctcagctgatgcaggagaccagccttaacctaagattttctatggaagaaacaagcaaaacaatacaacaaaggcccttgccctccgagctctgctctctcgttcactgagctccacacacccctcgtaggctcccaagtcatcaagttgttagctccaagacaaataaaggatctaagcctaagaaaaattaaaactgaaaaaggaggaggaaagggagggagggagggagggagggagggagggaggaaaagggaagaaaagaaaacagaagaggaaaggaaagaaaagggacaggaaggagggggagaggaagggaggagaggggaggggaggaagggaagatatggtaacttgagctcaggaatacctctctaggtaaagtccttttttggttcatcttctcatcacccaagtaactcaccatattctgaaaaagactttataggctgaattgttggcagccatttggccaagaccttaagatgccaaaagagctctcatcattttaggcaatacatggtaggattcctatatgtgtgtgtgtgttatatgccagtcagattactcaagtgttttcttaggcttttatgaacaaataaagctaccagaaggaagaacagaagctgaccctgtgctaaatccaagagactgaactttgttttatttatttttgttttctttttcttttcttttttttttcttttttcttttttctttctctcttttttttttttttttttttttttttggtttttcgagacagggtttctctgtatagctctggctatcctggaactcactttgtagaccaggctggcctcgaactcagaaatccacctgcctctgcctcccaagtgctgggattaaaagcaaaggcgtgcgccaccatgcccggctattatttttgttttcttgagacaaggtttctcactgtaaccagccctggctgtcctggactcaatttgtagaccaggctggcctttaactcacagaaatctttctgtttctgtctcccaagtgatgggattaaatgcatgagccaccacgctcacagagtcaactttaggctcactagactgaactttaaggttatacaggtattgtaaaccaaggctgaactaccttgtgctattttcaatccctctcaaagccatccactgccatctggtgtctgtgacatctttgtgactatcaacaccttaaaatatattcttagcagaccactagctttcaccaatctaaaggatatctattttgaaacctacatcagaattcttcccttggttataactcacatacctgtgacctctcccaatacatttgggaaatattttgatttatgactttgtttaataataaaatatcaggtaagtacttcaactatggaacataagagtatttgtgttcctgggtcatggtcagaaatgaccatcatctcttatcttctttgaagtgagacctgtgtttctgcatggacactttgccatgtcattaaatagccttcaactgctttctataatctgacatcgttcagtattttggggcaatcttctgtattgtagagaaaagtataaaaactattttcttactaggctctaccacacagtacaagtcaaagattccgaaagcaaccatgcagtagaccaacttctcccacagtctttcagatcactgataaactttcagagtatttcctttaggccctttcaacagtaaagtctactttcatatataacgagaaatttgtattaaaatgacatgtttttacattatggttcgcacagaaatgtccaggctttgagccaggtgtggtgagtcagcttggtcatcctactgctcgggaggctgaagcaagacgaatagcacaagcttgaggccagccaaggccacaagtgttaccaggcaaagctaagctaatttgtgaccttaaaaaggaggaaaaataaagaaaccaaacaacagatagatttcactcctcattcccgagcagtctgacaaaattacatattcatttttcaagttctcatttttagtaagtgaatcactataaatgatgcttattttgtttgatatacttacgtatactgctacatgttatggacatatgtctataagcacatagtcctgccaccttaatggtgatttgattcatactgagtacagctttctctatagccttctgtaccaactgtacactcagaatacttacatattaatttattttccctaaatggaaaacattttatatttattcttaaaagtagatcctcttctagcttacttatacatgcatgtgtgtgtgtgtatgtgtgtgtgtgtgtatgcatgtgcatggttgctggcaatttgtttgcattttgagatctataaagccaaaaaaatggtaggcactttaatcaaaattagaaggtcatgatacattctctcattttccccattttcttagtatagtctgaggtcctacaagcatgaggtcctattctttggaatatgtacttttccccctttagacaaggtctcactatgtagcccagggttgccttgaactcagagatccatctacctgcctctgactcctgagagctggaattaaattcaaagcaaccacacctagccctagaatatgtaatagttttaatgtttcctctttaacttctgtggttttggaagtaacatttcttaaaattgcagactagtcagggacaaaaaatacagaacttaccatcaccacaaattcaagcaggcaagggttttataaagtggttgtcttcagttctcccattttctatcaccaactggaaaaacaaatatattaaatcacaagtggtcaacagatcacatttcttgagtgatttttttcgacacatatttattctgagtttattctcaattcttagagaatctctagactatacaacttctctaatacaagtggactcaattcactccaaactcaatttccctgaaagactactaagaggtctgcatgtttaggttcatcacaggctcctgtacatatatgtaaggcgtctaccactgagatgtacccctagctccggcatattgtaaaagcgatggacaactctttaaaaggactggtgttacttaattaaatcgatttagtctcattattaaacaacctgcattcttttgtgtgagagaaagggtctcagcctagactgtcttcaaacctgctatgtagcttaatgctggccctgaactcctgatatgctgaaattgtggtatgcttgcataatcctaaaaaaaatatataccatacattttcatttttttcttttcttattacactatacatggtttgatgccattagtccatcactcaacaaacaggaataaactattcacaggaaacatgactttttggtatgtgtgtgtatggaggggtgtaaataacatagcattttcttttaaaaacatttttatttactttaattataatatgttttgcttgcatgttccccacatgtgtaccttgtcttcgtgatggttagaagaaggcatcagattccctggaactgaaattacaggaggctgtgagtcacaatgtcagtgctaggaatcgaacccaggtcctctgcaagaacagccagtaagtactattaactgctgagccatcatctctccagccccctcctagtattaccttgtagctgaacaaatacaaagactagcaagcatattggcaaacaacaaacaagcatgcaagcaaacaaacaaaaacagcaactgaaacaaatactcttagatgctgtatagctagcttatctgtgatcaattgcattctgctgttttacattgacaacatatagcacatgtttatatacaggctgatggaatttgttggtattgactctgacttgtataatatataaggaatatatccttgcctcttcagttacttctatcacctgtattctcaggcctcatatcataacccttgttattacacgtagaaattaatgatagcattccacgtgcataaaaattaagagtgaggtcttttaagagggaggcttttgggggctactgggaatatggggatatggaagagggaaagacagtatgtaagaaggtacaaggtaacagaaaagatgtttgttatcaaaatatcataaacagctatatgaaaatgccctaactagcaggtgtgacggctcatgcgtgctgacaaaaggatggccatcagcttgaggacaatatgggctacaccatgagtctcaaacgctggtcccctccccacaaaagaaaagaaatacaattgtgaaacttgcctttttgcagttaatacatgccaataaaaagtgatctttaaattttgcatagaaatatgatttttttttttttagagaaaaagacgtggctatttttcagttatgtttttaaatggtaccgggttttttcttgtttttttttcttttttaaaaaaattcaaatatgtgttttctattttcaacattttaattctaaacataagaataaatcaaagcttcaaggctgaggctgagtagagagctcagtggttaagagcacttgtccttccaggagacctgaattcttttaccaacaaacaccctcacggtggctggcaacaactcttgcctccagttccagaggatccgatgccctcctctggcctctgtgggcaccattcatgtgtggggcacacagacacgtatgccgaccaaatgcccatacacagaaaattagtgagaataataatgctaataacagatttttaacaacttgaaggcaataaacaactggcagttgcacaattagtcctttggacctagtcactattttgctcaccatgtttctgtgaagaacatatttaaacatgtgtataataaataagtagagaaagtcttatattcctgccaggagctttcccagcttgtgtcctctgcggctgattgggcagtaagtcagcaggggacaaaatgtggtttcacgactgtaaaggttgcttagtgttaataatattcactctctttgattcttagttatactagggccagaagccaatggcttcaggtgaatttaatcaccttttgcttaacacctaggggtaggggaggttagctaaaggattaatgctaatactctttttttctggcctggcacgcagaagtccttcactagcttggctagttaagtttttgcgaaccagagaggacggaaaggaagagaattaagaatcctttacacaggaaacgtcgcaccgacacattttcatccatacacccacactctggtcaggcctgagcacctctctcaattaactccacaggaatttgtgcatgcttacatacactcacatatacctacatacatacatataaacaaacagacatacacttttggatggatgcatggatggatgcatggatgaggcagagctccccaagccaccataccacagcacagcacagcacagcacagcacagcacagcacagcacaccacaccacctttatttcttttctctggccttttaatagacaaaagttcttggaaaattacctcataggtaaaagactccacaaatggaagttacaaaaggctgttgatattaagttcaaagcagtgttccattctctatactcattgtaagtccaaagcaagtttctcatggccttgttttatcatagtacacacctgtggcttcatcctgggacctgaatgttttaccttgaacacaaacttgtcaagcctgtatctctttttggagtaatcatgaaagctcactgtatttcttattatgtaacttttacttactattctgaagattaggcacattctattcttgattttaactttattacatcttcctagcaaacaactagaactgtctcttaaaactttcttcctaagattatttgaatcaaattaggtactctataaaattactaattcatctaaatagcatgaattcatgaaagttcatctttatgttgatctgcaagaaatctgcaataggataagctaatgtccaagtattatataatattaataatgataggaaaggcatatcagctgcaagaagcagtcctgagatgaagtctctttgggaccttgcctcatagagctcactcatcttcgtccatgcaaaactgtgggtcacctccaggaaggccaccttctaacctgtcctagatggctcctgacctattctctaaccaaaatagcttcatctgaaagaaacaaaaatctgttttttcattcctaaaacaaaggcagctatctctcccctaaagaggacttggaaatggctttcaatgttctaaaagttgaagacgactattttgcatagaggaaatgcccccctttccctaccccactggtactcttacaaaaggaattcacccttcctctttgtgcctacctttcctgtagagcgtgactgtgtgaccaatttcacgaggcagtctttggacaaagagatgtctatgagaaaggttaactgtcgtaaccattgacattggaagcggcgaatcaatgaacagcattgcttttctggctagagtttgtacagttctgtaaatctgcacacaaactgagttgtagcaatgactttgctttcatgttcttgctcacttaaagcatgggggcattatggcagtacttagggggctgtagcttaacttcagcacaggaaaagtcaggggtccattatgccttcactgaattgtttcgttcctctgaccctttcattctgagataccatttgaactgacacaaatagtttgaagactatctgttagccgtagctgcaatctgtcatttttgaattcctgggacccaggaaggtactactgctttaggtttccactcaccttctggctagatgtaatctcttaatgtatgtgactacaaaattcttgtaccttaagatgtttagggcattgtgctaccttatctgtggcccacaattctaacttgaagaacaatgcactatcttcacacatgtaacccccttagtctagcacaaggggaaactatgccttcagtgtgcacagcttaacctagctcgtgtagcatttctcaccacctgcttacctacagtcagccgaagaaggcatgggttactgtcacatactactcaagaccttggaaacaagctgtttcaaatgtctccattcattccatggcttacctttagagcatcctcaaggagcgcctggcccatcgccaatttaacccgtaacttctttgtcctcatagacagggatgaagacttagcaggagaggtgaagcatacctgggtaaaggagttcaagtagtgagcaagcattacgacaatacagcagactagcgttccttacaacaatacagcagactagcgttccttacggcagtacagcagactagcgttccttcctctcttgtgagtgctcagctaccaacaccaccattacaagggggaaatgttcatgtacagtgactatgaaataatcaatatttcttactatgctgacaccaagagtcctagggttcctggtgtgcttaaaactctcttaagaggatatcctagaaggcctatagggaatctccatttgaaagctgctaagaagcaggcagttgaataacacctgctaactaacatgaatcaagggttaggtctcaagtagcataagtttcacttttattactagactgacttccagttttaataggcaaagtctcacctcatgaaaactgaggtaagagcatgtccttctagagcagtggttctcagccagtatgtcgtgaccccttgggggaggggggtcaaataatcctttcacaggggtcacctaagaccaccagaaagcagatagttacattacagctcataacagtagtaggattacagttatgaagtagcaatgaagatgttactatgttgggggccagcacagcatgagaactatattaaagggtcacagcattaggaaggttgagagctacactagtctagagcaggccttccactagaccgtggggaaaaccttcactgccactgtagctgttatctcttaggcctggaaaaggttacctcttctctttaggctctcctccatcttggcaatggagcatcaattctgagtgtcttttgagactccaaataccctggtgagaaaatggaggattccctgggaatctgatcctgagacctaagtcacctgatatggtgcctaaattggcatttccccggagctaaattccagagtcctctttgttttcttaggcggagatggctcacagaagcaaatgactagggtaagagtagggactcttggctgaatgaagggcaggtttgttcagctcctgcaccttggtcaagaagcagagccagaaaacaaatgcccagcacctccccacaaagctcctcgagtgctttggtttttgcctgatttcactgactctgagctacaggacctgcaataactggcctatcaggcagctgtcctcagtcacaaaaccaccctgtcaattcctctttagtttcttcccttggatcccatctttgtctcaagctccttctttgaagttgaaggtggtctgtttcagggcctagacccacttaaccaaagagccaacctttcttaactgttagacacactctcaccacagggtactggaaaacacctccctctgggtgatagtattattctgggaaacgtgattaatcagccccttctacttcctactctttggttgaaagaaaaaaaaaaacttgtgagaagagattgcagaaagaaaggtgccaccccgtttgttctggtgggggacatcatacaggcatgtagcacccagtttatttagctatgaatggtcttcaagaattccatctgtactctagcaaggcgcaacaaacctgcccttcattcagccaagatttccctactcttaccctaatcgtgtgcttcggagagcagtccctctgaagaaaacaaagactctggaatttagctcccagggaaatgcaaatttaggctccttatcaggtgacttaggtctcaggatcagattcctagggaatcctccattttctcaccgaggtatttggccttctgtgttcagtaggaggcaacgtggctgggactctaaatggaggacccaggaaaggccacatcccaactccgtattattaagtctctcctggagtgactaaaaattccagtcaaatgggacttgaatatgtctcataggttcatttgacagagcacaaccacattttcttcacacatgaatcattaacgagtgcttcctatgtttttattatagtaagtcttacagtgttcttccctaaaatacagtgcttgcaaaggatttagaaagccgccctatcttgatcagaaacaaaagcaatgtcataaagtcttggatcaagcactgataattctttgcaaatttattccaattttcttttgagtacacacatatagtttcgtacttatggccagtaaattgcaacaaatcaataataaagtcagatttacacacacacacacacacaccattttaaattccaaacctgtacttctgatttctgggtagattaaaatatcctgaaatatttcaaaggactggattttagataaataagaaatttccaaagagtttctatattgaccctgttcattaaagaacactagcttctcccttaatatttaaaactctatacagcaatataaagtatctataatattatcatttaaggaatttattatcaagtccttccttacctaaattgccacataataacgaaacaggtccacacaataaagcttaagaaacttaggaactcagccaggtggtgggggtgcacgcctttgatcctagaggcaagggaatctctgagcttgaggccagcctgatctacagagctagttccaggacagctagagggatacacagagaaaccctgtcttaaggggtgtgtgtggccttaggaattctagctgtacactttgcagaatttgctacaaatttccatctcgaaaaatgtctttaaaaactgtaagacgggcaggagagagagagatggctcagtggttaagagcatggactgctcttccagaggtcccgagttcaattcccaacaaccacatggtgactcacaaccatctgtaatggaatccgggccctcttctggtgtgtctgaagacagccacagtatacttacgtaaaacaagcaaataaatctttaaaaaataacctgtacaacatacagaatttaatgaagtttgccattagcatttctcttgaatattgtcagcacagtaaatttcaaacatgtaacttgtgatacttgattgtgcttatcgtttgaggaaaaataaatgtgttgtatgcaccaaatacacccgatttttcatgtgttaagcatatttcttttttaagcatatttcaataaaggaagaaaaaaaagctataagtagtcgctgtacttgctcaagttttgatctctaaggcagtttttaaaaaaggaatagatatttccaaaattcagtcacacagatggatattcaaagaaaaggggccagcaggtgcagtcacaccctttgtactgcagtgatggttgtataaaaatataaatacaacatagctatgaatacacagccttggctgagatgttcacgttgaatagtacagtcaagccggctttaacactgaccaggattcaaagtctaaacctttagcaatgtctacaaggaaaggatcgtataagcacgcactcaagcttgcgtcttctgaaatataacccgatgcacgcagggtacggcagcgcagaaagtgctcggcacagaccatttgctcccctggcaatcactgcagatttctaagtgcttggcatcattattatgtctgcatccagaagccctttctatcccaagaaattgtcaaagttttcccacttctggcaaagtattccaattttgagaaattacaaagtaaaaacaaactaatctgagaagcaagacaaaccaaaccaaaaccgcccttgccacacattctcgtaacttcactttgcatgtgtaatatataggtttttattttaaggggcaaattcccttgtactttgggcatgaaatcattagttttcctcatatgtagctttaacacttttaaaatatagtaaatgtttagaatactgctttaaaaattctgctcgttttccaatcttctagaaacaaccatgtcttctccggtttaccacctaccttacaagagccgtggctggtgactttttgccggcttcatcttcagtcctccagtcctggttttgatctgtttggcgtggttggcatcctagaagccccgacttttcttggctcgactgtcctcggattttgttccccccgcccccattcctctccaagtctctaaaacaacgaggacgcacctgagactttttacaagcacatgaagttctgttcccaggcctgactttgctacataaaaggaccctagagctccggaccctagagctcggagaccccgcgcgtggcctcctctaggccccgagggggaagagaaggaagacggtcccgaagccagggtgtgtctgcaggtggcccccttagtcccgcccactgtc

SEQ ID NO: 53 - DNA, 3578 bp, Mus musculus
acttctgtacacatgtactttgctcagagtccacgctctgctcttgaagtcacactgccaacagcagctaccatgccctaccttggactatgctctcttctgctgcagcctgtctttgcacagcagaaccaagcaagtcctccttagacacaaactcctgctaagtatgcagataaacattcttacctacatgctgctctgtagggcaagaaaaatgtgggtatgatttatagtttttcactttaaacaaactatattttagattcattctgtttctaggaatccggtctatggaaatgcacacaatcatggccttctgttatttgcattagcaaaagaggatgtcagaaagtacctgcaacagttattttggtttttcttttgttttgttttgttttttggttttttgagacagggtttttctgtgtagccctggctgtcctggaactctgtagaccaggctggccttgaactcagaaatcctcctgcctctgcctcccgagtgctagggttaaaggcgtgcgcctgaggaagataggcggttgtacagtaggaggcccatcctcaactgtggtgtgaacacatcacatactggtaaggatgacaggaagcagactgagtgtgaaccttgattccatgtggcacaggttcttcttcatgctcttcagccagcatgaacttcatcccagctgggaagagtggtatgctaacctgccgtggcccctggccctccacgcagggtgcaggccttttctgctcaaggatctttgctgctcccttgctcttcttggagcaaccctagctagagtccctttctctctgctgcctgaaaacagctctatctgaagcgccattctgtcacaagtgtccaggtggctacagtgacctgagtagcacagtctggctcccaatttcacttatccatcaagctgtagctccgaggccaccttctccacaagtttacagagcagacaagtgattctaatacacttcaagcctgcccaaggctttcatgaagactcccacctaacatagtcagccctgacccgcactaccatgctgacccctcaggccatctcccttgggtcatgctttactcagaaagcagagggcaggcaccttcttctcacatgactctcaatgggaatgaagaaacagcagtcattgggggtgtgtggcactcagaggagcctgacagagactctgtcttatgaatgatcttgccagtgagagtgcataacctaggtataagcaaggagtggctcacaccaggtactgccacaggcagccaggctgcacagcagtgtgagcagcttctactcacatgcccctaaaattcccaactaaattcccagtgatggagagtgagtatggattgtaatgcttcttgggtttccctagatgtttctaatagtacaagcagaggacagattaaaaccatgataaacatgagttctaagggtaccaatgcttctttgtgttttttaggtaaggtgtctctaatagagtaagcaggagagaactgcatgaaaaggaaggctgtgataagctacacaagtgtcaggatcttctttgcacagatccaagatctacaagcaagtccttgaatgaggaggactcaccggccctgtgcctagaaggccgcagagccctctgtcctgagggcaggtatatgagacttgggtacttgctctgaaggacttgggcacaggagcccttttgttttcccctggacatcagcacagtcactgaaacagactggaccaactagacaggtgccacttatagaccaacaaccagaaccgtgaccttccaacagcatgttcaaggctagggaactctcttcaggtcagctctgaacagcttcctttttcctagatggtaagattctaggtgctggtgtgagccctggctgaggtgaacacttaacctaagacggaggtgctgagaggagcttcctccggtgagaagggctgtatcccgctgcttgtccaccagcaggtggggccaggatcagtgtggtcactgaagtggaactagctgcccttactctgattagccagccacgttagtggggaacaatatggaagctcaaaggccccactatgtctgtgggcagcagaaagtaggcagaaacatgccatcatcactaaagggaggagctgttttaaacctaccttcagaaaatctctgaatgccaggcagatagctctctcacttgggcccaatggcagccctctgagggaactgagtcatggaataggacctagccagccactcaagccccacatttctaagtggctggacctggcatgtgcatcaccactcagcaggacagcatagggaattgggttgagctgagacacattgttagaggtgtcacagtgcagggtgtgtgttagggtcggaggcttacctgctccctgacatacctgtaacatccaggggtcgcttttttagagcagtggccacagggccatctttcctgcgcaacagggggctgctccgtctctcagctactttctgcttaagccttgagcgtaatttcaggttaggttcagaagctgtatggaaggagatgttgttatagccaggcagacacagctggggtcaagggcatcacactggtggtttaaaatatgcacagctggtaaatctccacttaagtatggactggaaggcagggctcctctgtcagtgggtacaagctcctgttagccccattagtggatgcagtgggtggctgccagggcaataggtgtgcttccattctaccctgaggacattaccatagtgtcactgatttactggacatagcaagaacctactgaagcatgacagtcactcaatgaggatgcctcttaaataatggtctcctaaacaattcatctgtaattttagagtagtgatgccttgaaacctgaggagagctttcaaggctgtctgtcacctgtgacatcatcacagcttctaaattactggcctccttgttcacctgaagatacctgcatctcacaatcctgaagcagacaacagtttcagaccccagcagcttctgtgaagggcaattgatgctccaaaaaccggggtgaaggattggataggctgcttctctgcactgaggcttctctgcactgaggcacagctcagaccctgaccttctttgctgacactaaaggcacagctgaggttgggacttggtttggcttctgtaagcagctctcctgtgcagacagattcatgtaagaatctgcaactgtgaggccatgacagacttccatcctcttcaggaaactgcagacccacttcatccctactcctggggtggcacaagccatgagcttcacagtctagcatgggttgggaaagggcagggacaacctctgcagccatcagctctcagagataggacaacctgggagagataagatagccaacatgtgccgggtggtggtggcgcacgcctttaatcccagcacttgggaggcagaggcaggtggatttctgagttcaaggccagcctggtctacaaagtgagttccaggacagccaagactatacagagaaaccctgactcg

SEQ ID NO: 54 - DNA, 16364 bp, Mus musculus
gcaatattgcatgacgtttattcaaatagtatcagcatgctgagactgagctcgtaacccacaaggggcagaggagatagacctccagcagttgcagtggaggtttttaaagaatgaaccataaagtgagggaaggataggataagcatcataaatatggggatggtgaattacagctcatctctccccgaaagtgaggggaaggatagatcacaaagactgggggagttgtgtaaatgttcttggtcccttacacaatgggtcagatgcctaggtgggtcacccatctcacctttctttagggctgatggcaaaagaacaaagaactccatcctgggctttgtttctaggggcctaagaaacacattgcattggggtcttacagcagcaggcaacatcgactgtttttcacccaccaagggtctgagaagcacagtccaccacagctgtctgtgtgaatgacagggcatttcagtggaacaggaggaactgagagtcagactccattttttaaaaggcttttaaatctaagccagggcattgtctgatttcaagccctgggtgttctaaactcatgagagaaacacagcatcccatctgtgaaagttctcccaggtcagggctaggcataaatcacagtgagcatgaagcctgcccacgggaatcaaggctgacattccaaaagagaggacaccaggagtggtatttgtgtgtttaaatctgacaaaggctcctcaggggttgatttccaggctgatctgagggcaggtaggcaggcaaggctttgtcatgtaaatcgttgctaggttacctgtgtagaaagaggaaggagcttttgttagggaattaaacaaatccttatctctacttctaggtgaaagaaaattaatattcaagatccatgactcaagcagcttgctagttaggaaggctttttgggtctagagcaaaaaacaaaggctgtaaagtcatcctaggaactggctagccataaagatagagaagatatacaagaatgtggggattggccaggcgcctccctatctcccaccctgtctaccttggttaaaagttaaccagatgttctgctgacttagataagcacctggccctcagaattcctgactcaccgacctgcacgtaatctttttctggtgtgtaatcattctgctggtgtttaaatgaaccaatcgtgtgaaacggtgccaattcctcccccagcgccagacccttttctataaaaccccttagctttcgagcctcgtggtcaacaacctccatctcgtgtatgagatacaggttggctcagagctcagtcattaaactactttgtgtgtttgcatcaagacggtctctcatgttccttgggtgcactctgattcgggaattgagtggggggtttccccactaggttctttcaatctgacaagaaaaaactaaagaaaaattctaaacaaatgcttctaatactagtaagtagtacatacataagcctgaaatttcattaaaaaaaaaagactgcccagatgattcaactcaatgatacaaaattatcacaacccaaaagttactatgtttacctacatgaagggaggagagttacttgaacagaagaacaaagtctgaagacacaggataccagaaatttccccttaacaaacaacaaaaagatatggaaaatattcagaatccctcatctatatgagataacagattactcaatttaagatactcttcccggtatattgcaacttacaccaaatagcaagtttctaatttcccaacacctgtgataatggactccaggcaatttgaacaaagggatagatttgaccgagaaatatcaaaatattttctaaagaatacattgttatcaattcagatacacacacacacacatttatatgtgtgtcaattttcttaaacaagaatacagacctttgagatctgccagttcttatacctcctgagacaaagaagcaatcaatatcaacatgccttacagagctatgatgtctggattcactcaatactgacatattgcctaaaaggaaaaaaaaagaatattcaaacccagataaatttttctcattaaaaacagatttaattaactttagaaatcacatttaaggagaatggtatcttagcatactatagaatattttatggactgtatgctaccttaatagatgaatttcagtttctttagttatccgatagaattttaaatcacttgaacaataccatggaattatttcctattctaatttctagctgcattcttttaaaactataattttataagataaatctgattttaacaatttcaagatgtatactttcacatacttaggtttgataaactccattctgcacaactctacaaactttataaatgaaataattacaatagctactactacccaatgttcctgataaataataaaacacaaacggtttacaaagggttagattaattctcacagtactgtggggaaaaattactatcagccccaccttttacagatgagtaatttaagtcccacagctggtgaatgcccaaattggaatttaactcaggtcagtttgaattccaagctctttttgttttttgtttttgttttgttttgtttttgtttttgttttttgagacagggtttctctgtatagccctggctgtctgggaactcactttgtagaccaggctggcctcgaactctgaaatccacctgactctgcatcctgagtactgggattaaaggtgtgcaacaccacgcccagctgatttccaagctcttaaactgtcatactactgtaataattagacatatttcaaaaagtagtccacaaaaaaaccaaaaatctatatacaaagggaatttttctttcacatttagctgttactaacatgttctgcagcatgtttattacatttatggagatgaaataaatattatttcataaggataattaatgacttagaataaccagagagtgtttataaggattattaggctaatattattttatgataatattattactaacactcctcctgatgttccaaaatataaaaatacggatcctaaatctaagaatctaaaatataaggacgttttaagcttgtaaaaagttctgatttcagagaatattcttgggtgtaacaaaacaaaaacaaaaaccttactcaggaacaattgagccacttcatgaattaactgtgagacaattgtctagtctcactaggtgcaaggctctgaacctttttccgtgttgtccttaagtagacataagctgaaagtcactgattcttgccattcctcttgcagaaaggaaagaggtaagaacagcgatgcccatgcatgttcctgttgcagaaagtggcagagcaaggatttagattgaggctgcatgatctagatcaaacccttgccattttctctgacaatttcaataatcacaatctctctttcttttgctgtgcaaggtatcaaactcagggcattggacatgtaaggcaaacaacaatcacaattctactgttcagagttctatgaaacagaaggtaaacaacttaaaatagtattaaatatttaaggggtactgactgtctaagtaaaatacctaccaaatgctttcttacaacataaaaatttatgaatttattcccattcatgaacctaattcataatagtatttttctttcttaaatttatttttattcttttcatacatggttacttagtgtaaacagccctggctgtcttgaagacactttgtaggcctcaatcctgtaagagcctgcctctgcttttcaaacgctggcatgaactttgtacaccattatgactgaaataaagaaatgaattaatgactttttagagtttaatgaaaatgggtacacccaaatttatgggacacaataaacgcagtcctaaaaggaaaactcacagctctgagtgcctccaaaaagaaaggggagagagcatacactaagcagcttgacagcacacctgaaagctctagaacaaaaggaagcaaattcactcaaaaagagtagagagcaggaaataatcaaactcagggctgaaatcaatcaagtagaaactaaaagaactgaacaaagaatcaatcaaaccaagagctggttctttgatcttctttacttgtcttatttttctggctagaattttaagtgatattttcaaaagatagctagggatagagtgggaaggttagtcttgttccttatacctaaatggagaggaaatgtttgaaattctccatttagtttgatttttatctattggcttactgtatgttactgtgattatgtttatgtatgtaccctgtatccatgaattctctagtacctttaaaatgaagaggcgatggatttaatcccaggccttttcagcaactaatgagaaaaatcatgtgagttttttctttaagtttgtttatatggtagattacattggtggatttcaatatattaaatttctaagcatctctttgaggaagccgaattgatcttgagcgatgacatctttgatgtgttcctggattcggtttgcaggtgttttattgagtattttgaatcaatgttaataagggaaatcaatctaaagttttctttctgttgagtctttctgtggtttaggtatcagagtggctgtggcctcatagcatgagtttggcagtgctccttttgtttctattttatggaatagtttgaagagtattggctttagctcttctttgaaagtctggtagaattctccattaaaacaatctctctattgggatttattggttaggagacattcaatacatgcttctatttctttaggggctatagagatgtttaaatagtttacctgtccctgatttaactttccaattggtatttggatagaaaatcacccatttcattaggattttacaattttgtggagtataggcttttggagtaagacctaatgattctttgaacttcctcaatgtgacttgttttgtctttctcatcattactgactttgtttatttagattctgtttctctgtcctttgcttattttggctagggtttgtctatcttgttggttttctcaaagaatcagctcttagctttcttgatttgttatattgttttctttgttatgagctgatttatttcagccttgattttcattattttcttcctcctactccttgttgatattcttgcaccttttttttctagagatttcaggtgtacttttcaattgctggtttcagcatttaaaatttctttatgggggcatttagtgctatgaacattcctctttgcactgttttcattgtgtctcataaaactggatatattgtaccttcattttcattggattccataaagtgtttttccttccttccttccttccttccttccttccttccttccttccttccttccttccttccttcatccctccctccctccctccttccctccctccctccctttctccctctctctctctctctctctctctctctctctctctctctctctctctctgccccccttccatgccccagagatcactgaatggagacttgttcaatttccatgagtgtgtaggctttacagtgttcctgttgttgacgtccaacttaaatccatggtggtctgattagatacaaggcattatttcaattttcttgtaccttcaagatttgctttgtgactgattatatgatcagtttggagaaggatccctcaggtgctgaaaagaaagtatatcctcttgggttttggtgaattttctgtacatgtctattaggtatttttgattcacagagccttttagtttcattatttctgtgattatggttttgtctggatgtgctgtcttttgatgctagtcaggtcttgaaataccctacaattaatgtgtgggatttgatgtgctatttacattctagcagtctttcttttatagttgttgagtgcccttatcttcggggtacagatgctcataattcagatatcatcttggtagatttttcctttgatgagtatgaagtgtccttccctgtctcttttgattaattttgcttgaaagtgtttatttttgttttttgtttgtttggtataagaatgactacccccagctttcttattgcattcatttgctcagataactttttttctagcactttactctgaggaaatgtctattgtcttcccgaggaatgtttcttgtatacaaaaggataatgcatcctctttttccatccattctcttagcctatgtctttttaattgggaattgagtccactgttgttgagagatattaatgaccagtgattgtaattttccattattttgtcattggtggtttagtgtgtgtgtgtgtgtttatgtatttgtcagtgctttctttgcttttgctggtatgggattgcttatgtcctgtgttttcttggatgtagttatgtttctttgtttggagctttccttctcctattttctgtagagtagaatttatgaacagatattgtttgattttggatttttattgaaatgtcttctttctgccatgtaagttgattgtgagtttttctgggcatagtagtgtatgtaggcacctatgttttttagaggttgcaggctatctgctcaggcccttctaactttgacagtctatgctgacaagtcagatgtaattctgatatatctgtctatgtatgttacttggcattttacccatgctacttttaatattctttttttgatttttaggttttgtattttgataattatgtattaggatgggtttcttttctgttccagtctaattggtattctagaggcttctcacacatttctaggaatcacttttcttctatgattattttgggaatatgttctggtccttggagcttggagtcttgtcttagttagggttcaattgctgtgatcaaacaccatgaccaaggcaattcttagtttcagaggttcagttcagtattttcaaggcaggaacatgacagcatccaggcaggcatggtgcagaaggagctgagagatttacatcttcctctgaaggctgctagcagaatactggcttctagacagtcagaataagggtcataaagcccacacccacagggacacacctactccaactgggagacaccttctaatactgccacaccctgggcccagcctatacaaactatcacagaatcttaacattcttttatttctgttgctctttgatggcctttggtggaatcccagatttcctggatgttttatgctaggagttttttatatttaacatttttgactgatgtattaattacttgtattgtatatttatgcctggctgtctctcttccatctccattattctgtacatgcttgttgcatctgttgatcttgttgtcttcccttagttttctgcctccagaatttcttcagtttgtgtcttctttattgcttctattttgacttccaggtcttgcccagttttatttgtttcctttacctgtttaattctattttcctgtatgtctttaagtaattatttgtttcttctttaaagacctttattgtttgattgtatttccagtgtttctttaaggaatttataatttcctattataaggcctctatgattattgtaagatagtagttaaggtaattttcttgtatttcagttttgctaggttatctgagcttgctgtagtggggtagatttgctttggaagtgtcatattgccaaggcttttgttgattttgtttttttgagggcctttagcaaactggatggttttaatccctagatgttcttgttgtagcagatattgggaagagggtgaacttcaattttcctggtgtggcaggattctgatggatatcattaggctgtatgtttcgggtcctgtatggttcaggagtctgactaggtttgaggagaggtgatgggagagtggaggtccacatggcatagcagtctgctcagggcagctttggttggcccagagggcccaggagctgtatttgttactttctctactacatattgtatgttatctacagcatttaaacgttgtaaaataatcaatcttccccaaaaatatatacttacaagtgacagcaactttagcaaactgctagaaaaaaaatgaatacaaataattgatagccatgatacactgaaaggacaaggaatataccagtataaaataatctgaatgtacagcttaaatctcaattacatcaacaaaaattatgaaaaaaatgagcataacaattggacaatatctgaaagtttctcaaatttaacatggaatgaaaaatttagataatcatcatctcaaaataaaaagtgacattaaggccagacgtggtggctcacacctttaatcccagcactcgggaggcagaggcaggcagtactcaaaagtagacataggatcatcaggtatggatattattaaatatgcattaatgatatttttaaagtataaaaggacaggaatatgaaagttgaacaaaattttgatgtattatttggttctcaaaatattcagtattattaagatgtttgatacataaaatgcatttaaataataaaaaattttaaggagaatctgttatatattttatatggtttaagtcatgcttttttatgtatctgtggaaatacaaattcaaggttattttatagcagtctttctcaataggactgtaatctagttcaaggatggcattcagagataaaacaatctttattaactttcatgaataaaatatttatcatatcatagtgccctatgtctatgaattcttaaattgtattcacctctaaagattgctaacatatgaggtttatttcaagacatttagacagaaatttagcatttctcatattacaaactttactgcaattggaattttgtttcaaacatcgttcttaatcatcattatgccttgttttagaatatcattgagaagatacgagttttctctggtaatgttttttgctactgatgagatcaacaagaatccttatcatttacccaacacgtctttgctattctccttcatggatggcctgtgtgaggataaattgggattctgggtaagatatatttagaagaaaaaatcatttggtttttaattatatctgtgaattagaggatgattgaaacatatatcttacaggaccatcatggaaaacagctgtaaaactgtcaatttattctaggacaccatatttaagaatgtgtgacactggatgagttaacaacattcaatttccatttacattttcctacaagaaaacttgaacagcgtgcatttatgagtgatgagtatattgctacacactcagaaacacacatacatacactctcacgtgcacacacacatgttttaaaatagatatatattatttatataatataaaataaagaattaagtaaatagatcatagatgtacaaggcaaactatttttgagaacagtgggatgtatcagagatagtcaacaatctaataggaatgatatttataacattatgaactaaccagtaccccggagctcttgactctagctgcatatgtatcaaaagatggcctagtcggccatcactggaaagagaggcccattggacttgcaaactgtatatgccacagtacaggggaatgccagggccaaaaagtgggaatgggtgggtaggggagtggggggggagggtatgggagacttttgggatagcattggaaatgtaattgaggaaaatacataataaaaaatattttaaaaaatggaatatttatagtataatcttactatctttgataggagttctgaaagatgagtaatgttacttgtatataagtccaaacatcctgacaatcatattcctcagtagatgttttatcatctcttctatatcctttaggttttctttggaacatttaatcctaacctaagtgaccatgacctgtccccctatgtccatcaggtagccaccaaggacacacgtttgtcccatggcatggtctccttgatgcttcattttagatggacttggataggactggtcatcttagatgatggccagggtattcagtttctctcagactcaacagaagaaatgcaaagacatgggatctgtttagcttttgtgaatgtgatcccagaaaacatgcacatacacgtgacaagggctaagacatatgataagcaaattatgacatcatcagcaaaagttgttatcatttatggtgaaatgaactcaactctagaagtcagctttagaagatgggaatatttatttgcacacagaatttggatcacaacctcacaatgggatgtcatcacaattaaaagagatttcaaccttgatttcttcatgggactgtcacttttgcacaccacaaaggtgagattgctaaatttaggaatttttttgcaaacaatgaaaaccaacaaataccagtaaacatttctgagtctatactggagtggaattattttaattgttcagtctctaagaacagcaataaaatggatcattttacattcaacagcacatcggaatggacagcattgcacaaatgtgacatggccctaagtgaagaaggttacagtctgtataaagctgtgtatgttgtggtccacacctaccatgaactcatgcttcaacaagtagagtctcagaaaatagcagaacccaaaggattattcactgactgtcagcaggtaaagtttcttacttttcattatgcttatatatataacagtgtgatctttttaaatggacccagagaaacaagtgtacatttgttaaaggttattctgtcagtggaaagatttctacactgaaaaactctctaattaaccatttacatgaatgaatatcgtgcacaaaataacatttaataggagacaaaacattttttatgatagcagtgagttttgtgaaaacgtgtctcaagatttccataaataagttcaaaatttaaaataggaaccaagagttttatcataaaagccttaaaggatgactagactagaatatttttaatgcataatttctcagccaaatagtggtggcacattcctttaatcacagcacttgggaggcagaggcaggaggatctctgagattgaggccagcctcgtctacaaagcgagtttcaggacagcgagggctacacagagaaaccctgtctcaaaaaaacaaaaaacaaacaaacaacaacaaaaaacaaaacaaaaaagaaaagtttctcagggttcagtacatgtgcagtacaaatagttactcgttgaacttaacaattacttacaaaaccataaatgattaagactgtacattttattaagtttatgtttatctcatatacgtttactgtctattcatgaaagacccacaaccattctttctttatcttcacacacattcagaattctccttcatttgcacatacatggcttcattttttaaaaagtatttttgacaaacatgtgcacacactcacacaccatgttacttgttatctggtaatcatcttttctagcacattttaccatcaaacattaatatgaagtatataagttttcaattatcaaaaaggtatattgtattttattatacagggttacttcatagagctgtcttttctgaaagactaagaaaattagaggaaattctcaattttgtcttccccttattaatatgcatatgtaatcatgaatttattttagatggtttccttgctgaaagcccaggtatttactaaccctgatggagaactggtgaacatgaatcatagggaatatcagtgtgtagagtatgacatttgtatcatttggaattttcgacaaggccttggattaaaagtgaaaataggaagccattttccttgtttcccacagacccaacaacttcttatatctgaagacctggagtgggccacaggaggaacatcagtgggtattctacaattttatatttttcatgatacctaaattttaaaatatgaggcagtgaagtaatagctgtgtggttgagaccaattgctagtcttacaaaagactatcctcaattacaagcacaaacatttcataactcacaactttatgtaaaaatggtcatagggaaaaaggtctcttgattccatgttcaattgtacccacatgcctattcatcccacactataggaatatgtttattacatatattatatatatataaattttgtatacacacacaccatggaattttctgattctgggtgacatatttatagcctaattaagtataggatgtattcattaacagaaatctccagatttaaggtttcctgtctttatttgtgtattttttattggttactttatttatttacatttcaaatgttatcttgcttccatgtttcccctcttctttagaggattgccttatctgacatcagagggaggggaggaccatgatcctgtggagactcaatgtcccagaataggggaatgctagggtggtgaggcaggagtgggtgagtagataggggagttccctcataaaaaccaggggaaacggaggaaggtatagggggttcaaggtcttcttttaaacttaggaaagcttccttaattttatgagagtcttatatagcatattttgttcatattcatcaaacaaatctttctggatctatcctaccttatttctctacaaacctcagtattgttattttttatttgtaaatcattagagaactgatgccacataaacattcctttggattaatcagtttaggaaggaaaaattttaaattgcttcaacctaaatattacatatctaatattacatggtgtattaaatattgtgacattcagtgcactgcagggtaatacaaataataatgtgcctgaaattgttaagtaatactgattattagaggaatatttatagccatatctgttaatgtcccatatatcaatctaagggtcattatgcatatgatgtatacatgaactacattcacacacgcaaacatatacaatttatgcatttcctcaggttcccttctccatgtgtagtgtggcatgtactgctggattcaggaaaattcatcaggaagaaacagcagactgctgctttgattgtgttcagtgcccagaaaatgaggtttccaatgaaacaggtacatgcttgcatgcagaagaaaaattgctaaatttgaatgtgttctctttccaaacaagaaatatatggtctagatgaaaattgaagacctaaaatcttgatgtttcagtacttaatcagttaaataatatcaactgcttttggacccagcaaatagcctgcaatatcttcttcaaacaatgtatttctctcacaatatgatggttactgattttatgttacatagaaaatgtttagggggatatatacatgtaacaaatttttaaacaaaaattttaggcataatctatgcatacatttatttttctttgatcctttatacaaaacaacttgactacatgatcagtccataatctttttctccagtacccagcttagtacctgacaaagaccagatgttcagggtagcagttgttgtttaatgaaatatattttaagagcttagatggtttaaaggattaagaatttcctgtgaaagacttagaacaagagtgaagatttccagaatgtaacaagagatgggacagtgcttatcatcaatcacagccaacctaaggaaagagggatgaatgtgaatttcaatagccttcgtgacctacagcttggaatgtatagctgggaagaaagagattgtgccacaatgagagggacatgcatatgtctatgaggcatacagtttcaagaatgaaaatattcctttatgcaaactgtatttgcatgagaaattaaatgttctagctcctacatgtaaataaaaacataggcacaatccacaaagcaacaaagtacacaatgcgttgcaacaactggcaccaacaatgatgtctgcaaactacccttttctgtgaatagtgaatttatggtttgaggagataataatctgagagtatgcatattaattttcatattttcttttttgtttaataaatattttttgtccattctctatgatgttttttttcttccactataaatcatagttcaattgacagcaatcttaggttcatggttcctacagcaataaggaatggaatagatgctcaacatcaaattatttattgatatatcctctgaataatacaaattcacaattattaactgcataactatgatatcttatacaggtttattgttgttcaccagcagatatggaacagtgtatgatgtgtccacatgataaatataccaacttagagaaaacccgctgcctccaaagagctgtgtcatttcttatgaacatccattggggatggctttaggttgcatttccctgaccagatctctaggcttacatatatcatgtccttaaaagtagacattaaaatttaaatatatattctcacgttaactattcaaagaaagatttagacaaatattatcatttcaaatttattttacctttggagatttattgattaaatatatttgttttttttatattaatttttaagtttagtttattatgaataaaattaactttggccaatttaaccagtttactttacttaaaagttctttggtattaattacatgatgtgaatgacacaccatgtgtatattctaaaccatgtgtatatgtgtatatttataaaaagcaaatattaataaaccataaagttgcatttactgcttgtctgagattcctttttcataattttgattgtcatgtgaaaacttcacatacagatctttagtaagcatactttttgtttggctagaaagtaaatcagatgtgtctagagcaaaagaatactgaagggcattttatttcgtaggaaaattagctgtgtaaataactgacagtgaggcccagaagagggtagcataaatgttgtatgttggcatcagtctgaatggcttttaaaacttattctttgattatctgttcggttttgtgaatatcaaagtctttgcttcctatgttaggatgctagttttggaattacatggatggaaaaacttttaggttcatttgagaagccattaagtatgcaaggtagaatctataagaataagaacaaaacaaaacattaagatatagtaggcctattatttcttttttgtataatcgggatactactgattcagttgtcccatcaagaatcatgttgtccaccattttgtcttgaaccacatggttatattaactaaacacatggcctatgctatatttatgatatcattatcaaagaagagcaccaagttccatgattgctttcatcttaggaggatccccaagtgaaacttagaacaaccaatgcagtagtggttttctgttctatgtgaattgggccccaggtaaagtaaagacatttcccatcaggaagttccagaatcttggataacctactttccactttcctgggggcaggaaaatagatgatgatattatgaaaaagaggactagggaggcagatgagagaaaagatagaagctgatttcacatagcacagcaaatcctttgccctaactttgagcctagacctaaccatgatatttcttctttgtgtaacagggatactattgactcagtagaacaatcaagaataatggtggccaccttagccctaaaccctgagcctaaccctgggacttaccctcagtctcttaccctatcttaaacctcaacccttaatttcctaaccaccctaaccctaatcctaacaacccttatcctaatccttaccataaccctctaatcgcctaatcctgattctaaccctgcttgctgtggggttatttcttaattataccttttgaggtgagaaaccctttcttattcttgatcttttgagatgttcagatccatctttaatctaggctatagtttctcttggcaatctacatatatttaaaaaagcctcctgttttctaaaattcctttttaatgttaatagcctggccacccttccattcctgggtcagattgatacctacaatgcagctagagtaatgggatattgaagctactcaccttgatttcaggaaaaagaaggcaagtggtatgaagaatgttcaggcaaggtctgaagtcaggatcatggctcacagaggggaggagctggcagcagaatagcctgagctggaatggtggattcttccccccgggcaagcacaaatgctaatgagctgaaaagggctctggagatct

SEQ ID NO: 55 - DNA, 16377 bp, Mus musculus
agatctccagagcccttttcagctcattagcatttgtgcttgccctgggggaagaatccaccattccagctcaggctattctgctgccagctcctcccctctgtgagccatgatcctgacttcagaccttgcctgaacattcttcataccacttgccttctttttcctgaaatcaaggtgagtagcttcaatatcccattactctagctgcattgtaggtatcaatctgacccaggaatggaagggtggccaggctattaacattaaaaaggaattttagaaaacaggaggcttttttaaatatatgtagattgccaagagaaactatagcctagattaaagatggatctgaacatctcaaaagatcaagaataagaaagggtttctcacctcaaaaggtataattaagaaataaccccacagcaagcagggttagaatcaggattaggcgattagagggttatggtaaggattaggataagggttgttaggattagggttagggtggttaggaaattaagggttgaggtttaagatagggtaagagactgagggtaagtcccagggttaggctcagggttagggctaaggtggccaccattattcttgattgttctactgagtcaatagtatccctgttacacaaagaagaaatatcatggttaggtctaggctcaaagttagggcaaaggatttgctgtgctatgtgaaatcagcttctatcttttctctcatctgcctccctagtcctctttttcataatatcatcatctattttcctgcccccaggaaagtggaaagtaggttatccaagattctggaacttcctgatgggaaatgtctttactttacctggggcccaattcacatagaacagaaaaccactactgcattggttgttctaagtttcacttggggatcctcctaagataaaagcaatcatggaacttggtgctcttctttgataatgatatcataaatatagcataggccatgtgtttagttaatataaccatgtggttcaagacaaaatggtggacaacatgattcttgatgggacaactgaatcagtagtatcccgattatacaaaaaagaaataataggcctactatatcttaatgttttgttttgttcttattcttatagattctaccttgcatacttaatggcttctcaaatgaacctaaaagtttttccatccatgtaattccaaaactagcatcctaacataggaagcaaagactttgatattcacaaaactgaacagataatcaaagaataagttttaaaagccattcagactgatgccaacatacaacatttatgctaccctcttctgggcctcactgttagttatttacacagctaattttcctacgaaataaaatgcccttcagtattcttttgctctagacacgtctgatttactttctacccaaacaaaaagtatgcttactaaagatctgtatgtgaagttttcacatgacaatcaaaattatgaaaaaggaatctcagacaagcagtaaatgcaactttatggtttattaatatttgctttttataaatatacacatatacacatggtttagaatatacacatggtgtgtcattcacatcatgtaattaataccaaagaaattttaagtaaagtaaactggttaaattggccaaagttaattttattcataataaactaaacttaaaaattaatataaaaaaaacaaatatatttaatcaataaatctccaaaggtaaaataaatttgaaatgataatattggtctaaatctttctttgaatagttaacgtgagaatatatatttaaattttaatgtctacttttaaggacatgatatatgtaagcctagagatctggtcagggaaatgcaacctaaagccatccccaatggatgttcataagaaatgacacagctctttggaggcagtgggttttctctaagttggtatatttatcatgtggacacatcatacactgttccatatctgctggtgaacaacaataaacctgtataagatatcatagttatgcagttaataattgtgaatttgtattattcagaggatatatcaataaataatttgatgttgagcatctattccattccttattgctgtaggaaccatgaacctaagattgctgtcaattgaactatgatttatagtggaagaaaaaaaaacatcatagagaatggacaaaaaatatttattaaacaaaaaagaaaatatgaaaattaatatgcatactctcagattattatctcctcaaaccataaattcactattcacagaaaagggtagtttgcagacatcattgttggtgccagttgttgcaacgcattgtgtactttgttgctttgtggattgtgcctatgtttttatttacatgtaggagctagaacatttaatttctcatgcaaatacagtttgcataaaggaatattttcattcttgaaactgtatgcctcatagacatatgaatgtccctctcattgtggcacaatctctttcttcccagctatacattccaagctgtaggtcacgaaggctattgaaattcacattcatccctctttccttaggttggctgtgattgatgataagcactgtcccatctcttgttacattctggaaatcttcactcttgttctaagtctttcacaggaaattcttaatcctttaaaccatctaagctcttaaaatatatttcattaaacaacaactgctaccctgaacatctggtctttgtcaggtactaagctgggtactggagaaaaagattatggactgatcatgtagtgaagttgttttgtataaaggatcaaagaaaaataaatgtatgcatagattatgcctaaaatttttgtttaaaaatttgttacatgtatatatccccctaaacattttctatgtaacataaaatcagtaaccatcatattgtgagagaaatacattgtttgaagaagatattgcaggctatttgctgggtccaaaagcagttgatattatttaactgattaagtactgaaacatcaagattttaggtcttcaattttcatctagaccatatatttcttgtttggaaagagaacacattcaaatttagcaatttttcttctgcatgcaagcatgtacctgtttcattggaaacctcattttctgggcactgaacacaatcaaagcagcagtctgctgtttcttcctgatgaattttcctgaatccagcagtacatgccacactacacatggagaagggaacctgaggaaatgcataaattgtatatgtttgcgtgtgtgaatgtagttcatgtatacatcatatgcataatgacccttagattgatatatgggacattaacagatatggctataaatattcctctaataatcagtattacttaacaatttcaggcacattattatttgtattaccctgcagtgcactgaatgtcacaatatttaatacaccatgtaataatagatatgtaatatttaggttgaagcaatttaaaatttttccttcctaaactgattaatccaaaggaatgtttatgtggcatcagttctctaatgatttacaaataaaaaataacaatactgaggtttgtagagaaataaggtaggatagatccagaaagatttgtttgatgaatatgaacaaaatatgctatataagactctcataaaattaaggaagctttcctaagtttaaaagaagaccttgaaccccctataccttcctccgtttcccctggtttttatgagggaactcccctatctactcacccactcatgcctcaccaccctagcattcccctattctgggacattgagtctccacaggatcatggtcctcccctccctctgatgtcagataaggcaatcctctaaagaagaggggaaacatggaagcaagataacatttgaaatgtaaataaataaagtaaccaataaaaaatacacaaataaaaacaggaaaccttaaatctggagatttctgttaatgaatacatcctatacttaattaggctataaatatgtcacccagaatcagaaaattccatggtgtgtgtgtatacaaaatttatatatatataatatatgtaataaacatattcctatagtgtgggatgaataggcatgtgggtacaattgaacatggaatcaagagacctttttccctatgaccatttttacataaagttgtgagttatgaaatgtttgtgcttgtaattgaggatagtcttttgtaagactagcaattggtctcaaccacacagctattacttcactgcctcatattttaaaatttaggtatcatgaaaaatataaaattgtagaatacccactgatgttcctcctgtggcccactccaggtcttcagatataagaagttgttgggtctgtgggaaacaaggaaaatagcttcctattttcacttttaatccaaggccttgtcgaaaattccaaatgatacaaatgtcatactctacacactgatattccctatgattcatgttcaccagttctccatcagggttagtaaatacctgggctttcagcaaggaaaccatctaaaataaattcatgattacatatgcatattaataaggggaagacaaaattgagaatttcctctaattttcttagtctttcagaaaagacagctctatgaagtaaccctgtataataaaatacaatatacctttttgataattgaaaatgtatatacttcatattaatgtttgatggtaaaatgtgctagaaaagatgattaccagataacaagtaacatggtgtgtgagtgtgtgcacatgtttgtcaaaaatactttttaaaaaatgaagccatgtatgtgcaaatgaaggagaattctgaatgtgtgtgaagataaagaaagaatggttgtgggtctttcatgaatagacagtaaacgtatatgagataaacataaacttaataaaatgtacagtcttaatcatttatggttttgtaagtaattgttaagttcaacgagtaactatttgtactgcacatgtactgaaccctgagaaacttttcttttttgttttgttttttgttgttgtttgtttgttttttgtttttttgagacagggtttctctgtgtagccctcgctgtcctggaactcgctttgtagaccaggctggcctcaatctcagagatcctcctgcctctgcctcccaagtgctgtgattaaaggaatgtgccaccactatttggctgagaaattatgcattaaaaatattctagtctagtcatcctttaaggcttttatgataaaactcttggttcctattttaaattttgaacttatttatggaaatcttgagacacgttttcacaaaactcactgctatcataaaaaatgttttgtctcctattaaatgttattttgtgcacgatattcattcatgtaaatggttaattagagagtttttcagtgtagaaatctttccactgacagaataacctttcacaaatgtacacttgtttctctgggtccatttaaaagatcacactgttatatatataagcataatgaaaagtaagaaactttacctgctgacagtcagtgaataatcttttgggttctgctattttctgagactctacttgttgaagcatgagttcatggtaggtgtggaccacaacatacacagctttatacagactgtaacaatcttcacttagggccatgtcacatttgtgcaatgctgtccattccgatgtgctgttgaatgtaaaatgatccattttattgctgttcttacagactgaacaattaaaataattccactccagtatagactcagaaatgtttactggtatttgttggttttcattgtttgcaaaaaaattcctaaatttagcaatctcacctttgtggtgtgcaaaagtgacagtcccatgaagaaatcaaggttgaaatctcttttaattgtgatgacatcccattgtgaggttgtgatccaaattctgtgtgcaaataaatattcccatcttctaaagctgacttctagagttgagttcatttcaccataaatgataacaacttttgctgatgatgtcataatttgcttatcatatgtcttagcccttgtcacgtgtatgtgcatgttttctgggatcacattcacaaaagctaaacagatcccatgtctttgcatttcttctgttgagtctgagagaaactgaataccctggccatcatctaagatgaccagtcctatccaagtccatctaaaatgaagcatcaaggagaccatgccatgggacaaacgtgtgtccttggtggctacctgatggacatagggggacaggtcatggtcacttaggttaggattaaatgttccaaagaaaacctaaaggatatagaagagatgataaaacatctactgaggaatatgattgtcaggatgtttggacttatatacaagtaacattactcatctttcagaactcctatcaaagatagtaagattatactataaatattccattttttaaaatattttttattatgtattttcctcaattacatttccaatgctctcccaaaagtctcccataccctccccccccactcccctacccacccattcccactttttggccctggcattcccctgtactttggcatatacagtttgcaagtccaatggccctctctttccagtgatggccgactaggccatcttttgatacatatgcagctagagtcaagagctccggggtactggttagttcataatgttataaatatcattcctattagattgttgactatctctgatacatcccactgttctcaaaaatagtttgccttgtacatctatgatctatttacttaattctttattttatattatataaataatatatatctattttaaaacatgtgtgtgtgcacgtgagagtgtatgtatgtgtgtttctgagtgtgtagcaatatactcatcactcataaatgcacgctgttcaagttttcttgtaggaaaatgtaaatggaatttgaatgttgttaactcatccagtgtcacacattcttaaatatggtgtcctagaataaattgacagttttacagctgttttccatgatggtcctgtaagatatatgtttcaatcatcctctaattcacagatataattaaaaaccaaatgattttttcttctaaatatatcttacccagaatcccaatttatcctcacacaggccatccatgaaggagaatagcaaagacgtgttgggtaaatgataaggattcttgttgatctcatcagtagcaaaaaacattaccagagaaaactcgtatcttctcaatgatattctaaaacaaggcataatgatgattaagaacgatgtttgaaacaaaattccaattgcagtaaagtttgtaatatgagaaatgctaaatttctgtctaaatgtcttgaaataaacctcatatgttagcaatctttagaggtgaatacaatttaagaattcatagacatagggcactatgatatgataaatattttattcatgaaagttaataaagattgttttatctctgaatgccatccttgaactagattacagtcctattgagaaagactgctataaaataaccttgaatttgtatttccacagatacataaaaaagcatgacttaaaccatataaaatatataacagattctccttaaaatattttattatttaaatgcattttatgtatcaaacatcttaataatactgaatattttgagaaccaaataatacatcaaaattttgttcaactttcatattcctgtccttttatactttaaaaatatcattaatgcatatttaataatatccatacctgatgatcctatgtctacttttgagtactgcctgcctctgcctcccgagtgctgggattaaaggtgtgagccaccacgtctggccttaatgtcactttttattttgagatgatgattatctaaatttttcattccatgttaaatttgagaaactttcagatattgtccaattgttatgctcatttttttcataatttttgttgatgtaattgagatttaagctgtacattcagattattttatactggtatattccttgtcctttcagtgtatcatggctatcaattatttgtattcattttttttctagcagtttgctaaagttgctgtcacttgtaagtatatatttttggggaagattgattattttacaacgtttaaatgctgtagataacatacaatatgtagtagagaaagtaacaaatacagctcctgggccctctgggccaaccaaagctgccctgagcagactgctatgccatgtggacctccactctcccatcacctctcctcaaacctagtcagactcctgaaccataaggtgccgaaacatacagcctaatgatatccatcagaatcctgccacaccaggaaaattgaagttcaccctcttcccaatatctcctacaacaagaacatctagggattaaaaccatccagtttgctaaaggccctcaaaaaaacaaaatcaacaaaagccttggcaatatgacacttccaaagcaaatctaccccactacagcaagctcagataacctagcaaaactgaaatacaagaaaattaccttaactactatcttacaataatcatagaggccttataataggaaattataaattccttaaagaaacactggaaatacaatcaaacaataaaggtctttaaagaagaaacaaataattacttaaagacatacaggaaaatagaattaaacaggtaaaggaaacaaataaaactgggcaagacctggaagtcaaaatagaagcaataaagaagacacaaactgaagaaattctggaggcagaaaactaagggaagacaacaagatcaacagatgcaacaagcatgtacagaataatggagatggaagagagacagtcaggcataaatatacaatacaagtaattaatacatcagtcaaaaatgttaaatataaaaaactcctagcataaaacatccaggaaatctgggattccaccaaaggccatcaaagagcaacagaaataaaagaatgttaagattctgtgatagtttgtataggctgggcccagggtgtggcagtattagaaggtgtctcccagttggagtaggtgtgtccctgtgggtgtgggctttatgacccttattctgactgtctagaagccagtattctgctagcagccttcagaggaagatgtaaatctctcagctccttctgcaccatgcctgcctggatgctgtcatgttcctgccttgaaaatactgaactgaacctctgaaactaagaattgccttggtcatggtgtttgatcacagcaattgaaccctaactaagacaagactccaagctccaaggaccagaacatattcccaaaataatcatagaagaaaagtgattcctagaaatgtgtgagaagcctctagaataccaattagactggaacagaaaagaaacccatcctaatacataattatcaaaatacaaaacctaaaaatcaaaaaaagaatattaaaagtagcatgggtaaaatgccaagtaacatacatagacagatatatcagaattacatctgacttgtcaacatagacggtcaaagttagaagggcctgagcagatagcctgcaacatctaaaaaaacataggtgcctacatacactactatgcccagaaaaactcacaatcaacttacatggcagaaagaagacatttcaataaaaatccaaaatcaaacaatatctgttcataaattctactctacagaaaataggagaaggaaagctccaaacaaagaaacataactacatccaagaaaacacaggaaataagcaatcccataccagcaaaagcaaagaaagcactgacaaatacataaacacacacacacacactaaaccaccaatgacaaaataatggaaaattacaatcactggtcattaatatctctcaacaacagtggactcaattctcaattaaaaagacataggctaagagaatggatggaaaaagaggatgcattatccttttgtatacaagaaacattcctcgggaagacaatagacatttcctcagagtaaagtgctagaaaaaaagttatctgagcaaatgaatgcaataagaaaggtgggggtagtcattcttataccaaacaaacaaaaaacaaaaataaacactttcaagcaaaattaatcaaaagagacagggaaggacacttcatactcatcaaaggaaaaatctaccaagatgatatctgaattatgaacatctgtaccccgaagacaagggcactcaacaactataaaagaaagactgctagaatgtaaatagcacatcaaatcccacacattaattgtagggtatttcaagacctgactagcatcaaaagacagcacatccagacaaaaccataatcacagaaataatgaaactaaaaggctctgtgaatcaaaaatacctaatagacatgtacagaaaattcaccaaaacccaagaggatatactttcttttcagcacctgagggatccttctccaaactgatcatataatcagtcacaaagcaaatcttgaaggtacaagaaaattgaaataatgccttgtatctaatcagaccaccatggatttaagttggacgtcaacaacaggaacactgtaaagcctacacactcatggaaattgaacaagtctccattcagtgatctctggggcatggaaggggggcagagagagagagagagagagagagagagagagagagagagagagagagagagagagagagagggagaaagggagggagggagggaaggagggagggagggagggatgaaggaaggaaggaaggaaggaaggaaggaaggaaggaaggaaggaaggaaggaaggaaggaaaaacactttatggaatccaatgaaaatgaaggtacaatatatccagttttatgagacacaatgaaaacagtgcaaagaggaatgttcatagcactaaatgcccccataaagaaattttaaatgctgaaaccagcaattgaaaagtacacctgaaatctctagaaaaaaaaggtgcaagaatatcaacaaggagtaggaggaagaaaataatgaaaatcaaggctgaaataaatcagctcataacaaagaaaacaatataacaaatcaagaaagctaagagctgattctttgagaaaaccaacaagatagacaaaccatagccaaaataagcaaaggacagagaaacagaatctaaataaacaaagtcagtaatgatgagaaagacaaaacaagtcacattgaggaagttcaaagaatcattaggtcttactccaaaagcctatactccacaaaattgtaaaatcctaatgaaatgggtgattttctatccaaataccaattggaaagttaaatcagggacaggtaaactatttaaacatctctatagcccctaaagaaatagaagcatgtattgaatgtctcctaaccaataaatcccaatagagagattgttttaatggagaattctaccagactttcaaagaagagctaaagccaatactcttcaaactattccataaaatagaaacaaaaggagcactgccaaactcaagctatgaggccacagccactctgatacctaaaccacagaaagactcaacagaaagaaaactttagattgatttcccttattaacattgattcaaaatactcaataaaacacctgcaaaccgaatccaggaacacatcaaagatgtcatcgctcaagatcaattcggcttcatcaaagagatgcttagaaatttaatatattgaaatccaccaatgtaatctaccatataaacaaacttaaagaaaaaactcacatgatttttctcattagttgctgaaaaggcctgggattaaatccatcgcctcttcattttaaaggtactagagaattcatggatacagggtacatacataaacataatcacagtaacatacagtaagccaatagataaaaatcaaactaaatggagaatttcaaacatttcctctccatttaggtataaggaacaagactaaccttcccactctatccctagctatcttttgaaaatatcacttaaaattctagccagaaaaataagacaagtaaagaagatcaaagaaccagctcttggtttgattgattctttgttcagtacttttagtttctacttgattgatttcagccctgagtttgattatttcctgctgtctactctttttgagtgaatttgcttccttttgttctagagctttcaggtgtgctgtcaaggctgctagtgtatgctctctcccctttctttttggaggcactcagagctatgagttttccttttaggactgcgtttattgtgtcccataaatttgggtgtacccattttcattaaactctaaaaagtcattaattcatttctttatttcagtcataatggtgtacaaagttcatgccagcgtttgaaaagcagaggcaggctcttacaggattgaggcctacaaagtgtcttcaagacagccagggctgtttacactaagtaaccatgtatgaaaagaataaaaataaatttaagaaagaaaaatactattatgaattaggttcatgaatgggaataaattcataaatttttatgttgtaagaaagcatttggtaggtattttacttagacagtcagtaccccttaaatatataatactattttaagttgtttaccttctgtttcatagaactctgaacagtagaattgtgattgttgtttgccttacatgtccaatgccctgagtttgataccttgcacagcaaaagaaagagagattgtgattattgaaattgtcagagaaaatggcaagggtttgatctagatcatgcagcctcaatctaaatccttgctctgccactttctgcaacaggaacatgcatgggcatcgccgttcttacctctttcctttctgcaagaggaatggcaagaatcagtgactttcagcttatgtctacttaaggacaacacggaaaaaggttcagagccttgcacctagtgagactagacaattgtctcacagttaattcatgaagtggctcaattgttcctgagtaaggtttttgtttttgttttgttacacccaagaatattctctgaaatcagaactttttacaagcttaaaacgtccttatattttagattcttagatttaggatccgtatttttatattttggaacatcaggaggagtgttagtaataatattatcataaaataatattagcctaataatccttataaacactctctggttattctaagtcattaattatccttatgaaataatatttattttcatctccataaatgtaataaacatgctgcagaacttgttagtaacagctaaatgtgaaagaaaaattccctttgtatatagatttttggtttttttgtggactactttttgaaatatgtctaattattacagtagtatgacagtttaagagcttggaaatcagctgggcgtggtgttgcacacctttaatcccagtactcaggatgcagagtcagatggatttcagagttcgaggccagcctggtctacaaagtgagttcccagacagccagggctatacagagaaaccctgtctcaaaaaacaaaaacaaaaacaaaacaaaacaaaaacaaaaaacaaaaagagcttggaaatcaaactgacctgagttaaattccaatttgggcattcaccagctgtgggacttaaattactaatctgtaaaaggtggggctgatagtaatttttccccacagtactgtgagaattaatctaaccctttgtaaaccgtttgtgttttattatttatcaggaacattgggtagtagtagctattgtaattatttcatttataaagtttgtagagttgtgcagaatggagtttatcaaacctaagtatgtgaaagtatacatcttgaaattgttaaaatcagatttatcttataaaattatagttttaaaagaatgcagctagaaattagaataggaaataattccatggtattgttcaagtgatttaaaattctatcggataactaaagaaactgaaattcatctattaaggtagcatacagtccataaaatattctatagtatgctaagataccattctccttaaatgtgatttctaaagttaactaaatctgtttttaatgagaaaaatttatctgggtttgaatattctttttttttccttttaggcaatatgtcagtattgagtgaatccagacatcatagctctgtaaggcatgttgatattgattgcttctttgtctcaggaggtataagaactggcagatctcaaaggtctgtattcttgtttaagaaaattgacacacatataaatgtgtgtgtgtgtgtatctgaattgataacaatgtattctttagaaaatattttgatatttctcggtcaaatctatccctttgttcaaattgcctggagtccattatcacaggtgttgggaaattagaaacttgctatttggtgtaagttgcaatatatcgggaagagtatcttaaattgagtaatctgttatctcatatagatgagggattctgaatattttccatatctttttgttgtttgttaaggggaaatttctggtatcctgtgtcttcagactttgttcttctgttcaagtaactctcctcccttcatgtaggtaaacatagtaacttttgggttgtgataattttgtatcattgagttgaatcatctgggcagtcttttttttttaatgaaatttcaggcttatgtatgtactacttactagtattagaagcatttgtttagaatttttctttagttttttcttgtcagattgaaagaacctagtggggaaaccccccactcaattcccgaatcagagtgcacccaaggaacacgagagaccgtcttgatgcaaacacacaaagtagtttaatgactgagctctgagccaacctgtatctcatacacgagatggaggttgttgaccacgaggctcgaaagctaaggggttttatagaaaagggtctggcgctgggggaggaattggcaccgtttcacacgattggttcatttaaacaccagcagaatgattacacaccagaaaaagattacgtgcaggtcggtgagtcaggaattctgagggccaggtgcttatctaagtcagcagaacatctggttaacttttaaccaaggtagacagggtgggagatagggaggcgcctggccaatccccacattcttgtatatcttctctatctttatggctagccagttcctaggatgactttacagcctttgttctttgctctaggcccaaaaagccttcctaactagcaagctgcttgagtcatggatcttgaatattaattttctttcacctagaagtagagataaggatttgtttaattccctaacaaaagctccttcctctttctacacaggtaacctagcaacgatttacatgacaaagccttgcctgcctacctgccctcagatcagcctggaaatcaacccctgaggagcctttgtcagatttaaacacacaaataccactcctggtgtcctctcttttggaatgtcagccttgattcccatgggcaggcttcatgctcactgtgatttatgcctagccctgacctgggagaactttcacagatgggatgctgtgtttctctcatgagtttagaacacccagggcttgaaatcagacaatagcctggcttagatttaaaaagccttttaaaaaatggagtctgactctcagttcctcctgttccactgaaatgccctgtcattcacacatacagctgtggtggactgtgcttctcagacccttggtgggtgaaaaacagtcgatgttgcctgctgctgtaagaccccaatgcaatgtgtttcttaggcccctagaaacaaagcccaggatggagttctttgttcttttgccatcagccctaaagaaaggtgagatgggtgacccacctaggcatctgacccattgtgtaagggaccaagaacatttacacaactcccccagtctttgtgatctatccttcccctcactttcggggagagatgagctgtaattcaccatccccatatttatgatgcttatcctatccttccctcactttatggttcattctttaaaaacctccactgcaactgctggaggtctatctcctctgccccttgtgggctacgagctcagtctcagcatgctgatagtatttgaataaacgtcatgcaatattgc

SEQ ID NO: 56 - DNA, 22292 bp, Mus musculus
agggtggcctgaagactgaggaggggcaggtcaggtgcccagtccagagaggaggagttgaagatgacaaggttcggagctccagggactgggtggtggcagtgctattaatggaaacagggaagtccggaggaggagcaggtttgggcccaggaggcggagttcatccttagacatgttgaccctattatgctaacagtgggctatttcggctgaggtctagccacaattcaaggaggaaaaaattaaggcttagtaaatattcttgaccaaagccaagctgctcttgctatgtcccatgttccctggcctgggcctcaggctgcagtgttaggatggcagcagcctagccccagccccaagttcaagccctaatccagccgctgggggtcgccactgtgcacagactggcagagctgccaaggtgtgccaaccgagaagagggtttggagccaggattcccctcacaggagacagaggtctcttccctctttgtagaggtagcagaggctcacgagcagaaccgagtatcaggcaggttaagctttccccaagagcctgattaaccttctccatcaggtctcggtgaccttggagccaggagggaaaagccacagagccccctcacctctggtgctttgagaacagctctcccagttgcccggggcggggggcgggggcgggggggacacagtgttcagggctctagtgacctcgctgggagcaggatcccagctgtttcaagcctccacatgtctcccttgacatttgcgtcagcaactctgccctttgacctttcactccccagagaggacggtggaggcaatcgggactaattatttgcagttcggtgtgtccagcagtttattggggtttgacctggctctctggtctcccccaccccagctttatggtcttggtctcccgaggaagttaaagaaccaagggcaggagtggttcctcttggcctcctggtgttgagagccaggtgggaaggtacgcttgtaaaagggcttggagaggtgtccccacgcaggcacgcacgcccagcgcaaactctgccccccacacccttgggccagcctcctgctgtgcttggacttgttgggacatgtccccaagtggactggggccaggagaaggggatgccagtctcctggctgcttgcccaggctggaagggggtggaggttgcaggactccgaaagagctgggggtggggcaggtgcggtggagtccatggggctccctaggccctgggcccatgaggtatctggttccctctatatttggccttgacattactagcatgccctctcagaggggcaggcggccagctgtacccaatgtctcctcacagggaccggattatttgagggctctgggggagacagttgtagcccaggagggctgagaggcttaagaggacatttccccacagatcccggtcagaaaggagtcaaggatagatggcacagatagatggccctgaaacttttctaagaattcccagtacactcactggaatgttccttttgctcaggttccccgaggaagcctaggctctgtggcatgggtgacgtggggcatgatcccaacctcttccccaggagaggttttctaggtatcctggtaccctcaataaaaataaaaacaaaaaacccaaataaccacagatcattttatgcagtaggcacctataatccccacattgcaggggctgagaccggaggatcacaaggtccaggccagccagtgcggtatacctaatgagactgtctcagaaaaagatacgaaaagggagccccgtccacatacatacagaaaacaacttcgttatagattgagtcactggaggaaagggtggctggctggtcctcagtgttagcggtctctctgattactatttccaaaaaagcaactgggatcggccagcaactccagctttccaatatgctgagtgcactcatgcaggccagagggactaggagtgtccctgtccccgtgccccccacccccaggggaaagtgtctttcagaccctatgtcactttgagaaaacctcacacttcactatactgtctcctttctcctgctgagggcagagccacacacggcagcagctggtcctaggcatggttggtagactcttgttccaggaaatgttagtccttccactccttggccagagcccagcaccaacagcagccagccctgttctcggagaccctcccgagtgttccatggctagctgtggtcacctttgtggtctcagtgctggtcgcctttgcttccctgtgccctcccctcccccggcctcaacagcaacaagcaggtagcaggtaggcttcacatcttacaggctggaaatgcagagggctgctgcattgctggctcactattggctgcaggacccaggctgtcctctgagaagtcacatggctaccacgctccctgagaaagctgctgctgtggcaggtgtctggatcagagaggctcaagcgccagccacggcctggccctgtgatctgagactcattgtgaatctctctccctttgacttcagtttctcagtctataaaatgggtgtatgaatagcttgtcatggggcctagggtgagcactaaaccagaggatgtttgtgaaagtcctttgtggactacaaaggttatggagggtggttattattcttatgggaaactagtaaacagtaggagaaagaacacccccaaagctgatctcagtttgtgggtacaaagaccaggctcacacccaccaggtctgtgatctggggtcccctccagccctgctgaggagccagtctgagccagtaatccgtgatgccttggctggaaaacaaaccttctgctggagtagaagccagcctctggcctgtggtaggaggagcccaagcttctagctacagtgatgggggggtgcacagctactggtgttgattgccccccactagtaggaaagtatatggaggcactcctttagacgggtttgagagccataatgcctagggcccagagaaggcccagggctcactcagtctttagtggctaaaatgccactgtgtaagacacagtaggggacctgctacctcctacccctctcctgccctgccccattcccagcctcaccactttagtgagcctcagtttccttatctgtaaagcagggttaggtgtccttccccaagacccctgggtgtgcaggccccaagaaccctcaggaaggaaactgaggcccggtcaccttggaaaaggaacaacagttttggccttgaccagtggccaagggggcaggtctcctggcccagtcaggctccaggtccccaccccctcagccagctgctcggcaaccagttgtcatgaagtcattgccaccttcagtctggtctgcccgaggcatcccccttccctctcttgccctgccccgccccggtgctgacatcccatttggcaaaacggttggaaaagccgctgactcttccagaccctgagttcattgactgggcagggcccactggccacaggactgatcatgagggagaggcccttactggggccccaaagtcccccagctccacctgccaaaaccttcctgtaacttttgcctacaccccacagtccaccactgttacccatgttctctttcttacacccccacgaagatcctacacacagcctcccatgtccaccacctcccaacacacacatctttatactgtgtgtagttcttggtcatcaatggtctctacagccacagacacacctatccttgatctgttcccttgaacctcactagatcaaaagacaccagggctgagccagaggaggatggagaatggagtagtgtgagtccggtagggatgtggggaggtggggagttagactggtccagaaggtggctagagaaacaagcgctgagacagcgcttcacaagcggggaatcccgccctgctcactggtggagccaggcctaagctggtaaacaaggagggttaagtcacacagccaaagtgctgtccagtgtttcaaagtgtgcgagactgaagcacaggctggctgcggtggcatattcggctcactgactagaggcagaccaatcagagtttgaggccagcctgctccacacagagttccaagccagccagtgccatacagtaagatcctgtctcaaccaaacagtgtagcctgtcttcctaccacactgtgcccgagcctctccgaacaggcagaaccagcttcagctggcctgtccacagccttctccaggtctgccacccagatgggcaccaggcgagactttcaccctctgcactgggggcaaggtcattggaagctagccaggggaggccctgttactgagccacagccttcactggcttagaatgtggcgtggagcttagccttgcccgtccttggcaaacactcagccaaggcttccatctcccaagacaccctccctccctcctccccctcccccctgtcttgctggtctactccaagtcttatacatagacatagaaaccctgtgctgctgccccgcctcaggcttttctgtggactttccactggcagccccacaagcaataacttccgggaggttcctagtagaggcccaaccgaatggctgaatgagtgactaaactgggtgtctgccccctgccctgccctgccctgccctcccctgccttccccgagaccactggtgggagttctggggtccagtgggagaagccctcagccaggagctgggagatcagtgagacggttgggacctgcctctaatgtgcagtgtggtactagggatcgcatctgcacagttcctccaggctgtccgcttctttctctctggctgggattgggcaccctttggagcagacccgggccagggagtcctatattgtaaataaaactgctacccagaatagtccagaacacttgccacccgggaagcgaggcaacaggagtaattgtggtaccttccccctagccgcaccccacctccccccaactcacttgggactggatccaccctgaggagcctcgggtcaacatcctgtttccggcaagccctcctggaggccacacagaggggtgtttgttcgtagtgggcgacgggagagatgctaatcacgttggatagctggtcccagctgaaggtcaggaggtaaggcgacccacagttataaataaccgagccaggctgctgagggcagcttgctggatccgcgcccctctccggccgaccgacccggattgatttctgacctcctggctgccacgggaacttgaaccccagagagctgagcgccatgacctttgggggtggcgcgcaaggtcaggccaggccgcctgggcttccctgactcctaaattcaggcagatgcacctttgccactctgcagaggcctgagttggaggtggttgtgcatgggactcaacccccaccatcaacacaggtacctgtacctctgcatcccacccaccaagccctagtcctcagcctgctccagctgaaactggaagacccagccttcagagcctggcccggcctccagacacctgatctgatgtggggttgattccagagccatgtgttctctgctggatggaaacaagagtcccccgtctcactttggaaggcttagtgaagagattctagtggcaacaatctggctgctgtttgtgtgcctgggaggcaggcacctctccttgtgtcctatgaacagaaaagggaggtgggtttatcctgccggggggggggggtgccttttatttttaaaaacaaaaacttttggggaggagggggccttgagtacattacacaaaagtgtgcagctgagggacacatcacaagttacacaaactggtgtggccaaaccaagaaacagcgccaggcaggtgggatgcagggctggggatgtggctcagttggaagattcgtgaggcctgagttccatctctccggcacctcccattgtctgtaatcctagagctcagaaagtagaggcaggagcatcagagttcaaggtcacccttgactacaaatcagatctgaggccacctggattccatgaaactttgcctcaaaaagaaaaagaaccagcactcgggaggcagaggcaggtggatttctgagtttgaggccagcctggtctacaaagtgagttctaggacagccagggctatacagagaagccctgtctcaaaaaaccaaaaaaagaaaaaagagagagagacacacactcaaaccaacactgaaagctcatcaggactcctactgactgacagctctaagggttgtcctttcccctcagcccaccctgtagccctctaggctgtgatggccagtgtatgacaaagcccacgtgtagcatggaattatgctatacctactgtgtagtatgggtttttttttttttgcccagtgtcctgtctatgaaggcctaccatgctgtctcgggcactctcaggccacttgtctttctgggaacttgtcactgtgtgactctcataatttagtcaccctttttactgttgatggatgttggggtgggttccagtggccggcaacagggcagagcatcattgggcccactccagcttctgcccgagaatccatagaccaagcgtgtctcttcagctcagaagacgcacgagggctaatttttcgccaccatggtggcaagacagcccaatggttttggttttttattctaaaatgagagatttctcctcctcctcctcctcctcctcctcctcctcctcctccttctcctcttcctcctcctcttcttcttcctcttctcctactcttccacttcctcctctttctctccctcttcttcctcccctcccctctcctcctccttttcttttaatggaaaatgcagaaatataaaaaagaaagaaataccactgttcctactgtttagagtcacccatcagacgacagtcaatggctgttttctgaatctcttgtaggtcaaactcaggaccgagagagcttgtctcccctcaggcagcatgaaagatgggctgaatctggcctgcagtagcatcttccagggagagactaggcaccctctgcttgctccataacctccatcacttctccttgcccctgcgtcctccatcttgcttctaggcctagaactcaggcttaccgtgtgcctccagctcaaagggcaagcaagccttgggtcatcatccagatggcctgaagggtttattgcagtgggggagatgggcgagtatagaagactacaggagagacagtagggaggggtggggctgctgtagggaggtggggtcagagtcagctctctgggaggtctcacaggcctgacctttgccctccatcccaagggttaaggagaactgggctttttacttatttgcttattgtagttctggggactgaagctggggtctcccaggtacacggcaggcactctgcctatgagatatatagtgtcagctaagttgcccaggctggctttgaacttgctatggaggctaggcaggctttgaacttttggtctttctgcatcaacctctgggatgctggcctcaccgacctgtgcccccacagtcagccaacaatgtgtttttttctcattctgcgggtgcttttgagcacaggaggccagaagagcaaaggcccagagtataaacaagtataaacagggggtggaggtgtctgccttacagagagtgggaaggaggacagactcacagacctgggtggaggtgtgatcagccaagacctgggggatttctttcccttctttcatgcgtttgaatccacttctgtttgagaatttctggaagccaagtcagactttagaacagagccagtcctgggaactctaagacagaagagatatttgttcattcgttcatttattcattcattcatcctttcatccattcattcaatgtgggtggacctgccctgacatatgtttcccttagaaagaagatctagcacagtacattgccatgcctgagcccccagtgttcatacaaagtcaaggactggctcccctccgggctgcctccctgtccagtggctgaggtgagctccttgggctggaggcaggctgagcagctcctgtgagcccagagcctgtagctagaggatgcccagggcagtggtaaagagtttcagccccaccctctcctcctcctcccactgggccagctctgccccctgctaactcaccatctccacttgggttagtaatggggccggcaagcctagtatgctcagaggcagccccaacctgccactcctctagtctcctccctagttggctaaccacaatcacctccctccacacagttaggcaaaaccccgactgtcatcattgctcatcgagtatctatgccagaaaatggtgggaggaggaggaggagggagaaagaaagaagaaaaaagtaagaagagaaagatggaaagaaaagaaataaccaaaaagtgcattggcatggtcttagaagcacccctcctttgagaagattctctattaattttaactatatgcgggcgcctagaagacagaggaattggatctgccaggagctagagttacaggcagttgtgagctaccagatgtggttcttgaaagtcaaactccccgggcgtggtggcgcacgcctttaatcccagcactcaggaggcaggggcaggcggatttctgagttcgaggccagcctggtctacagagtgagttccaggacaaccaagactatacagagaaaccctgtctcaaaaaaaaaaaaaaaaaaaaaagtcaactcaagtctgaaagaatagtacatactcttaactgctgagccatctcgtcccacctgagctcagccagctcactggatgcttaacaatagcacctgccctcatcctaacatctgctctcagccattcctgatgttcctaacaccctagccagagtgattttattaagacagaactctaatggcaccatttgcctggtttccctgtccttgtccttctgaggggaagctaaagtctttgtgatggcctctttttgttgttgtttgtttgtgttattttgttgttgctgttattgttgttgttgttgttgttgttgttgttgttgttgtgatggcctcttaccatggccactgcaccacctcaccacctcactgcctatactgctatatggttcagctgctggctgcctcagggcctttgcacagccatcgccaggcttcgctcctcagatcttccctggggttctaccttatctaggagccttccttcaggacctccatgttgaaaaccaaagatcacttctgtgcccagatgttgctttctaataccattctgtaatgaaagttcccatggcctcttcaagaaatggccacaagaagacccacagagtcaactaatctggtctcatgggggggctcacagagcctgggctaccaactagggagcatgaaggagctggacctagaccctccctccctatttgtagcaaaagtccaacaagtagagcaggagtgtgtgtgtgtcggggggagttgtcttggtctctgttccctgccgttggatccccttccccctccctacctggacagcctggttgggcctcagagggagaggatgtgcctggacctgctgggactagataccccaatgaggggtggtaccccttctctaaggagaagagggggcaatggggggaaggatttgtaaggatggggctgggaagagaggaggggaggggtccatgatcgggaagtaaagtaaatttaaaaaaaaaaaagggctgctccttgtacttgggtgggatggtggggggaaagagcctggagtatctcaaagcatcagagagggagggagggagggagggagggagggagggagggagggagggagggaggaaggaaggaaggaaggaaggaaggaaggaaggaaggaaggaaggaaggaaggactgaagacaagagccccgggaatgtgggtgtgtcatgctggagcaactgctcagcccagcaaacaggactggatcatagcccagaggtaaaaacacatttaccagcctgagacacataaatgactgaataaaccaatcagtgggagagaagagccaaggtgtcatgaggcgtggaatgtaaggagcttgttagcagagaattcacagcctacaccagccaggggctaggtcatcagtcaagatagcagtgtggaccccagtcatgaagaaaatggcactgcccctttgtgacctggcttcccaagggcttacaacctcaatttagttttgtgaggaaccagcacttttttgtttgtttgtttgttttgtattttgagacaggtttgtatgtagccttggctggctttaaacttctgtataactgaggatggtcttaaactcccaattctcctgcctccacctctgggatgctggaattataggggtgtactataccatccccagcaggcaaattctcatttttaaggatatctacaaaacacctgaccaggatgcctctaaactactagagtcatcaagatcgagggctgggctgggctggatgggcgagagctaccgtggcctagagaagcctctagagagaagacaatgggatggaatgtggctgtggagggatcctgaagcaaaaagggattcgatgaacaaagaagtctggtgaaaccgcagcaaaagtttctctgggtaataattaccattggatatggcaacactcactggaaccctgacacccgagaggctgaggcagaaggatgctaagtttgagaccagcttgggctatgtagactctggcttaaacaaccaccactaccaccatccatggcactagatgtccgatgtcattgatgagagactgatggggaagtcctcgtactgttcttaatttttgtatggatctacaactactctaaagcacactgttgttcgtttgtgtgcttttaaatcacattctctaacatgagcatagtgaagcataccagtaagcgagccctcaagaggcagataccagaagatcatgagtttgaggccagcttaacctacacagtgagagcccatcttcaaaaaagggtcagtaagagccagctaggcaactcagagggtgaggcagttaggactgcccgccaggccgagttccttccctggaactcatggaaagttgcgagaggagagttaactctccatccctgactttagcaagcatatcaaggaatgggcatgccctcttaccccgtacatacatacactaatgataaggcaaatattttaaaagcaagtaaataaaagcaaaaagaaagcagcatcccccccacccccgctctgccgcgcccctcccctggctttttccatttgtacctttcgccatttaaactgcagtacattgacctcacagagtctgtgacctgtactccctctctggatttaaactctataaaggcttctgcctgcccactgctgtgtgcccagaacctcaatcagtctgacaataaatatttgttgaatgataaatttccacagataggctgttagcttttccaagtgcccctgtgcctaaatacattttctattgttgtaaaataaacacgagattatgctgcagtgctcagctctttgttggatccggatcgcttttgcctatttgtccttttccagcctatgctgttatttgcaggccagcaaatggttgagattcaagaggcaaaggctttggggacgtctcttcctctgtgtcagctctgccaggctgccacatgggcaggagggctggagtgatgccagggccattggaggccactccctccctctgacatcagatccgtgggcactagatcctgcttggtggtgaacggggtgcgtcagaacccagggattaaatagattttgaaatccactggcttgtctttcaccagccagaaggcacatgcctggaccttctgacagctcaggcactgtggaaaacactgtgtgcatacacaaggcagtgccactcagaatgggtcacagccaggcacagaaagatgtccctggaccacagggctctgagaagctaagccccaagaaagggcaggcagattgtgggctgggagcagtcagctatttttctgccactgttgtctgatttccataagatgggacccagggccttgcacaggacgggcaggtgctgcaccatacctgttctgctggtgacctgggcaggcctcaggggacccaatatgttagtgtgtgtgtgtgtgtgtaatagggcaaacaaagggtaccctacgttttgcacttaggagccatctgctttcaaatcctgccactctgtcttccttcacggtagcaacacgaaaactacccggaggctgtgtgacatttgagtgccaaggataaaaatatgcaaagaatatgtgcctctggaaagtggtccgcgtgcttcctggggccttcagctcccctagaaaccaagattccacccccaccccagggtcccatttccacggcctcattcatgctgtaaggatgaacctgtgtcatctgagtgtccacacacaggtccccttgctccgcatctggaggagccccagtgtgcacaagttggtgttgcagtgtacctgtctgtgcttgcttgagctccaaagcatggccccgtgcgtccatttggctgctttgtgcttggcttcctcgccgttttgagtgtgagcgtgtatggtgcgtgggtttatgtggatgtagaacgtgtgcgaagctcctctgttttcgtgggtgagaggattctgggagagactcccacaagttgtgtgcatgctcttgcagagatgtgctggctggctaatgtgtgagcttacgtgtgtggctctgtgggtatgtgcctaggcatgagcacatgtgtgccgatgcccacagtcaaggaggccccacacacccgctctggcaagtctgccgccctacccaatgttcacatctttttggcaggatggctgggccctttcctatctcacagctgagctggcttctgcttttctcataccttgaatttctcctgctcacctgaagtttgccagaattctcacttgtgtcccagaaccctagcttgctgttttgaagatcctcaaaaggaccaggttcctgggtcaatgtaattttgctgaaggttgcatctaactcacctccatggagagaggcatagtaaaggtccttcgaaggtcggaagtgaagagaccagaatgagttcagcaagggacttcaaggcagagccgcaggagaatgcacatgtacacatcttatagacgcctcttccagaaccctctcacccacaaaaacagtattgcaagcaagatccaaaatggtaaccttggtggaatagaggcgtctgcagtgtcacaggaaatgcacagcctccctgctgtgagcttctgtccggatcaatcaatgcctggttggtcagtagacaggatccacaacagtagagacctctagcttgggaagctgagggaaccctggggagccacgtcagggcaccattcagttcccacccccaagcctccaagcagtgcagaagtgacatagccctggccaaactgccatggcaggtgacgttctgggcacaaggagggagtgctatgtgttctttgcttggagacagagtgagagctgcccataggagggagactgaggcacttgggtacctgcaccttccccaggactacacgtcctgcccctcaacattgtacatgccaaatcagacactagcctacctcaggcccaggatcccaggcagcctcttggtggtcaggagacctccaagcatcccctccagtgggggtggggtagggagagctcgggccttcctaccaatccttttatttagtgtggggatcaagactctgtatagccctggccgtctggaactctctctgtagaccaggctgacctcagactcagaggttcgcctgcctctgcctcccgagtgctggaattgaaagtgtgcgataccactacctggcattaaccagtccactcttaatctaaccactgctttcggagaataagatggtttagatggctctgtgctctccgtcctccagtaaaaccgaacgaatccttcaaatcaggcagacatcacaaaaacacaggctctttgtatgatgcagatcacacaaagtaaaatacgatttagtacagccctccccatccccaccttagttccacagcataatttatcatgttaataattcactatgtcttgctgggcatggtggtgcacacctttcattccagcactcaggaggcagaggcagacggatctctatgggttcgagaccagcctggtctataagatgtgttctagggcaaacacaactatgtagagagaccctgtctccaaaaataaataaacaaacaaacaaataaataaatcactatatctctcttgaaggggacactggaatgagacctgggccttgagactgctatacaatgctctggaccactaaacagtctcctcagatttttcttttttttctttatccttttttagatttgtttttgttgtagtttgaagacaaggtcttggtaaattgcctaggttgcccttgtgttcaccttgtagctcaggcgggcttccagcttgcaaggtggggctagcctcagctgcccccttcagtagctgaaaagcctcgactcatttggtttacttttgtttttttaaggggtgtgtgtgtgtgtgtgtgtgtgtgtgtgtgtgtgatatggctcagccaatatagggacttgtggacagtcgtgagagcgttgactcccgaaagctgaactttggcttccacatgaatgcttggcacatggcaatatgagctctctctcctccccaccccatcccccactcccaccctacccccgagagaggagagagtttgacagcaagtccagttactagttgagccatcttaatgcccactccccacccccgtcctttgttcctttttgagacaggcccttatgaagcccaggcaggcctcgaactcactaggtagctgaagctaactctagatgctccatcctccggctccctcctcctccagccgggattccagatgtgcaccgctaaattcagtttatgtggtgctaggaatgtaacccaggtctcatatatttccagcaccgtttacagatttaaataaaacaacacagacacaattatattctttatatttcctcggcttgcttaaaaaaaaaaaaaaaaaaaaaaaaaaccaaaacaactggatctacgtcaacacatctcagactaccctactttcttttaaatcagcaattcgatgttcctgtctgctccatcccttccctggtgagaggcgtgctgtttcctttccttcttttcttcttctcctatttctgaaggcataaaggtgcaacgtgcgtcttccagcaggtgttggggatggggcacgcgggtgaaagatgcactccccccacccccggcgccgcgcacgctgggttcagcggcgggtggaaatcacgaggaggctgggaccacagaaccccgcgggtcccgcgtcgcccccgcctctagcagcccggcgctgccgtttttagcgcgcctggagcggggagtacagactccatcacccccgggaaacgcggccatcatatttttggttgcacaagcaaacgaaattagaaatctggaacgcgctcaagaccttcggaggggggcgcggggcccaggacagagacagggattaagcgagttgagcggcaagaggatggtttcctcttttaatttaggttccattggctcggttacgtaagcccggttacacagccgtgactgcgggtgggctgtggcccgaggccgctcgttcgcagagggctcggggctgcgggcgcacagcactacccccttcccctgcacggaacaggaaagcagccagggacacatggccctccactctcactgccctggaataacaagcctttggaagccaccaaaatgtatggcattgtgtggcgaacagtctagtgaaccatgaggcagtcgtatggcatattatagagcagaaaaaaaaaaaagtgggggagggagcaagtgaaggatgcacccgtctagaatagtcacaaaagccagtttgagaacagcaagaacgcaggctgtcactggtgtgaaaagacaacacaaagaggtctctgcccagtaaagccggcaaggggagaggcaggaaagcacgccctgggcgatcccttgagcaggtccccacagcgcttgcgcacactaccacttggctgctgaggtctaccaattttttttttttttttttttttaatacccgtccaaggtggttctctgtccctccgcttttgaatctggactgaccttagggaacttgtcaacctttgaattcagaggaagtgatactgcctgcctcatgagacctgctgaaaccgtattccgaagctttcttctaggtattgtgggaggtccaactgggtttgggggacagtctgtaagaagtccaagtacactgaggttgcctagcctggaggcaggtcacagcacttgagtggcaagcccaggtgactctagccatattacacttttggatcatggcagcccatcgtagaccccaggtgagaagcctcaggccttcccaaactccagctccacaaaaccaccaacaaagcgagatagtacacttacagcacaagacgaaagagtgacctcacaaagtagaagtatttgtgtggggctggggggggggacctacagcaatgagtaagcgtggtctctgcccccaataaactaataatttaatggagaagccagacacagagcaaataattataaaataacacggcaagctcagcaagggagtcacgcccaggtaatagggggatgaggctgaagagtctgtaatctaggcgggtgggtggctttcctggagcaggtgaccttggactggctttgaaaggtgagtaagggttgactaggttaagggatgaaggaaaggtatctggggaggaggaggaggaagcgagagagatgagacccagaacgatggcagggtgtgggggagcgggctttatgggagctggaaaagaaagccaggtagacccggcaggacctcaaatcatgggacagtttccccgcaggccaacagcttagattgacagcagctgggaggcatcaaggctgactggaggcggaccttcctgggagcagcgggaggatgggggtggggggtggggtggatgtggtatgggaggagggtggaccaaggcaaggtagaaaccagaaggggatgtgggttccagaacagggatcgagagagatagggcgtgaagagcagttagggaatcgtcaggcctgggtgcctggctggggtgttatgggtagcgttcagctttgggtttctgactcaggagcatagaatggccgatgcaccagccacttagccttgaagcagaagccagtgtgagtccaggaggggcaagcctgcagctgtagcattgatgtggtccagtaggaagcatccccagtgccatgctgagagggagggactgggatgggggggcggggcgaggagggaaggcacgtggggaagagctgtgcggacagcagctactactcacagtgtgtcagtgagtgaacggtggggtgactgcatgagtgtaggtggctgttgagctcatctggagttgggacgtgggacaggccctggggcggaggacggaggactctggtgctgcaattgtccggggaggttagggtgggagccaagggtgatgacaaaaggcctgataactcctggtcatgatttcctggggtgggtccccacaggtaggccacgagagagcacgggaacaaaacagagacatccagagagtcagatctgagaaacagcacagtgccgtggtaagctgacacacacacacacagtatcattcgattgaatcctcactgtgccaggcattgtacctgacgccaggattgaaccctgtccctgtagggctcagattagaccctgtggagctcttccatttaccacaactggacgagattaacttagtcaaggttatgggggcaggggaatgttttttgtctgactcaaggcataggggtacgaggccacctgatcaaggagcacaggtttgtgtggagtcggagaaacagtaaaatcaggttaggccagtcttccctttcagggaacctggactccactgggactttggaaggcaatagggttcttgttatcaagacaatgtgcacctcagggctgggctgagccttggcacttaatgtcccctcttcactgtgactgtcgggacagtccccagcaagcacttcaactcatagggcatttcactcatgtgaaatgccttccaggccgaagctcaactgtgtgctatagcagcctgcccactaccagcccattgtacacatgggaacactgagacccagtggggtggttatctacctgaactgccaaggaaaacaaaaagcttcaggactgggcctgttgaatcccagaacttgagggcatagccatgtcccacagtgctgccaccagagtgggtatgggaacaaagtgagcctgaacctgtgggtggggcctcggaacccagctctaactggggagtgtcacaggcctgtggtcagaataggcataagctgtagtacgttttcagcataccccagggcccagacatctcctgcccaggacttgggaccttccttctaaccctcagcttatccttctgaaataggaaatacttaagttcagcacacccgaccctttaccttgcacactaggaaacaggcacagagagggagagagctattcaaccccaccccgtaagcctgtgacagaccctaggttaactaacagaggggggtccattttccttctgtgggttagacagggcatgacctcattgctcttcctaacacacacacacacacacaccatatgcaaacacatacacatgtatgcatttgtacacatgggaacactgtgtatacatggatataccacatacaggcacacaaatgtacacatatatcacacacataccatacacaaatacctgcatgcatttgtatatacatggatacatgtgtatacacatataccacatacaggcacacatatgtacacacacatcacacatgcacacactacacataagctatacatatacacacagcacaaagcagctaaaaacagtaccattctggacagtgcaggggagggtgttcgtatactaggcaatggtagggaccacgacaagatgataggtgccggcctacctgaggaggtggccatgtttgactgcagtttacagaagctcccacagctgtggttctcaacctgtgggtcaccacctcacaggggtcaaatatcagatatcccgcatatcagatatttacattacgattcgtaagagtagcaaaactgaggctggagagatggctcagcggttaagagcaccgactgctcttccatccaaaggttctgagttcaaatcccagcaaccacatggtggctcacaaccatccataatgagatctgacgtcctcttctggtgcatctgatgacagctacagtatccttatgtataataaataaatcttaaaaaaaaaaaaagctaataggaggctgtccttccctgcagtcctgattaaggccaaggacaaaaagcctgctgatttaaaaaaaaaaaaaaaaaaaaaaaggagtagcaaaattacagttatgaagtagcagcagtataattttatggttgggggtcaccacagcatgaggaactgtattaaagggttgcagctttagggagtttgagaaccactgctccacagggaaagcttgtctagagaccccagctgcccagtaagatgtctgattggaacagtggcaggtccacacacttccctctcaaaatagcaaacagctttgcttgccttcaaagacacaggtgtaggaaacagactaggtggctcaggactctacccctagcactagaaaggtagaggcaggaaggccagaagttcatctttagctacattgagagttctaggccagcctgggctacatgaccatttctagatagattaaataaaatcaagtcatccctccattctgagatacactgtctgccaggcccccacggaggaagactaagatggctgtctgtgaattccaggggaccctaatcctgctggtccctctccttgtaaaccttagggttcttgagctggccagcacatccagaaatcctgatgccctgggtaggagctcagtacagccctcttttttttttttttttggtttttccagacagggtttttctgtatagctctggctgtcctggaactcactttgcagaccaggctggccttgaactcagaaatccacctgcctctgcctcccgagtactgggactaaaggcgtgcgccaccacgcccagctaagtacagccctcttaagagagccacacaggttattccaaggcgcagagcagcaccgacatcgttagagtagctggttagaaatgactgcctgaattagagttcccagggtggggctgagccggggttttaacaaccctctgggaggttgagtggctggtaccatttgagcaaccatctctgacccaggaggtgtgaggctaggaactccagacatctgaccagaggtatttcataagagatatccaatttagacactctttgaaagaaaaattaaaaatcttactcattaattataaagtgtcaagaaccaaacagatacaagctgggtcgctttctcttgttcagttggaaaccctctctccctgagtccagagttgtgaaacctactactaccaccccactcatttttttgggacaaggtcacagtgtccttcccctccccacaggcacatgctcggcccccctgtgttgcccaggctggcctgatttcctaggctcaagtgttcccctgatctgagaatgcaactgtgaccaccatgctcagtttcccccgtttctcctttattttattttattttattttattttatttcatttcctcttcttcctctccttctctccttggtcttttgagacaggattttgctatgtaggcctagctagcttggaactcattgtgtagctcaggctgacccaaagcccattgcagtcctcctgtctcaatgctgggattacagctgtacctctccacacccaggttttagactctcattttatttttaaagatttgtttatttattttatgtacgtgagtacacaacactgtagttgtacagatggttgtgaaccttcatgtggttgttgggaattgaatttttaggacctctgctctctccagtcaaccctgctcactccaatcggccctgctcattccggtcaactccacttgctccagcccaaagatttattattctacataagtacactatagctgacttcagacgcaccagaagagggcgtcagatctcattacgggtggttgtgagccaccatgtggttgctgggatttgaactcaggacctttggaagagcagtcagtgctttcaccttctgagccatctcaccagccctagactcccttttccatctggggtcttgaatcctgatacacaaggctggcactagtaggtgctcattaaacatcctcttctactctcccctttcctcttagaatgttcagagcaatggctactgctgttttgatttgtatgaaagctagcctcgttgttcagctacactctatgggagtggccagctgtccgggattatgaattattgtggctcatcctagggcaacctattgtcctgactgaaaagcctataccatagccagagatagaaaaggcagtgcatgaagtcataggggaatcatgctggtaattgagttcatcttggtgatgtgccctgttctattttcttggttctaggatccatcatttacctaccaagataactaccttacttaccatgtaagttcctggtgtgagtggaaaaagataagtcgttctcatgtgtgcatatgccataagagatgtctctatcttttagaaacgtgaacgatgcaggcggctagagggctcgctcggtagctaaaagtgattgctacacaggggcagcaatctgaattcagtccccaggagccatggaaagcaggaaggagatgaccagctgcgtggttagcttctgacttccccacacgtgctgtgacccacacccacaccaataaatatatttctactttatgcgta

SEQ ID NO: 57 - DNA, 5026 bp, Mus musculus
ggaagagtcaaagttcaggagctagaggcgccgggagcctgggaaatggaatacccctacacaaccaagatgctgagttcctccctgagcccgcaaaacggcacctggtcagacaccatctctctgctcttagctcttggcgttgctctctacttgggctactactgggcatgtgtgccccaggtgggtgagggccgagccatggccggcgtgcttggggtactggagactatgagggtattctccagcctaggcttgagccctttctgaaagcttgggtagttggttctgcggcgccatgtggattttgctattgcgacctactggagagctggttctgcctcttttagattcttggaaccttctcccgacagctgggtttttttgagcataggaagggtgctccccctatactgttgactgacttttggataaaggtggggtggagggtatcctcaaatttcagaggtgaaggatttctgctttgcttttgcttttaggtggtctaacaaaaatatgtagattatgttcactagctgtacagaatagtggaacggatgcctgtgtggttctggcaccgctccgtcagcttagcaggccctcctctctcttgaggactggctgaggtttctgccaagcttaggacagatggataattctctacactcagtcctgttctaagttctagcctccttgtgtatacagtgctgagaagtcttaacaggtcaatttgatttggtcaatctgatcaaacggaaatgtagattaaaataacacaatctacatatccaggacagctaaggtttttaatctcattaaaacctacttaggtaacttgagtctaacaagaaagctattgattcaacttgttataaaagatctctaggggttaaatgcttactcctggctactgggaaggctgagacaggaggatcacttgagcccaagagttttgcgccattctggcctacaggtaacataacaaggccctgtgcccatcagtggggtcatggggcctgtttctaagacagccacttgtagatgaaggtcatgtaaattgggagtgaagaggtgcttgaatgcttacgggcagccaggttctgttcctggcaactacatggcactcccagttcacaactgtcagtaacaccctccctggctttcaggcatatgggtagtgcacaaacatgcatgtaggcaaacactcccacatagtaaataaaaataaatctaaaatataaatagcaaaattgaaaatgtttaaaatcacataaaatgcttactttacataatacctggaatgcagggagcatccactaacttttacttacaagttattattgttgataaccataattactaattttgctttgctcttgtttgctctgtcttggggcagaccaactaccctctgagagtcataattcctttacttttatcaaataaggttgggatttgtctccactatagcacagtgatttcattgttgttatttcagggtttaaggaccagggtccaagtcacaagataaactgggccttgttagtgtatcatttggctagccccttctgagtagcatggctgtaagatagaacaggatctaagtttcttacaagtgcaatttatgattaaaacaaacaaacaaacaaacaaacaaacaaccttctccaatgctggagactgtcccgggcttgctgtatcccaacataaccctcccattctgctcttaggctggcgtcctccaactctgttcagcccagtgtccttaggtctgtgaggctaggccagctcatttacttcatgccaataaagaaccaagcgaagaggcagaagagagtcagggcttggtgcccatcaacctcgtttgtccccattgtcccatcactgtgcccttttctctagttggcacgaggaaaggaaatacttgttcacgttggggtgcttcctcctgtagaacacagcctaagaactggggctccacaagagaatatgaggtgcccctgtaaaagaagcccttcagcactgagcacacatacattagagaaatatgtagacactggggtgctaaaatcagtggggtacaggagctggagtgacccgaatgagcttcagggtgatgcatttggacaaggttgctacaatgcaaaggccagattgaatggcagaggtatcttcacctggtcaagagtcccaaccagcacaccaaggtgacacaagcctagcacagaggcaggaggattacgatgagttcaaggctccaaccatccaggccagatgtctcagccctgaagagcatatacttctgtccctgcagatcagtttgtcccagcttccatgctgtggctctctcagctacctctaactccagctccagaggatccaacacttcttctggatctcacaggcaagatctgacctgtgtgcccatgctcataggagaggcacataattagaaataaaaccaaaccagacaaaaactccagtttaccagccagaggagcacaggccatactctagctgctcacctgagcggcttatagtacctgttctagcacaagtgggtttgaggaggggacaggctgagtgtgggagtcagtacctcgacaactgctgcagtccttccttcagggtcagtcccggaggggacactttaggactgtggtttttgtggggcaccatatgccactctaggctgagctgtgctggacacttgactgtggcaaatccatccttaaggctggattccggggaggagctcactgaccctccagtgtctgggacaggacaacaaaagaggccaatgtgttgtatgattatagaggcctcgtctggtggctgggccccagtttctggccttcctggaacaacactgtccagtcactgtggagactttctacccgacactgtggtgctttgagggacggctgcaaaccatcttccgagtcctcctgcagtctcagcctgtggtcccttaccggaggtaagaagggtcaggaccaggaacacaaagctgcaagtctctatggtccacctctttatatgacggtaatctttgtcccaaagcatgagcctatatgtatggaaaggctctctacttgcacccacacaaggttaatagtccaatctagctggtcaccttgctgttttatatgaagcgtgccttcaagtgatacccatgacaaacagcagagcttgtgggcgagtcagagggtagagctttgacatgcagaagtgcaactcctaataacatctttgtgttgcaatctctaaaccccagtgaagtcctccagaccccagatggaggccagttccttctagactgggccgagcagcctaacagcactcactacccggaccctaccacccagcccatagtactgctgcttccaggcatcagcggcagtagccaggagccgtacatcttacacctagttaaccaagctctgaaggatggctataggtaaggacagggtacagaacttgggaagggcaaaagtacatctgaccctgatatggtactctctgacaggggcctttctgaagactatcaaggggagggtcttcttgggagggcttggctcacactcctatcttgccccagggctgttgtatttaataaccgaggatgccgaggggaagagctgctggtgagtaccctcctcctttgtggtggccctgtccctgttccctttagagaccactggccctagggctctacctacttaccaaccccctacccttcctgagcccttccgcttggctgtcttctggcaagagcctccctccctagtcaatgacccgctttgccctcagactcacagggcttactgtgccagcaatactgaagacctagaaacagttgtgaagcacataaaacgtcgctactcccaagctccactgctggctgtgggcatctcttttggagggtaatagttgcctgggtttgttcatcttgtctttttctcctcttctgtcccagtgttcccatgccaacactttccatggccctgcatccaattttacaggatactggtgcttaactatctggcacagactgggaaggctggaggcttggtcgcaggactgaccattgtctgcatgttgggattcctttgagaccgttgactccttggagaccccactcaactcactgctcttcaatcagccactcactgctggactctgccggcttgtggccaggtaggatagcagatggcaggctctgccagtgcttgggtccattccaatctgggctttcttgaggaggtaagaagacagaagctgtgagctctgggttaggtgcaggagttcagacaaaccctgatgtattcttttccaggaaccgaaagccaattgaaaaggtgttggatgtagactttgcgataaaggtatctttcgatcaccctctcaccccagtgttggtctcctacgttctaatattatagcctaccatgcctctaccacacaggcccgcacgatccgccagctggatgagcgctacacatctgtggcttttgggtataaagactgtgcggcttattaccaagccgcaagcccaagaaccaaggtagatgccatccacacccctgttctctgcctcaatgcagcagatgaccccttctccccagtccatggtgagtgcctgcaacgaggtcctgatcccacagctactgagccatagatgagggttgaggtatgagcctgggttctcattcccggacagctttctgacctcctgactcccttctagccttccctctgcaggctgcccagaagtctccctatgtggccctgctcatcacagctcggggtggccacattggcttcctggaagggctgatgccctggcaacactgttacatgaaccgcgtactacatcagtatgcccgagccatcttccagcactcagtggggctacctgacctgggagtactcactcctgaagatggaaagagctgacaagaggactgctgggctctcggttcaattgttctctctttattaaatatcaactcttcctgcctaa

SEQ ID NO: 58 - DNA, 21588 bp, Mus musculus
cagactcttttatttctcttttatttcagttctcttttatttcattgaagcacttgagccttgtggagcggcaggggaggctcatcttctgaagccagcaatctattgagggaagctgcctgggttcctggatatgagtcacacacagacgggtaaatacttgaagagccaggagaacacctgcaagggagacaccagggggtcaggagaaccacgctgacctcccagtaggtcaaaggctgactggtgacaattatgcaaacaagggctgcccagtacctaaacagaagtctccgcctaaaagaaaaagaaaagaaaacagtttgccggctctaccctaagccactcctaggaaccactggcacaccctgtgtagaaaacaacccaagctggccaggggccagcctggggtgcgtcagccgacctcaggtaggaggtgtgagctgttgatagtggtgattccagcaaccatgagtcactccgagacagaggggaaaatagcaagctggctccaggaccaggtcccgaaagcttgactgtcaggatggacacaccagggttctctgctccaggtgtctgtctggagaggaggagagtaccccgcagtgagaggggcacacagctccagggtgtagcgagggtggtgagaaggagaggtggctagcctcgaaccacacagggaagagttgggaggagtgagctttgcattgctaccatcccagggtaggagggaaagaaggcaggaagtggcttttgaccagaggggggtggggaatgtgggggatgggggaggagcagagggagaacgggggggggggggtgcagaggggtgcaaaagctgagacagccagtggcaggccctcataaccctaccaggtgaacaggcaccttgtcaaactttcctgtcagccctcaagagctcaacttcacaatccaatgaggcttttaaaggagaaagtggaaaaacagtgttttctattctgaggctcctggccctggcattgccatctctgtgctaaccactattcaagacgatttcttactccgtggtcctcaaggtttctgacagccttgtgcttcttgggttgacctggtctgaagtcaagaaggtcttccctctcactttccctgtcccccaccctctgcctaggggcagggttctttgggaaggatgagcaggctccagtagatcttaatgggcatccagctggcacagggcagaggctcagtgtggcccaacagagggtcaaggggaacagatgtgttgctcaacctctaaggactcacacacccagcccacacctgtgtgagccatttaaatacagagagcaccctgggcctgcagtaacctgcctgttctcaaccaaagtccccctgtgcaggtacagagctaggcgctcaagtagagagaatgacggtgatgggtttgtgccagccattggctgcggaggaggcagggctgtcagctaccaggagctggacagagaagatgctgtagggatggacagagatgcaggggatggtggcagaacatatagacagaagcatggatagttgatgatttctatagaaagatatgtagatgatagagagattcatagattatagctggatggatagttgataaattacagattttggacagattaacaaatggatggataacataattaatatatagacaggtgattgataaatgatgaattgatgacaggtagatagggcatagataaagtagtggttctcacccttcctaatgctctgaccgctttaacacagttcctcatggtgtgctggtccccaaatataacattactttcattgctacttcataactgtaactttgctactgctgcagatcacagtgtgaatagctgacaggcagaatagctgatatacaaaacccccaccccagcgggggtcgtgacccacaggttgagaaccattgaggtagctagctgctacacagagatggaatctcacttgttccacagagctgactccccgcctcaaggccacagtgactcacttctgtagcacagttataggctgaaagctggagtgaggttactccttcctagccccagccctcctccactctcaggcctttccctgtctggctttgaaagctcacccatatgtcacctgttggctgccttctcaccagctaagaggagaactggagtaggtagggcaatgctctctctctctcgctggggtgcaggacacactctgagtggtaaatctgaggctctgaggggccattgtatatactctgcttggagctgagttccgcagcagagaaacagagaccaggctctagagctcatccccccaaccccaccccacgatctttctgtaaaccagcaaagaacatttgagctcaaagatgaccccccccaaccctgagtaagactctcagccaccacagccaccacccagcctcacagtggagcctgcatttcactaagtctcttggaaggatgactggctggcgcctcccggtccccagccccatgcctgctttcagaccacccagagtgcttctccaaccccactcctcagcccacccgcccgccccgagcctccactaatgggaatccgctggaggagtagcttaccacgaaacagccttatgatcccagggtcctctcaaggagccccttaaaaagccagaggcaccaactgaccggctacagtcagggctgtgttctgagtcaaccccagaggaaggcctttgtccctctgctttcccaggcctcctgctgtgtgcccttggtagctgctggtattgtcttataaagcttgtccctgtctttgtggacagggaaggagtcttttcatacgtgtgttcatccccaaaccccgggaggtggcggtctatgaaagataccactggacatgctggacacagagcctgttccctccctagggcaataaaaaatgtgtgtgtgtgtgtgtgtgtgtgtgtgtgtgcatgtatgtggtgtgtgtgtgcacgggcactgcatgtgaaagtcagaggacaacttgggggaatcagctctctccttccatcatgtgggttccagaggttgaactcaagccatcaatcaggcttggctggcagcaagtgcctttacccacagagtcatcttgctagcccactctggggacttttaaaggggtccaagggaagtgtgtcacagccaaaggcctgaagaagaaggggagaagcgtcaggatcctctctgcatgcccttgggaagtatcgcctcctctgtctgcttcaccaaacctctgggaacctgtctgtctagacagggggctgtggtgacaaagcccatccatcccacactctgatcccaatccccacactggatgaacagctggctggcttgcactcagcactcagagctgagccttgaacagtttgttttgggtgagtgacaagcagaaaccaaaagtcaatctgtttgttctgtgcctggggactccagaggctgcacaagttcagagaatgaaaccaaagccaggcttgcgttttagagcatatgctataggacatggtagatagcaagtgagtgacaccgagggctgaggagacagctctgtcagcaaagcccttgccttgttagcatgggagcccaatgttggatccttggatcctgagaatccacgttgaaggccagacacaaggctccagtttgtaatctcagcactgagaaggtggagacggaagcactcctgaggcttactggccagtttaacccacttcttaggcgaagttccagcacaacaaaatgtgagaggcactttgtgaacgacagtcaaggttgtcctctggcctccatacacatgcgcagatagatatatgcacacacaggcacacagaaagtggggctggggagaaaaagagagggatggtcagaagtaatggaagtgcccagtcgtaggggacccacaaaaactgggggcagcggaagagtttatgacctttataaaaaattatatatataatatataattttttttcatgagaaggaggagctttcaggagacacaagaacacaagattttgacagggttcacacagtgagacagtgagatccgccttgccagttttgtataagcgtgactccctgcaactctatatttcagaatgaagtgtgagcagagatgtgagaagtccctatatcaggatccagtgactgtcatgtctctgcctgaaatttgtattttacagttttagtcacctttctaatcactgtgacaaaaggaactggaggaagggcttatctaggctcataggttgagaatacagtccatcatagcagagaagacatggcagcaggagcctgaggcagctggtcacattgtatccacagtcaggaagcaaagggagatggatgctggtgctcagctcactttcatcttatttagttcaggtcccccagctcataggacagtagcaaccacactcatggtacatcttctttcttcagttaaccaagtctttaaaaactggcatagacacacccagcaatgttgctgttgtgattctaagtcctgccaaggtgcaaatgaagatacaccatcttgcctatgtcttctgtgatggctgtatgtgaacggcagagcaagtatgtttggtgtctctgcttgctcttattggtggtgagaatccaggaacatattgacaaagagaaatggggaccaagtcaaggcctcactcgagtgcaaacactgctatagttggtgacaggtctgtgataacatccatagccttatagaagtcaataacaaccacagccttactggagtccagtacatgccaccatcagtctgcttcctccatgtatcatgggagccccagcttgtcctggggttccatactggacatcttcaatgatggacagatcattcctcacagggagaacctactgaggtgtcatgcaagagttcagagaggtcctggcttctgtggccccagtcgtaggttgcccttttctataatacaaccccaagccaaactccctagacccagcctgacttttccttaccctgatccccacatacctccaccaccaccaagcttccaagactgtgagcacaggctgcacctggccttgtctctttgcacccaggagcaggctgctgagtctctgcccctattctctggctttgaaatagccatagccttctttgggatctgtggggtgaagggacacagagttcaaaaatgacactgggttggaactggtctctcaggaacaaaggcaacgcaaagcaagagcttgccagactcctacacatagcattcttttgcctgtctgtctaagagtctgtgaccttccagccctggcctggatagcagagatacccattgcttatggaatacattcgaatgggagccatgcatcaaggaggcaatactctcaagagctagtcagtgtgagcgtgaggaccaggtcaagagctcagacggtaggtgacatagacgggagtggggggtgaggggcggggggcggctaaaaagaacctgggggacaggctgagctggaataccatctccttcatctggctccccagacacctcccttatccaccaacacacacctctagcgatatcaatatggctttgtcaaacacattcttattttgcaactcctcaggagagcaaatgatcacctgcagtgactgggcccatcagagatcttcggtgcctttcttctgatttcaattttaacattgactaggggagccagcagagggtgtccagaagacccttctgggttgacccaagttctatgaacactcacaggtgcttcctatctccaccaaagtcagccttgcctccagcatcaaaacagagacctggaggtggcggcggggggggggtgggggggtggggggtggtgcatctcaagggatggctcagaggttaggagcactgatcactcttccaggggacagactcaattcccaacacccacatggcagctcacaaccgtctgtaactccaattctgggggacctgatgccctcatatagatatacatgtaggcgaaacatcaatgcacatgaaatagaaattagttaatttaaaaacaaaacaaacaaacagaagcccagagacctgttttgccctcagtcactcaggtccccataccagcactagcctgaccttgagggacatgaagccagtcaggaagaaccggtctcttccacacagataagcaccccggagtcagacgtctgctctcttccctcactgtcttcgccatcttccttctcctggaagaactcaggatactggggcctggaagagagagaagagggcatagaagttgagagtgttgattctgccaggggtgaacctaatgtgagagtcagggtggaaatatgtgcttggcgatttcagatgctaccctccaaagcactgggttaaggaggccactatagattctggcatttgcccaggccagcatcctaaagggagcatgctcattcctccctggcatccatgcagtctgggcctcccacaggctgaggggccagggagaccaccgtcttcgctgaggtgggaagaaccttgcttcccacacagtaattaggcttcccaactctgccctatacatataattacactgctgcccacgcagggaaacagaggcagaggcccgagccttctctgttgcaactggggcatggtccaggcaatcttatctcactgtctgactgggtacagggtcaccccagttgacccagggagttcccacatccctggtgactagaatggatgtcatctgttgtctgcacagaggccctgcaggcatgaagagggcccagtggagtcccagggcttgatagttgaatctcatctactgggcacagcagctccatcctgtagttagacctgggcctccacccgatagtgagaactttggacaagctgaaacagaagctctggtttttatgttaaatagtggatcctttgaaggtcactagaggtcatgaacaaattcacatttctttaaacctctgtatagaacaaaggagagaggtagggtgcactgggcctttaagaaaggtactgcacacctttaatcctagcattcattcaggaggcagaggcaggcagatctcggtgaattcaaggccaacctggtctacagagccagtaccaggacagtcagggctgcacaaagaaaccctgtcccaaaacaacaacaacaacaacaacaacgaaaggaaaaaagaaaagaaaaagaaacagaaaagatccagggctgaggggtgtaaagctaaagtcagggttagaagtattctagtattctagtattctagtagctatcttttaaaaattacatttaatttacctgtgtatgtgccctcacatgtgcgagggtgtggtatgcatgtgtgagtgtgtattcgagtatgtgtgtgaatgtgcatatgagtgtaactgtgtgtgtgtgtatacacctgaatgcaatagtgctgttatagctactgtttaaagagcaaagtggtggactaaggatgtagctcaggtggtagatgcttgcctagcatacatggacccctgggttaaatcttcattaccacataaactgggagttgaggctgggcagatggctcaggggttaagagcatgtggtgttcttgcagaggacctgagtttggttcccagcacctatcttgggcaggtcacaaccactccagtttcagggggatctgatgccctcttctacctgggcactacacttatgtgcatatacccccacgcagacaggtatgcatacacatagatataataaaatcaatctctaaaaaagaaactggaagttgtagtggggggggggggtctgtcatctcagcataggggaggtggaggcaggaggatcaggaattcagtcatccttggctatatagtgattttgaaaccagcctgggctacatgaaaaatcccacaagcaaacaaacaaacaaaaaaaaaaagtcaagagaagcgtgtaaaacaatactatttaacccaataaaccaaaatattacttaaatgtatatttagaggaaatggttaaagacctgttcccctgggtgctcgatacagaggtgatacatcccttggtgtcttttccattcctgggtgccctgtattcaacgtttccccgtccacactgggctcattctggaagacctggaaccaaaggtccagtcaggatattagaggccctgagaatcagtgctcaggccagaaagtgtgctttctgcctgtctcaccaaactgctggacgccaatcccagcacccacccacccccaagcccttttgcattcttcatcaagatcataccagctggccacccccactttggctctgcctctcagccctctccctccaggattcccagaatcaactcctgcagcctccccccaacatgtgatctcagtgcctcaacacagagagtcacctgtgctcagtaaagttctcttggtggcaacagagctttgagtgacaggatcttcatacatcctgcatcccacatttttgctcagtcagaggggctctcattacctttccagtgctctgtttgagccttgtataggttctccccagatatctctcctatacccccaaaccaagccagatcacctcccccagccccaggacgttcctaactctgcagcacaggtttgctgcataagcctcagaggggaaattccctttcctgccccagcctgcactttttgagctccctttgaggtctgtctggtgggatccctggcaatggtgcttgttgccattcttggtttgctctaaaggaaatcaagattcaaggaaacaaatccattgcctggtccatgagctctggatgcgtgggttcagaccacggagctaaagttatcagtcaagaagtccacaaacaagaaaggttaatccccattggccctgatcgcctaccctaactacatgttaaggccctactgccgggctgaagagatggttcagtggttaagagctctgactgttctcccagaggtcctgagttcaattctcagcaacaacactgtggctctcaatcatctgtaatgggatctgatgccctcttcaggtgtgtctgaagaacagctatagtgtactcacatacataaaataaataaatacatcttttaaaaaaaaaaaaagaaggaggaggaagaggaagaggaggaggaggaggaggaggaggaggaggaggagaagaagaagaagaagaagaagaagaagaagaagaagaagaagaagaagaagaagaagaagaagaagaagaagaagaagaagaagaagaagaggaagaccctactgctacagacaccacacacattggttagcaggtacagagaaatcaaccttgaagtgaccaggaaatggttgcccagctagctagttttcatagcaccttcaactttgatagctatttttcgcagaaggtactatacaggctgtgtgggaaaatcatcaaaggttttacgtagccttgggtctactaggcaagataaacccattggtgcaataatgacaagactgtttatgaagtaaccaacctctctcttgactgggttgtggcctactccacaggaggtaattcatgtttgtcactgtaaacatggtcaaaagacatggccagggaagtcctaggccctaggtggagacactgataatgattttctaaactttcatgtcgtcaaactacctttagaaggcagtggttatttttatacccatagatttgtgctgctcccacagagaagtttcttattacggtgggtagcagttaatgaagagactcactagggattccatatcaccctccctcatggctcaggggacaccatgaaagaataggtaggaagcattgtaggagatggaggactgggagagagcactcggagctcagcagtggggaccctagatgacagacactctgtaattacaaaactaggaagtggtcctactgtttctttctggggaaactgtgcacatgctgatgttataagagcccagcctgtgggctggcagagacgtgattctcctagaagcaggagcagacagatattcctgaaagatagtccaacctaaactctggaacatcactgtccttcaggcaaagcatgttgggaacatttttttcttcttctcccgtgcattccattgggcacttaaaatctgaggtgccctcagcctcctggcttcaataaccacatcaaaagcctttgcagggatatttctcctctgtgaaacctgaagccataggtgacctgctattatgtgggtaattaggccactccctgggcccagtgaatacacacacaggctgccagggctagaaggaaacaggtgcctccctaggtaggacaccagtgacccagctccaactctccaccctaagaaaaccttacttcaaacctcagatgactcctgagggagctgcaatggggtccaaccatgcattcaaacaggggcaatgggtgacttcctggactcagtcattactctgccacagcagctgaccccaacaaacactcaccccacagtaacagctctgtggttattaaagggatagtgtgcaggagtccttctttggaaccattcaaatgtcataatctgcccttggtgaccaaacctagaggaccctataatgcctgttggtcaccagtccctcagctccactcaggtgtctgtccttctcccagaacacatcccagctggtctacgacagcctctgtgctcttacttccggtcatcaaggtcattgtatctcctctccattcccaatggacagacactgtttgtgtatttgatggcaggagcaatcgcagcaatcctgcggttcctcaagaggaaaggaagttagcccaggctaagcctcataggcggaaaatagcagcgaagcagaagaaatgtagccaaatccttcacaatgttttcagctgccatgtaactcagcccggaagcttttctggctgtggccatgcagttccagctaatacctacctgctgttgtacactgccattatagactactaggatttgagaatcttcaccccacccccaccccatcttcctgaatgcagtgtgtctaagaattgcttggacccaatgacacagataaggtccacccagagatctctgaaaacatgaacacaggaagagttccagccctcggcctcccaggctcacaccagactgcttcagcaaaggggcagaggaaagagaggcaaagaagtattcgaggtgagcaaccagggccgtgaatgaggcattgggagtccagagactggactcagcctgcctctctctgaacggtctacacagcaggaagtgtcacctttgcagcacaaaaagtccatatgggaagcatagctgaaacctggaaaagaactcgatatccatggattttaaaaacatgagccagtgacccagttccttccataatcgatccttagctagtgcctctgaatgacgctgatcagagagcaccagtctcccactaatgttaagatcatcaggccgggtggtggtgcatgcctttaatcccagcacttgggaggcagaagcaggaggatttctataagttcgagggcagcctggtctacagagttagttcgaggacagccagaattgctcagtgagatcctgtcttgaaaaaacaaaaacccaacccaaaccaagcaaaataaaaacaaacaaacaaaaaaacaaacaaaaaaacgaaatacccaacagcattggattgtttcctgtgagttaatatggtagagtgtagtgaaccctttccttcccaggttggtcttggtccatgttttatcatagcgactaggatgatggacaggatattataatcagataaagttattatggtcgacggagagccacctgctgacacccctgtcgcagcagggtttcatttcttattgctgtgattgaaaaccagacaagaagtgaattagagaggtaggatttctcttggctcaggttctgagcacaccggctatcgcgttggtgggatcaacacagtgctcacatactgacatttatttaggaacagtagagcgccaaccgaagcacaccccacccccacccgacctccccattccccatcccactccaccccacccacctctccatactctaaccctccccacctcatcccacccacctcctaacccctgccatcaccccagggagccaaacagaaccctccctcctcaacccccaccccatgtatcccttaaggccatgcccatgagactcagttcctctaatgacgtttcacctcctgaagactctataccctctcagaacagtgtccccaggaggaggttggcggacaccagctggatcagcacccatccctctctgtctcctgtctgagtaccctgtgagcaacagcctcaacttccagacgctgtgcctttccctccacagtggacggtgtccccgagctgtgaggcagaacaaaccctttctccttgagtcgggtgttctgtcccagcatcaggaagagcaagtggtacaactagaacatcagcatgaccacggtcctgtttccagcaccaaaaatacaaatatggctgccatgctccccgtgggtgggtgggtggggcgagaagccatatctcaggtctctgggtccttgggtgaggttgaaccccccataggaggataaagtccccgagtaacttccctctttcgccatgaaacccagatccactcatggggccttcttagtacttattgcttgaggccccatgcctatgacagtggcctctacctaaggttgatgagcaggccggtgcccattagcctagccccaggtgcttacttgactggctgactggggatgacagctagccaactgatacctagtgctgctggctgtcacacctgaggttcttctccccggacaagtaggcatcttggcccccatctccagtgttaggtgacagctgactgcccagacttgctaggcaagtcctggctcacttgtctcagtcccagcaaactcagctgcctctctgggctggagaggaatctggcatgactccctcactctgaagacagcagctgcagacttcacagagctttccttccccatcctctgccctttggctctggtgcccattgggcttctgtgctgggccctgaacaactacaatggagaggcagcttcaaaggtctgcccaatgtgttggccatctgtatggcagggctacctttaactccagaatttcagctttccgatctgatctgggggacagggtaacaaaagcattgggggcagagaggtagaggcatctgggagatgggtccatgggtaaaacagcttgctatgcaagcacgaggacctgggtttaaatccccaggacttaagctgagcatggtagagtatctaccatccagctgtcccacagtgagataggaggcagaagtagaattcccagaagctcgaggggcagtgagcttagcattcacagaggcaaaacaagagaccaccccattctaccccaagccgtctcatattaagtggaagacaaagacctctgatctccatatacgcaaggctgacttcctggctatctgaatagcccaacctacaacagttgatgttttgacctcaggtccagagctcacccagccttattctcagctgagctcttcctctgtcacccctactccgacccaggcatgatttagcagccattgatttggaaagactggagccaggtagaagtatacatcactccagagcctggagagctctgcctttcactcagaaagtcatcacaggcccaccaaacctgccaatgaggcctaagagtctctctcctgtgctgtttggatttttgtcaattagatacaagctagggtcatctaggaagagtgacacttccttgaaaagatgcccccatcacattggaccatcgtctagggagcgttttcttcatgattgatgtgggagggcccagccctttgtaggcagtgttatccctagccagatctgggcgaggtggcacatacctttggtctcagcactcggggaggtagaggcaggcagatctccatgagttcgaggccagcctgatctgcaaaggcttcctggacagccagggctacatagagaaaccctgtctgggtgggagatgcagggagcaaattgagcagggcgtggggttcaagctagcaagcattatttcttcacggtctctgtttcaatccctgccttcaggttcctgccttcccttcatgacaggctgtaagatgaaagaaacctgttttcttccccaggttgcttttggtcgccgtgcttatcccagccacggatgacaaagtaagccagaatccgcaaacggcctctgctctgcggcctgttgggattcactctttccttgattcgtttccagtctgatttctttgaccacccagacactgctgggctctagaccagtcgttctcaacctgtgggtcgtgacacctccagggggtcctgtatcagctatcctgcccatcagatgtttccattatcattcaaaacagtagccaagtcacaactgttttaaagggccacagcattcggaaggtcgagaaccgctgctctagacgaagccctgaccagcaggctgactctttttcccaagtccgtgtggttctctctcacatgatgctctctttggctccgatgctgttcctaactgccctgcctaggatgcagctacctccatccatctcctttagccccttggatctttccactttccccattctcccagcatggaagatccactcggctgttctccatgctgacatgcctaggcccaccctctacctccttctggaggccgtagtgtgagactacagagctttctttcctcaagcatcttcccgggatccttcctgcccgcccgcacccccccccatccctgagaagaacagagaatgacccatcagcaagccaatgggttaccccgagaatgtgacaaagggtgaggctgtgggtcccaagggtctgcagatagagggacgagccagcagccttgggtgcaagaccaggccttggagggtatctctaccttaccttataccacagagagaagtctggctcccatgttgccctgtggatgaaggtgggcaggccgagcacaagctttcaggaaccattgaattcattgtgaggctgagctggatctgcgtccataaggccaggaggggtaacagtgtcagaccccagccccagagggcgctctgcggttgattcagtagccaggagcatccagagagctcttctggggcccttgctttgtctcccactctgcaatccaggggagatctgcagccccttttccttggcaacactcaagacagaaagaggaagctacatgcccagccacccacggggaaggagattggttccactcctgcatgaggttgtcgacgaagtcattctgccttctagcaggacaatggagaattgaagaaagagggccgaagaaatggctcagtcgttaagaacacttgctgctcttgcagaggacacaggttcagtatcccaggacccagatggtggcccacaaccgcctataactccagttccaggagatctgaccaccttcttctggcctcctaggccaccaagtaggcatgtgtacaggtacagttacaggcaaacactcacacactcaactagccagggagtctgctggctagtaaatcccaagtggccaagtggcctgcttctaaatccttccttgtagctgtctgatattcactccatcccaagtcttaaaaaataaataaataaaattgacgttattaccttcattttaatgcagagggaacagaaatcagatcagagaggttaagtaaccagcctaagatgccacagctgaggtcataaataaacatctctccccttcaatctctgactttgaacagccctcttaagagactgtagaacacagatgcttctccgtccaggaggaacgatgacagctccacagggtctgttcctggaaaccccagctggctgctgacatttcctgggtgcatgctgttccgaggcagatgtcacccaggacccctgaaccagatggggcttctcagatcacagctataacgtgactctcgggactcagtttcccatctgtgaaatgaagaggctccttcctcatcttgcttcagcagttcctgtacaatcaagtatcttagtttgtcccaggagctcagtaagtagccggatgtaccaaaggctcgctgtccaagtgactcacgttggcttttaaatgatggatttctgggattctgtcttactattagtttgctgtgacagactaaccaacaagaagcaactatgtaagggcttatttcggctcacggttgaagggcacagcccttcatggtggggagccacagtaacccgtttgtgaggtagctgctcacgttgcatcttgcttcagggcagggagcagagagagagatgaatgctggtgtttggctcactttctccttttttcttcagtcctatggatggtgctgctcacagctagggtgagtcttccaacttcaattaacctaatgtgaaaactcccgcacaacagcagcggcctgaggagcgtctcctacatggtcctggggcctagagagttaacaataaccatcaaccaggatgatgcccgggttatatttactgtgcttcacaaactgtcatcttggaaacagccttgtgcctggccttactagattggatcttatttttcaggtaagaaaaccaaagcccagaatccggaatagctcagccctagtcaggtggctctagaccagcggttctcaaccttgctaatgctgcaaccctgtaaatacatgctgtggtgaccttcgccccataaaattattttgttgctacttcataactgtaattttgttactgttatgaattgtaacatcaatatcttctatgtgggatagctgatactcaacctctaggaaaggacccttgggccttaaggggggggggggtctcaatccacaagttgagaaccaatgctctagaaagtggtagagggattttcagacccagtgatggtaggtagagcttaaggttgccccagctttgtgtccaagttccccccccccctcccccgtttactgtgtcagggaggatgacggaccagtttccagactaggaaaacccaggtactgaagaaatgaataaagctgaaagaagcagcggtagctggggtggtggacaaagaaaggcactggcctagcagctgaggggcagaggcctcagtcgcatgagcccatggaataactgtagaagtggctgttaatttcagcaaactgtcttccggtgtcctctgggacactaatgcaaaacagaatcacgtttgcctgcttcattttgtgaggtaattctgtaaattttatttacttgtttgtttatttatttatttattcgtttattttatttttttaaattaaactctatatactagggtttaaatgctgctcacatggggggttcctgaaagccctggagggggcacacgtgggtctgcccgtgttttaaacagaggtatctccagcaatccgaagtcacttagcctggtgcactttacacctttttaaagattattccccactgccctccccatccccaccccgacacatttgtgtggaggtagcagagacggaaaaagctgtgctgtgtctttaaacagggaggagcgatcagcagaagcctgggctgtaaaaaggctaatgcgctgtggaagagtaggagtttaatctaatttagttggagggtgtctgtctgcggtgttgttttttggagtgtgggaacagaggaggggagctgcccccttgaatggtcccttctgcgccagaagcagtggggagccgcgcgacgccagcgatccaaggcccggccttgaaagaggattaaagcgatgcttgatttgcaattcacacgaaagcgccccgcgaacctctggtaatatttcaatccacatttcaagggaagtggccttaaaatagcggcctaaattgttctgccgcggcccggacactccttcatgcattttataacgcagagggccaagggccttttctctctgcgcctcaccacccccaaccaccccgtatcttacatgtgctgaagtgtaattaaaacttgttcttaagtttggggcaacctacactgctttgtggtatgaggtgtgtgtgttttatgcttggagcatatgtttgtgtgtgttaactaaacatcactttggatgactttaatatatctcctccgaaagggggggggggattgtgaggcagtcgtggaaccaagcctagtgggttggaaaactgaattctcaatgtgtgccttttaaagagaccattaccagtaagcagaccactttccttactgtaaggaacagtttggaaaatgcaaacagagatcttaagagctttccaactggatccgcaaataggaaagttctagaaatggccttgaagctaccaagacaaacgttaaggagccagctccctggttcatcttcaggctgggagacaggatgttcatgtctttctataatctctgcccataccccacatgtttactcttgcaattagcttgtaacaggctaagcttctggcttaatttttctttattgtaggagacgaagtacttttttttttatcttaaagagattatttgggttctctctaatcctatttcagaaacccctctcaagactttatggttccttcacccatactgaggaaggatgcagctttgattaccactgagacccatggcagagaatcttttctttttttttttaacttctgactttaccaattaaacagggccttcctttcaactccccaccacctccaaaattatttaactcaagacaccatctgactcttaaagagtattccttccagaataccttgcactctccttggtagacatttgcaagaactctacgctaatatctacagacagtattttgaaatctcacgtagatagatatattaggagatttggggtccaaagtaccctttgctctaggatgctatttaaaatcatgtttaattatcaagtttcattagaaacccttgctcaaattttgagaaacctaataagatttccattaatttaaacatagctctattcccaggccagtcccccccaccccaccccaaagctttctcttccctcttttatccctggttaaatatgtaaataaaatgtctaaagtcgttcttcaaagaagacaaaagaaaaaaaagagccgaggggagagagacagccataaaattcctcccagctctccataacgcttgccagaggggggccggtttccgagccagggctgagcagcaggggacccggctgctctggagtcactcgtctcaaatcccacacacaggagagagaaaaataaaatatcttttcagctggagccatcaaaggggtcctttcatttattagcgttgccttccactctcgctatctcggggcccttatttttagatactaatgtctatttgttgctttcctttctttttctatactaggttgggcagatggaagaaattctgttagctttttcttctcttaatatattttaagggagtcccgggggttgggggagagaagaaaggaacgtgaagtgatcatagctaaaataaaaggtcggaacactgtagaagtaaccagagcataaaagaccaattacgtggggcagtctcaaatagctcacaccctgctccggagctgagctcacccaggctacttccacgccccccacgccccaaggggcgggggggggagtgtggaattagaagagagagagagagaaaacggaaggcaaaagtgtcaggaaggaccccttgcaaactagtctgtcttaaagctaagcgatagcccaagaatcttacctgacttaaaaggttttggaaacagcgtactaaactataaatatctaagtaaaccatccttatccaagccgcaagcgttcaccacaccgcaggtttttcttgggtcactaacacggtggtgggtggtgattctgactgtgttaacctcagtcttccggaccgctgtttccacggatccaacttcctcccgtgaaaggcagaggggaccaggggatctaaaggtgaggcatgagcctgtgcacacccctccgccccccacccccaggactcagcaggtcctgggagtgtcccagcctcaggtctgtccgctatgtctgacaaatgaaaggggggtaaagaggaagaactccctgcagatgggacgctgaagccttgttttaattagaagtcgatcctctgcaggaagcgcaaggcagggcggggaggaggggtcctgggtagcctcgttcctggcttggctggagccactgaaggcttccaggcatctgtgcacccaactcggccctggggtgcgcaagactgactggccgaaagatgagcaggggacttagctgcacctatgcagttgggggagtccgcactggaggtcctggtagtttcccagacacttaaaacgcagacctgaatgggggtggggtggggtctaaggagagagtgggccaccgccctgagggctgtttatccaaagccaagagtccgcgacaggtgccgcaccccagatctctcggacatctaaggactgcggtgggctcccatggtgcactcactccctgtgcgggggaaggaggttgaagctctgtgtccttatcacagattagcccaaaaccaaccaaggggcaggagccagcatagcaaggcacggagaggccccaccactctgcgtgggaaccagccgtgcgcgtgtaggccggggctcagcctccgcctcccaggaggacgcaggccgagcacatctttcgccaaataatataaatacacaacttcctataataaataaactcagccgcttggagaaaccaccagccggcttggcgcgatggtccccaacacggtggccttggcggggcaagggtcaccacgattcaagccaagcccctcttctcggggtgcggggtgtcagcggcccggaaagtctcctccccgccccctcccttctttctttgagtagaccttgcagaagaggccctaaactccggcttcccaagtcccctccccctcccctgcactcggcccttttgaaatttcaaaggcagcccctccccggagtccgagctccgcgccccgggcagcaaacccccggcttcgggaagatgcgggcagctttacaagccgaggggccacttttttatgagcacggtcataaaacgcaaatcccgtgtctctttgaaagtgccctccgccagggcccggtcgtaaaagtagaagatgcgtccccagcccccaaccccgggtgaggaccacccttacccgagtccccaaacttcccgtaacctcggcgtccttggggtaccggggacaatctcaaggcctcccaccccccctctggggcggggagggcaagcagagaggccggcaggaggtgaggctggaggctggggtccagccccaagctggggctgagggc

SEQ ID NO: 59 - DNA, 1911 bp, Mus musculus
gtgaatagcaaaaaaggaactttacttagtgtggctgcaacagaaggatacccagagatccagggagttcccaaatccttagggatcctgaccgagggtggggcttaaataataagagatttgcataactccttagtcaaggcctgaccctgtctgttacctcctcagttcagttccaaggtcatgggattagttgttaatcttctgggtgaccagttcccctcaggttgtccccaaggctccaggcatttattctctcaccaggagaatactggggaacttttcatttcttggggtccatttttttccactagactgaaagctaaagagagggtcatgagtgtctctttagaatgtgtcccctcctgccagacaggctgggtatggcagaagtagagacttcttcagtgttggtggcaacattcagagacttacctgggagctgaggagggcacctgggtgcaccccaccccccaaaggaggcttttgctcctaggattgttcttcagttgaaaatatttcatgctgagctctgggctccttgaaagccccacttcaggagtttgggccccttgtccaatcaaaggagagaaaagaaacccagccttaggtcagtggagcagggctctggggaacggagcctgaggagcaggccagagcttaagccgcacacaagagcatcccacctgaagactgttccagtccgtgtgaagggagctttgagccaggcctgtgccccctcaggtctgcaggagaccatagctgatgtctgcagccaacctgggtctgccctcagcgccatgtgcccagaggctcagtagctcactaatttgttgttaaccactgtttgtttcctgccaagccaaaacatcttgttcatgaggttttaccttgatgaattttctccatgagaggtactttccagtgaaggaaggatccaggactcagggcagaggctgtccatgcagcaggcagtctggctatggtggcctagactggcttttcaccttaatccagcagggctagaagagaccaggaggccaggtggtcccaggaaaactagtcaggggccctggtggcagaagggacactttgcccacagcagagcaggcatgagacggaactgcagggagacgggaacagattctcctgtttgggaaaaagctggacgtcagacatttttttatttttgaaacaaggtcttgctttgcagccctggctggcccagaacttggcatgtagaccaggctgcatgttggccccgcagcaaggcttagcctgggtatactggtacactcctgtaatcccagcatttgggaggaagaggcaggaagatcagaagtttcaggtcagcctcagattagctagagatgacctttaactcctaatcctcctgcccctggctctgccccttcagaggcctctgagatcagatgcatagaatgagggacatctgtccatcaggttgtactagctccagcccagacttcccagctcttagctttggcccctgattctgacgtcttataaaaactccagagacaggtgactccactttacaaggaaggagctctaggctcaaagacctcacagtgtccctctccctgcctgtgttctgtctgggtggaccatagcctctgtcctacccatggtgacacgtgggcgaaaggatctgaccccagctatgaagtcccagagggaccctgggtaggatccctcggctaccatctacccagttacatttccagtacctgcagagggcacgtgctcttcctcaaggttgtgcacccagtaggtgctcaatacattccagagatatctgaccttccagctctgtttggctctctgtctgacagcagagagctgacagagaagaaatggcggctgtagggaatgctgccctgccctggc

SEQ ID NO: 60 - DNA, 4741 bp, Mus musculus
ttcttttgctggggtctctggcgccagtggagagtctgcagatgatgttggctctaaagtaggcacggaaggggcaggtttggaagcctctgtccgtggagaaggactggcgcaatcagctggtctggcatctatagggtcctgtaaatgtagaaacagggcttctcccaaaaaaaaatccagtcttttttaattatccacttagtaggtctttattttgttaggggctagaaaagtttttaaaaatggactattttttataaagtattgtaaggagatgaataattatgatttcattttttttatttcattttttaattcagatgtttatatcttttaaaagtctgatgaactcactctacaatagcatgtccctgtgaattataggggatatcagtggaatatgagaaacttagagtcaaacaccaaatttaaaaggctttgtaagtttaaacaaagacattaagcccttggtattataaactaatgaaacaaatactgtatcgtatctttggaagttttcccgagttaggaaaagacataaatagcaatgagaattaagtgtacatacgtacaggaataaaggctaactttccaaaagacaggtatttgtaacatttgtctgttttaaatcacaagggcacaggctcatcagtggttaattcccaagcttagctgacagctctgcaggaatgcaggagcagtttctctgagcgctatggtgatttgtcatgtgagatcatgctaagttacctttgtagggaaagcaacaagcttttgttaagaaactaacccttaccttcatttataggaccagaaagcatagaatgaacttgaacatgtccaatagagaaaaggcaatttttaaattgaagtaagacttgtaattctgaaagttggggctaaaaaaaaaaggaaaaaaaaacggtacaacagctgtaaaacattctttaaaaaggggcttgtccttcacatttaaaagacaatggcgccgggcggtggtggcgcacgcctttaatcccagcacttgggaggcagaggcaggcggatttctgagttcaaggacagcctggtctacaaagtgagttccaggacagccaggactatacagagaaaccctgtcgcaaaaaagacaatggctattgtcattagctctgttggttgtgcaaatgtttcttgtgtgaggaaaatttcttttaagatcttaaaagttatgataacctgtttgaggagaagccgtgagtgaatatttttgtggaggcacagccctgtgctgcctggagttgctccctgcagctgttggacagtccttctttgacaaatggattggtcacctgaggctgttgaattacctctcttgtttgaggggtctgaggtaggtgcctcacagtttccctggtttgataaaatttctgtattattaaggattacagtagcaccagataaggcagtgccatttctgtgaaggtcagtgtggctggcgctccttacgcctgtcgtaccctttcagacaacagtgacacccagtgggatttctgctttgagtggggccaggagaattaaaatttatggcacctcttgctttgccaggatgttgtttgctgataagtccagaattcttacttgaataacttttgcgagccaagcctgatttattaaatgttttctgcccttattagtaagattttggacagtgctctggccttgtgaggttgttgtaatgggtacaccttgaaaatatgaactagcaacctcagcacatgctttaaatacatttccagatttttaaattgtctttcgaagagattgacaagtggatgtagcactctcaaaggccagttgtttcaaaacaataccttttgcctcagagctaagaactatcctctctactgcctccattgagagagcaacaacctttgtctgagtgtcaaccatacagttaacctcatgaataggaccagggagcattgtataaactcgaacatgtcctacaaaaaaaggacactctctagattgaaataacacctgcagttttgaaagtagagctaagattgtggagtggctagatggcagtagagctgtctcgatataagaaaataatctgacaatatagtgggagtctgtacataagttaaaggttttatttttaagtcttttaaaggcagcaattactgctactaattctacttgctgtgcagaagtttcttgtgtagggaaagattctttgttgccatcaaaaatcaaagcagccctgaagccgagccatcagtaaacaccattgctgctggaggaggcaagggagctgatttagttctgagaggaaagatgactcgatgccctttcatgaaatataacaaggggtgattaggcaagtgataagaataggtcccagtatatcctaattgtacaatctgccattgctcaaattcataagacaaaatattatgttggtctgcagtataaggagtaaccatatctccctttacctctaggtgatcaaccctgagttgaatgggctgaggagaaacaagttttgtctgaataacacgacccaggtatgagaatgggggtcgaatctgaaccctttctgaagccacttgaagtccatataagtttaaccgctcagctaaaaatcgtagtgtctcttgtacctaagctctatctttatgagaaagtagaatatcatccatatgatgaacaggataaatgtcagaatagattttacggacctgcaggatagcaatatccacaaatttctgacaaggagttggactatttttcataccttgggggaggaatttccactggtacctctggtatggcctttaaaggttgggtgaaggtaaactaaaggcaaaactctgacggtcacaaggacacagcagtatggtaaaaaagcaatcttgaagatcaataacaataacattatcattttgggaatggcagaaggagacagcaacccaggttgaagggctcccatgctttccatggtgccatttagttctctagagtcctgtaatagtcgccatttgcctgatttctttcttaataacaaaaattgaagtgttctaagggctagtggaagactcaatgtggcctttttgaagttgttcttccaccagcagagtagctgcttcaatgtttacatttgttaagggtcacttgtgtttgtgatattttgttactttcttttcagaagtcagactcctcctctgaggttggtttttttctcttctgattcaccacgactctctcctgaactacttttctcagacttttctgttgaggaataaacatttttcttagatcctgagtgagactgtagtaatggagtctgctcatgaggtgaatctgatgctgcttgggcgcctaaggcctttctgtcatctgctaatgtttcctcaagtgtattccaaatagcaaacgaagagcaaatgctgtaaggggcacaccttttcctccattctctataaaccagtttttaatatctaaccctaacttcttccatgtatccacatctaaacttcccctttctgggagccagggactgactgtacaaactgaagaaagtcagtcagatggctagttttaaccttaaagacttttctttctttctttctttctttctttctttcgggttttttgttttgttttggtttggtttagtttttcgagacagggtttctctgtatatagttctggctgtcctggaactcactctgtagaccaggctggcctcgaactcagaaatccgcctgcctctgcctcccaagtgctgggattaagggcgtgctccaccattgcccagctaagactcttttcttaagagtatacttattaatatctgtaaagaactctctatctgtagattcactttgtcccatcttgagagatacccatgaaatgcacacaacccagaactgatgtcttctgacctaagacgggtgctgatagcttccaacagaacagctaggcactgatggcacctagtatcagcctctgctgatggcagcaggcaataaaagccagagctgatggctcctggcttaacatgggcactgatggtacccaaccaggaactgatggccccaactatccgcctctactgatggcagaagacaatttaactgcacactccttgtccaatggatttgtaagacccagttaagagtcctatctgtgtccacttaccttattcaatgtcgctgttcgggtgccaaattagaacattgggagcctcctggcccgggccaggggtagcagtggagtcacagagtaaggactctggtgatggctttaacgtctgagggtcttggggctttctagctctctaattatactgaaatgctgatgataacttctaaaaagtcctaaaaactttcttgctctttctgagggcttgcttgctggcttaggcgattaacacctgtagcctatcaggggaggattaagcaatacagcctttgttctatctcagcaggaatctttcctaaaatgagtccctcatagccttgcttaatgagggctcactgtcgcagattatataataatccaaggcaggctacttcaggatgatcacctgctagttattagcttgtcccattatggctcctgacatgtgtccgattttaccgcacccagatcaaacccagagctcagtgctggctaagcaagcactctaccaactgagctacacccatgcctggatcttttgtttcatccaccaaatctgattttgaac

SEQ ID NO: 61 - DNA, 8651 bp, Mus musculus
ctcgtccaggcagatgtcgttattcacagcagggttggggtacttggggtaccgcgctaggaatttgtggcatagcaaccccaagctcttctccttccgactcggctgggatttctcaaattcgtctcctgataagtgttcctgcagagggaaaggtaaataatgtctcattctggaatagagcatgacagatttattggggggcctctgtgctagatgactaactcctcttacccacacatgcacgcggtttgaacagctgcaacaaagtgggaggggaataggaatggtcttaaggcctgggataaagatcactcatagagtacaattcccggtgttgtgctccaaagctacaaactcttcccatgttcagcaggtcaacagccttccaacagctccgggctccacactgaccgtcccttcatccacaagcccccaaacgccacccagcctccctgtaaacctacgtgcaaacagtctctagcttcaggtaatgcacttcggttgtcagacaggccccttttctgatctcgacttcggatctcggggctcacggcgctgatgagcattttcaggttggctgtgggtgtccatggctctccttgggagacttccttgggcttggttggtgtggttagagggcccaagtcaggctggatctcagccaacaccatgttggccttcgaggacggatgcagggggcttttcatcagtccccttttatgtggctcagaaaagaggttttcctggtttaagaggaattaataactgagttcattgtaaaacagaacctagcagaaaggctttctgcctttcatattgaccaagtaggttaagaatatcacagtgatctctggacagtattttccttttttgcttgagacaaggtctcactatacattccaaccagtctggaacttactatgtagtaacaagctgaccctaaattaacaatcctcctgcctctgcctctgttgtgattacaggcatgtcccctgctactacggtaaatttaatagttaaacttcccacttttaacttggtagatactatggatctaaatgtcttcaccatgtgatctaagaatttacattaataaataaataacattaactacaggttttatttttaaattctattttgagaaaggagggctgtaaagatagcttagagctcagtcccttccctttccttactagaaccaatcactctaagtaactgatcacttctaaattcctaaattcctactaatgagacatcaggtaaaggctttcaggacccacaccaggccccacccagtggagtggctgtgagcagtggttgctcattgatataccaggaacaggctcaagcagccaaggtgagggtgcccttacggttagggcctcccgcctaccagcaggacttctgaccagaaaaatttgctttcaacatcaacgcttgaggcacagatgcagaaaatgggaccaagggaagtaaggttagccatttaaggcctcagagctagtttctgctatggtaagttagcacttacctacactggtaagttaagagcaattcatatagatagtagagactgggcccccttcacttttagacaccaggcagtacaccattcttaaagaaagggatttggaaggcaacaactcagagaacagagatacactgtttcctcagtaactttgggagcccgggttaacaatcctctattacaaccatgaaactaagggctcagtgtgtatttctgctgaatctgctacttagcagacgatgatgcgaggcagagggaggtcacatggggctggcacctgaattttcagttcagtatggtgccctcaggaggtgctgatccaagggtggggtttcagtgaacactgccaaggacagcattgagctaacatctaaatgcttccaggagatctgtcaggaacagcatttggaggcccagtaggttaaagggctgacattttaaaatgttatcttacaaagaaatccagtatcaaattatgacctttgtgaattccaatggttcatgtaaataacatatacataattttttaagcacagaaaaaaccccaaagctttttccatatatattaaatttatattaaacttttgaaacaaaaaggttactttaaccctggacaaccctattcctcttcaaaaattaaaatttccttctggatttctgtaaaagttaaccaaaaggatacagcattcgtgactatcaaacgaaaaatttaagaaaacttattaacgaaaaactcaggatgatacttcatttgacattgcaacagtatagactggactttaaaaataccttttggttctccattttgtcaattcctcatacatttagtgtgtctttaaaaacgaaaaatctgaagttcctccccaagttccagtggtttaagtagtccaatcgattaaagttttttactatccttaaaaggaaaaaaagtaaagcaagaattaagagctgatgaaaatgattcacgtacacaagagcccccggaaacaaacaaaaaatgacaaaccaggtttatttttgccttgaggacagacattgcctctaggcagaccgcgccaacagacagcagtaaattcctccatcaaacccttctgtcacgagacttcaagcaaacacagaatctacagtgacagtcctctctcaggttcgagatggctgtagcaagcacccacctgtgcactgatccgggctgcggacggagcgcacgagcccgggttccgatggagcacgcaccgagcctgcatcgggggagatgctgaagtttctcgcctgacacacacgtgcacaggctcagaaggaaggacttgtgaagtggcctgagaacaaccctccaattcagcctctgcgctctaagcgcacgaccgggcatttacaaagggctttgggatcttgaccccctttttcaggcttctttcaatacacgaagtactggggcgagggaaggattccctaggtgccgaaatcaccgcgatgccaaagcgcaccgtacgctgcgctcccggtcccaggtacagtccccagcagtagcccgcgtcccgcccggcgcaagcactggctcctcctccccgccaactgcaccgcccccgggggcagccagacagcatctcacggtttccagggcgacggctccgagccaatcagtaagcccggtgaaggcctgcgattggctagaggtccccaaggcggggccggaccttccgccttcgatttaaaaatttggcgcggaaagcgggaccgtagctggcaccgcccccgagtgcgcggggctggagcgcgggcgagcccctcccccgccctctgcgcgggagctcggctcctccccacgggccccggcggggcgggaggcgggaaacggccgccttcaccctggccttcccgggatcccacaaccccgccgcagcagtctgctccccgctcacctgtcaatcctccttcagagctgacggtccggggtggccccgaatcctggctgcgcgtctcagggagccagcgcgtctcagggagactcgcttagccccgccgcgcagaggtgggtgccgggggcgccaccggggccggggctggggggggccggcgggcgggccgcgggagcgtggccgtccaggagcagtccagcccccgatttgaaattaacccgctcccggcgcgagccgctcccgcgggcgcggagcctcccctcccccacgcccgctctcccggcccggggccccgcgcgccaatccgcgcctctgcactgccgccgcggcgaatcagactgtaggcaccaccctccgaccccgcctacagccagacttggggaaaagtcctcaaaaacttttcctttttcttttttccttttctttctttctttctttctttttttttttttttctttttgcaaacaccatttatccgagatcgaagttgggggatgaaatttggctggtccagagctggctggctaggactcgagggctccccgccatccccagcttggtgccacgtcaaccgggtctgctcacctgccctctggaccctagcgacaccgttccctctgcgaccctttgcatgactgcttagcagcttctgctccacggtttccagaaagaaacgtgtgaggaggaaagagcttcgttgtctgaagcccaaggatgcggggcgttggccgatctctgaacacgcaggtgtgggaggagggagagaaactcagaaaacccgccaagcctgtccccagtgtcctgcgtctgccgatcccctctttgctctttcccgcttttcttccttttccttttatgagcttctgacatcggcctggtatatcgaacaggtcaagggaattttagagttaggagaccatctcgtccaaaaccctcattttgcagaagtggaaaaagaagctcggcaccccaactatgcctttccgtgctcgagttcttttgcacccgcctttgccttgtaacatttccccttttctgatcactctgggatcgcccggaccgcatgttgcccaacccgcttacatctaagattgtggtttgggctcttcctgcttttaactttgtatcttcagcctccagaaggactcggggccacgcagtccaagtcccatcactgagcttggccatcagtaagctaaccatcactgacttcaagggagatactgtgttttcctggcggtggttagggcgtggatgccataacaccgccccgggatccaggtgcaaagggaatgcacactgggcagaggtctaggtgatgagccagggtcttcttcctgagggtggcttccaagatgctgccacatctttgtgtctctctgttcagttctagtagctatcagaagctccggtgctcagggtcacccaagtgttcctcaagaccaggactggacctgaatattcacgtgctatacataggggctggctggctgtagcatcggatgtaaaataaaaatccgtcatgaggcaggacaggatgcttacagaacagatacatctttactgagcagggactaagtttaaatatatcaccaagaagtagtgtgtgggcttctgtctaagccactgtctgtcaggctacttgtcaaatctttcacctgtcagtgcttagcgctccgaaggattgaatgatgcccagcttatatccagagccagaattcaggacctctaccctacccccaagcccccaccccttaccacttcttatatcctagtgccttgcctcagaaaattctcaggacagcaaagtcggtgacttgtagtccaggtcacagtcatttccagccctccctcaacatgggagaaagggtgagatacatcatttttgtttagtggtggcttccctgtcagttgtcatcaaagtcgtggagcagaatgaaaaaatggtgcttcgaagagaggtttaaagtcttgacgctgtcagtcatgagaccttgaaaaggaagcaaggatcttgggatttagctcagggcagagggattacttaacaggctcaaggccccaggggtcatctccagcatcatacgcaagtatagtgcgtcaatttgaagtttggtgtgattttaaaggaaagatgaccgcagaataccttccagcttactgtgcaaacgaggggttggaggacaagcttgaagtcacttttcttactttcccttcaaatcttatttttttgttattgattatataacccaagaagatttccatgcctttgtgtctggtcatatgagttgcacaatagctcatatctcactgagctgggccagtttttccaccccactgtcactcttctgtgttgtacaactcagaagattgtgtaacatattcaacaataaataagtattatgaaaaaaagatatcaaaggtagggggatgacggatgtcatctcaggtacttagattcaaaggtaaccttaggggtttctgaatcgtgtcccttcccataatcatgggcaagtcctcccccatggccaggataggatgagaggctaaggaaatgtttttctattggtgggttctgagacctctctttttcacagtcccttcctcccaggtccttcagtgactagctgtatgtctgtccagcttcctgtagagattggattttagcctttgccatatgcattggcatatccacccaaaaccagctgttgggagcattaaatcataccaatcaccacagctgttcacaaccagacctcagccctcccttgtccctggaacaaaaatggttactttgtgaataagtggtatcagactcaaattgaaagtgtttcaagacagtgaacaggagagcaagggacctaggagatgggagagctggcactggtcctgggcttgctggctgtggaagcaggacttggtcagagcttgccctagctagagctgaaaacctgcctgttatactcgctgtgggcagctcctccctgggcctgggcacatatctgcagctagggactcggctgcagcagctgccattgttgctgtttattgagcaattactgcccctgcagttttaagatgccttgaggaaacaacataaaattctaaaaggccccccttttttttttaatagaagtggagtctgaattctgtcattgtgtgagtgtgcgtagcatctacaacggttctagaactgaggtcacgtcctcttgtgcttatcaggagggtggaaggacagttttcccagttccaggacacggcagaagtatgtgtacaggttctggggagtaggggtggggactggccacacacaaacaaattcctaaccagggcagaatccccgttacctccctgatgagccagggctgcgttttgcttaaagcgtggaagcgtggtgggaggatcatctgtgtggatcccctccagccagatgcctcacatcctgttgagcacagaatccctatcctggtaggtgcccttctactatggactcctccctctgacccccaccttgtgatcccagagaacaggagagagaagactttgtcctcacttggtcttcccagcatctagccctgaccaaggagaggaagggctcggtgaacactgattggctaaggttctaccttagcaggctatcctaccaagtagcgaggatgcttttctccccgcctgaagcgtcaagtgcaattgtgaacacgcaccaagtgctcagtaaggtgagaaaagtgactctcataatgaccagattaaaatgatagagagagagagagaaagagagagagagagggagagagagagagagagagagagagagagagagagagagagagagagagagagagagagagagagagaatccatgggagcacacaaacacctcagctacatgttcactcactaaaatgtatctaaacctcttgccctgaaactgggacctgtgttcagcatcaacttcaggatgaattggatcccaacactagatccagctccactttctcactggccttccctttctcatttcttttccagggatgtgaacctgttttgtacaaattggtggcttgtttgggttcttcagaattgtggcttctgattcactggaggtggctgtgcccctaccccgcaaccccctgaagtggctggcattggtgcaaatgaggctgttgaacctgatcgtgttctctctggccttggacctgagtgctgcagagagagagagagagggagactctgatggctctgaagatcatggcccttcccatatgaggttctaggcagtattcctgagccggtctcttgctcactccccagcccttttgaataccccttttcggtatgaatttgatgatctaatttgactatctctcaaatgctcaggtgtgttacagttttactcttcactgtatcagtttgtcacacggttaagagagcaggatctacccttcactcggggtcattctctgcatcctagctgatgttcagtgaaagctccaagggtttgtcaatgtggaaactggttggcagtcaatcgatggtctcgcagccacagttagagatgagctgcatctgggtctgcccatgtgcttttagaataggctgaactttataacacattcaatctttggaataaactgccaccgttttattgttagttgaactatatacaaggttgctggggtaggatatttcaggggcagagtgcttgcctagcatgcatgagactgtaggtggactccatccccaggaccaaaataataattttattcatagaggaagatgtttgcctgggttcaatgcccaacaactccagctttggaggatccaaatgcttctgtcttctgaggtcactagcatggacatagcccctaccacacatgtacacacaattaaaaaacaaagcataggatttggagtaaaacagactttgcttttaaagccccataataatattgcaatgctgtagacatgaacactttctcaacaacccccatacacatatactgaaagagaaattaaaatataaccctgagtgggccttacaaggagaagatgagttagtgcatgaaaaacagcagtgtttagcatgtgctaaataaagaaagctgttatatattgccatgtgtaatctaatccaaaacaatccatacatgtgtgtatctggatttgcctttaaaaaaaaaaatgttctaatcaccacagcg

SEQ ID NO: 62 - DNA, 29518 bp, Mus musculus
gaatgtggcttcaggcctggccgtttcctctttgtttagttagcgattaccaaacacttttgtgtgggtgcggatcgggctaccggactgccttgaatctctgctgcttgcgccccgaaaaggaagaggatcagtaccacgtgaccaccggcggcaagctccgttaggaaaagatgtgaaggttagtgaaacaagatcatactggagttttttacagagcctggtgactcagggatggctcggtaaaaatacctgtagactgaggtcgtagaagccgtccttggtgactaaggtttcacgtatctcagtttgtcaaattctttgttaagtggttcaaaacattgagaaagaccttagggccctaacagaaactttcttctcaatgacacaggaggtctcggactctgagtcagtggccctgggctccagagcaaagtaagcatgggaatgcatggaatttatttgtagtttgcaggaaataaagtgttattgttagggacgtttcctgtcataaacacacacacacacacacacacatatacatcaacactttaatttggctttaaaatagcaaccttagatgttgtttttgatccaggaacgtatgggaaaccccaaattatatgtgttttgtgttttctttgccttttttgaatttgtggtgtaagaattctccatatttctcacagataggatgttagatgtttctagtttcttggtgctgtgcacgtaaagatgtatgacttcactgtatgtgtgtgtgtaggtgacactgcagtataaatagggagattctagagagttctgtgatgcattagatatgaaaaactagccttttgaggctgatgtgtagctctgtgtcccagtacaaaaagagcaaaaaacttaaaaaaataaaacaacctggcgcacacctttaatcccagcactcgggaggcagaggcaggcggatttctgagttcgaggccagcctggtctacaaagtgagttccaggtcagccagggctatacagagaaaccctgtctcgaaaaactaaacaaacaaacaaacaaacaaaaaaccaacccaaaactaataatagcactgggactcccaattagggaggaaactatttatgtatgacattctcaaaaagaaaattttaattaaaaaaaagaaaagagtgctcacttcggcagcacatatactaaaattggaatgatacatcctggcccctgctgcaaggatggcatgtaaatttgtgaagcgtttcataaattaaaaaaaaagaaaagaaaagaaaagcaaggtggagggtggtaagcctgcttggggtgtgccggcgggggggtggggggtggggtggggggcttggcagagtgcaggatgtgggggtggtgtgcgggggggggggggggagggcgggcgggggaggtgctgggaagggaagaaagtccagccttcctccccagtgcttcccaaggttttggaaactatcttagggacttttcttcttgagagagcaacacacatagatattcaacagttagcaccgatggtctggaccatctacgagtgtggctgaagtgttaaggtcctggggcttatgttaaggagtcagtgtcctgggaggtgttagggtagtgaccatttgccagttgatatataaggatgttatttttataataattttaattatttgtgtatataagtatatatattggtacacatcacatgtgtgctcctggtgcccatggagatgaggggtccaggatcccctggaactggagttatagacagttgtaaactatgtgggtgctggtaatcaagtccgggtactctgcaggagcagccagtgtttttaaccactgagccatctctccagccctgtgttttctttctattcatttttggtttttcttagagacagggtctcactgtgtagccccacctgcagcttgctgtgtaacccaggctgaccttgaactcacagagatgcccttgtctctcctgactactgagtggtggggttaagtgtgcaactgggcctttttcctttcttcttttagacctatttattttattattttatgtgtatgagtgtttttcttgcaggtaggtctggacatcttgtgcatcctgaagttggagttggatgcttgtgaacccccattcagttgctggaaatgcagatcctttatgaaatagcaagtgttcttatccactgagccatctctccagctctgggctttattttctcaattgtagttagcttatttcttggattcagaaaagccctttggataagccctcagcagtgagggtcagacttgtgcatggagatagagaaggcaggaatgtgtcctgataggcttcccttaagccctgggcacacccctgtcggcttcagggaatgattaaattcccgggttgctcaattggagtcccgtttccgttgctagatgaggtggcgatctctcctggcccagcctccactttttttgaaacaaggtcttgcttcatagaccctgctgacctcaaagttgccaagatcctcttgcctcagcctctggaattctgggattacaggcacataccaccctgggttcacattctctctcctggcctcctcttctggctctttctcacttatttatagcagattgtgtgctgttgattctgcagagcggtaagacggtgagcctcagtagcacttttttgagatgcgaggaggagagaggagaaactctgagagggaaggggcaggttgccaaactggtttaaccctgctctggaaggccaaccagaaaaaaacaaaagtcctagcttggctcagaacagtttagcttaccaacaaagggaattggggaagagaaggaagaaaacagaagagaaagggtcaggggaagggctccaggctcctctctgcaggagagcttcgaggagtgctcaaaggcctggcttgggaaacatgactgtttattctgaggtgtgagacctgggggacatgctaccctgatctatggtgatatttaacctgaggagtggaaggagaattgtcttcaaaagcagcaggctgtcagtttcctggagatattgcttgcgcacttgagtaggtgaaggcccgggtctgcctgcgttcagttctcagaattcacagagcagaaatgaaagttgtcttctgacttcgtacgtgtgctccctagcacagtaaataagtgtaacaagacgatttttaaaaggaaacacccgttttcttttcttttttttttttcttttttttttttttttttttggtttttttgagacagggtttctctgtatagccctggctgtcctggaactcactttgtagaccaggctggcctcgaactcagaaatctgcctgcctctgcctcccgagtgctgggattaaaggcgtgcgccactacacccggctttttctttttcttttttctttttttttggtactcgttttcttaaaaccactttgcagatctaatgtctgtgcttcctctggtgtgcacctccactaaggccttaaagcattcctgtctccatctttccccagccatctatctgcttcctgccacggtgcacatcttatcttgtcatctccttccttatcttgagactgcaaaacatgccagaaagtctagaatgaaatttcagtaactggagtcatagcgacagatagtcgctggctgtcttcctacctagaccattttcaacaccactcctcctcctcctcctcctcctcctcctcctcctcctcctcctcctcctcctcctcctcctctccttcctcctcctcctctgcttcctcttcttttaaaagcacactcaccctcagaccctttgttttgtagaccctggctggttttgaactcactatcctgcttcagcttcccaagtcctgggactgtgtgagccaccaccccggtttatgtacgcttcgtatcttttgaatatttgaaaggaatttcccagggagtaattttgagtgtaagttaggattgctgagtttagaccttatatctaccctctctaccactccttccaccccagtttttctgtgtggctgtggctgtcctagaactcacagagatcatccccctgcctctgccttctgactgctgggattgaaggcctgggcctccactagccagctgaccttatttcttcttaagtaaagatgtaaaatgaaccttttataagttatacttgaaaattgcttctaaaggcatttccagctgagtaaagatctctgctactcttcagttgagcatggaatgaagtgactgccggaatgagcttgggattaggagaggtttcaaacactagacccactatcttcctgccccctgccttcctgttttgagactgggtctaaagtataggagatggaccttaaacttcatgtggattgagtcgaacccaagactcctgcatacgaggcaaacagttaccaactgagttatattctagcccacgttagactctcttttctaatcattcctcctttcttgtcctagtttggccccttgcttggcttggtaccacctctggtttggattttggtacccaacctgggcctccatgcctaagctacttcctaggctgcaagaaggacagaacactggccttctgatctattcagccacatgcaaatgaggtgtgtgtgtgtgtgtgtgtgttgttttgagggacctatttttactcaggtgcccacaacccacacccttctatttactctcccaatatgccttatgacctccagtatgctggctgcttgtgacagccttctctgaagttctgagcaaattagattttctccacacatgagactgtgggtgagcattacacaaatgatactgagtgacaggaggcagtagcacaccaggtgctttgtaatacttgtatgcaagtgaagccagtggttgggacagtgactgggatgagatgggggaggctggcggggagtagagcaagggagctgggatgctgctgttgctgttgagtgttctacaacttaatttgagtgctggctacaagagtatttttaataagtaagggtactgctatgtagccctgcctggctttgagttcgtggcaatcctgcctcctgttctgagtgacagaattataaatatgcaaattgctgcccagttatttttacttttaatgcctagattacacagtaagttagggccagtcttcttcatactatagaatttttttttttggtttttcgagacagggtttctctgtatagcctggctgtcctggaactcactctgtagaccaggctggcctcgaacttagaaattagcctgccgctgggcatggtggcgcatgcctttaatcctagcgcttgggaggcagaggcaggtggatttctgagtatctcccttctgggttttgttgcctctttccgctcttatacagccacctcggttcctggcttatctctgtgccaaggacatgctcatcaggcaagctgtcccactctgaccctcccactacgtatgctcaggacctttctggagtctgacatttgactaaagcatgcatgtatatttggtctggatcactgacaactatatagcgagaggcctgacagccttctatattcagaagccaagtcgccatcaagggtgacaaatgacaccaactaatgaccacagtaattcactgtcctgtttaaagacactatttagcaaagtcaaggttaaaaccatgtaatggaacaaatgaaggggctctgcctcccaagcgctgggattaaaggcatgcgccaccatgcccagtggcaggctaatttctaagttcgaggccagcctggtctacagagtgagttccaggacagccagccctacacagagaaatcctgtctcgaaaaaccaaaaaaaaaaaagaaagaaagaaagaaagaaatttgcctgcctctgcctcccaagtgctgggattaaaggcgtgtaccaccacacccggctcatagtatagaatcttgtttcaagaaatatataaatagggggctggtgagatggctcagtgggtaagagcacccgactgctcttccgaaggtccggagttcaaatcccagcaaccacatggtggctcacaaccatccgtaacaagatctgactccctcttctggagtgtctgaagacagctacagtgtacttacatataataaataaataaatctttaaaaaaaaaaaaaaaagaaaaaagaaatatataaatagggctggagaaatggctcagccattgagcactggttgttcttctaaaggtcctagattctattcccagcaaccacatagtcgctcacaaccatctgtaatgggatccgatgctctcttctggtgtgtctgaagacagtgacagtgtactcatctacataaaatatttatttatttatttatttatttattttatttatttattttggtttttcgagacagggtttctctgtgtagccctggctgccctggaactcactctgtagaccaggctagcctcgaactcagaaatctgcctgcctctgcctcctgagtgctgggattaaaggcgtgcgccaccatgcccggcatacttctttttttaaaagaaatatatatatttatttacatgtagttacagtttgtgactttttgtatgtaaaacttaaaaacattgattttgtttgtttgtttgcttgagacagggtttctttgtagccctggctgtcctggaactcgctctgtagaccaggccggtctcagattcacttgcctctgccctccaaatgctgggattaaattgtacactaccactacctgacttgatttgtttttgtttttttttttaagatttattacttatttttacttgcactgatgttttgcctgcatgaatgtctgtttgagagtgccaggttctctcgaactggagttacagacagttgtgagctaccatgtgagtgctgggaactgaacctgtgtcttttggaagaacagccagtattcttttttttttttttttttttggtttttccagacagggtttctctgtgtagccctggctgtcctggaactcactttgtagaccaggctggcctcgaactcagaaatccgcctgcctctgcctcccgagtgctgggattaaagacgtgagccaccacgcccggctcagtattcttaaagaatgagccatctctccagcctccttgattctttttttgtttgtttgtttgtttgttttttgtttttttgagatccttgattcatttttaaaacacttactttcttttatttatttagagagatggtcttactttgtagcccaggttaaccttaaacgctcgtttctcctgcctcagtttcccagtcctgggatttcatgctactacatgcaactacatgcaactacatgcaactacatgtggctaatataaacttttttgtttttgaaataggctcttactgtatagccttggctgtcctagaactggctatgtagaccagaatgtctttatcccacagaaatccacctgtctctgctcccagggtgctggaattaaaaaaggtttgctccaccacatcaggctagtagagactattttaaaatgttatagtgcatttaattacttttaaatccattatggtgatttcattttaaaatccactccattggaccataaagtattgcttatattcagttttcagttattgggtggtcactgtaattggtatggataggtcaaaatcaaaggttatatgtttgattttacttttaaacatgtggctgtgtgtgtatgtatggctgtgtgtgtgtgtgtgtgtgtgtgtgtgtgtggttaagggaactcattttcccagagtctatttgcatacaatttgttctctctgctgttcatggaagcctcaggatagaagtgtgggacatgtcaccacaggtagggacaatgatggacacttgcttttgccttccaacctggattctccattctgtgacaacagtgacctgcccttggcttggcaggtaatcagttactagcctctgggtacagtaccatcttgaccataatggtgtcgatgatgttaacacctcacggtttctgagggcaagggtttgggcaggcacagcttgctatggcttgctgcctggatctgaggcttgtttccaaactaacagggctattggcagaactcagttcttctcaagttgcctccccttcttggctgtgatctgatcaccagccctacttcctggaggccactcaattcctcgccataacatggctccctattttgtcaagccagtaagagcaggataccattagcgagcggcctctcaagccttgtgacatataactgcatacctaggctctttattgactggtgaggagctagccacaggatgtgtaccttctcaaggcaaggattgcacaggggtgtgaacactgggaggcacagttgtggcagctggcctgcctatctgccactgacacagctgttcaagggaagcagaccgctatgccccaggacaagccggtatccacacactctttcctgtccacagaagttggctacaggtgatgtatggccgaagtgactgcagggttgggtgagcaggctgagtttttacatagtgcagggaagagagtcctgggacgggaagccaatctgcaaaggctgggctagagtccattgcgagaaacaatgtcattctgcactcatggagacagacagggacgttcaaagggtgtaggtcaggctggaccacttaataagaccctgtctcagaagacagaagcaacaagagaaatcataaaagtattcgtcctttataacagtgggtctcattatagtattttatatttttatttagagtagtttatattcttctttatttattattgacaggtctctgtcatactcaggttggcctcgaatttaccatcagcctcctgaggactgagattacaggcatagatcactatggtatgacaggtttttgggttttttttttttttttttttttcaagacagggtttctctgtgtagccctggctgtcctggaactcactctgtagaccaggctgacctctgcctcccaagtgcttcgattaaaggcatgtcccaccacacctggctatgacaggttttattaagatgccttaatatatataaacagtatcctttgatcatatttatcttcccatagtgccctattctttttttgttttatagtcttcacatataagagaaacatacacagtatatatatatatatatatatatatatatacatatatatgcatctatattatattcatatgtaatttttcatgtttttcaggttaccctgtaagtcaccgtgtagctgaagatgaccttgaacttctaatcctggctctgctccccatttctgggattataggcttgggccactacattccatttgtgagttggggattgaacctactacttttgtttttctttttctttttttgagacagggtctctctgtgtagccctggctgccctggaactcactctgtagaccaggctggccttgaactcagaaatccgcctgcctctgccaccggagtactgggattaaggcgtagcgccaccacacccggctgaacctattactttttataaactactaggtaagcattctcccagtgtgtcatgcccccattgttctttctttctgagcctcatgtggcctaggttggccccaaacctactgatagaagatgctgactccttattctctcctccctccactttcttagggctggtattccaagagcaggcaggtacacccagccgtgagtcagggctgtttctcctaacatggttagagatttttagttgctatcagatggttggttggttgattttagacagtcttctttgtctcttgaactggccttcacctgtacttctctatgtagcccaggctggccttgaattccctcagcctgatttgttactgagatttttgtctctagacttgtcccttttccctttctgaagtgagaaagcaatgagcattgactaaatagcgaaacagatatcttcctattcaacaagaacaagagaaacggggacaaagggaggttatagatacggtatcaaaaatgaggggaagaaagtgctggagagatggatcagcaggtgagggcgttagctattcttccagaagacgccagttcaaattccagcacccacatggcagctcacaactgtctgtaactccaagatcagcactctcacacagacatacatgcaggcaaaacaccaatgcacataaaataaaggtaaattaaaaaaaaagattttaaaaatgaggtgctgataagggtgatgggtagtgaagatatttattcatctcttttctgggaaccttaaggcagtctctttttgttccttttatagttccctgccacggttaccatggcaattgtcaacaggcatcgtgctggagagtatgccatttagccggcagatagattacaatgcggttaaatgttgtctggctgttgctctggtggccattttaggtgcagacagtttctgctcatacactttcctgaagccccgaacattttgtcctcaaaatgcactaagatcagaaacacagtcaggctgtgcttggggcgacaaaataggagccgttttcctgcagcagggccatttgggtcaagcccacctgcggtaggctctgctccatattgaaaatcaccgcagctgatgggatacatgtgctatcttgactagacttttttctaggcaatgtttggatggtacccagcacctcatatgttcaacaaatgctccctcacaccatcctgcctagtgtgcctgaaccgcgctcaggaaacgagtaatgttgaggagtaaacctatgataaatgtgagatttttgtttgtttggttttggttgctactgagctaattactggctttgggatggggcctgggcaccgggaaagcgcagggaaggaagcgagagaggctgcaaatttgttaccagtgatcaactcagtcacgaactcagtcatgcctacgtagtgaacattccacaaagacctgagttcggagagccatgagatagatggctggctgttctaagcacctggaagctggctttccctcaaacccctgtcttgactatgccctgagccctgtgcgtcccttcatctgttacctagttctacagtaagccagcaagcctgtttccttacttgcaacaccagcagattagccaaacaggaggagggaggcacagctggtgtggtggtttgaaaggaaatgacctccagaggctcacagggcgtggccctatgaggaggtgtggccttgttggagtaggtgtggcctttttgaggaggtgtgtcactgggggaagggggaggagctttgagtttcagaagctcaagacaggctcagtgtggctctctcttccggctgcctgccaatccggatgtagaactctcagctacatctccttcaccatttctgcctgcatgcagccgcgcttcccactatgacgataacggacctctgaattgtaagccagccccaacgagactttttccttcataagagttgctgtggtcaccacggtgtctcttcccaggcaccgtgagcctgaatagcactgactagcacagctgagttgtagttggttagaagcacaactcaaaaacgatccatagcgactggcacgggatgtggggagcctgggaccaaagtgtcttcaacgtgtgggatctgacacggtgaccggctgaatggtgtcatatccaaagtgagttgcaggactgagctgttgtctgattcggggcctactcgtgactggctgtatagatcctgcccgcctccccaccccacctgcacgcacctgttcacagatgttttccgtgatgattgatgactaagcagagaaagaactttgattattttgtcctctcagataacctctaaatatgtctcccctagggggagacagtagggccttcaagatgctttagcaggtaaaagcccttgctgggcagggctgacaagcggagttggagccctggaacccatatacaagtggaaggataaatcgtcctgaagctgacctctgacctctacacgtgtgtcatgacacatttgcacactcttccctttatgacttgaaaaaaaaagtcaggtgtcaagaaggagtggctgctgttggcacccccttctctgcccaccctggagacagggtcttactgtgcagcctaggctggtcttgatccccctgcctcagcatcgcaaggattacagctgatccatcatgcccagcttccccttccattgtctgaggaagcggttcttcacctgtggtcgtatatcagatatcccacatatcagatatttatattatgattcataacagcagcaaaattacagtcataaagtagcaacgaaaataattttatggttggtggtcaccacaatatgaagtgtattaaagggtagccgcatcaggaaggctgagaaccgctgatcagcgtttggacaacaaattaaatagtcagccaaggtttaaggtgggctgttctgttgttgtttgttttgttttaacatggaaagccttagggaggcccaccattagagtcaagctgacctacaggggagagctgcagatgttcccgcccttcctctgtaacagccgttctcaaccttcctaatgccacgcccctttgatacacttctagaatcatattgtggtgacccccctcagccacaaaattacctcactgctacttcataactgtcgttttgctactgctatgagttataatgtaagtatgctttcggatggtcttagatgacccctgtgaaagggggtcgcgactcacaggtcgagggacactgctgtacaagtgaggctgaaagttactttcagaaaaaaggcatggcaggaagctgaggtgaaactgaagacgtggggaagaagagaagggcggtgtaggtcacacaacagtgacatgagctctggagacaagtcaggcagattggagtgtggattctgtcccttcacacttgtatgactgtgtcacgttcatctttcacacagtgctaacaatgctgtggacattgaggatcacatgggattaacacacagaggtgactggtccaggccttgcaccatagtaaaatgacagccaggatcagcctttatgaataagactcgatggaccttttaatatttcatgtggctgtgaatatattgttccatttcactaaaagatcccccagcttgtgcttggggaaagtatggcttggaggtggtatctgtttgcagtggtggtgggcatcttctgcctctgctgcttctccaccatactctgatgctaggtccccagagcccaagacacttctgctgagggacctactgaatgcacacaggctggctgcagggatggctcccatctccaccgtgaccgttcttttgtgtggtctgttggccatctgaggattcggctcccagggtattgcactgcaccatttactatgctgactcttgtcttggaggctttgtgcgttgccagtccctggccaacacagttttcagaaggccagcttccccttgtgttgttcactcatggcccaaactaaactaagaagtgtgattgttcggagcttctgaggttgaggactcttgatttactttcaaagattcagataccaaatgtgaacttggcaagcccacccttcctaagtcgagtcaaatgcacaccgctgtctttgccagggttgtgcttccaaaagcagtcattgccaccctctgcagaccgttggctgcctttgtttcagaagctgtgtggtccctggaagaacttagagcttcagtcatgtggtttccagggcccacggcctcatgctcaaagctggatggatgcacagaccccaaacttggtgaggtcagatgaggtaccagatctgaaaggcattactgttgtagattactgtaaaaatataaagcattttaaatatgcattggtgaaaaaaattggagaattggagttgaatctagaatcttagtatatttttaaatgttattttattaattaaaacaatgaaacatgaaaatttttatgtgagttttgcttacatggatgcttacgagtacatgcagtactcagagaggccagaaggcggcgctggatttcctgcttgtgagctgcacgtgggtgctgggaactgagcttgggtcttctgggacagcagccagttcatctctccagtttgtagttaattatttcttaacactgggaattgaacccaggacttcaagtgtggtaggcaaagctattgtgcctagccagagatttttttttttaaacaaaaaaaaccttgagataggatcttactacatagctcaggctggccttgtactcctgatcttcctgcctcttggctcctaagtacgtgtgtaccatcacacctagctgaatatgtacaagaaggtcctatctccttccttccttccttccttccttccttccttccttccttccttcctccctccctccctccctccctccctccctccctccccccttccctcccttcttccttcctttcttttttctttttagatttattttttatgtagacagcgttctactggtatgtatgattgcaggccagaagaggacaccagatcttataaatggttgtgagccaccatgtggttcctaggaaatgacctcaggacctctggaagagcattcagtgctcttaaccatctctccagccccagggggccctatgtcctttgtcacctctagattatgagattatgacgtgtagtatttcctcaggcttgcctgtgtgcgctatttaatgttgccattgtgaagggggaggagaggggagcttgattgaatcattaagtcatgggcctgagacagaagagttgctttgagttggaggacagtctagcctatggagtaggaccccactcaaagagaaaaggaaagaaagatgcagctagaacattactgaggcgtgagatggaaagatgctccaccagttgagagcacactggctgcttttccagaggacctagatttgagtcccagagcccatgcggtggctcatcaccatcagtaactccagttgggggtgtgtctgtgggggtgtccaccaacctcttctggcctccgcaggctccaggcacccacatggtacagagacctacatgcaggtgaaacacccacacacacaaaatagcaggagagagatcctgaagttctggaaggatgcttctgttgtatgcagcgcaggctctgtggcccagacccggcctctaagcctctgcttctaagctggccgttactcccagtccctgcatccacaccacatggccttcccagtggttttgcagcttcctttcggtttggagcctggatcactggagccatggaaaccaatcctctgtggcacttccttcagagcacatcaactggatcactcttgctctctgtctgtggcctggggaccatttttgcccgcatatacttacacaaaaaatatttatttttattttattttattttatttatttatttatttatttatttatttatttattttgtttttttgagacagggtttctctgtatagccctggctgtcctggaattcactttgtagaccaggctggcctcaaactaaaaaatccgcctgcctctgcctcccaagtgccgggattaaaggcgtgcgccaccatgcctggccaaaaaaatttttttaattaaaaaaaaaaaaattggacttttaaccctggtgcttggtaggcagcaagtttgagaccagcctggtctacaaagcgagttctaggacaggaagggctgttacacagagaagaaaccctgtctcaaaataccaaaacaacaaattttgtatgtgtgttttgcctgcatgtatatctgagtaccacttgcatgcctggtgccccgagaagctggaagccagtgttggaactcctggacctggacttatagagagttgtgagccaccactctgggagtgaatgctcttaacttctgagtcatctctcctgccccccatatatatatacacttcttaaaataattttcaaaaattttattcagtcttggacagatggctcatcaggtaaagatcatgtaaaatctgtcacctgagtccaattcctggaacacaagttgtcctctgacagggctggagaggtggctcgtgggttaaagagcactggctgctcttgcagaggagctgattttcgttccctgtactcacgtggcagctcacagttgtctgtacctccagttccatgagaatctaacaccctcctctggcttccataggcactgtgtgtaaaccatgtatgtacatttacatacatacacatttatatatgttcatttacatgtatgtaatcaggcaaagcactcagataaaataaaaaatcaagtaaattttaaaaagtcctctaacatctacacagatgccctccccatcctgtgtacatacacaattataatgctttttttttccattttttattaggtatttagctcatttacatttccaatgctataccaaaagtcccccatacccacccacccccactcccctacccacccactccccctttttggccctggcgttcccctgtactggggcatataaagtttgcaagtccaatgggcctctctttccagtgatggccgactaggccatcttttgatacatatgcagctagagtcaagagctccagggtactggttagttcataatgttgttccacctatagggttgcagatccctttagctccttgggtactttctctagctcctccattgggagccctgtgatccatccattagctgactgtgagcatccacttatgtgtttgctaggccccggcatagtctcacaagagacagctacatctgggtcctttcaataaaatcttgctagtgtatgcaatggtgtcagcgtttggatgctgattatggggtggatccctggatatggcagtctctacatggtccatcctttcatctcagctccaaactttgtctctgtaactccttccatgggtgttttgttcccaattctaaggaggggcatagtgtccacacttcagtcttcattcttcttgagtttcatgtgtttagcaaattgtatcttatatcttgggtatcctaggtttggggctaatatccacttatcagtgagtacatattgtgtgagttcctttgtgaatgtgttacctcactcaggatgatgccctccaggtaatgctttttttttttaaagaaaattaattatgcagtattctgcacaatctcaattggaaggtcaatgtgaacacatttaatatgaaaatttgaaaacataggaaatccattacagcttctttaagtgcatctcttcctcctcatcctgggccgtgtgttgagacttttttttagagataacgctatgtacatgcgtgcatgtgtgagtgtatgtgtttgcatatgtgcagagaccaagggtgctgctggcatcctctttagtcagcagagcacagccctgacggcccacagtgctccagatgagacactggttgggatggacgcagagaaatttgtgtttcacagggacttagcacttaccagcatccgtttccatccccacaccccctgtagatgcttatcctaaggcagcttgtcctttgttggtggtccttattcattctcgactgtacaactgtgtgtgtgagcatcctaaaggcaggctctgaaggtcagcagtggccttccgcatggaggtggcatcaggaactgatgggagcctcacagatccattacatttgataggtgaggtttaaacacagaggacctttgattgacacacatctcttctggggatggactggtaaggaagtagaggctctcaccctctgggtgggataagagttggggtgtgtgtgtgggtgcttttgaagtaggctggggagcatctgttgtgatttggggtagagagtggattagcttatgttctcaggctgattaattttaggaaagaaaacatatggacacagtattttgaaatgatttccttaaaagctctgtgcccacgtaccctctggaaagtcttcatgttcccatagagggattcttacatccacttgatttgactcaatgcgccttcctgtaactaagcaacactttccttttagtgattcggaagaattttgcacatagcgtgcatgttaaagaaagcagagcctctgtatttataccgtgcgttacttcatatgtcaagcaagaaaaattccttgggggggggggcggggcagatgtggtagagacagcatagcaccatagttgacttctccatttgcacacaaaatttgttcccgttgaagcaaatcattgtgtacagccctggtgtacagccttagcttttaaactgagattaaaacggattcctcaaaaggatgtgagtctccgcaaggtcgtacatataaagccctccttacagtacacagcatataccaactattgaataaatatccgttgttaatttaggtattgctgtgtttgccagcatgggtaagctaagatggtggtggaatagctactgctattccaaagacaatgtgtaaactgtggaagaacgagttctggaaaggccatggctctgagtgatactttttggatatttcaggataccttgtcattacataatgtagatgaacgatgtccggcttgccatgggctcacttgcgcaaaacatatgtaaagatatgacttccagtaacaataccaaaacaccttacttggtccttgtgtgggcaatcgtcttactgggttacacggttttaatcccagaggagttgtctcttgacattaaactgtccaaacagtatttatatctgaggctgccctgcaagatcacttaccctgcagagccgtttaaaagtagttaatgacagaagcgacgtgactcggccctcatgagtgatcgcctaagttcgacccatgctgtcatggtttatggaggaaggcagtttgtccatacccagcgtccaccacagcaggtaatttgaaatgaaacgagacagtttctacaagcagattgatttgggaatcttgcctgttcttccctttgacccttgacaagttgacactacaaagattgtgactttaaaaaatgattgggtgcaaatacatttaggtagatgatttactgtgcgctgaagcaaggacagtggccgaggtgatgctgcgagggaggtgactgtaaactttaacaactcaggttttatgtttctgtagcttattaattatcccgccaggtaaatctactgatagccctacatcaagtagtttatattcttggcaagagaccagggacctgattttctggtgagagacttggcacccagtttcaagactaagtgatgtggtactcatattaaccttcattgatattgcaggtgctggtcgccatcttcgtaggatctcaaagcatgaacgtgaagtgagatagctatctcagtttgtgatctctctctctctctctctctctctctctctctctctctctagcatacagaggaataaatgctaaatatgattaaagtaatgataagcttaattacacacacacacacacacacacacagagttaaggagttaaggacttgccagggatatctaaaaggaaattctgctctgaattaacacattttgggggctagagatctggcttagtggcactcactgccctctgggtggactcaagcttggtttccagcacccacgtcaggtgactcacaactctctgcaagtccatctccaggagaccagatgcctccacagggacttgcactcatatgtgtacatatccacatgcatagatacacacctacatatagttaaaaataataagaatgaatcttaaaaatgagttaatgcactcttttagaatcctttgaaattgcattgagatttcattgtcctctgtagcagtgtggctggaacccagagccttgagaattcaggacaagcactttatgtctgatctgcatcccccaactccacatttaggttcttataacaaatctattctatatatctatatctatctataactatatctctatatctctatctatctatatatgagagagagagagagagagagagcgcctagagcttgctatgtagggccaggctagctttgagatcctcctttctgcctttgcctcccaaggactatgatctatcaacataatttaaagatgaagtattctctaaagcaggcaccaggaagagcctttgaaacatgttattccaggtgtggaagggcacacctgtaaatcttgcagaggagggtaagatctatgagttcaagtccaacctggcctacatggacaggagtacacagtgaggtgaccccccctcctcaaagttatctcatctataatcatgaagtgcttatggctacatatctacatgaagtgcttatggcgttctgcctgcatgcgtgtctgcgtgagagtgtcaggtctcctagaacaggagttatagatggttgtgagctgccatgtgggtgctgggaattgaacttaggtcctctggaagagcagtcagctcttcactaattactctttagagacagggtattgtgtagttcaggctggccttgagcactgtctccttagtgctgggatcctgggctgtcctaccaggcctcctgataaatgaacttggtaacagagaattgttgatgggttagcgtttagctccgggccaggcattacaggcctccatacttgctagagaaatatccattctgcgaggatgggaaaccttgggctattctctgtagcttttgttcctttctgtctttctatttacctgctttgtttgaaatataaattgaagatgctcttaaaaaaaatggaacagtttccccattggtctctgtttaaattatttactgccctttcgagccgtatcttcattgaactatgttaaaagtattttgctgaaatgtttctttatgttgtccatcgggtttaatagacgtcccatttaataagctctctacctgtaaggatagactatttgacctctatgccctgctactgctagacatagtataagattgctttgtgaaataaagctgtcggtaacatcaacaaaataaaaaatgatcgtattccaatactctccgctgagtactctgacagcgctgaaatatggaataaaattgaaagtagattagttttgggtcttaagtcatgttttgacaagaaataagagaggagaacatatctttgaacttttagttttaaagtttttaatgaaaatatttatcattttgtaagcttccttctttctttatcgcatctaggccgtatgatcttaaaacaatccgttctctgattgtgagggacataaatactgctctatctttatactaaatatcataaaggagacgcgcacagggcatggcagcttgacacttgtaagttaaggagtgtcatgctaataaaaaaagcttattgaagaggttgggaaatcagtcattaataagctacatatttccagggtatgtagagcatgtaaatactgcagacaagcaggctgcgtttgctgtatttctaaactcacccttctggaatggtttgaatctgaagaggaagaataaatatgtcacgggggagaaggccttgctggcgattgcttccaacctggaggaatgtcagaactgcctagacatgcagattgtgaaacgccttgcctttcgcttctttggttacatattaatcaaatgaactcccgagggagagtggtatggatggttggcagagagggctggccgagtgggtgactctccccccactcccccaccccaggcagctgcaaacatcctgggccaccagattcggggttgtggcttccttgaaggtacagagcctccctcctcctcttcctttcctatgcagaaggttcccagagggctgccttagcagtgtgcacctcactcggaacatctctatttgtgtgctttcccacagactgggggctagcccctccctgccttcctcattgtgtccacttgaggcaaggctgggcacgagagccttcaatgacagcttctcagatggacatctctgccgacggtcccctcctaagcccacctaagtgtgagtcacatgctagcctaagcccaccatgctagcgcgtgactaagacgagctagagcccttgagagattcttactgttttcagtagtgaaaagggcaattctgtgtgtttgtatttttttttaatcatatttatgattgagtccagctcatggatgctctctctctgagctacattccttccttctttattttaaaaggttagttttatcattttttattctcatgtctgtatgcatgtgagtgtaggtaccctcagaggtcagaagcaagctttggatcctggggtacttgggtgacagggggttctgagctacccagcaaaagtgctgggaactgaatttaggtcctctgtaagaacagcaagtgttcttaattgctcagccatctctctagctcctttgtttaagttatttcattgtagcccagtctggctttgtaggtgtgggtggcactgaactcccgaaggagcacttagtgaggagtcctgcacctcctgcctggccttagtgtaagtgtttataaggtctcaaacaatctttccttagatgttttacagctgttcccatgaagaacattttaaaaatgtagatggctggcagattgctgagttcaaggcctgcctggtctacagagtgagttccaggacagccagggctacacagagaaaccctgtcttgaaaaacaaaaacggacaaacaaaaaacaaaacaaaacaaaaactcaaaaaatcactttaaagccgggcgtggtggtgcacacctttaatcccaacactggggaggcagaggcaggaggatttctgagttggaggccagcctggcctacaaagtgagttccaggacagctagggctatacagagaaacccggtctcgaaaaacaaaacaaaacaaaaaatgtagatggccacatgagatagctatttcctggtagtggaagtcaatgctaaagtgtgcggtcctggagcagagccccttcatttgttccattacatggttttaaccttgactttgctaaatagtgtctttaaacaggacagtgaattactgtggtcattaggttggtgtcatttgtcacccttgatggcgacttggcttctgaatatagaaggctgtcaggcctctcgctatatagttgtcagtgatccagaccaaatatacatgcatgctttagtcaaatgtcagactccagaaaggtcctgagcatacgtagtgggagggtcagagtgggacagcttgcctgatgagcatgtccttggcacagagataagccaggaaccgaggtggctgtgtaagagtggaaagaggcaacaaaacccagaagggagatacattgtatctagaagataacagcaaggagaaatattggcggaaaaataaaaagggttctaacagggacagagatttgggaaacagttcgctgtgaggagctatgtaatgaagcagagagagggagacatgacactcatctctatgagcggctccagtgtccggcttgctggctgtagctgtagcacctttagcagatgggacttttgccagggccaaaatctaatctgtaaaatgggatgttgatgtgggcggagactggaggggcttggtagggcggctgctacactgcagctgctacactgcagctgccctccggacctgctcacctcctcttctgtcctcttccttctggaacaaggatgtcaacttctcttcagatctgaagaatctgaggaggcccattccatccttgtgaaaggaatttctacaagtttcttattgtcagtaagcaaaagttcttattattctcaggcgttcgtcgtatgtttgaaggactctgaactagagcttaatgtcaatttacttgatttatttattatttattagggatcaatcagagggtcttgccatactcagcacttaacgttcaccttgctcttgcaaaagacctgagataggttcccagcatcacgtgggtagctagcttatcatcacgtgaaacttaaggactgggagagtggacgctctggtctctagaggaacttgcactcacgtgcacatacaaagacacacatgcatacacataatttaaaaaataaatgagcatatgattttaaaatatttttcagtagcccctcattgtttgttctgtaaaaacaagtatttgtacaaaaggcattgatgccgatgggtaataagaaaaacaataccgaggctggagagatggctcagtggttaagagcactaactgctcttccagaggtcctgagttcaaatcccagcaaccacatggtggctcacaaccatctgtaatgggatcggatgccctcttctggtgtgtctgaagacagtgacagtgtacttactcatcatatatataaaataaataaaatcattaaaaaaaagggaaggcataacatagttggaatatcctatgaaatgatatcatagtggtacatatatctgtttgttatgttccaggcaccgttcaatgtgtcttgatatacatcagctcatttaaatgtaataagaagccagtagtataatgattacccttatagtctgaggactcttagggacagacggctatgaaatatgtctgtggtctttcaggaagagctaggattccaaaccaggaggaaggctcagccttgagtgctggcagatgcctttagtagaaggtggatctcggtgaggttgaggtcagcttggtctatatcgtaagttccagacagccagggctcctgttctcattctcctgccagcaaaacaaacacacgaacaaataagtaagcaacaagcatgcaccaaccaaccaaccaagcaaccaaccaaccaaccaagcaaccaaccaaccaaccaagcaaccaagcaaccaaccaaccaaccaaccaaccaaaaaaccaaccaaccaaccaaccaaccaaccaaaaaaccaaccaaccaaccaaccaaccaaccaaaaaaccaaccaaccaaccaaccaaaaaaccaaccaaaaaaccaaccaaccaaccaaaaaaccaaccaaccaaccaaccaaccaaccaaccaaccaaccaagcaagcaaccaaccaagcaaccaaccaaccaaccaaccaaccaactaaccaaccaaccaaccaaccaaccaagcaaaaaaccctaatccaggaactctggtgtcagagtcatgattcttttttgtcattgttgtttccagtcagggtttcactgcagccctggctgtcctggaccgtgagctgtagacctcaaactcaggagattcacctgcctgcacctggagtgctgggattaaaggccaccaaggctggcctccaggattcttttaaaaattttttttaattaattaattaattaattaattaatttttatttattcactctatgtcccgctcactgcccccctccttgttaccccctcccttaatccttcctccctcccccatccccttctcctctgaaccagtaggatcctccctgggtatcaccctaccctggtacttcaagtctctgtagggctaggcatgtcctctcccactgaggccagagagggcagcccagctagaagaacatatcccacatacaggcaacagcctttggatagcccccactccagttgttagggacccacatgaaggtcaagctgcacatctgctacatatgtgtgagcaggcctaggtctagcctgtgtatgttctttggttggtggctcagtctttaagagtcccaagggtccaggttagttgactctgttggtcttcctgttggagttcctatcccctttgggacccccagtccttcctcctattcttccataaaagtcccaagctccatccactgtttggctgtgggtgtctgtatctgtctgaatcagctgcagggtggaacctctcagaggatagccatgttagactcttgtctgtatggttcaggatctgaaggtttgatgaggatggcaggagaggtgatgggtacccctgggacagcagggtactcagagccccatgattcttataaaacctggcacaaagcactgtttcttaattcactcttcaactaaccagccagccagcaaaccaactaaccaacaactcacccatccacccacctaaccaaccaacccaccaacccaccaaccaaccaaccaaccaaccaaccaaccaaccaaccaacgtatttatgtggtctcgactggcaagatgggaactagaataggggttagaaagagatagtgttggctcagcagttaagagcactgactgctcttctgaaggtcctgagttcaaatcccagcaaccacatggtggctcacaaccatctgtaatgagatctgacttacatataataaataaataaataaataaataaataaataaataaatcttaaaaaaaaaaaaaaaaacaggacagtggtggcacacgcctttactcccagcacttgggaggcagaggcaggtggatttctgagttcaaggccagctttgtctacagagtgagttccaggacagccagggctatgcagagaaaccctgtctcaaaaaaaagaaaaaaaagaaaaaaagattgtgccttcatgtaatttacagataactgagggaagcaggtattcaatactcaattcatgaatatcttagtaattactcatataattctaatatcgcagtggaagacagaggtagcaggtaggtactggaaggaatttgatctagcaagacccttgaggaaatgtggagttgtatctgaaagatgaagtccagcatcaaatgggagctgagcctgttcttccacgttcctgggacagggaagtcagtgcctggggagatcactcaggtcagtagcagccccgtgctagaggagactggggccacacaggcggacctgtgtgggctgtggaagggagttccaggttcatctcccagaccagaagagtttgcagcagggagaggggctaccatttgtttctttgttgctcttcttactacagtgaaaaggatggatttgatatgggcccaaggtggatgtgaggagcgggatttggggccactgcagggctcaggtatcatagatggaaaagctcaagacagaggatggcagtggataggggtggtgtggaaagattcaagaggttattgggaagcagaattgaccaaaagcatgaatgaattaaagagaggacagttgttccatagtccctgagctttgattttggagcttaaggaaggtctgtattgatggggaccgtggataagaccagagtgggtctgccctgggaaagctgagtttggagttgacattgtgggtttaatgttgcataaataaataaataaataaataaataaataaataaataaataaaataaagttttaaaaaaagtaaattcctttagctggacttttataagaattgaattcaagaagagttaggagcgggcatgctcaatacctaccattctctcatgaaaccgggttttataggcgcgggttcatttattcctcgtccctcatcattttatgtttaagagcaaatgcacttaaaaccactgtttggaacatcgcttttactaaagaggggaccactctaccatcagtgtaattgcttcggcactgtcttcatgtagacagacttgtgtaagccatcattaatcctttgtataattaatgcataaaatgcagagtttctattactggaaaagcaaactcaagcatcacgctggtaatatcaataacatgcatttgtaattacatactgtagataactctgaaagctacattttattacattaataaaacagaaaaccccctgaagccacccagaagcaggcagcggtgacgctgtgagagcttgctgctttgtctgtcaggagtctgcagggcgctggtagccggtcgggacacacatactacacaaaaggatgatgttcatatttctattttcaaaaatagtatgaatttactatacaaattaatgagctggattgtgacattttcatatgtgtgtcatgttctttgattatattccacctccattacccttttttttttttttttttctccaagacagagtttctctgactgtcctggaacttactttgttgaccaggtggatcttgaactcacagagatcaacctgcctctgcttccagagtgctgggattataggcgtgcacctcctggcttttctcttcattcttcaaggaatgcccatactggcttccagagaagcttggtcacgttacatccatctctatagtgtaagcatccttccttcctcgctagtatttgttgtgatctgttttctgggtgatagccattcttcatggcatgacatagaggcgcgtttgttttcttttctctttttagacagggtcttgctctgtatccctggatggttggaacccattctatagcccaggtaggccttgaccatgaggcagttctgcgtcagtctgctgagtagttgatcacacacctgtaccatgagctcttgacataatctgcccttctactgactgaaaattttcatgtgtctctttttctttccagattctggatatcaatctcttgctcagtagataggggggtaacattttcctcccattttgaagcttgtctcttcactctggtaacggtttccatggctatgcataaacattttaacttcatgtggatcatgttcagggcaggacgaatgttcaggatggacaagaccagtcgctactccttatggagcctgtcactcacaccatagaggaagaaaccaggagggctattttgggcagttctaagatgctccaaggactgagtaagtctctcttctagacaagacatgggggaaaaaatagcttcttggggggatgcaagagtgaaagtctccagatttggagatcactggagaacattcaaaccatctcagcagctggctcctgtggtcagtgcttgcctagtgcttaaggaagagcttgggtttcatccccggcactagagaagacagtgtcagagacgatgatggctctgtgtaacctacactgtgtaaacagagaaggcatttctacaagctaaacaaaccatgaaaccacgaatcctcacaccctcgttactatctcatggtgatccaagatccagagcctgtcagaagcagatggagacacaacccagaacacccacaagccattcccatccaatttaccccagaaatgcaactctctctgactgtgggacaaggttaaagggttttgttttgtttttctttttttctttcagtagttaaccaccagatttgaaccaaaaaacatttagtgttt

SEQ ID NO: 63 - DNA, 1893 bp, Mus musculus
gctttcgacctccgaggctgcgaccgcgtgtcctgtagcagcaaccactgcagatggggcgttgcagctctcgagctgctgcggctgcagctggacttggcaggggtgagataattagcccttttgatgcacaagcgccttcctttcttctaccttcctgttcttgacaaaggtttgtatccccaagacattaaaatgcaacccttacaattttcctgtttcggctacaaattagaaatatcctgatccccattaaaaaaggattcgttcccagagaaagtggcttaattcaagttttcacacaggcacccgaaagccagcaattcccttatggaaaggtagattcaggagatctgggcaggactgcgtggcagcgtcaggtaagcatttctttaaaacggggaaatgacattaagcacgatttgaacaaacacagctgtgactacccgatccccggaagcatatttcttaaacatttctttactacttttccacattaatgtctaagtacaccctgccccgaacacacacacctttgtactctgtaaagcatgtatgcatgcttttgttttttgtgtgtgatgggttttttttctcctgatatatttgtgaagatctcatgtttttctctgcacaataaacacccttctgaaatgagagcatttgccccagatgccatgtattcagggtcacagctaacatttttctcctttaaataggctcccttatttcctagccctcaatccaattcctagtgaggtggctgtcctaccggactcaaagaatgaaactgccacctgggctctgaagagatgccagttccagtagttcctcaagggttcaaagaacttcagtgactgccacaggcaaagtggattcaaatgctaaacggaaccaagcagaccgaagactgcagaaaggaaggtctgacactgagcacagatgggggggggggggggaagagacgaagcttccagaaattcagatctcctcccagctgcccctccctacccaacttgtaaaggttgctttgtgctttgaccaggagaggcctggttggaaagtgactctactctgtcttaatacagaaacgccttactatgctccagtgcagcggcggacggcccggtgttatttctggaatccccaaggccaggctgcaagacacacgagcgtttatgttcctgtgggttggggtggagctggacacacagaaatcccaacggataaaatgccttctgtataagcagtggatttcaagattccctaaattagagcagcaaacccagcccatagagaggagacgcccatggaggtgatgagagaggagacatatgaagggaaattgtcaaaaaggttgtttctgagtgaggcctacccaaaagaggcacgtgccaaatatttaccacaaacaagctcatatgatcatgtgaaatcaaaaactgacacattatgaaattgtaatatctgagggactccatagaatctgcttgtgtctgaaaaaaaaattcttggtacttcaagtcccagaacacagaaaagctgacatttagagtggctttatttgttattattttatttatttatttatttatttattttaaaagatttatttatttattatatgtaagtacactgtagctgtcttcagacactccagaagagggagtcagatctcgttacggatggttgtgagccaccatgtggttgctgggatttgaactcctgaccttcggaagagcagtcgggtgctcttacccgctgagccatctcaccagccctattttatttatttattgagggtcacactgcatttaaatcctgcaaggattaactcattcaatatacttgatgccactaaaagggaaatgttgtaaacaccatctccaattt

SEQ ID NO: 64 - DNA, 72750 bp, Mus musculus
gcttgttcatgccttagggattttatagctagtattcttatggcttctattttgatcacttttgattgatcagttgactttcacattttcttctcttccctctttcattattatctttaacaaaatagattgtctgtacacagggaacttacatatttcctttttaattttttaaaattacattgtttgtgtgccctccaaggaatgcatgtggtgtgtgtgtgtgtgtgtgtgtgtgtgtgtgtgtgtgtatgtgcatgtgattggcaaaagacagcttgtttgcatcaattccctcttttcatcatgtggttccacaggcatcttgtgagtccctttatatattttctgcaaaccataggattctgcaaactcaaagatcctctccaactcgcatttgaacaggtaaataaataaaggaaggagtactaggcttagattatatattcatattttttgtatttacattcaaaagtatttgaacatttcttcaggatttaaaattttgtgggctggtgcagtagttaaattggtagaggtacctgccattgttaagctatacaaacaagtttgattctttagatatacataagtaaagaggaaaagaggctgcaggaagatgtcctttgattcccaaatgtgtactgtggcaactgtcctccatctgtgacaagaaacaaataaagaaatatgtaattaaacatttcaaaaattaaagttaataaggagcttgccctgtacatgtacttttagaaaagagtaaagaagaaatgttatgctcccaagcctatccctcaacgtactctttacctcagccacattagaggaaagacagtttatggatcgctaagggaggcctatcctcccagaaagtgactttcctttgtctgcttttctaataacagatgtataaatgttactgtttgaatattgaatgacccctgaaaattatgtggcccccaagatgattttatgcataactgttgtggtctttgatgaggtggaggcttaagtttattgtgtgtgtgagtggtgttcttatagggactgtggaagtatgatctatctgtctctctctgtctctttatctctctctatctctttctttctgtctgtttcatgtgtatgtaagtgcatgtgagcacacgggtgtatgtgtgtgtatatgtatgtatgtatgtatgcatgtatgtatgcatgtacctatgtatgtatgaacatgtatccaggcagtattagatatttttctcattgctatgacaaaaaagcaatttgaatgagaaaggaattctttagatttacaattcaagggtacaatccattaaggtggggaagacaaggtggtagaaatagaaagcatctagtcacatgtaactgtcagaaataagagagaaggaaatggggcttgttcaaagccaacctctagcaacccattttaaagagctttcaattcctaacactttgcaattttctcaaatagtgacaccagctagagactgtttagagactaaagttctaaaacataggagctcatgagggcatttcacattcaccccacaattgtggccataatgggagcagttgccactcctacatgttctctgcccctgcactcactgtagactccaagctcacatttgccccatgggagaatagacctctaaatggtaagttgaaaggagcatatttgttttgtaagttaattaccattgacaattcattatagtaatgtcaacatgcaaagtaaggaattcagagctaggctgatggttttaattagaaatggcccccatagacttatatatttaaaaccatggttcccaactggtggaactacatggaaagatttggaattttggtgagggaagatttgcaagaggaagtatgtcaacaggggcaagcttttaggtaaatatattggcactgtttctgtttttcgatttttgctttctgagtgtaggcaaatgtgaacagccaagttcctgcttctgcagccatgcctttgttgtcatgtgtttcctgttatgatgaaatctattcctgtggacccataagcctacaacttctttattttcctcatgattattctttccataacattttttgttataccaacagaaaagaaatcaaatattcaatgaatgttttcacaattcccactgcaacacccacaaaaggacaagaatgtatggtgtgcagtctctgtatcacataatctccagaattttgggcaaactcagattatagtgctatttaaactagaaatatcctggatgattatctgggaaaaaacaaaaacaaaaaccaaaaacaaacaaaccaaaaaaaaaaaaaaaaaaaaaaaaaccttctcacatgagaactctaagaaccagaagaaactcagggtctgaaagttaacaataagataggcacacagtgtattctcaattgatggcccagagatggagaccaccccacactcaaaaaaagaacattcttaaggacctttaaatattatgtccaccaacatccatttccaaggtttttggatttttattattagatattttcttcatttacaattcaaatgctatcccaaaagtcccctataccatctgccaaaccagctcctggccctggcattcccctgtactgtggcatataatcttcacaagatcaagtgcctcttctcccattgatgccaactaggccatgctctgctacatatgcaactaaagacatgagctctggggagtactggagagttcttattgttgtaactcctataaggatgcagaccccttctgctcctggggtactttctctagttcctccattggggtccctgtgttccatccaatggatgactgtgaacatccacttctgtatttgacaggcactggcatagcctcacaagagacaactatatcagggtcctgtcagcaaaatctttctggcatattcagtagtgactgggtttggtggttggttatgggataggtcccctggtagggcagtctctggatagtccttccttccatctcagctccaaactttgtctctgtaactccttacatgggtattttgttccccattctgaggaggaatgaagtatccacactttggtcttacttcttctttgtgttttgcaaattgtatcttaggtattctaagtttctgggctaatatccacttatcagcaagtgcatatcacgtgagttcttttatgactgggttacctcactgagcatgatatcctccagatccatccaatttcctaagaattttataaattcattgtttttaataggtgagtatctctccattgtgtaaatgtaccccattttctagatgcattcttctgttgagtgacatctgttttgttttgttttgttttgttttccagcttctggctattataaataaggctgctatgaacatattggagcatgtgtgcttcttacaagttggaacattttctaggtatatgcccaggagaggtattgctggatcctctggtaatagtatgtccagttttctgaggaacctccaaactgatttccagagtggttgtaccagcttgaaatcccaccagcaatggacaagttccttttctctacatccttaccagcatccgctgtcacctgaatttttgatcttagccattctgactggtgtgaggtggaatctcagggttgttttgatttgcatttccctgatgattaaggatattgaacattttttcaggtgcttcacagccattcagtattcctcagttgagaattctttgtttagctctgtaccccatttttaaatagggttatttgatttgctgaagtcccacttcttgagttctttatatatattgcatattagtcccctatcaggtttaggattggtaaagatccttttctaatctgttggtggcctttttgtcttattgatagtggcttttgccttacagaagctttgcaattttaagaggtcctgtttgtccattctagatcttacagcacaagccatcgctatacagttcaggaaattttcccccatgaccctatctttgaggcttttccccactttctcctctgtaagtttcagtgtctctggttttatatggaactctttgatcaactctagacttgagtttatacaaggacatactttctccctaccttttcaacatagtacttgaagtattagccagagcaattcgacaacaaaaggagatcaaggggatacaaattggaaaagaggaagtcaaaatatcactttttgcagatgatatgatagtatatataagtgaccctaaaaattccaacagagaactcctaaacctgataaacagcttcggtgaagtagctggatataaaattaactcaaacaagtcaatggcctttctctacacaaagaataaacaggctgagaaagaaattagggaaacaacacccttctcaatagccacaaataatataaaatatctcggcgtgactctaacgaaggaagtgaaagatctgtatgataaaaacttcaagtccctgaagaaagaaattaaagaagatctcagaagatggaaagatctcccatgctcatggattggcaggaccaacattgtaaaaatggctatcttgccaaaagcaatctacagattcaatgcaatccccattaaaattccaactcaattcttcaacgaattagaaggagcaatttgcaaattcatctggaataacaaaaaaccgaggatagcaaaaactcttctcaaggataaaagaacctctggtggaatcaccatgcctgacctaaagctttactacagagcaattgtgataaaaactgcatggtactggtatagagacagacaagtggaccaatggaatagaattgaagacccagaaatgaacccacacacctatggtcacttgatcttcgacaagggagccaaaaccatccagtggaagaaagacagcattttcaacaattggtgctggcacaactggttgttatcatgtagaagaatgcgaatcgatccatacttatctccttgtactaaggtcaaatctaagtggatcaaggaacttcacataaaaccagagacactgaaacttatagaggagaaagtggggaaaagccttgaagatatgggcacaggggaaaaattcctgaacagaacagcaacggcttgtgctgtaagattgagaattgacaaatgggacctaatgaaactccaaagtttctgcaaggcaaaagacactgtctataagacaaaaagaccaccaacagactgggaaaggatctttacctatcctaaatcagataggggactaatatccaacatatataaagaactcaagaaggtggacctcagaaaatcaaataacccccttaaaaaatggggctcagaactgaacaaagaattctcacctgaggaataccgaatggcagagaaacacctgaaaaaatgttcaacatccttaatcatcagggaaatgcaaatcaaaacaaccctgagattccacctcacaccagtcagaatggctaagatcaaaaattcaggtgacagcagatgctggtgaggatgtggagaaagaggaacactcctccattgttggtgggattgcaggcttgtacaaccactctggaaatcagtctggcggttcctcagaaaattggacatagtactaccggaggatccagcaatacctctcctgggcatatatccagaagaagccccaactggtaagaaggacacatgctccactatgttcatagcagccttatttataatagccagaaactggaaagaacccagatgcccctcaacagaggaatggatacagaaaatgtggtacatctacacaatggagtactactcagctattaaaaagaatgaatttatgaaattcctagccaaatggatggacctggagagcatcatcctgagtgaggtaacacaatcacaaaggaactcacacaatatgtactcactgataagtggatactagcccaaaacctaggatacccacgatataagatacaatttcctaaacacatgaaactcaagaaaaatgaagactgaagtgtggacactatgcccctccttagaagtgggaacaaaacacccatggaaggagttacagaaacaaagtatggagctgagatgaaaggatggaccatgtagagactgccatatccagggatccaccccataatcagcttccaaatgctgacaccattgcatacactagcaagattttactgaaaggacccagatgtagctgtctcttgtgagactatgccggggcctagcaaacacagaagtggatgctcacagtcagctaatggatggatcacagggctcccaatggaggagctagagaaagtacccaaggagctaaagggatcttcaaccctataggtggaacaacattatgaactaaccagtacccctgagctcttgactctagctgcatatgtatcaaaagatggcctagtcggccatcactggaaagagaggcccattggacacgcagactttgtgtgccccggtacaggggaacgccagggccaaagggggggagtgggtgggtaggggagtgggggtgggtgggtaaggggcacttttggtatagcattggaaatgtaaatgagctaaatacctaataaaaaatggaaaaaaaaaaaaagaaaaaaaaaaaaagaatagatgaatttgcattcttctacatgataacctccagcaccatttattgaaaatgctgtcttttttccattggatggaaaaaataagatcccttgacaaagagcaagtgaccataggtgggtggggtcatttcttggtcctcaattcgattccattgttctactctacctgttcgttggtgtacaagtaccatgcagttttgttttgttttttttttttttttttcacaattattctgtagtacagcttgaggtcaggcatggtgattcccccagaggttcctctatagttcagaatagtttttgctatcctaggttttttgttattccagattaatttacaaattgccctttctaactatatgaagaattgaattggaattttgatgggggctgcattgaatctgtagattgctttcagcaaaataacaatatttactgtattaatcctgccaatccatgagcatgggagatccatccatcttctgagggtttctttcttcagaaaattgtagtacatatcatacagatctttcacttccttagtttgattcacactaaggtattttacatttttagtgactattgtgaagggtgttgcttccctaatttctttctcatcccgtttttcctttgtgtagataaaggccactgatttgtttgagttaattttatatccagatactgcacagaagctgttttacaggcttaggagttccctggtgcaatttttagggtcacttatatgtattatcatatcatctgcaaatagtgatattttgacttcttcctttctaatttgtatcccctctatctccttttgttttctaattgctctggcgagaacttcaagtactatattgaataggtatggagaaagtgggcagcctcctatagtctctgattttagtggggttaattcaactttctctccattcagtttgaggttggctactggtgtgctgtataatggttttattatttttggtatgagctttgaattcctgatccttccaaaccttttatcatgagtgggtgttggattttgtcaaatgctttatcaacatctacggagatgatcatgtggtgtttgtcttttgaggttatttataaagtggattatgttgatggatttccatttattaagccatccctacatacctgggatgaagcctacttgatcatgatggatgattattttgctgtgttcttggattccatttgtgagaatttcagtgagtatttttgcatcgatattcataagggaaattgatctggaattctctttctttgttagttctttgtgtggtttgggtatgagagtaattgtggcttcatagaatgaattgggtagagtaccttctatttctattttgtgaaattggttgagaattagaattagggctttgtggaaggtctgttagatctctgccctacacacatctggttctgggcttttttttttttccctttgtttttgttgttgttgttaggagactattaaagattgcttctgtttctttgggggatatggggctgtttagattgtttagatccttaatctgattctgatttaaatttgttacctgttgtctgtctagaaaattgtccatttcattcaagttttccagttttgttgagtttagccttttgtagtaggatctgatgatgctttggatttcctcaggttctgttgttatgtctcccttttaatttctgattttgttaattaggatactgtccctgtgccctcatgtttgtctggcttagggtttatctatcttattgattttctcaaagaacaagctcctggtttggttgatactttcaatagttctttttgtttctacttggttgatttcagccttgagtttgattatttcctgctacctactcctcttgggtgaattttcttccttttgttttggagcttttagttgtgctgttaggctgctagagtatgctctctctagtttctttttggcaacactcagagctatgaagtttcctattaggactcctttccttgagtcccataagtttgggtgtgtgtggcttcatttacattaaactctaaaacatctttaatttctttatttcttccttgacagagttatcattgattattgttgttcagcttccacgtaaacattggcttttttttttagtatttttattattatgtattttcctcaattacatttagaatgctatcccaaaagtccccaatacccaccaaccgcccccacttccctactcacccattcccattttttggcctggcattcccctgtactggggcatataatgttttcctgtccaatgggcctctttttccagtgatggccgactaggccatcttttgatacatatgcagctagagtcaagagctccggggtaatggttagttcataatgtttttgcacctacagggttgcagatctctttagctacttggatactttctctatctcctccattgggagccctgtgatccatccaatagctgactgtgagcatctacttatgtgtttgctaggccctggcctagcctcaaaagggacagctatatcagggtcctttcagcaaaatcttgctagtgtatgcaatggtgtcatcgtttggaagctaattatgggatgggtccctggatatggcagtctctagatgatccatccttttgtctcagctccaaactttgtctctgtaactccttccatgggtgattgtttcaaattctaggaaggggcaaagtgtccacactttggtcttcattcttcttcagtttcatgtgttttgcaaattgtatcttgtatcttgggtattctaagtttctgggctactatccaattatcaatgaatacatatcatttgagttcttttgtgattgtgttacctcactcaggatgatgccctccaggtccatccatttgcctaggaatttcataaattcatcctttttaatagctgagtagtattccattgtgtaaatgtaccacatttttttctatccattcctctgttgaggggcatctgggttctatccagcttctggctattataaataaggatgctaggaacatagtggagcatgtgtccttcttaccagttgggacatcttctatatatatatgcccaggagaggtattgtggtatcctccagtattactatgcccaattttctgaggaaccgccagactgatttccagagtggttgtaaaagcttgcaatcgcatcaacaatggaggagtgtccctctttctccacatcctcgccagcatctgctgtcacctgaatttttgatcttagccattctgactattgtgagatggaatctcagtgttgttttgatttgcacttctctgatgatgaaggatgctgagcattttttcaggtgcttctcagccattcggtattcctcaggtgagaattctttgtttagctctgagccccattttttaatggggttatttgattttctggagtccaccttctttaattctttatatatattggatattagtcccctatctgatttaggataggtaatgatcctttcccaatctgttggtggcctttttgtcttattgatggtgtcttttgccttacagaagctttgcagtttcatgaggtcccacttgtcaattctcaatattacagcacaagccattgctgttctattcaggaatttttcccctgtgcacatatctccgaggcttttccccactttctcctctataagtttcagtgtctctggttgtatgtgaagttccttgatccacttagatttgacattagtacaaggatataggcatggaccgattagcatacttctgaatgttaacaaccagttgtgccagcaccatttgctgaaaatgctgtctttcttccacttgatggttttagctcccttgtcgaagatcaagtgaccataagtgtgtgggttaatttctgggtcttcaattcttttccattggtctacttgtctgtctctataccagtaccatgtagttttatcacaattgctctgtactaaagctttaggttaggcatggtgattacaccagaggttcttttatccttgagaagagtttttgctatcctaggtttttttgttattccagatgaatttgcagattgctctttctaattcattgaagaattgagttggaattttgatggggattgcattgaatctgtagattgcttttggcatgatggccatttttacaatgttgatcctgccaatccatgagcatgggagatctttccatcttctgagatcttcttcaatttctttcttcagagacttgaagttcttatcatacagatctttcacttctttagttagagtcacgccaagatattttatattatttgtgactattgagaagggtgttgtttccctaatttctttctcagcctgtttattctttgtgtggagaaaggctattgacttgtttgagttaattttatatccagctacatcacagaagctgtttatcaggtttaggagttctctggtagaatgtttagggtcacttatatatgctatcatatcatctgcaaagagtgatattttgacttcctcttttccaatttgtatccccttgatctccttttgttgtctaattgctctggctaggacttcaagtactatgttgaagagatagggagaaagtgggcagccttttctagtccctgattttagtggaattgcttccagcatctcacaatttactttgatgttgaatactggtttgctgtagattgcttttatcatgtttaggtatgggccttgaattcctgatctttctaagacttttatcatgaatgggtgttggatcttgtcaaatgctttctctgcatctaatgagatgatcatgtggtttttgtcctgagtttgtttatataatggaatacgttgattgatttttgtatattaaaccatccctgcatccctggaataaaacgtacttggtcccgatggatgattgctttaatgtgttcttggattcggttagtgagaattttattgagtatttttgcattgatattcataagggaaattggtctgaagttctcaatctttgttggatctttctgtggtttaggtatcagagtaattgtggcttcatagaatgagttgggtagagtaccttctacttctattttgtggaatagtttgtgcagaactggaattagatattctttgaaggtctggtagaactctgcactaaacccatctggtcctgggctttttttttttttttttggttgggagactattaatgactgcttctatttctttaggggatatgggactgtttagatctttaatctgatcctgatttaacttttgtactgggtatctgtctagaaatttgtccattttgtccaggttttccagttttgttgagtatagccttttgtagaaggatctgatggtgttttggatttcttcaggatctgttgttatgtctccctttccatttctgattttgttaattaggatactgtccctgtgccctctagtgagtctagctaagggtttatctatcttgttgattttctcaaagaaccaactcctcgtttggttaattctttgaatagttcttcttgtttccacttggttgatttcacccttgagtttgattatttcctgctgtctactcctcttgggtgaatttgcttccttttttccaagagcatttagatgtgttgtcaagctgctagtatgtgctctctctagtttctttttggaggcactcagagctatgagtttccctcttagaaatgctttcattgtgtcccataggtttgggtatgttgtggcttcattttcattaaactctaaaaaatctttaatgcaaggccggcatacccttgactctgacgcgaggacggggccgggtgccatggcctcccacttattctacacctctcatgtctcttcaccataccagactagagtcaagctcaacagggtcttctttcccccgctgattccaccaagcccgttcccttggctgtggtttcgctgaatagtaggtagggacagtgggaatctcgttcatccattcatgcgtgtcactaattaggtgatgaggcatttggctaccttaagagagtcatagttactcccgccgtttaccagcgcttcattgaatttcttcactttgacattcagagcactgggcagaaatcacattgtgtcaacacctgccacgggcctttgcgacaacattggctttctattatttatgttgttattaaagatcagccttagactgtggtgatctgataggttgcatgggataatttcaatatttttgtatctgttgagtgctgttatgtgtacaattatatagtcaattttggagaaagtaccatgaggtgctgagaaggaggtatatccttttgttttagtataaaatgttctgtagatatctgttagatccatttgtttcataacttctgttagtttccctgtgtctctgtttagtttctgtttccaggatctgttcattaatgagagtggtgtgttaaagtctcccactattattgtgtggtgaaatatgtgctttgagttgtactaaagtttcattaataaatatagatgcccttgcatttggagcatacatgttcagaattgagagttcatcttggaaaattttactgttgatgtttatgaagtgaccctccttgtcttttttgatatatttgagttggaaggtgatttcattcgatattagaatggctattccaactcgtttctttggactgtttgcttggaaattgttttccagacattattctgatattgtgtttgtgttcttaaggtatgttttctatatgtagcataatgttggatcatgtttatgttgccagtgtgttatctatgtatttttattggtgaattgagtccattgatattaagagatattaaggaaaagtaattgttacttcctgttatttttgttgttaaagttgggattctattcttgtggctatcttcttttaggtctgttgaaggattactttcttgctttttcaggcttaggagttctctgggggaatttttaggatcacttatatgtactatcatatcgttttcaaaaagtaatattttgacttcttcctttccaatttgtattcccttgatctcttttgttgtctaattgctctggctaggacttcaagtacaatgttaaattggtagggagagagtggacagccttgtctagtccctgattttagtgggattgcttccagcttctcaccatttactttgatgttggctactggtttgctgtagattgcttttatcatgtttaggtatgggccttgaattcctgatctttccaagactttttatcatgaatgggtgttggattttgtcgaatgttttctccgcatctaacgagatgatcatgtggtttttgtctttgagtttgtttatgtactggattacgttgatggatttctgtatattgaaccatccctgcatccctgggatgaaacctatttggtcaggatggatgattgttttgatgagttcttggattcagttagtgagaactttattgaggatttttgcatcgatattcataagggaaattggtctgaagttctctaattttttgggtctttttgtggtttaggtatcagagtaattatggctttatagacaaggaggggcgcttcatactcatcaaaggtaaaatcctccaagaggaactatcaattctgaatatctatgctccaaatacaagggcagccacattcattaaagaaactttagtaaagcacaaagcacacattgcactttacacaataatagtgggagacttcaacacaccactttcaccaatggacagatcatggaaacagaaactaaacagggacacagtgaaactaacagaagttatgaaacaaatggatttaacatatatctacagaacgttttatcctaaaacacaagggtataccttcttctcaacacctcatggtaccttctccaaaattgaccacataattggtcacaaaacaagcctcaacatatacaaaaatattgaaatttacccatgcatcctatcagatcaccatggactaaggctgatcctcaataacaaaataaataatataaagccaacattcacgtggaaactgaagaacactcttcttaatgatacctttggcaaggaaggaataaagaaagaaattaaagactttttagagtttaatgaaaatgaagccacaacatatccaaacctataggacacaatgaaagcatttctaagaggggaaacttcttgagtgcctccaagaagaaacgggagagagcacacaacagcagcttgacaacacatctaaaagctctaggaaaaaaggaaaaaaattcacccaagaggagaagatggcaggaaataatcaaactcaggtgtgaaatcaaccaagtggaaacaagaagaactattcaaagaattaaccaaacgaggagttggttctttgagaaaatcaacaagatagataaacccttagctagactcactagagggcacagggacaaaatcctaattaacaaaatcagaaatgaaaagggagacataacaacagatcctgaagaaatccaaaacaccatcagatcctacaacaaaaggctatactcaacaaaactggagaacctggttgaaatggacaagtttctagacagatacctggtaccaaagttaaatgaagagcaggttaatgatctaaacagtcttatatcccctaaagaaatagaagcagtcattaatagtctcccagccaaaaaaaagcccaggaccagatgggttttgtgcagagttctatcagaccttcaaagaagatctaatcccagttcttcacaaactattctacaaaagagaaagcatttctaagaggaaaactcacagctctgagtgcctccaaaaattaactacagagagtacacaatagcagcttaacaacacacctaaaatctctagaacaaaaggaagcatattcatccaagaggagcagatgacaggaaataatcaaactcaggggtgaaatcaaccaagtggaaacaagaagaactattcaaagaatcaaccaaacaaggagctggttctttgagaaaatcaacaagatagataaacccttacccatattcactagatgtacagggacagcatcctaactaacagaatcagaaatgaaaagggggacataacaacagattctgaagaaatccaaaacaccatcacatccttctacaaaaggctatacgcaacaatactggaaaacctggatgaaatggacaaatttctagacagatacccagtacaaaagttaaatcaggatcagattaatgatctaaacagtcctatatcacctaaagaaatagaagcagtcattaatagtctcccaaccaaaaaaaaaagcccaggaccagatgggtttagtgcagagttctatcagaccttcaatgaagatctaattccagttcttcacaaaatattccacaaaatagaaacagaaggtacactacccaattcattctatgaagccacaaatactctgatacctacaccaaagaaatacccaacaaagagagagtacttcagaccaatttatcttatgaatatcgatgcaaaaatactcaataaaatacttgctaactgattccaagaacacatcaaatcaatcatccatcttcaccaagtatgtctcattccacagatccagggatggtttaatataaggaaatccaacaacataatccactatataaacaaactcaaagacaaaaaacaaatgatcatctcgttagatgcagagaaatcatttgctaaaatccaacacccattcatgataaaagtattggaaaggttacaaattcaaggcccatacataaacatgataaaagcaatctacagcaaaccaatagccaaagtcaaagtaaatggtaagaagttggaagcaatcccattaaaatcaggaactagacaaagctgcccactttctccctacctattcaacatagtacttgaagtcttcgccagagcaattctacaacaaatggtgatcaagggaatgcaaattggaaaggaagaagtcaaaatatcactttttgcagatgatatgataatatatatgtaagtgaccctaaaaattccaccagagaactcctaaacctgataaacagcttcagtgaagtagctggatataaaattaactcaaacaatcaatgccctttctctacaaaagggataaacaggctgagaaagaaattagggaaacaactcgcttcacaatagtcacaaataatataaaatacattggagtgattctaaaaggaagtaaaagttttgtttgatacaaagttcaagtctctgaagaaataaactaaagaaaatctcagaagattgaaagatcccccatgctcatggattggcaggatcaacattgtaaaaatggctatcttgtctaaagcaatctacagattcaatgcaaacctcatcaaaattccaactcaattcttcaacgaattagaaagggcaacttgaaaattcatctggaataccaaaaaacctaggatagcaaaaattcttctcaatgataaaagaaactctggtggaatcactttgcttgacctaaagctgtattacagagcaattgtgataaaaactgcatggtactgctataatgacagacaagtagaccaactgaatagaattgaagacccagaaatgaacccacacacctatggtcacttgatctttgacaagggagctaaaagcatccagtagaaaacgacagcatttttaacagttatcatgtagaagaatgcgaattgatccactcctatcttcgtgtactaaggtcaaatctaagtggattaaggaactccacataaaaccagagacagtgaaacttatagaggagaaaagcctcaaagacatgggcacaggggaaaaattcctgaacaaaatagcaattgcttgttctgtaagatcaagaattgacaaaagggacctcatcaaattacaaagcttctgtaaggcaaaagatactgtcaataagacaaaaaggccaccaacacattgcgaaagaatttttatctatctatctatctatctatctatctatctatctatctatctatctatctatctatctataaaactcaagaatgtggactacaaaaaatcaaataaccccatttaaaaatggggctcagagctaaacaaagaaatcttacctgaggaaaaccgaatgcgtgagaagcacctgaaaaaaaatattcagcttcattaatcatcagggaaatgcaaatcaaaacgatcctgagattccacctcacaccactcagaatggctaagataaaatattcaaatgacatcgaggatgtggggaaaaaggaacactcctccattattggtgggattgaaagcttgtacaaccactctggaaatcagtcaggcggttcctcataaaattggacatagttctaccagaggatccaacaattcctctcctgggcatatccagaagatattccaactggtaagaaggacacatgctccactatgttaatagcagccttatttataatagccagaagctggaaagaaaacagatgtccttcaacagagaaatggatacagaaattgtggtacatttatacaatggagtactattcagctattaaaaagaatgaatttatgaaattcttaggcaaattgatgggcctagagggcataatcctgagtgaggtaacccaatcacaaaagaactcacatgatatgtactcactgataagtggatattagcccagaaacttagaatacccaagataaaagatacaatttgcaaaacacatgaaactcaagaagaaccaagaccaaagtgtgaacactttgccccttcttagaattgggaacaaaagatccatggaaggagttacagagacaatgtttggacctgtgccaaaaggatggaccatctagagactgccataccaggggacccatcccataatcagcctccaaatgctgacaccaatgcatacaccagcaagatttttctgaaaggacccatatatagctgtctcttgttaggctatgctggggcctggcaaacacagaagtggatgctcacagtcaggtattgaatggtacacagggcccccaatggaggacctagagaaagtacccaaggagccaaagggatctgcatccatatagatagctggaacaacaatatgaactaaccagtatatgctggagctcatgtctctagctgcatatgtatcagaagatggcctagtgggccatcattgggaagagaggcccctttgtcttgcaaactttatatgcctcagtaaggtagaacaccaggtccaagaagtgggggtgggtgggtaggggagtaggagggggagcatctgggggacttttgtgatagcatttgaaatgtaaattaagaaaatgcctaattaaaaaaataaattaaaaaaaaagagttttaattctcttgtctcttcctcttcagcccagtgtattcatcctccctattccagctgcccactgttgtctacacaaatctttagctctctctctctctccctctccctttccctctcactcaccctctctttctctctttctctctctctctctctctctctctctctctctctctctcacacacacacacacggacacggacacacacagagacacactgtgtatgcctgtgtacttgtgtagttgtgtgtctgtgtgttatctacagatcaacctcaatgtcatttctcaagagtcaacaaccttatgattttgaaaccggatctttttttggaacttgaacttcttcaattaggttgtgctccttgaccagtaataccaaattccctcctgtttcatcttccccttcaattccttgagttcataagcataagccatcaaatgagtcttttttttgtttgtttgtttgggtcctagaatggtaactcagatcatcatatgtccatctcaggtacttcactgactgtctgatatccctaagctctcttcagcctctttctatgagagcattatctgtcatgcaacgtgtattgacagcatcatgaagcactatagtttgccacataagcagtttggccacgtgtaaacttttattttctacattgactagtggagacagtttgtcatttaagaagacactagagcttctacatattggactgttgaaatgaatgactttagattgttaagatgtttcagaaaataaaagtgttttgctgcacatgtacacaactttcagtttgatcccctggaacatatgctaacacctagccaaccaatcatatgtagtttgtgctgcatttttgaaatcccagtgctccccttgtgagaaggattagaaaaaggagaatgtatgagacattaggggccaggtataataggtatatccagtgcaatagaaataaataacacagcttctgcctcaacaaagtagaaggaaaaaaatctgactctcaaaagttgtcctgagattttcacagatttccatggaacatgtgtgactggatatacttacacatatgtatcttacacacatatgaaaatgttgtaaaatagtcataattaaaaagaacactttgagtctaatttaattgatttttttattattatttagacagatctttcctgggtaccattgagatctgcatagatcaacaagtcatgggtcctgctttggggctttataggttgttctgtacatggtcattacatgaggcaataattacaagttgagtgagttgtgtccaatggagtagttcacagatgatgaaatacattcctgatttaagattgggacaaaggggattagaagcaagggtatatataaaattcagatgatgattgtcaacctgataggattgaaaatcaccatgggagtaaatctctcaatgtttctatgaaagatattctagattacatgaattaaggtgttaaaacccactaactctggatagaatcattccatgctaatatccttgactgaatcagaaagtggaatctagcattcacctttgtttcctaactatggattcagtgaatcaatattcctcaggctcctgacaccacatctttcatactatggaggtcagtacccttgaattgtaaggataaaaatatggttaaaaatactaaccccctttattgaagatgttttctttttttcaattgtatatttttaatttctttgtcaaagatcaagagtctggaagagtgtggttttatttctggatcttaaaatgctattccacgtgtctgtctctgtaccatgcagacattatcactattgctctgtagaatagtttgatgtcagggatggtgattcccctagaaattattttttggttaagaattattttcactattctgggtttttgtcttttctagatgaatttgagtattggtctttccatgttcttgaataattgttttgggattttaatggagattgcattgaatcaatagactgtctttggtaggatagccatctttactatgttaaatctgtcaaaccatgagagtaggagatctctccattttctgacatcttctttgatttctttcttgtgagacttgaagatattgtcacacagtcaaatctcaagaccaagtggatcaaggacctcactataaaaccagatactctgaatctaataggagagaaaataggaaagaaccttaaatttattggcatagagaaaaacttcctaaaaagaatgccaatggctcatgctctaatgtcaagaaatgataaatgggacctcaggaaactggaaagcaaaggatataatcaaaaggacaaatcagcaacctacagattgggaaaaaaaatcttcactaaccaaacatccaatggagggctaatgtccaaaatacataatgaactcaagaaactaactaccaaaaatcaaaacaacccaatcaaaaaaggggtataaaactaacagaatttataacagagaaaaagcaaatggctgagaagcacttaaagaaatgttcaaagtctttagtgatcagagaaatgcaaagcaaaaaagcaaaacaaccctgagattccacctttaaccaatcagaatggctaaaatcaaaacctcaggtgacagtacatgttggcaaggatgtggaaaaagatgaacactcccccattgctggtgggattgcaaactggtacaaccactctgataatcaatctgggggttacttataaaattggaaatagatcaacctgaagattcagctgtaccagtcttggtcatatacccaaaagatagcctaccatggcacaggagcatgtgttccactatgtccactatagcagccttgtttgtgatagtcagaagctgaaaacaatgcagacatccaacaccaaaaaaaatggaaacagaaaatgagattcattttcacaatgggatactactaagctattaagaatgaggacatcccgagttttgcatgcaaatggatggaactagcaaatatcatccagtgtgaggaactcagaccaaaaataacatgcatggtttgtactcaataataagtggatattagatgaaaaatgtacagaatacccaggatatagtctactgaactcgaaaaagttaacaaactgaagggcccaagttagtatgcctcagttccacttgggagggagaagaaaccaaccacaggggagtaggcagagagaaggggtctgggtgttaaaggggaggggaagaggagaacattatcaagtattgggatggggaagcatgactgaagaccctagggccagcagaaaggatggaaaagtcaaccacaggaggtatgacatggggtatcctccaaaatgtatcagagacctggtaagaaacttaggactcaaagggagggaccttggatgaaatgccatgcactggggagaggcaatttttagagcccacttttagcagaaagactgggcatcttgtgagggatcaggttgctatcctgcagtcaagaactctgccccatagttgttcctgtctgaaaaaaaaaattgcaaggacaaaaatgcaaaagggcctgaagaaaaggaggtccagtgacagtcccaaattgggatttagctcatgtggaggctccaagtcttgacactattactgaaaaacacaacaagtagctaaagagtccgatgcatatacttatacccaacctatacacagaagaggctgacccctgtggttgaactagagaaaagctggaagaagctgaggatgagggcgaacctgtaggaggatcaggaatctcaatgaacctggacctctgatcaagatctctcagacactagaccaccaaccaggaagcatgcaccagctgatgtgatgtgcggccccaacacctacacagcagagcactgcttgatctgaactcagtcagagaagatgcacctaaccctcacgagaatggaggccccagggagtagggggttctggtggaagggtggattagtgagttggggacttccttgtggagatggggggaggggaggtatggaatatggaatagtcagagggtggaccacgagggcgataaaatctggattaatcaaaaaacaaaacaaaacaaaacaacactaaataggagaagaaaatcctaagccatgaagttggagttgatttaattaatgaagaaaggatagggagggtggtctcagagacggtacagatttagaattctcagggtgaaaagaatttggatgtgccaagggaaatagaaatatattgtggctggatgttctctcgatcctgcatctagagacagaatggttatacaagtagttttcctgaagttgtaaagaaggaaatctaatctcccctagcaactgtctgctgccaatagctcttcagctctgtgttcaacactgagagtttttcatcttgcaagatgaaagactgaattaaacatttgtggatataagactacttttcacattgaatgtttctgaaatgtagctatcaaatcattttctcatatttccaagaaccatttccaagtctctattaatcagacataacttctctattttctaagtctctgttgattagacataatgttaccattttaagagtctactgactagacactgcttcctcaaaacatctgtggaagcaggacccattgcttgcttcacaattgtcacagacttattcagcatgtatatatctcgttctctaaggaaatgaatcaagtacccatgtgtccaagattcatggtcacatccaatgaactgatacaggcaaaaagaggaaaggagggtttttacccctcaaaattgtattgactaaaaagacccaaaacatagaatcacgcacagggctttcagcttgtgtgttcctgttcttttccatgactgagaaagtggaagtaaatattgctatgagtataaacagcatagtgaaatcaaggtgagctataatacaccaatctaggtaataaccatagaggccacaaaatttagcacagcttattgcaaagtgtaaagggatttccatgggctttgccatcagtgtagcactcatatgctcttccctttagatgctgcatggccactgcaatggcctgcttcctcctatgctctgtgtgctatacctttctcactgcactgtcttctgtattagagatcattttggacatagttcctggctactggctgtttttcttgttcacccatggggtgttgaaggcaggacattttgatgatattgtgagaggcgaaaggctatataaggacacaagtagaaagtgagccctattctcatacttcacttacctttctggcagaatttctaagtgcctgcttttttaacccacaggtggtgtattttatgacactgtaagctgacaagaaatccacccccatcctcaaccaattacttggtaaaatgacagccatctgtgacaaactgctaaaactaaggtttttctggaagtttcgaactagctcgagggaaagacatctttccatgaagcgtgaagctaaaatgtaaactttgaggttgtttatcttcatgtactgggcagcaagaaggccttctgacaaagtacagaggtacagatacaccaagaaaatagcagcttagggtctggtatggctcctgagtcaaaaagaaaagtaggctacaacctactgtaaccttcctttgcctttttcccttacatattagttatactatatattaatatcttaaattgttttcatcacaaaacatgattctcttgtgctttactctggatgcatgagttcattcctggtgtttgcaaacacataacaaatctcaagtatgctgtccttgctgtttccaatacatacctgttggtatttcttagtcttttctgagatgttcagaatccctgggtatccaaatgatgatgcatagataactaatctcaaatgctttcttaggaagcttggtagcttctgctgaggtaggtcacaatgtcagtttgatgtcactgaaatatttaaggcagagctggaagtttagaacacagaaatattggaggttgatttggagttccttcagtagtatgaattttttgggcacaaaataaaattaagttcttataaactgctttttataggatgttcttggatttttcttgatatgctctttctttgcccagagctacaagtgtactatgtgaactttccccaactaagaacatgtcatgaatagtttcaattattgctcaccaaaatctcaccaagagttttagaggattcattgttgtccttacatttctaaacatccttttatgcctttacatttttatagtaacatggactacctgcacagaacacacagatgtctctttgggaaaatcctgatagaggaaaatctgaatttaaaggagatataaataagagtgtttgtattctcatggttttgtggaggattcagatatcagatttcactggtgcctttggtgtcttccctattttctttactgatcgtcaacaatgtcttacacagactaggttctgaatggaaattctgatatttgtttgatgagtctcttgggaagcatagcattgtagagcttgagtcattgtttcccactgctaattggagataaattatagagagaaggatagccatatctcatagggaaatgggactcaatttgtaaaaatatgtgactcagacacagatttgaggaagttgcttgctacataaactaaactatacatgaaattttcatgtcatcatctccaaaaacccaaacaaactctaccaggaacaaagcatttctataaaaatgaggaagtacatgcccattccaaagtcatgttgagagccagaatttttgtaaagaggaactcattttattctttgtctctctgtctcagtttctgtctctacctctccctttccctctcattcaccctctgtgcatgtgtgcaggtgcacttgtgtccttaaatatattcatgcactacatgtgaaggccagaggataaaaatcagctttcatttttccatccagggacactcactttaaaaaaaaaaaaaagacaagttctgtgtgtagtattggagctcatcaagtatactatattattggctgtacactgagcacacggatcctcctctgtccacctcccaagtgctgtgattataagtagatattacatgcctagccattaaaagcaggtgttaggagtttgaactcatgtccttaagattacaaggcaagcactctactgactgaatccaaccctctattttttcattttctcattataggatcattgagggaagaggtcacattttgcaaaactgaggccttgaccagcatgagcaactgaaggtattttgcttctttctcctgagtgtctgcataggaaggacttctggttgtaaagagcagttactaaagggggatgggttgtcaagaaggaagaatttcttatgagtaaagaaagttacttcctggacttcaatggtaggaatactgttaatctcagtcagttgacccagaagatgagagtgtcaagaatgtaagctgggcttcactcttcatacttactctatctttttcttcaggtgtagttttaccaagatgtaaatgcatattgccggtcatcaagaagaaggagaaaactgacaacccaagatgcaggacagtatttatactaattaccatgaaactctgagaaaaagtgccttgagacaaccaaaaatctctaagaactgtacctgacatgagattccaatacacaaattgcattcaatatgaattcatgaagtacccctgtatgtatctcctgtaataagtactagaaactaaaatagtaggcaactttatagatttttatcccccccagtgtgtatgtgtttgtgaatattcacaagagagatgggaattggaaagatggaatatgccagaagactgaggcacaaggacattatatttgaggcagtctaatatagggagtccctgtatttaaataaagaatagacatcagaatatagttcactggtgaagcatttgtacaacatgcacagggccctggacactcccctcaacactggaagagaaatctctgagtgtcttacaatggggctatttacatagaaacctatgtatccgaggatggtgtatgatgtagcatggggaacgatgacaggcacaagtgttgagtagtaaatgatcaacttttaagtgtgaaaatgacaaatatacaaacttttgagtgataggactagtaagaggagaatgggatgctatgattgacagccataggtggcctctgttttagacgagacataaaggagaccctctataatgagtcatgacactgtgatataacatggaaagctcatttcagacagagggaacagcaggtagattgatcaaaggaaagagtgaccatgaagttggtgtgacaagtgctagaacagagacaaaataggacatgaaagtagaggggcaaacaggagtcaaaacatgaagaataccgtagggctttgtgtgatgaggtcataactagaaatttaagaggaattgatagtattaaagtgtttggtttttttttttttttttttttttttttttgacagaattggcctgagtgagagatagaaaagtctgttttgctttgacatagaggatgtgagttcagagagacaatggaaagccagtgtgttgatttctatcatctatagtgagtattccctggaatctgagtggcagatgagacaggtggtactgtgtagttatttaccaatgaaaatatcttctcccaagtacagaaagagactaattaatctaaggaagcaaatgaagcatacaagtatcagaaagtaaagttacagggcttaggaagctcatgaaatttataagattcacaagattttccgtaacccctatctaaggcttatataaacaataacaattcctagagagaagagactctgatggacttatctatttttgggttgttccaggatctcgaggtatgcagctgttatgatttgtcatccatgtcggtgtggagttttcagtgattattttccctttgagttacccttgtacctgtaaataatccctacctatgtaactgcaagcaaacactataagatcataggatcaccgagattgaattggatgggatcaagtttttgacctgtggtaagctttcaatcagtggtagatagatgttgcaagtttcctaggaaaagtcacacaagtactcatggccagctatgtgttaaaggattaaccactatggcttgcaaaagataatttaagatttcatttatcagattgtagttaagtaactagtggaaatgttgaacaataagggagagactgacatttgtactagatgtaatgaggagaagagtgacagctacatataattcttctgagagccagtggagaaagttcaaggaagcccacagtgggtttttggattttaatgcccagataaccacaacatgggccatacataaatctttaaaattcacaagctgtattaagcagataaaataaaacaggtaaagttagctttaaaatatatttaatagtttatcatatttccaaatactttcatttcagcatggagtcagtatgaaatagctagtgagatattatacatcttctgtattttgttttcaaattctggctttgtttctgtcttttagtccatctcagttcaacctctctgtactcatgtagcttggagctgtcatatgagaaatagaattcaggaaaaaagtgagatttaggcagttagagttgttgcttttttttttttttaatatgtaaggtacttggaaagattggagaaggctcagtggttaagagcacttccagttcttttattacacatgttgaataggttacaaccatatgtatttctagctccagggaatcaaacagcaacttttggcctccgtggatactatacatacacacacacacacacacacacacacacacacacacacacctttttaaagacacaaaattacctaagagcaacaatgtaataatatacatggcaaatttcatgggaatatagcttataaaccaaggcattttgaaactgacagatggacaaactaaatgcttaaaggactttaagttatcaatcaatagtaatatttgtgcacccacatatactgcagcatcacacataattgtcaagttttgaaatcaatttaggtacttatcaattgatgaatggataaaggaaccagaatatgcacacacacacacacacacataacgtataattatatctaattataattaatacgtattatatgtaattataattacataattataattaatataatatatcataatattatattaaatattatatatgataattataattatatgtaattataatttcaccatcacgaataagaccatgctctttgtagaaaaaataatgtatgcaacagggcatcaatatgttatgtgaaataaaccagattcagagagacaaatatcatgtttctcttatatgtaaaatctagattaaaaacaaaagacatgagattttgggggaaaaggaaagagaacagcagaaaggggaacaaaggaaggttttgggttgaccatatagaaaaatatcctaatgaaacagtatcatttttataagtaatgcatagtaataaaaatatcctaatgaaacagtatcatttttataagtaatgcatagtaataaaaggctttactataaatatagcaaatcaaagttttcaggtagagaagaaaaggttgggggacaggatatttttcctggagtgacaatggactgcttctgaatagagaagagatacatgtggctcataggcacctggtcatctataatgagaaaagaggacagattaggtgtgttgacttattttgattgttcaaattaaaaagggcatccaaagtggagcttttgatttcaggacttcagtactttggcaacagaaccttgattgtcagctttaggaggaggaagtggccacataagggaataaaccttggcggctaatgttaggaatataatataatggctttgatcaaggaagagggaatgctgaaaaggcatggcctcctagaacccatacatgccatgtttagactggtgagattcctttcaactgtagttatgggaaccatacattatcttgccatgatggcatccaattgcctgggttgcagatccaagtcttcatatctcgtccagctcttttttctgtttgcattcttttatctttcactttatcttctgtgacaaatgaataacaagctgctgtataatgttctcatgctcctgatccccaaaaagcattctttgttgagaaacacttgaatatgcccaacacatgtagttctgatcacacagaaatttagggaagtgtgggaactgagctaagcagtcatgaacttagcttcttgatacacttacggatgtctttataattaacatcagagcagaggcatactgtaggccactttgggtattgctgtcaggatgagattcagatgcaaaggctaatagattaaaaaaaaaaaaagagtaccaagatgagggtgaatataacatttttttttcagatttgaacttctctgcatatttctgaaatccatgtgtgtgtgtgtgtgtgtgtgtgtgtgtgtgtgcgtgtgcgtgtgcgtgtgcgtgtgtgtgtatctgtgtgtacctgcaagtacgtatgtgtttctgggtgttactgtgtgtgcatatagtatagatatgcaggtctttccttgggaactagcaaacatttgtaattccatgattatgctggcttatatgtcaaggggtcaagggagcccaaaggatttttcagtctctgcctcccagcactgggatgataagtgcatgccaccaatcctagctttataatgtgtggtacagggaatcaagctcagtccctcatgcttctgcaggaagcattttattgaacaagttatcgccccagttacccaaacctcagccttgacacggtttttacaggctgcataatgttccaccttcttgtttgcttaatatatttatttatttgtttgtttgtttgtttatttatttatttattcattcattcattcattcatttgacttagcaatgtagttagggcttactttatgtcagccattggttgtatagtgtttttatataaaagaaacatcacacctactgtaatcaagcataaagtgtagctaggataagacaaatgttagaaaaacatactattaaataaatatttcacttagaactggagcaaacatagaaagaaattcttgtaagaatccattgtatgcacatgcttttacatggtggcaggaaagcactggctttcccagtacatgaagaggtgttgtcttggaaacaacagttgctgatgtggagtttgcacagtgttttcttgttgttgttgttttggtttggtttggtttggtttttttttttgtttgtttgtttgttttgtattgtttttatgtgaggtgacctctggaactgaggactattaagtggctttaaataccctaaatatcaccttcttaaagtggacacttattgaaaaacaggtggtacagatgatgtctcactatccaggtaagtccctggatcagacactttgtcttagccttttgacttctttttcaagcagtaagaaagaaagatagagtctccttttcaggattacacaaaacctaaccagtaagcaggcattgaaatttcctaatgtcaaataaacatatgctatttccattgttgagacagctgaatctgatgactaggctgtgactctgttatttcctagaagaaaaccttcctcagaaaccctccttatgaaggagctgcagctcacagccccaggcaagaatttatacgtggagattttcattagtaacatgctcaggtgtttgtggcatagttcctggcaatgcagctaagaccaagggcaactaaggactactgccagctctagaagccattatagacaggggacaatcttccatcatagtgtcctgaacaaattaacccaacaaatatccaaagtctcctactatgctgtcctatgttgtgccatcactagctaaaagagatattaactgacttattcttttggaacatctatgacttctttatatcacagatctttcaggaattatactaccagtgcgcctgccttggcaaacaagaactctgatctcagtgatagttgtctcctgcatgtcccatccatctgagcttctgtacagcatcatggctcttgtgtttgtgtgtgactctgtgttctcctctgcttactttctgcacttaaagtctttttctctagaattctactgttggccctatccacccctctcataccctgtgtggccattctgtgtgctaatcacatctcttatacttcccccacgttgagtacttaccagtcactgtgtgtgcaggtgcatgtcagtatgcatgcagtcttttactgtggcactggaacttcataactggtcaagcacagttctaggacatgcactaacttttctgttctctacaaaatctcctgtatgttcttattccccactgataactgagggatctaatattgactgttactaatgttgtggtgttaatggagcccttatttagtttggaagaagtctgggattccatcccacgcctgtgtgagcaagtgactccgatttctgcactttagaggtgagtacataagaagaaggagttcaacatcctctcaagttacacataatttgaagccaacctgggatacatgaaattctgcctttttcaagtaaaggaaaaacatgccactgctttcccaatagtttgtagaaatgttctgggattgacttgaaagattctaggtgtaggaaggtagctagggataatgtgagttattaggagagagagagacagagaaagagacagagacagagagagacagagatagagacatagatggatagagacacagaaacagagacacggacaaacacagagacacagaaacacagaggatgaattgcagacatggagcctattgaacaaagaagaggaaaaatcagcaattttaattcttgcttgagaatgagaatccatgtggaattttaataaggaagaaaactttgaggaagatcacgctccatcttagcttttcttccaagacacttggtgatagattcggggagcagctggtgaaaatagtgttcactagttaaaaactggagcaaacttccttggtatacagaaatcaattcttcattttcattagctatgcaaatccaaacttgcacttttctgtctagagaaagcacccaaggagctaaagggaactgcaaccctataggtggaacaacattatgaactaagcagtaccccggagctcttgtctctagctgcatatgtatcaaaagatggcctagtcggccatcactgcaaagagaggcccattggacttgcaaactttatatgccccagtacagaggaacgccagggccaaaaagggggagtgggtgggtaggggagtggggggtgggtatgggggacttttggtttagcattggaaatgtaaatgaggtaagtacctaataaaaaatggggaaaaaaaaagcaacacatatttattatcctctagatttggctgacattctgatatttattaattctgtaagatttaatttgtaatagaccctgaatttggcacagaggagacatcagtgaccaaaactatactctgtcttctgtcttttggcttcctggtacaatgaaggatgcagtcacagcatcaggaactggatttagactaaggcagctgtgttagaaatgaggcacagtcatatgttaaatgtctataaagaaacaatttctctctaccaaactagaaaatagagtttaatcactttctaccatagacaccagtccggtatggcagtccctgggatgagggttctctaaggctaggtgggtaaggatttggtggtgacaaacagaaacaatcacagagacagtctgaatctgaatatattttgcagctctcaagcaagggattttatatagaaaaaacaattattacaactttgaaaagatgtattcagtgaaacaatcatgaatagaaacagataacatcatttggcatagtatggaacaaaaatcagccaagtggtacaagtctaaagtgatgtattcagtaaagcaatcacaaatagaagaggtgacatcattgttatttgggaagagaggaccttggacttgcaaacattatatgccctcatacaggggaacgccagggccaagaagtgggagtgggtgggtaggggagcagagtgggggagggtataggggactttctggatagcctttgaaatgaaaatgaagaaaatatctaataaaaaattgaaaaatatcatcctagtattgcaactctgaaagggtgtattcagtggggcagtcatcctaggctagtggcatatttccaagagcagattaataaatttttattgtcagttattgcttaacatctagtgcctgatttttttgtaaaatcttcaaaatataaatttaattattttaattatttttgtttaaggctttctttatcacatacggaagcccacttcctatgacacatttgcagccatatgaaattttattgttgggaaattttttatctatcataatgctgctatgtaattttgtaaatgattcatgaagtaaagcgctggttttcccggagataaggtcatggctagtgacccattctcaagggattgtttcttacccattttttcccacttaagatcttagcctgggctatcaggaacatgttgtaaataagaaaaggaataaaagaaacagataaattgccatgagacctactgctcaatattatgttccaggcaaaagttctacaacaggttcaaggaggcctccttcttttgaagtttttgcctctgtctgtagaacgtgtcacagagagtctactggggttggtgtgggtactttctactatgccttctctttccatttattctctctctctctctctctctctctctctcatatgtgtttatgtgtttgtttgtgtactttgcttcatatatgtgtgcatcacctggcatgcatgtggatgtctgaagaacaacctacaataataagctctctcctttaactatttgtgattcacagatcaaattcaggtcactgggcttgacagcaattgcccttacattgtgactcaccttactgactgaggaacacctttttagaggttgtatagcaggagtaatgtgtactactatctacgtgttttagatacagtcccacttctacaatagggagagaagaaactcatagaatccgagcagacctctggaactgccatctggagttttgtctctctggacattttgttatgaataacaacatgttagattgaaacctcaggcattggaatcatattttcctgctgctgaacacatcctgattgattctactttgtactacactttaagttctgtgattgcaggagtttaaaacatcatgtttatgcttgaaggcctgtcctcaagaacagtcctcagcttacactcagaaacacacacacacacacacacacacacacacacacacctatttctttcttcctttatgtctaaatatattagatggcagggagaataagaaagcagaggtggtagttttttgggaatcaatgtatactagataagttataagagattacatataaatatatgttaatttatgaatagtaataacaaaagtggttacaattatgttttttagtagaatgatggccttgactaggtaagaaaatagttacacatttctggaagtcatattttttactaggtaccttagatgtgagagctgagaattatgctccaatacaaataatagccaatcctatctgtgattactacatttcattcttgacccaatgtcccagacaatggctttccagcaaaagtatattgtattctgtctctactatttaaaatccccagttctgtaaaaacccacgttcactctgtgccttcctcatgaattatttctaagaaaggtgtccctgaatagaaatcatgaatagcaccagccctttatgtacatgtataaagaaatatatcatttttccctgtagtactgtgacagaagattatgatcgtggggtggtatcaagattaccatataaaagaaaggctggaaaacactgattctgagcttccaaggacagaggattcacaggaaaagctcacactctccaaacagcagcgaaggaaatgaccataaaggatcattactctcttggctaagtatcattgagcttttaacattttctatctctctgccccacttctcaggagtacacctccatgcattgtaatcagtgttgtccagttctatcactattagccattcacgcaatccagaaattcttagcaggttctctctgggttcagatccacacctgaagcaatactatgattataccttggtccacatttatggaaggtaatttccaagttggataacctcagccctatatataaaattagtaacaaggtttctaatatacctatacactataatgaaactcaccttctaaattaggcacaataaaagattaacaataactaacaatgaatagaccagtttaacaatatagtctaataatatttctgtgaatgtggttctctttggatttttgatgcagtacactatgtaaaaataaattaatttcttttctaatccactccatccatttgctttgtccaaaagtagaagggcatttttgagaaactgaggaaatatgcttatgggctagttgtgggctggccagtgtgactacagtgcaccgcactcatatggtttctagcagtcatttcataagatgtgaaacaaatcagtagaaatcaatttattactagtattcaaacaactgtatctaatagttatgattaccacatctgaagcatgttatttccaaggaaatgaattcttagggcccatcagcacactggccctgatgttactagggttaaaagatgagaatctggtccctggtaattctaagaagggagattcagccactcatgttcaattggccaagtaatggtgaaaataaaaaagagagattaaatcaatgtggcaacactgagaagagaaacaaataagaaacactactaatcctcaggtccatctccaggtcctgccattggctgattatgtttaaacagaaggtaagaggtatgccccattaggcagtcatggttccactcatcattgtcttatcactgtcttggactggagtcagccctgcaggagagttatacatgttgttagaactatgtaaaatattttcccaggaaataacatgccctctggctgaagctaggctttttttttttttttttttttttttttttttttaatttctcccatcaggagattcctggggaaattccagtgctggggaatcagtgtcccagctgttgatagtcaagtggatgtgtatggtgtctatctttagaatatgttccatataaatggcaatatgtttaatatgtaatatataatatgtgaaaactgaaacacagggtcacatcccacttcagtcctctagtagtgtgctgtttgttacactgcctatttcttctctgggcctgtcttattgcatcttatttccttatgagaataggcctgatgtgcacagctacttgaagttttctaacaaatcttccaagtaggcattagtcactgatggtccctctgacaactttaatcttgatccactaactacccctgcttgccccacccttcaatatatatatatttaattagctaaagaacatttacttattcacaggtgaaaaaacatgggaagttcagccagatttcccccttaattcttctggacagagataggatgagaacacatgatattaaagccacccccagaagaaaaattcctatcttcgtattaaaaaaaatcatcctttttatccccaaaggagaaggcacctcatctcaacacatacattttgcagacagtgtcatgcattctcagccattctttaactcactatgaagataagagtgacctgggacttctgatattcctgctctccctctctaatgttggcatgacaagtatgcaccagcaggccagattgaggtggagagaaccaagggcttcatgcatgctaagaggacacactaccaactgagctatagccctagttgttctacttggcattgatagtgaggatttctgctctcttttggcaagactgtctttacttggtaatttttcatgctgctatgtggtatgaagatgtgctatgaaggatccattgatttcccttgagggagacccccaatcttttctgtgtagagtggaacttctctgctgtgtacagccctaccaaacatattcaaaaccaaaattagcttgagctatgctgagtcaattcattttttcttactagagtaactgcaacatagtagtttagcagttgacagctatttccaataataactggaataataattcataattaataaaggtcataataaagtactctttcaaattaaaagtaccatttaacattccctccaccttttcttttattcctactgattcatttgaaacattgttgctttttcctttctcccataaaagggtaaaaaataccatttcacctctcagtaaaaatacaattttcttccagctggttcaccagcagttcaccattgatttatcataaaagccaattaaaagccaatcactctcatttcctaattccaagtgggtatgctttaaattgagtggagagagtctgctagtggcctgaattattcttatttgctgcttgggtagaagctaagcaacctactgagggaaagttccagagacacatgtatcaggttcactggtagtctactttccagtcctttacccatgttgatttgcttaggtcttagagaggtggaagccctagctgggaaagcctgtattcttaagccctgtactggcattgagcttcccgaggtgagcctagcttgggctcaagggccatattgtggatggcacagctttaaggtggcatgggaactttctgtaacagttaatgtaaatcgaatttctgcgacagtcaatgaatactaaagacacagtgtcttgggaatccattttcaactttaatgaaaaataatttgcaaaaactcttttcagctatccatgctcactgcctcttctgttttgtgctgccagcacccatttcactgatcatctttacagcaggagcaacttaacctgaaaatcaaacaaagccatatgttcaagtgcaagggaggcaagtgcttgggtgtgtctgtagcccaatctgagagcagaggatccctggcccttctcccttcctcatgtgtacaactttttctgaagaaaatatggaacaatactgtatagtcgggaatgaagatattttaaagagtcctgatgttcctccctttgtatatcatattattgaaataatggtccccccaaattaggatttttgctaggagtctgaggagaaattatctcaaagtttgatgctagccagaatgacaacttgtcttccagaaacaaattttacacagctttgataaactctcagaaatctagagaatgaagatgagtggtatcagtcttgcctcttttcaacacgagtgaaaaatgaagaaatggctgcttctaggtatgtttgagaagaaatttttattgtagatatgagggacaaactgctgtgcatatccctgcttcttttacttagtttcttttacgtagaataaattttgagtaaattggaattccccccaaaagcatacccttattttagaagtgctctcacttggccttctctactcctaaagaacatgactttaccttcctaaaaaatagttaagaatatcaacctaccccaaagttagagaaggagtggaaatactgtaagagccagagatgcggagatcttagcatatctatgctgcacagctagaaatctcttttatgttacgatttattttttttctcaaggagaatctctctcccaccaccaattggtttcttgatggaagatggaacttacctccttatttgcctctcactttactttgcattgagtaaattttcatttctttttggaagactttccaggtatctgaatttggagcacgtctcctatgaaatatgctcttctagctcataagaccttgagttatcagggaaaatttattgctttgaagactcagtagtagtcatttagtgtacctatcaaggcctttgtgctctctctctctccctctctctctctctctgtctccatctctgcctctctctctctgtctctgtctctctctgtctctccctctgtctctctgtctctgtctctctctctgtctctgtctccatctctgcctctctctctgtctgtctgtctctgtctgtctctctctctctgtctctctctgtctctgtctctccctctgtctctctgtctctctgtgtctgtctgtctctgtctgtctctctctctgtgtctctgtctctgtctctctgtctctatctctgcctctctctgtctgtctgtctctctctctgtctctgtctctctctgtctctacctctgtctctctgtctctctctctgtctctgtctgtctctgtctgtctgtctgtctctctctctctctctctctctctctctctctctctctctctctctctctcttcccataggagatagtccacaagccaaagagacagttccaaggaagtctaacttgacaaatcgatgagtttatttatggttatttacaggactatgattcaaaggaatgtgcaactctgaaaagaccacaccagttacagtgacagttcacagacactgcatgtcttcacaacttactggaagaccagctggtcagtatttcttgttcctagcaattctcacttcatgtagcactgggggggggggggggcggtggtcattaatcttataacgttcaggaacttcttgtgctttatggagtgttttaatgaccctctctcttagatgaaatattttagttgggaggaaattggttgtcagcacctttcctttctcccatttcctctccccttccattttctttccactttccttctttctcttcacttctattctactttttcttcatagtgcaattttttgttgttgttgttctgggcattatttatttctttgtacctcatagaaactgtgaagtagggaagagcttttctttgccaaccaccttcttctctctgatagttaatttttttcagggcacttattgtcacttgccaggatatgtttctttgtcagtttgtctccacacattggaaggtagtatgattagtaactggagtagctcctttgattctcctgtgacccgggacttagaacaacattcagtgtaagaagaaaactcaatcaataagtcttatgtgttgattttaagaaatagatacattggattcttacattgaagggaaaaaacacctgtggctgatgaaaaaaaaaaatcagacaaattatttgtttctataatggctaaccttcactcaatgtcaggtgatttataatcagtttagaaacacatgtcttcatatgtcttgtttttttgttttttttttaactgagcatggaagacttaccctaaatgtagacggcaccatccaataggcagggatctcagactaagaataagaggaaaaatgaggtaagcattagcattagctacttttgtccccctgactacagattaaatgtgagcaggggccttaagctccttcctgggtgacttctgagcaataatggactgcacttttaaattttgacccaatataagacttttctttctggagttattttttgtcaggttactttgtgagaacaaggaaaccagagactaatatatctcctatagccttatgtttataagagaagtatatacccctgtagctaagacaattttttttacaagagatgaatgagtgaggttttcctagccacatcttaacttgattttcctaacaggacttataaacaacggattaacagctttttctgatgtctgtaggggaaattatcaaaaataatttgccatgtaagtccaagaaatggctgctgtgttgattatctgtgccactgataaggaagatggcttattttgctggaatactgggttcttccttctagaggtgtctctggaaaagggagtttgtagatgccatacattattctgtcagttctgggtttgtttgtttttgtttttttttttttttttcagctgttggatccacaaaagaaaacccacatccttatgggggaggtagggaacatttgacaaaaatatttaaaagctatgtagaaactatgtgtagaagactataatagtttgactgacagcaccatttgcttatcaatgtacaaaatgaatctcaaagacaaaaagcaccaacatctactaatgaaaatacactaggttcaaataaaatagctgctgtttttctcaagtgtagggccaaatttcataagaaaaaaccaataaggttcttattagtctgaggagataaaaacaaaaatgtgttagaaaaacaatttgcaaaacactcattagtccagaattgttcagagaattctccctccagatctttaatgggccatgaaacctgaattcaatataaaatgacttaaccatcaagcaggagatctagatacaatttggttattttgctttcccattatggaattttatttttctttttgtggattctgtttctgtaaatactatttgctatactgaaatacaaagcttcccattgaaaatagagttctatctccttggagggggttatgtgcgttgaccaattgtgtttttctttgtttgtttgtttttttgtttttttttttgttttgtttttttgtttgtttgtttatttttgttactcttctgcccttgctttgctctttgtcaaagtcctcctggttgcttcatatttctcatactctgtcactgatctaaaatatgagttgcgtgagtctgccagcctgtgtaattttgagagcttgtactttaaaatcttgctttccaatccattaatttttgcatactaggtctgtttggaatcttatttctgcttgtaagaataacagactgctgtgaatttttttagtatctcacatttaaggcaggtgttttgcaggtacacaatttataaatcgtgccactagacttttggaggtacacagtacacagtggggcacttttacaataaactcaccagaagcagatgtatgtttccatttatgattgggtgtgttgtgttcctgtgtgctgttctgagatattcaggtgccccagtctaatcttctcatggtaactttcagtttacccagtaagaatagatggtgcaacgtaacaggatttcttcctcaggcttggaatgtcgctcagctgggaaactgcttccttagcatgcaccaagccttgggcttgatgaacctggataaacctggaattcctgtgcatacttgtaatcccagtatgatggcggtggagactggaatataagaagttcaaggtcacattcagttatatagtgtgtttgaggcaaatatgagattcatatgaccctgtgtttaaaaagaaccttcttaacattatgcagaaaatatgaaggatgttttcaggacatggtattgtgattttttttttttttgatttgtgttctagctactttttactttcaatttgacacagcctagacccttctacaaagagggagccccaacctgaattatttgttcaaagtgttctgtggccatggctgttcaatgttgttttgactgatgaattatgtgaggaggcccagcccatggaggaagcaggatttccagacaggtgggccacggcaataataataaaacaagctgagcatgagccagtgagtgagtctgtagcagaattcttccatagtttttgttccaacgtactgccttttgtttctgccttggtatccttcaatgatggattaacctctacaatgaaataaaccatttcctctcataaattgcttttggtcagattgttttgatcatagcaacagaaaactattagagtagtactttcaacaagagatgctgaagtgagtagggccttgcttccactaaaggaatcaaagtggctgattataatcacaggcaaggcagttatgcctgttggaactgggtaccagcaggctagttattgtgaagaggtgagtattgggcaggtatggatgagaagagctgacaggtcatgtttcatggtctgtggttctgtagcatcagggcttgatcagaattttgaggctttgcagtcatttgcttttgctagggggacacatctccccattttcacttttgtatactttcagcccagtgctgtcccaggaggttggtttgtgtattcagaattcggcatctaagtcatagagaaaaggaaaatagttccttggacaggagtcctgatatctctcagcagggtgacatttggatgtttccttaataactctgagtccctgtttccctgtaaagaaataaatatacctactacactgaaatattataaataatttcttaactggtagctgaagaaaaaggtcaactggtaaaatacttgctatgaaagcttgaggacgtaagttctttgttcaggactcatgtagaaaccttggtatggtaaaatgcaattacaatctcagcatatgagaaacagagacaggcagacacctggagctttgtgtcgagtagtctagactacatgttgagtaagtcaatgaaacaccctgtctcaaagtgggtggtacctgatgaatgacaagtaaggtttcctttggcctgcacatgcatatcacatatgtgtatgtgtatgaataaacacacacacatacacacacacattcacaaacacacaaagagagagagagagaaacagacagacagacagacagacagagacagtgatatttttcttaacctgagtgaactcaacagttcttagaagcaggatgaccatatagtaagcttgtcaaatattaatttcttgtccctgggttatatgtgcatgcttcttggccctttgcaaactgtgcttcagcaaggacaacctttccctcctaccattggcccatggtaggtgtttaaaggagatgaggaatggtgatgtcttactccttgtttcttcctgctcctatgtctatcccagcagtgttttgttcatcttcattcactactaaattggctccttctaactttcttttttttttttcttttttttttcctttttcttttttttttattttttttttccaattttattaggtatttagctcatttacatttccaatgctataccaaaagtcccccatacccacccacccccactcccctacccatccacttcccctttttggccctggcgttcccctgtactggggcatataaagtttgcgtgtccaatgggcctctctttccagtgatggccgactaggccatcttttgatacatatgcagctagagtcaagagctccagggtactggttagttcataatgttgttccacctatagggttgcagatccttgggtactttctctagctcctccattgggagccctgtgatccatccattagctgactatgagcatccacttctgtgtttgctatgccccggcatagtctcacaagagacagctacatctgggtcctttcgataaaatcttgctagtgtatgcaatggtgtcagcgtttggatgctgattatggggtggatccctggatatggcagtctctacatggtccatcctttcatctcagctccaaactttgtctctgtaactccttccatgggtgttttgttcccacctaggatagcaaaaactcttctcaaggataaaagaacctctggtggaatcaccatgcctgacctaaagctttactacagagcaattgtgataaaaactgcatggtactggtatagagacagacaagtagacaaatggaacagaattgaagacccagaaatgaacccacacacctatggtcacttgatcttcgacaagggagttaaaaccatccagtggaagaaagacagcattttcaacaattggtgctggcacaactggttgttatcatgtagaagaatgcgaatcgatccatacttatctccttgtactaaggtcaaatctaagtgaatcaaggaacttcacataaaaccagagactctgaaacttatagaagagaaagtgaggaaaagccttgaagatatgggcacaggggaaaaattcctgaacagaacagcaatggcttgtgctgtaagatcgagaattgacaaatgggacctaatgaaactccaaagtttctgcaaggcaaaagactccttctaactttcctgtgtcagctcaacagctcttaccttctgagggctgggttaggttaatgtgaatatcctttacacttgtagctttggatgtctccacttcatcttttatttcttcagcttcatggaagatcaaacatttagagacatgttatgctgctggcttggaggatgaatcctataacttaggatgcgtttagattcttagaattttaaacaaaaagtttattgaagagtctccaagaagaaatgtggccttgctgatattctgcttccaactcagagagccttgtggtgagcttccgaattatttctttctgattacaaggttgactatagaggacataaaaggatgtattcagacctcagagattatttagtgctggccctttaatgatgcttatgcctagggttctaaatgcctgtgttctgtaagtcaggttcatggacttatgctgtggtcattgacccactttctgaattttaaaagacaaagcagtccacattggtctatgtagtatgggctcttgtggcagaaagattttaacatccttgtgccatcccctcctttctaggtatcatctcaaaccaaccactttctctacaaaagccattattctcttagagtagtcatcagagatagaatgtaacagtcaaatgtctatgtaagagtgacctggattatgttgactggaacactgaattgtttgtcacaggttcaattgctaaatttttgacatttggctgttgtttccatttaatgaggttgtggcaactttaggagctgtagtctaatttaaagaagaaggtcacaatgaggattgggggtgggagtagagtttattcctagacccagcttctcatctgtttctttatttcccagctgtcatgaagtgcactgctctatccccccattgcatttcttccatgatggactcaaacctccaaatccaagggcacatgtaaatcctttcttctttatcttgttcttctgttacatacttctacagcaagagggaagttataaatacttatgtctttcatttaagctagggttcattcacaatggaaaatgaaactggaagtgaagagggtagaggagtatagtagtgctgtgctgaaatttcagctccaatgcctaagacatggtaccatgcaaagtagggcctcaggatttgtttgttcatatgtgttctgtgtgtccatgagagtactgtcacatgtgtgcacatgtgtgttgaagtcaacagtcaatcttaggtgtttttcctcagctaatttggctagacagtaaaccatacaaattccacagctccatctttgcagtaatataattacaagtatgtaagcatgtcttaccacatctgacttttaaaatgtaggtttgggggcttgaactcagagcagtatacttacagggaaaccattgagctatctcctagccaaaggaacatcacatctttttttcttaaaaacaaaacaacaaaaacaataacaacataaagcctggtaattaagaaatgttaagagacagactatctaagttcaaatttgggctctttttcttaacttgtctgtgtttagctggttaagtaacacaacttctctgagccttagtttctcactttacaaagaagtagcatgatacttattaggttcttggaaaagttaaatgacacaatgtatataatgtgatacaagaaaagcacaaggaaggattatgttaatattactcttgtattaatttctttagaagcaaagggtgttgagtgaggttcactatgagatgtgatgcatttcataaggctataatgcgtatcggtgaacaggtgtgaaactgactggcttgtcctactcatgcacatgattatactgctcaagtcctttatgccctggacagagagtcaggagcaactgagagagtgactgaaaatgagaagataaactatgtcttatatggctgaagatggtgatgagtgggaggtaagcttcatgacattagggactcctgtggtatttaagggaattgtgcatatttcaatgtttccatcagacaggagcctgtcttctgctgacaccttgtctgtagatatcgcctaggattttttttttctgttgctgtgataaaaatccttaccaagagaatcttgggtagtaaacggtatattgcagatgacaggttttagtgcattatggagggaagccagagcaggagcttgatgcaggaactaaaacagagacaatcaaaaatgttcctcactgtgtgtttcccagggcaggagctcacatacctttccttcataaaccaggtcaatctacccaggaatggcactacacacagtgggctgggaccttacacatcaatcaataataaaaaattatccacagacatgcctttaggtcaaccaggtagagacattctctaattgataagtccttcaaataactttggactgtgtcaagttgataactataatagcacatgtactaaatgacaatttccaccaatagtcaatatggacacacacacacacacacacacacacacacacacacacacacgcacacacacacttatatagaaatgcattcattaggttattggaaaggttgaaggcattcagaatcttcccagtgcctactagggaccaatcaccatgcactggttcctaagtggtgctggcatcttgggcaatcattggaaaatggtgctatgaaagttacaatgacaagcaaaatgtgaacagtagtcagtacagcagcctcaccacatagatgagtcttgatggtatgttgcaagttctatactgagaatctcacaaattttaggatatttcatccttccagtaaccctgtgtatttgtcattcctccttgatctgtagaaaattgaggccaggaataatctgtagttagtaccaagcaagatgggtgacacagcttgacttaagttgatgactatttgatccctaaaccttgtgcttttccaggtcaatttcattttacccaagagaaggcattcaacgaattacctacccatggagaagggtagcactatggtgagaaacaggaactggaaggaaacatttacttaggctgcctgatgtcatatcaggagggaaagaaggtgaattatggtattttatttttattgaaattagatttttctctcatacaatataccccaaccatagtgtccattcctcccactcgtctaagctcccccaacctgccctcttttccagatccacttcccccacccccatttcctctacaagaaaagaagagatcccaagagaaaaatagccaactaagacaaggaaaaagtccttttatcaaggttacacaaggtaacataatcagattaaaagagtctcaagagcaggccagagagtcagaatcttttcaatataacttatttaaaacccttgtggtgctctaactggttttgcaaaaaataggatagctaatgagacatttatggcctcctttgggctatcagattactgaaattatggaccctagaaatagaaattttcctaagatacctgtactggtagaaggaaagtctgaggtcctagaaactgacagaggagaaagaagaagcttgttccttagagagaaactttaaaacttatcagactctcttgccagagatcctgggacctggacaatggagagttattcttttttgtgtgatattttgactggtactgcttaattaagcacacctcttgccctccttttaaatgtagtactgtttccctttgttggacattgtgggaggggggaagtcaagcctttaattcaccagcctctctgcctggactgtttagagcagcacattttaaagtcccctctgagcctcatatcatggccttgccaagcatttgtaagacacgaaacaaaactaatgctaactcaggataaaacatagcttcctgtgccttttccatcctcataagatcctgcctgtaataaggttgtggtaatgctagaaaactgacatcttttggcaaatagacttacatgtattccaaacttttgatctcagaatcaaagtctttttttggttgctgtgcaaattttcctaggcaaacatgggtaaatgcctttttacctcatatatagcaccgaggacagagggaaaaaaatgaaatacccatagtgaaccagagttttcactggagttttacacacgattgtggatgactcaagaacagctggatcactgaaaatcccacctcaaaatgggtgatgagtcatgagcgatacatccctgaaaatcagggcacttgaaggacagatactctactcgtcagagaatttatttttcccaattttctctagctattgttgttgcaactatgatggtatatgtttcaggaacttcttgatctttgtacatttgtttacttcctgagctttctaagtttcacttacttctagagtcttgagaaacatttcaaaatgtggaatgattcaagtcacaagaatgagctacatatcagtctaaggggcttgttcctgtgtagagtcatttgagtggcttcttcccaaattgccattctaggttgattctgaggctgttctgtttgaacttacaagacccttctgaagtttttggtggggatgtttccctgacagcaactgtcttcatcaaggaatcagctagtaaaagacacagagatattcctcaacaaaggtataacccatgagttaatactgcaatctgtctctatcaactggagaagagtaaaggattatatacccttttaatatctgtgggctcaagatggcaggataaggtgcctggatttggtatggagaaggaagacaggaaggtgtgataaaggacagacattgtcattaattatgaagcaattccacactggtcctgtaatgtccactgtatttatgaagctagaccacatctatacccagatacctcatatttcattcagaaattgatcttctttccttgtccttttgtacaagcttctggctgagttgccaatttattgagtataccacctctgagaatgccctgaccccctccccccatgcctaactcattccattaccatttcaattacaaagctcattttcctctgttggtttgaaatagtccaataagttctctgtctgggtacattttttaagtggccatggtgtagcttatttattctcttacttaacacacaaatggcttctaaaaagaggactttaattttgcagatcactggctcatcctgtgcatcaggtactctgctggctgtagcatgctgtctcttgtcattgctatctgaccagggctgccatttcacttgcaggagtgggatggatgtaagtagcagacagtgtcttcctcaggaaggaatatacttagagatggtagtttatataaacattcatgattatggacaatgaattttgttaaaggagtgatgcttaatttagttgcacaatcgaacttctttccagatagtcagtgtctctcagaattcagccaaactgatgccaatttacatagtttgaatgtttgaattttaaaaagtatcagttaagagccattagcaagaggcatagctacgtggggaggattctggttgcatttctctgtaaggttgagaaaaacaacttctgcctatctaggttgacaaaatgacattcttataatgctttggaactgagaaagactctatatatgtgtgtgtgtgtgtgtttgtgtgtgtgtgtgtgtgtgtgtgtgtgtgtgtgtgtgtgtgtgcaattgtttgtgtgtttgtaattaaagatgccaacatcaggcagaagttctcatcctggagctgggtcagccattgtgaactggctgatatggacgttggaatctaacttgtgtcttctgtaagaggagtatattctcttaactactaaactacatcttacatgaacatgtgatgagacctgaacagcaaagattcccacatggcatttactaatagatctttgaggtatggacttaatctgtgtttttgatggttcaaagtacagctagccacacttttcaattcagtttcttctgtgatgtctacccttagtaggtgaccctgcattataactgctattagaagcatctttggagaaacacagtgaatgacagccattgagagaataggagctactgtctcatttgaactcatagtttctcagtattataaactgttcaaatcttttccttttggtgtgtcttatttaattctgacaatatttcctttagcttgaaatcaagaggctgcatgtgacaggatacttggctacatttcttttcacttttatttcttgtttcaagtgtcctagaggagttggaggcgccaccagtctcctgggtgcaccagggtctttcatatgtcaggatcattaatcttatttgtcagattaactcaagagtcaactaagagagacatctataagggcatttttaggaaggagtaactaaaagcaaatgtctgacccccaagctgtgaggaacattctaaaggttctcagatataaagttcccaggaaaaagcagtgcagcttacttgcctgcctgtatgctttacatgtgaatgtgtccaactttttgctgtcatgctgctccatcctttgctgttatcagaacctttcaatatggacagcagttcccaaggaatctgcccgaatttcagtgccagagtagaatagttcaaatctgcagcctcctagatgagcagatactgttttctaaggctccccagaacacagttgccattgaactactcagcctttgttgggtaaagcaatatagtaaaccccctatgtaatgtgtacccatccttcctgttctgttccttcagagaactgcgactaacatgtggaacttcagagaaaggaaaaacagacaaggaaatgagagacttcactggcaaaattggttctatctgagaagcatgtaaaagagagttctctaagttgaaaagccatagctagtttggcattgagactagaggtagttataggaagatgggtggatataaaaagcatcctgtggggggggggtcaaaatggtgtttataagtgtgaaaagtgggtattagtgtttagtaatagaagttatgtcatttgcatgacaatggatgaaatttgaggtgattatattaagagctcagtcaatcttaaaaagacaaatgttacttttctctcatttgtgagttttacaccttatagaaacataaaagtacacctatacagacaacagataagtagaaacaaaactgattgggggaatgaataggaactaaagagaaaggagaagatcacagagcaggtagtggggtatggggaaaatatgctcaatgtatattatatgcatgcaggaagatgatcttatgcaatcatacattgggatgaaagggaaaaaatgtttagctcacagccttggaggttcaggaccaattgaggtagtcttttcttgattctgcagagaaatttacagcagaaggccttcatggtgacagaagtatacagaagaggaagagctcatactgcaagatagaaagacagagaccagggcccagccctgctcttttatacacactgactgtagttgtataaggactactatattaatcctgcaatgacctaattacctcccactaagctctacctctttatggatccactacatctcacactgacacagttggaggaaaagcttctaacacataagtatatagggtgacaaatttgatccagacattgcactatagaatgtgatagtaggagggatgaacagaggggtgtgggcaggaaaactcagagaagaaaaggccatggatgagaagtataggagactgtcttcatctctgacatttaaacatgggtcccacatctttgagtcatgacaagaaagtaggcactgtacttcttgaaaattgtggagataaagaaattaatttaattgctaaaggatttaatatatatattacaaactgaaatgagaaggaaaactgcatgaataattaaaagacaaaacacaagcacacaaaagaaattttgttcctgcctcaggccacttaatggcacatcttcaaacatgcagggattcattcccttgaccaatttactttccacccttttttttcttctttaaatcagaaactgaatgtataaagcaaagaacagaaaaccctctgggaccatgaactagggaacaattttctatgtcattttagctgtgaaagcaaaggcagaggaaataacctgtgataaaatttaaaagcaattaatgtgcatataaaattctaagagaactccattaaaaccaggaaatggactttttcatcattttgagagacacagaatggaccttctccttgaaaggcagtacagatgcatcacagcagctgtgtctcaggttattgcttaccagtctacaagcagcttccacctactcatcttttctccctcccaacctccctgtctctttccccctcattctccctctcatcctgcctcctttcctccttctctccctcctcccttcttttcttccctccttccttctttcctttttcctttaatttcactcttttatttcaaaaatcaatcaaatcttcatgatatgggaaaaaccctctgggtgctataactacagagaagcatggtgacgtggattgactctgaaatgtcccattaggtaggtatatttgaacacttggtctctggctagtgatacagtttgagatggttgtagtaattttaggaagtagggttttgttggagacagtaaaaccatgccaggaagcttgatgagtagagctggttgaaatctgggagacttgaacacattcttgagacttaggcaactccccactctctgccagattcctggcctggaacatgtgccaagctccccacataagtgatcaaagaaaataggaagatagaaaatctgtgttttcttaaccttaacttgtatcacgtgttgtcaatagagtagtcacttgaattctgtttaaggatctgctgatttcttttatgcttctgtaacacaatatcatgggatgtgaaaattagaaagaagagaaattaattttgtacagttttgagaattgaaaagttgaacatgtaaatgtgaccaattggtgaattcctctagccatgttataacatagcaaaagacatgagatgacagagtgtggtacataacacaagcaccctcaaatggttctacatcatttctgggagtggtgcattcatgactgaaaaacctgtcaatagccccgatctcttaacacttttgggtttcctgtggtgttgaaatttattctaagagaaacattttgctttagagtaggactgttcaagattcaggaagtaaagaaaactcagaagactccagaagttaaaacaaggtcaaaagtctcaggaagctcctagaacttacatttacataggaccccaccctaggtaacatttattatgcatgtgcagaagatatcttccctggtaacagccagaaacgaggatcttccatcagttataatgtctgtaagatgtacaaggatacagatttcacgaatgggctttcctgtaacatgttcccatatacaactcattggtttacttaggtaaccttccctcaaaacatttctgttctatgctgtcggcactccatctggagtgtatagacagttttgttacatcttcccaggaaaagtcacacaagaatttccaacacatggtttttaagtggaacattcatgctatgccaggatctgtgtttctttctccatctatacatataacacatagataccaccatctctgctgacttctttctcaggatgtaaaatgactgtcctattcataggcaaatgtttcatcatcagtacaagtgtcctcccacatcagtgaataataccacggttctctccaacctttctccttaaaggaatagggagttggtgtggccttaagagggtgaggtgatgttactacaggaaagtcagggcaggtaccctattaaagcaagccctagctaccctaacacaacagaagcacaggaaaattcaatgttatgaagatgatagaggtcttttgtcttagtcatggtttctattcctggacaaaacatcatgaccaagaagcaagttggggaggaaagggtttattcggcctacacttccatactgctgttcatcatcaaggaagtcaggacctgaactcaagcaggtcaggaagcaggagctaatgcagaggccatggagggatgttctttactggtttgcttcccctggcttgtttagcctgctctcttatagaaccaagactaccagcccagagataccaccacccacaagaggaccttcccccttgaacactaattgagaaaatgccttacagctggatctcatggaggcatttccccaactgtagctcctttctttgtgataactccggcctgtgtcaagttgacacaaaaaactagccagtaaaattgaccccttgtcaacctgacacacaaacacacatcactattaagcctcaacccttagtttcttattcatccccaagatctaaataactctaaaagtcccacagtctttgcaaattcttaaaatttcttaaaatccaaagactttacaattaaaagtctcttaactgtgggttccactaaaatacttccttcaagagggaaaagcatcagggcatagtcacaataaaaagcaaaatcaaactctaactgtccaatgtctgggatccaactcacgatcttctgggttcctccaagggcttgggtcacttctccagccttgccttttgtagcacacacattgtcttctaggcacagctgcctgaactccactgctgctgtttttcttggtggtcatctcatggtactggcatctccaaaatgctttagtcttccactgtaacttggcttcaacaatagccttgcataggctctcttcatggttccaaacctcaaatcccttgcatgatcccttcagtccttggccttcaactgcaactgaggctgcaccttcaccaatggcactgtgccgagcctcagctgctcttagtgaccccttcatgccttcaaaaccagtactacctgggtaactcttacacattactaagtccagccacagcacaaggtacaaccatggctatctctggaacacagcttctgtgctctcagaaaacacttcccagaagatgtcatctcagtgatgctggtcttttcttaatcaaccactaatttcttagctccagctaatttcatcaacagtccaagtaatacaaaggtttcactttactagctctggtatcttgttaatcacagctgattcttcagccgcagctaaccagaaccacagaatcttcacaatcaaagtagcaatggccctgaaaaaagtctttaattttcccaacgtaatttcacaagccaggcctccaaattctgcactgttctcaacattatcttccaaactcctacacaatattctgcatatctcttaacaccgatcttctacccaaagttccaaatccttccacagtcctcctaaaaacatggtcaagttgtcacaggaattccccactatgctggtaccaatttgtcttagtcagagttttactgctgtgaacagagaccataaacaaggcaagtcttataaaaaaacaacatttaattggggctggcttacaggtttagaggttcagtccattatcattaaggtaaaagcatagcagtatccaggcaggcatggcacgggcagagctgagagttctacatctgcatccaaaggctgctatgctagtggaagactgacttccaggcaactagggtgaggatctatgcccacaatcacagtgacacaactactccaaccaggtcacacctattccaacaaggccacacctccaaatggtgccactccctggcctaagaatatacgaaccatcacacctttaaagaggaaatacccgagtgtcttaaagaaatacaggaaaatgcaatcaagcagttagagatttttttaaaagaggaaacaaatgaatcccttatagaaacataggaaaatacagttaaaccattgaaggaaataaaactgtacaagaactaaaaatagaaataaacgtaatgaagaaaacctaaactgacagaattctgggtttggaaaaactagggaagggaacaggaaaaacatcacgaacagaatacaagtgatggaagagacaatctcatatatagaagatatacaacagaagaaactgacatactagtcaaagaaattagtaaatctataaaattcctcacacataaaaaaattcaggaaatctgggatgccataaaaagatataccctaagaataataggaataagagaaggtaaagagtaccagctccaaggctagaaaatattttttgacaaaatcatagaaaacattccaaacctcaagaaaaagatccctataaacctaaaagaagtttacagaacaccatttagagtggaccaacaaagaaaatcctcctgccacataataatgaaaacacaaaatccaaaaccccttatggttaaaattttagagagaacagggatacaaggcacatacctaaacataatcaaaacagtacacagcaagctcttagtcaaactaaatgaatagaaacttaaagcaatttcactaaagtcagggataagacaagggtatgggggacctttgggatagcattgaaaatgtaaacgaggaaaatacctaataataataaaaaaataaaaaaataaataaataagaaaaaaaaaaaagacaaggctaccaattctcttccaaactattccctagtacttgaaactatactcagagcaataagacaatgaaaagaaattaagggaatacaacttttaaaggaagaattcaaaatgttgctatttgtggatgatgtattagcatatatttctatcaaaaaactccaacatctgataaacatcttcagcaaagtctctggacataaagttaactgaaaaaaaaaaacaaaacaaaacaaaaaaaaaaagtaccccttctttatacaaatggctaaacagagaagaaagaaattagggaaacacccttgaaaatagccacaaatcatataaaatatcttggtatatctctttccaagcaaatgaaacatctatttgacaagaacatcagtttactaagaaagaaattgaggaaaatatcagaagctagaaagaagaacatagaagctcctatgttcatggattggtaaaattaacagtgaaaatggataacttaccaaaaacattttagaaattcaatgcaattcccaccaaaattccaccaaaattatttacacatctggacagagaaactctcaccttcctatgataaagcaaaaccacctcggtaagaaaaaaaaaatccggaacaataaaagaacttcctgagttatcaccatctttgagctcaataacagtagtaataaaaactatatcttgtttgtataggaacagacaagttgattaatattgaactgaataccctgaaataaacctgcacacctatggacaattaatttttgacaaagaagtcaaaaccatacaatagaaaaaagaaagcatcttcagcaaatagtgcttgtctacttggatatctgaattagcagaatacaaattaatctatacctatcaccctggaaaaaaatctaaattcaaatagatcaaagagtaaacataaaaccagatacactaaatctaacaaacctaaagtggtaaatagccttgaactcactagtatagaaaacaactctttgaacagaaagtgactaaggctctaataacagtgatgtataaattggacgtgatgaaagaaaagcttttgtaagggaataatgttttcaataggataaagtggcagtctacagattgggaaagaatctttaccaatcctacatataatagaggattaatatccaaaatataaaaagaactcaataaggtagaccccaacaacctaaataattgaagttaaaaatggagtagagttaaaaagagaattctgaacatacagcttttaaatagttgagaatcactttgagatatgttcaatcttagtcatcagagaaatacaaatcaaaacaacttggagactatatcttacactggtcagaattgttaagatcacaaactcaagtgatatcatatactggggaggatgtggagcaagtggaatgcttctccattgctgctagaaatgaaaatttgtaccattactttgaaaatcaatttggctatttctgagaaaattgggaatagacccagctataatgctcctgaggggaggtttgaggaccttgaatgggatagaaattccacaagaagaccaacagagtcaactaacctggacctttgaggcccttaagagactgatcaaccaagcaaagaacatatgctggctggatacaggcccctcatgtacatatgtagcagaagtgcagatctatcttcatgtgggccatgaaccaaaagcttttgcctgactgtggcatatgttcttctacacaggcttccttgtctggccccaaagggagaggatgtgcctagctctacaaagacttgatgtgccagaatgtggggatacacttgggggctccctcttctcagagaagaaagagggggtggtggtgggattgtgagagagggtgactgaagaagcaggagtgattgggatgtaaagtaaacaaaaacttttaaaatggaagaaaggaacacagaaagagagagagagagagagaaagaagggagggagagagggaggaaggaaggaaggaaggaaggaaggaaggaaggaaggaaggaaggaaggaaggaaggaaggaaggaaggaaggaaggaagaattacaaagaatgccaaatgaaagaattgtctttatgtattttagtacaaagtaaattcttgatatttctctctctggagagagagaaaaattccagctgtctgctgttacttctttggtttaaatatagccagatatatggtatgtacaaaagacaatcatgaaatcagatcacttactcacctgaggtatgtcagagatgcctgttgtagctttcatgggagtgaccatgaaatgaccagagaaagggcagccttgagttttgccactccatgtaaaatgtatgtaacataggaacatgttagtcagtttaatctaggctaaaatgaaacaacaccaccttcctgatctttagttcaacacagtaaacatgtatttatcccccattctgtaggtgtaatcgttcaagggaaggctttgctttccatagtctttcatgtctctggaatgatgcaagttccactatcacagagtacatctgtgacacacagtcctagtgaccagatggaaaatatagtgataaatcttgcttcttgaattaaatacctcagactggaaactgtatgcaacaattgacttcccagcctgtaggccttcctttgtaacttcaatgaataggcaaatccttcttcatacatagacgaggagaaatcaagtttggtgattattccaaggtgttcctcagctatgatcttgcttttgaccagtggactttttatttttagcatagatgagaatcagagaggaactcatttttgctaaaaacaccctgtcttttgctctacagatatacaggaagcctcagagttatatgacaaaaagcactagaattccatcagtgaaaaatatctttttcatgttgcttcctagaatcagaagtcaggaaactcaatttaagaacagtttgtctcaactccttagaaggcacacaaaccaggcatctctgatagctttcaatacaacaaacacttggaggcccaggttttcaagcattagttctcaaccttcctaatgcttcaactctttaatacagtccctcatgttgtgtaactcccaaccataaagttatttccattgctatttcataactgaaattttctactgttacaaatcatgatgtaaacacctgagtcagtgatgtctttgccacccaaacatgcagactggacatacaaacattcctatagccctaagactctgaaaagtcagggtcaggtggacccctgatgtttgctgcccaacctgcccagctgatagagcagctccagattcaaatgagatagtgtcttaatgtaaaaatattaggtggcaagtgattaaaaaaagacatcaagtgttaacctctgaacctcatatgcatgtgcatacatacaaatgtctatacacaccccccccccacacacacacacacagacacctgcttgccaattcactgatatagacttctttggtggctcttttctgggtttccacatccaaatctagggcttcaacagtcactaaataagtcatctccctagcctactaaggagttttattttggaatgtgtttgcaaattagaaaaacaggtttctgtcaaaattgtgcaagtaatgcatccagtagactgccacagaccctgtgagaaggagataacacaggttgttatctgtataaccccttccacatgcacacagagcaactctttttggcttagtaggaaggcagtcctatttccagaacttcccatgtactatcagacaccccacaggcatctgcttggcaaagtcatattttctagtattgatgtgtgtgggcaatttgtagggttacaaattagaaagtgattgggatggaaaggaccttggcacgacattcagtcagacagtcagaaggttgcctgtgcccacaagttttcccttatggcagtatatgcctctgtacaacggtattttcaattggattcatctatttgatagcaacatactaagtaagagggaaaataaataactttttctcattaattactcatccatttctcaaatactgtgcccagtgctttacactaattttcatatgggataattgttatgatttgaataagaaatgtcctcattgctttagatatttggtccccagttgatagtgctatctcgagagctatagagcatctatcaagtagggtctagatgtgtaagtaggtagataggtgtaagtagggcacaagaaatgggagggtctttaaaggtcagagaacactcgttcatactttcccttggtttcctaggtacttatgatgtgaacagtctctatatttccacaaccatgaactcagtggctccaccctgctttctccatcatgatagactgaaaacctactttattgagacaataaagtaaatattaagttttatatggttacaacaatgaaaatattgcgcaagtatggcaggaggttaacaacacctatgagcagtgtaatagagaaaaaggagagaaagctggctgactttccatatctaaggtagacagaggtcttcagcagaggaaaagactgtaaggtcaggtctactttgacatattaaatatgcaactcagttgatggtgcaatgtttgaaacttaatagagggcaattctcatggttatgattagcttctggctgggatctcaaaatgtctttcaagtgccttttttttcttttttgtcagggggaggtctcaccatgtacaacccacttgattccctcagttataagtgtcatattagttacttttctaatgtgacgagtacctgaccaacgcaatgcaaagaatagaaaagtattttagctcacagttcagtagtggttggagtatgaaatagcaactcaggaaatagaggaggggggaagatacccaagaataggatagtaccagtcacagttagggcagtctttttgtattaggttgtgacagggctcaggttcttcatcttgtattcttagtaagactatttcaggtttaactagaatttcatttcctgatgtcaagaaggcccagctaattttacttgttctaaactgtctgcttgcccagaactccctccagctaattgtttattttagctgctgttaagctgcttgcttctatgaaactcctattcccttctgtcactgctgaggttcaccaacacatgagtataatcccagctacctggggcattcaatcaggtatcaatcttgtgaatttctgataacatttctacattagaaattaactcagtttagaaggtccttcacagacctgcacaaagctgtgcttcctagatgggtgtcaagatgacagtcaatgttaaccctcacagctggtgaccaggaatcagaaagtaaaccttgaacctctgaacattccaaggtccagatagtaggtgatgaggccagaactcatttactctgggccatttgttttatgttccaggaaatgaattgggaatggtcagagagcctcattcccccttctcttagttgggatcagggagttaaaggagtactgttgtacagttgatccttacttctgctaaaggtcactctgataatgctgctctggacctttctatgagttccagttcttataagcatgtgtatgtacagtcttcactcatttgtacatgaagagacgagatctctactttcgaatgatgtttataccaacacctccctattattttgaagaaaaaaagacaaaaccctccagaaaatgtggtatttttgtcagaatgccaatataaaagttgacataaagattagtgatgtggaagctttgacattacatacatatatatttgcactgtaaaagttaatggtcattttatttatgatgatattgcagattattagttttatatcgactctgtcaatggtagctgctttctgtttatttcagttatgtcttgaaatgtttgtatgagatatttaagtctacattttgtatcacagtatcaggacacaagcttcttgccttagcatggcagtagaactgttactcacttgtccttccaggaaaagaggattcgtgtcctcccaaattcatcattcatggcattatagatcacagctttgcttgtcttctttacagatcacgtttcactctctctctctctctctacaatctcataacagcaaccctggattatatcaaacttgtaagctagaaacattatacttgacagatatgaaagcccctggattaagaattgcctctaatctaagtccttcatatatacatttgtgtcatttgaaactgctctgttagcctgggtatgacacagcccctctgacctgttctaatataagatggtcaatgtcttgacttcattatctgaccttttataccttgctgaacaggcagatggcacaactagtggaaagttaacttgtgttgacactaagcagaagagaaattgatttctctactacacagacatacttcatcccagatccctgttcaagtggtttatcttcactctaaactttctggaatttaaattcgtcatgaaaatccatctctcagtgcatttatgaacatgttttcacaaaggttttacttagtaagcaaacctacccagagaatggcaattctatcccactggctggcattcaagactgaatcaaaaaaaaaaaaaaaaaaaaaaaaaaaaaagaaaagaaaagaaagaaaaaggaagtaccagtcttcccatgtcactgattgcactggatgtggatttaatatgacacatttgcctcatgaaactacaaccatttcttccccaccatgatgaactttatcttcaaatactagacacacaagctggaacttgcatccccaataaaccatataaaaacctgttggggctagcctgcggctttcatgtccaggttccagcctggaaggcatcttggaactggaagagaagagggaatctaggcaggtagagaaataatggaaccaagacaactagtctgctcaaggttcaaatttttatggcggacacactttataaaggagaggggaaagcccattctggccaaatcatctttgaagcccagctgcagataaccatgtgtaggctctggtccagctaggccgactcccagcaggtagcagcagcagcagtggctgaacaatagagtgatccaaggaggcaggctccaccctaagtaatctctttagtgacaacaaagtcaaggtctggctcagccagcttcaggcttgtgggaggctacatctcctcccagttattaataaaaaaaaaaaaaaaaaaagctggactgaggcataaaatttacttatgctctatacttctgtctgaattatttgggcctagtgaataaacctgtctcagtgggattccctaacttttctcatggtaaacccttgtttgattatgactgtccttactgtcctataaatattttgcagaccagccctgagctgttggctccattttttgtaatgcttaattagttactgaataggtaacttccttgctgaattcctgctgaattcctactgaattccatgttgtcggtttcaaggtcttactaggatgttggaacaatggcgaaggcttaactatgccagaatttaatcttaaaagacacttataataagataatactaaaagagagcacacggatccatacaccagactaactcggggatagggtaagaatgtacgggttatgagaatgccaaagttccaggaggtgagtttcagtgaaactctttgccttgtgagtgttctcaggcctcttggcctgccaagcaaactttactggagtgtgcatagcattctctctcatttttatatgactgccgaagttccggaatgtcccgcctcgtcgtagctatagatgaagatgagtggaaacacaacgatttactaataaaccaatgccaataataatagcaagtaggattatatattgaacccaatccaggggattcaatgcactcaggttctcttttcaatctctggccaatttatcaatgttccaagtgtccaagtgactattgataatatctgaaatttctgcctttctagccttaatatatgttatgtcttgccctattgttaagactactacttctaagacattaatctttgcctccaattctttacatggctctaggcaagtacctctgtctagattgatatgattctgagatttgggtgtccgtctagactgcctggccctcatagcaaccttaattccaaatgagaccaaaagccacaatatgtactggaattcttcttgaatgaagataataactgccacctgcttggatgcagggatgcatgcctgttgcagtcaggctgaagggcgttgactgacctgcttgagaaacaaagtccagagagtgaaaggcacagtacaaaagcttcttttgcagaagtccaggtactccattcaattgcaaattagcaacaatcaagcttagacttagagctcccagtgttggggaggtgaccttgagaatcacagaaaggctgcaatctttctgcaagaggaggctgtgttctaatttacctttgttaagtaattaagaatattttgttatcttccctgggatactctaatactggaattattactagaccagtccaagattgagttagaataaccggtcacatgagggaaagagaagaatcactaatcttgctaagtcaaattacatagtctctgatgttctttttaccataaggttaaaaagctcgaagcaaggcagcttcacttgtccaaactggaaaaatagcatgcaaggatgggttgaaaacatgtacccaaattagctttcttgtcactaaagtcagggcacttacctgtcagcctgtcacacgaattatccatcatgcttctgcagtgttctgtgaagaatacctatgttttcccctttcctaataagatagctgttcaagatcaagccatatgcaaataagtagatacttttaagatactataagggattcgttaatttcttagacatctaaatttcaaaattctaaaataaaagtatgatttaaataatgagcacaggaatgcactaaataatatgcacagggatatattttctctcttctttgtcttttaagaatctagaggtttaaagttttacaataccttgtcctttagaattaataacatgttgacaaaacatctcaaatacttgactgttatagtcagtattaatgtaacatgtacagtgattaattgcactttcaattattaccctttttttaaatgagaaaatactaattttattttattatattctatttcattattctctaaatagttgataattttatttattttttacttaggtatttatttcatttacatttccaatgctatcccaaaagtacctcacacggtcccccacccacttccctacccacccactcccacttcttggccctggcatttccctgtactgaggcatataaagtttgcgtgaccaatgggcctctctttccactgatggctgactaggccatcttctgatacatatgcagctagagtcaagagctccggggtactgcttagttcatattgttgttccacctatagggttgcagatcctttagctccttggttactttctctagctcctccattgggggccctgtgatccatccaatagctgactgtgagcatccacttatgtatttgctaggccccggtatagcctcaaaagagacagctatatctgggtcctttcagcaaaatcttgctagtgtatgcaatggtgtcagcatttggaagctgattatgggatggatccccggatatggaagtctctagatggtccatcattttgtctcagctccaaactttgtctctgtaactacttccaattttgttcccaattctaagaaggggcaaagtgtccacactttgattttcgttcttcttcagtttcatgcgtctagcaaattgtatcatatatcttgggtattctaagtttctgggctaatatccacttatcagtgagtacatattgtgtgagttcttttatgattgggttacctcactcaggatgatgccctccaggtccatccatttgcctaggaattacccttagagtagttgtaactagaaagcttgaaaagttattaatagtcacatgtgaataatttatttatttattaactcagaaataagagcatttatttccagcaatttattaagtataagtcttcaagcattaacactgttatgtggaaacaagtagtaactgacgatactaagagcaaagaatttaacatgtacaatttccaagaatactaaaatattatcttaaaccataactgttttgaatatataaagaacgagattatatatccaaccaatcttatatgtaggacctatagactgcgtgagatataaatctagcatggcaattctttaagatgtccaggcaatctagaacaatttattaaatgtccaagaacagccttcttaaaaggaccacattttttcttatgagttgtatatgcataagcaattgcaaatttgagaattaatagcatctgagggatgaacaatcttaagcaattatgagctctgagatataatattgactattaatgtacaaattaaggttggttgttaagcattttaaaacactatccacagcacacaacttgattgtgctgaagcaggaggaagctcaaaagaataagcatgcgatctaattcacatctacttatttcccatagaggagctgtttttaaacacaataattgggatgcatgcatgcatgaatttatagaagatacaaaagcatgcataaaaacatttttaacttatctattatttaaaatgatggtgtgcaacagataaaatattaatattctgtaataaccaaattaatggctgtttggacaaggaacagacacttaatcaggtttttaagacacaatttttgttatagttatcccaaactatatgaatttatcttataatttttgttagcatcacaagagcttaaaaggttgctgaaaccgtactatgaatgccacctcagccacacccttgagaggtattagctaataaaatactttccactaggaaaaaatataccccgaaagatttaaactcttagcttcttgattacagctcactagaagcaaataatctttacaattatcagaatgtaaaggaaaaatcaaacctttaaatctataataactttatatgaagtagacaagccagattgtaatgtcctggtaaattctacagcctgattgtcctttttttatgaacttacaatttaaactttaaatttaaacaacatctgcaaaggtgctcttacagctaaaaggaattctctcctggaggcagggagtggggaggttctcagaagttccctagtcacagtttgtggaaacaaaggagatttcatactagcttccccaaggctgctctgaacttgcattaactggaacataagaaaaaaaaaaataatccaagcaatttggccctcctgtgttgaggacagattttagaagtactaagtttcatatgcaatattagaccataactacaactttgggaaagcaaaacccaacttcaaaacaatttatcatctttgaatcaatattaaaacttcactactgcattgcgagatttggctaccaatttacacctatgaatgcatgacagtgcaagctttaatgcttcattaaagagaccttgctttaaatcttatcttaatcctactttctaggatgagaatcacgttaaatattatctcagtgtcttaggcccagttttttggcctgtttatgccccatgtttgaaaaactcctgagttgccaatttaaggctaaccctctgttaccaatgtaacaattatttaatcatgaccaataacttatgagctgattgtgaaggtgtgcagagcacattaccagttaaaaaaaaaaaaaacaaaaaaaaaacaaatgaagcagtaacattaacacttttctaaattttcacatagctctaaacacatacacaaaacacacaaaacagaaacaaacagatccagacacttgcaaccctttcttgtctttcatgagcaggcaaaggaattggaagcgtaagcttctatttcataaacaaaacttggtctctctgaccaatctctggagactgccagaggtctctggctctcccttctccccagggcgtcccctggggagctagtggtcttcctatcacatctgctgaccacagtcctctggttcttacagcctgaagggacggctgcaaataccaagcacacgtttcagaaaaccccatcgtctataagcaccagagaaaccaaactcaggcagatctaaactcagactgtgccattttcagagacacggtatgaaacacagacaacaaaccaacacaaggagcacatgttcgtttttcaggaaacataagacagacactcagaacaaagataccggctggcaagcacataagaggggattccccagttttctctctgtccctgggagagtttcaaaatctactttcctcctgcctgatacaatttccaactgcggcaacccgcctgaatataaaatcccttttattaaaccctattatttctctcgcctaaaaagcagcttctggaagctgaggtcgactgactgcctgttgagttcctagttcccgataactcactgctgaacctaagtgaatccagcgcaggtttagtgctgttccagcttagcctgtaccataccttctctggtacgaattttctttaattcttttcttcttccatggagctccaagacagcagtgcttcttccaaatgccttctgcctttcccaggcccagtgttggttcgccaaattgttggggccggctctcatgtccgggtttgagcctggaaggcatcttggaactggaagagaagagggaatctaggcaggtagagaaataatggaaccaagacaactagtctgctcaaggttcaaaattttaactgaggacatgctttataaaggagagggggaaagcctattcctgccaaatcattcttggagcccagctgt

SEQ ID NO: 65 - DNA, 1725 bp, Mus musculus
gcaaagaagggtttggcatttaaaaatgtaagtaaaatattaaataaagattcaaactgaaatagtcatctgtcagttattttaactctgtcatttagtaaggaccaaaaactcaattattaaaggctcaaaacagggaaaaaagagaaaaatcacttttcttaaaagtcttattaccaaataatctcagcaaatgtggcgctccgtacacctgggacatgggcgcatccgggtggtcggcgaggatttcagcgtactgtggtctctcaaacttgtagaggagctgagtgcccaacatgacattgaagtactcctttatgcctgccaccacctcattaacagcatactctctgaaaaagaaaaaacattactttcaaaatatttcccttctgaggagagtaaaggtaaagaagtatggctcagacttaacaactaaaaccaatttcaaagttatataaaagtaaggcggcatttatgctttcaagctttttttttttttttttttttttttttggtttttcgagagagtgtttctctgcgtagccctggctgtcctggaactcactttgtagaccaggctggccccgaactcagaaatccgcctgcctctgcctcccaagctgggattaaaggcgtgagccaccacgctcagcgcatttatgctttcaaaatagtagaaattttgggctatgggatagaaatgaggttcaagacaaggtttctttgtgtaaccttggctgtcctgaaacttactctgtagaccagcctcagagatcctacctcagcctcttgagtgctgggattaaaggcatgcacaacagcagcagcagcagcagcagcctcaaaatagtaaaacttttaacgactgtaaagcacctacaggataccttcagttatacctaaaacagtactttgtgtatactcaaaaagggtacattcttacttattatctgtatttcctcgagacttcttataatttgcataatcctccaaaatggaatccacattcttcttggcaggaagataaaaaagctagaaaaaaaaattgaataccaatgtttataaaaattacattccttccaaaatgagtagatgagtgggttcaagattacagatactatgcagggagatgtaactgtataagtcaaccaaataacatcaaccaaattccaattatgactatgaaacctcaaatttcatgaatctttaacaacaattattcttctcatccccaccattcccactgcatctgtcatttgtcaatttaaatagtttgtctgaagttcctaaatctggacttagagaacccaactcttaagtaacattccagtttttctggactgttttgaaaccagtttctttagattttgaacatgtcccttcagaggggaggagagaggctcctaaaactaagtaatcaatcagtgaacaagacccagaaagctgatgcttgaatgatccacagggtccccaacacccaagatggagctccagggatacaacattcattcattgctgagtcatggtttactagaagtgggcatttcagtggtatacttacttctgaaactgcaaaacctcactggtttgccatgcagttctgccgttggcatctgttttatgttagggcaaggcccttttgtctgcctctctccctgaggagtgttattacaacattctgcaaatgattcattaaccctaggaccttaattacattcagggtca

SEQ ID NO: 66 - DNA, 4743 bp, Mus musculus
aatgggggcgctccttctttccctgtgaggtagtgggaagagaccacttcaaactgggcctgttttatctgctactttccttgacatttctggacgccttgtttaaggaatttcgagagatatacaaaagctttttcctgtctcttttgtcacattttacagtagtgtttggatatgacggaagcaaacgcaatgcctaacacttggctctcagtgagtatgtagtaaatgaagactggggcattccacgtgcctcggatataggaaaacagtagtacagataagaagagtgacacttatggtctccccagtcagagttgcacagagaaactcaactctgaactgtagttttcttgtgagtagaataaatgctgtcatatatcccacctcccctgcctccaacaaggagtcatttactaaattccaggtgactgggtttagcttaatcctgggtggtgtctacaattgtttcttttctaaatttgagcatggagatgaggcagaagggagagaaaaggtttgcatcgccttatcatatgaagtctctgataagttattccttcacggtaaaatgagctaattcaagccagatcagggacctatctacctatctgtctgtctatctatctatctatctatctatctatctatatctcaggtttatttggaaactgcttttggcaggggaggcaagatcacagatcagggaaacagccttgggaagggagacagaggagaaggggaagagattgaaagttcccatggagagaaggtctgaagatagaaaggacaagaggccgggcagtggtggcacacacctttaatcccagcacttgggaggcagaggcaggcggatttctgagttcaaagccagcctcgtctacagagtgagttccaggacagccagggctactcagagaaccctgtctcgaaaaaccaaaaaaaaaggaaggacaagagaccaaaatgactggattatatagggaagagcctctggtggaagggcagcccaacccttaggctggaaagttcaaggtttggtacaccaggtagggacatagggatactggaagaacctgaaggtcaggcctgccttgatgtgtaaaatatgcacttaagcccctggggtgggggtggggggggcttgctgaaatccaacagtctccatctagcttgttaatctgaaagaaagacagagacagacagagagagagagagagagagagactaatgtgtaaaactctaagatggacacagctgaacagctgaatagcctctacctataaatctacttttgactctaatccaacagttaaagacacacagaagcagagcagtggtggcacacgcttttaatcccagtacttaggaggcagaggcaggtggatttttgagttcgagtccaccatggtctacagcgagagttcagggacagccagtgctatacagagaaactctgtctcaaaaaatcaaaccaaaccaaacccaacccaaaaagaccctgttattatgcaagttaaacattagtacctatcaactcaaattatttttatatctttgaggagagaggtaacatttacgtcagtgttccccccccacccccaccccccgttttttcaagacagggtttctctgtgtagccctggctgtcctggaactcactttgtagaccaggctggcctcgaactcagaaatccgcctgcctctgcctcccaagtgctgggattaaaagtgtgcgttaccacacccggcttaagtcagtgtttttatgtagtctttttttttttttttttttttttgatcagttttttttttctttttctttttagcttgcccccatttctctaattttgaacagtcccctccccattttttacaagaagaaaatattttctctccctgcctccctctcccaggtccctcttctctctcggagacagtgccttgctatatagccctggtttggatgtaacagtgtgtagaccaggctggatttaaactcacctacttctgactctggattaacacacccagatgggaagatattttaagtgtttggttgatctctctgccaatgtgctagctgacaccacaatgttcttcacagacttgccaggagcccttcttcatcaccatacagagggaacaaaattgagacttgaggagtgtgggtgggtgggtgggggagcactctcatagaggtaaggggatggaggagaggatagtgggtttccagagtggaaactcggaaggaggataacatttgaaatgtaaataaataaaataaccaattaaaaaaaaattgaaaaaaaaacaagtcttttctggcaaagtctcactatgtatccctagagaacctagaatttattatgtagtccaggctagtcccttaacaatctgcctgtctccagatccccagtgctgagtttataatctaatacttgtcctgttaggtccaggagagactgatttttttcatgacacaaatcttgaatcccagttaggttgcaaggttgaaagtaccttacaatagaatattgaggaggtgggtactgggtgttgggttaacattgatttgttatacattttgttttctttagaagcaacagaagaaaaggtagtggtacaccttaagaagttggatactgcctacgacgagctgggcaattccgggcattttaccctcatttacaaccaaggcttcgagattgtgttgaatgactacaaatggtttgcgtttttcaaggttagtttctgttacctgttatttctaatctaaaatttctcctgattaggaacctcgggagtgctccttttacaccaagaacataacctgaatagacactcacttttctaagactagtcaacaattgtaaatttgacattgaaaaattaaacttttgagtaagttcgttcatttaaaaatgcataattctgtatttatattttagatgttcccttaatcattggcattgtagagaagctataggaaggataaggagatgatagacttcatcgtctagagttcattctattctaaccatgttgtgctggccttaaggactcattgctgtattaacatgtattacgtattttaatgtgaataatttatttggctaaagtagagagggaaatagaattcataaaagtcattatgctcctggagctttttaaagccaatggcccactggcctacacagctggaagtttacttctctgacgagtaaagaaccattgcctgtccctgtattcaagcacagtgctccaagctataagcaactctctgggttaaaatgggtgggactgcctagattctgtgtctcccaagtattcattcttatggaggagctgaactgtttcctataggtttattattaaatggtttaagtaaatggaatctgaagcagctgtttctcattatacctagaatagagagagcgagtttttcatagtctggtgcatcgggtaagaatagacccgattatagacacttctgggaaactaggtgatatatctgttaaaaatgttaacagacagcctgacctctaagtgtgatttctcaagacttgatttatcaccaccaggatgtaggattctgagccaaacatatttcttagaataactttccagagatattttaatacagacctctctttaagacaaaataaataaatgaataaataaataaataaataaataaataaaacaagggattgagagggtggcacaattcctacctagtagccggctagctagtaagaatcagtctatgtattgttagttaggagcccacttgattagttcaaggacaagtgtgactagttgctaattttatttatttatttatttatttatttatttatttatttaattgggggggtgttgagatagggtttctctctatagccccggctgtccttgaactcactctgtagaccaagctggccttgaactcagaaatccgcctgcctctgcctcccaagtgctgggattaaaggcgtgcgccaccactgcccagctgttaattatttttactattaactctaagccctgtactaaatccatcccaacagtatctgaatctcaagtttcagttacatgatggatgtggtaggtgtattcaatctgaatttagttctcagtgtgtatttgaatgggcctaggttgttttttgtttgtttgtatgttttagagatacacaatttccccctttctcttttctcccctcaaacctgcctatatacccttccattctccttttcaaagtcatggcctctaatttttatttcttaatatatacgcacacacacacatgttcataagtatgtgtataatttcctcagtctgtatgtgtatggtttgaggcctgaccatttggttttggataaccaattggtgtgctcttcactgaggaagactttctccctgtctcagaattccttagttgcttgcaattatttgtatagagttgaagcctcagagcctttccctagaccactccaagacattcattgttgttgtctgtgttcagctcatgttctgggtgagggtttttagacctcttgtacagccatgttcctttttttgccttcagatcaaatttgtaaacttgacaatcatgggcaaaaaaaaaagatacttagtttatattatgaaccctgagatgggccataattaattgtttggttttctttttccactatcttttattgacacactaagaaatacttagttggcatttcc

SEQ ID NO: 67 - DNA, 26732 bp, Mus musculus
cagctcgcggctctcctgctgcgaggtcggcgtcgctgagaacgcgacggcggcgcgcggcacccggtagggctcggaaaagggattaacagtaccaactcggcagcgggcgtagtgtcagccccgggtacggagcatgaatgcacagcaaacaacacattgattggtggtgatgggcagttacttctctccgtgagaagccgcaatatcattctgagagagacggtgatgggccgagctcaacacagtacccacgagggggaaatgtccgccagcttcaggctagccgcaggccaactcttccacccttgtccccagtgcccgaccaccgcagccctctatgcaaatgccgtcactactacaggaccaggtactatgattccgtatgatctcggagaaattcagagtgaatgaatatttaaaaacattttaaatgccagtggattagatactttgaagtcggaaagtacaaatgctaaaataatggcatcaacggtttgttaaggaaggtgttgagaatgaagttgataacaaaatcaaatgacgtttggtatagcaaaagcatgtgacagatgtatttgctagaatagtgtagcttttgctgaaagcagttttcttaatggaaagaattttatagcagaggcaaagtgtacagatacaataactaaaagaagcttttggaatgtccccttcagatggtaaaaaaattatctggattgtttgcacattaattttggaagtatttttcaaatatgtcaaataaccaaacatcttactgtggcaggaaaacaggcttaaaaatataaaatcttgctttatcgtccttggtttttctcaacaatttccaaagaaaactggcttcccccactggtgtgggtgcatccgactgagatcagggaagagaattaaaattgaacgacttgcttttttctttcttgatttttctgaacaacttccatggaaacctttgcctcatacagtgggatgggctcatcgagcagaggcctgaggagggaaatgattcgagatgtcaggcacaggcacagaggagcacagcacgcaggatgcagtagaccacacatttgcttattttcctttatctaacacaagcagctcgagcctttaatcccagcactggcgaggcagaggcaggtgaacctctgcaagttgctggtcagccagcctgagctagatagctatcttaaaaagaaaaatccaaacagaaattacaaatgcattcattaatatttctgtggcttaaagaagtagtaatttccccccttttctttcttttttaaaactgggtttgtcttgttagctagcccagtatggcctcagactcatgactcttagccttccaagtgccttgaatacagctgtgtgccacaacactgggctaaaagtgtttaggttttgaaagaaaaaatatactactcagtccctttatctaattcttactttataattgatataaaatcccaatttaaacaaccttgtcaagctctgaattatttcaaattctttggctagaggggaaggagaaaggagagacacacaacagaatgggggtaggggtgtgggggagaaaaagcacaagatcctctctctgtggcaatcctcacaggtgcacaagcagacacattttgagaaacatgaaagaacagctatttgtctacagtgaattaaaaaaaatatatacaagtactagatataccataaaattggaatgaatacaaactctttatgtctttgagaattgaaaaatgatgatttagttttttgttttagcatacctgaaaacaccagctgataacttctccatcacatcttttaagatacgtaaatggaaggattgttaaggttcaacttagcagagaggggtaaagaaaccattcaagatgctgggcaggactcctttttctttatatatagctttgcactttcaaattcaaagtggcaccacagctactaaaactgtcagtcactgctagagcaacgggatgattagcagtatctgaggtgtgacaggaacacaagcgctggaaggcgagtggtaaggacagccagccagccagccagccagtcagcacggagctggtcaggggtgccatggtcttcttcacttaagcattatgcacgcggtatagtcagcatttcagctctcacagggagttaacattcatcagttgatccggttggtaacaggttcaacttgtttccataaattcttttatttgtttcaaaaatgagaaaaaaaaacaagttaatatgcatctatttgtggcagttttaatgaaaaatgtcccccaccggttcctgagtctgaagaatcagccccggttggtgttagagaagttatggagcctttagaaggtgcatccttgttggaggaagcgcttcaccggggcaggctttgatggtctatggcctggcctcatccctgcttactgctcgctctctctccctctctctcacctatcttgatgacaaggcttcccagccattatggaactgtaggcccaactgaacccttccataaactgcttttggtcatggtgcttgccgtagcaacaaaaatgtaactaacatactatgttactagcaatcaatagtatatccatattaagaaaaataacaataaataagaagatctggagaggggctggagaaatggctcagcagttaagagcactgactggccgggtggtggtggcacacccctttaatcccagcactcaggaggcagaggcaggcggatttctgagttcgaggccagcctggtctacagagtgagttccaggacagccagggctatacagagaaaccctgtctcgaaataccaaaaaaaaaaaaaaaaaaaaaaaaaaaaaaaagagagagagagagagagcactgactgttcttccagggtcctgagttcaaatcccaacaaccacctggtggctcaaacccatctgtaatgagatctgatgccctcttctgatgtgtctgaagacagctacagtgtacttacatataataaataaataaatcttaaaaaaagaaaaaaagaaggtctggagagaggctcattggtaagatcacttgctgtatttgtaaaggacccaggtttggttcccagttctcaagtgagccataagtgtctgtaactctagtttcaggggacctgacaccctcttttggtctccttggacactaggtacacagacatacacataaataaataaataaacttctaaaaaaagttccattatgatacttataaaattaaactgtaagcatttaggaatattttatgcagtggcaccatcataaaagttaagtatgctaccaatttaggtatcaggtaatgccaggttaaaagcaaaagaaaaatttccacttgtctcattctttatctcccattcagaaggggttagaccctgtggtgtgattatgactctgtctcttgctccctgcaccactgggcacccaacagtagcctctcacctgtgaaatggagctacattactcaggcatcatagacttaatgtttaaatgaatacaagatacatgtcacactgtcagacagactcaaggaaagttcacagctaattatcatttcttattgttacattgaaagaatttatgagtacaaggcaattcaaagctagcaattcaaattcaagtcagtacaaaaaaaggatataaagatattttccctgttgtgcatttgacaaattccaaacttcatcattaaggaaagccaccgttgctcccttgaggaaaaggcagtggctatctggaggatccaactttatagaagagacaaagacaaagcaaccactattaagttgaacagcacaaagatgctcagactacaaagtctttagtacaaattaaacattgtaggaagcatagcacttgctacaagcttaaacagccagtagttacctgccattagttaactcttaggtttccttctctatgctgtgatgaagtagatagaacagggcagttgcagggccgatctggcatctgggggagatggggtaatgtgtttgatagcttctctgtgtgccttctgcccactactgtcaggcacctttgtctggactggtatattattatagtacttatatattagctatgatataaacattcaattagaattctgttgaaaaatatttccttgggaggtaattcatctatatagacatacaggaatatcaatttgggttataaaattatgatagtattatttataattatttcattacagttataaggttactggaaagaaaatttttagggtctgggagatgactcaagctaccaatgtagttgttgcatagacacaaggacccaaggtcggacgctagcacccagtaaaaggccaggtgcagcaacacacctgtcatcccagatgtaaaaggccaggtgcagcaacacacctgtcatcccagatgtaaaaggtcaggtgcagcagcacacctgtcatcccagatgtaaaaggccaggtgcagcagcacacctgtcatcccagatgtaaaaggccaggtgcagcagcatacctgtcatcccagatgtaaaaggccaggtgcagcagcacacctgtcatcccagatgtaaaatgccaggtgcagaggcacacctgtcatcccagatgtaaaaggccaggtacagaggcacacctgtcatcccagatgtaaaaggccaggtgcagcagcacacctgtcatcccagatgtaaaatgccaggtgcagaggcacacctgtcatcccagatgtaaaaggccaggtacagaggcacacctgtcatcccagatgtaaaaggccaggtgcagcagcacacctgtcatcccagatgtaaaatgccaggtgcagtagcacagctgtcatcccagagctagagaggcagagacaggatacttgggtcttggtgccagccagtctagccaaactggcaagctttaaactcagtgagagatcctctctcaaaagatagggtggagaacaatagagggagagaccagatgtttacctctggcctctcttgcatatacacgtgtacacaaccataaaagtgtaatatgaaatacaatttaaaaatacaactgtaactcattctaactgaaccacttccctgctggatagaatctgaccagtgcatacctaacacagaaaagaagctccattcttttaagcccagggtgtaattagaacttatgctgctctttgctaatggcattcccttggtgtaatagcaaggctttactatttctgataatacctgaaggttttcttctgttgttacccaatggcctccgacaccaagaagtgtgatgatgtcatgcttatgtggcagatgtaactttacagctggttcatcatctttactatataatctcacttacaaatgagtaagtaaaaaagagaaaaaagagaatttataaaaatctgacaatttattttatttatcagtcagttttatagcaagaaacacttttctttggaaaaggcaaacttagttggttttacactataccaaaatgtactctagacttaattaaaattaaatgcaaaataaatttttatttggaagcaagcaaggtatgtctcatgataattctaagcagcctggcttcatacaacggggtgaagtgctgtctcattaactgacagagtcacatgcactgaagcccacacgtgagaagtgagcacactgatgtacagtatacactgccactgacgacttcatacgtcagcttccaatcctggaaaacaaacatcagggaggcccacacagaatggctacagtacaacagagtacaagtacagtcactgtgcggctcctaacgctgactcttcaggaggagtgatgccgccacatgtgcacgactaggtgtgagatggcttcaagttaaatgtaaaagctcacaaagagatgggacaaacttgtttccctctatagcagtacagaggtcagccgtccactagagggcagccatgcagtacccgtgcctagggaatgctgggcaggcgtgtagtagtagcgaccctctgtggagactcatcctgatgacggttttctcacagggttcccctgttctgtttaagcttcagtgcctaaggcttaaaacctgtgctctcttccagaggaacagcgttgaggatgggaatcagggaaggagttagactttaaataatttttaattaaaaacaaatccttaaacatccaactttatgagtgcagtaataattagttcctagttaaaccttttcttcaatttatctaactaaaaatatcacacaggctactcagttctcaggaacccacctcctgcatctgctcggttctcaggtacccacctcctgcatctatgacaatatctactcccaggccacctgtttcctccaaacagctttcagcaacatggactttcccattagacacatcaatcacacgggctgtaaaggacaggaaatgaagcaattgtactgttttctttgcgatcaacacaaacagattggggggaaggaaaaaaaaaacagctagtaagtttcgacaattattaaattaaaaggaaaaagtcaatcctgcttaaactgtttctttaggaattcaatctgggttggcagctccactaggctgaaaacatccgaggctggcctgtgacagagtcagctgtctctgagcacgggacagtctgccagccccaggaaccagagatgcgtcctgtgtctgtacactgtgacactcatcatttcatcccttctcactcacggacccacctcccctggctcctctagctccctggaatggataacagccctgaatgtgaggaacaggaatgtgattggttttggtagagatagggtaaaaatcaagctaattttgattggcttcacttattgcatatgtgcgtgtgcacacgcacacaaacacacacttttttgtatctgcgtgctaagtgaaggacatggataaaccctggaccttatcaattgcaaaaaagcagacctctacggagctatgttcttagctcttgaaagaactatagcaataggaaaatgaattatattaatagtacaatagaactatactgagaattgaaaaaaattttcagaatttcaactaatgaggatataattctatttcattttgttcttagtacctcggtgaggacaatgtttgtcagagctgttcagactacaggcagagtctaacagcaatctgtgactcttggtggtaagatagggcaaggatggggtgcagggtgagggtgagagtgcagaagcagggtgcaggaatgcaggggtgcagggtgaaggtgagagtacagacaggggtgcagggtgagagtgtagaagcaggggctgtagggtgagagtgtagaagcaggggtgcagggtgagagtgcagaagcaggggctgcagggtgagggtgagagtgcagaagcaggggtgaaggtgagagtgcagaagcagggctacagggtgagggcgagaatgcagaagcaggggtacggggctgcagggtgagagtgcagaagcaggggtgcagggactgcagggtgagagtgcagaagcaggggtgcagggtgagagtgcagaagcaggggtgcagggtgagagtgcagaagcaggggtgcagggtgagagtgcagaagcaggggtgcagggtgagagtgcagaagcaggggctgcagggtgagagtgcagaagcaggggctgcagggtgagagtgcagaagcaggggtgcagggtgagagtgcagaagcaggggtgcagggtgagagtgcagaagcaggggtgcagggtgagagtgcagaagcagggctgcagggtgagagtgcagaagcaggggtgcagggatggcttacactgcacatactgctcttccagaggacctgagatcagctcccaggttcctggtgccattgtcacacaattctcaactgtctgaaactccagcttcaggggatctggttccctattttggaacagcacccgcacacatgtggcatacatacacgcatataaaataaattgtaaacaaaaactttacacgaaggtgctgggtaatcctgtagggggagaattagccaacaggcaaacattttcaagaacacagtcgtagctatctacctctgtcctaagctttctccccatcttcccatgccagagagaggaacacaggccttcttacatgataggtaggagtctattactgaactacaattggcacctccattccactttctctttgtgtgtatatgaacatttgcaaatgtttataggtgaacatgctctcatatgcacttgaggatggaggcccaaagtctacagtggaaatgatcctcaactgttctgcagtaaacaaaataaacaaaaaccccaactgtttcgtattacattcattgtgtgcatgtgtacaagttctcatgtgtgtgccacagcagaggacagcttttctcttcccaccacgtgggtcccagggaaggcatttggtggcatgtatctttacccactggcccatccacttgtgtactgactgaggtagggtttcccacagacgctgtcttgtcattcagcctgactaatgtagccagcttccccagggaccccatcagcctctacttcccagtgctgactacaggacatgggttctgggattcaactctggttttcatgtttgagtggtgactgctttacccaccgtgccatctccctgccccccagttttattctcaaacatcttcaatctccagcttttcccccttagctcctgtattaccttgcttctatctctgtttatctttgtcagatgcagaaagcagcaacagaaagaacttgggactaaagtcttagtccagtcctttgtcttgtttatatcttttccctccctccctccctccctccctccctccctccctccctcccttccttccttccttccttcttcctttttggttttgccagacagtgtttccctttgtaacagcattggctgtctttatttatttatttaaatattttatttatataagtgcactgtagctgtcttcagacacaccagaagagggcatcagatctcattacagatggttgtgagccaccaggtgggtgctgggaactgaactcaggatatatggaagaactgtcagtgttcttgacctctgagccatctctccagcccccagcattggctgtcattgaactcattcagtagaccaggctggccttgaactcagagatccacctgcttctgccttcccagtgctgggattgataggcctgtgccacccaccactgctcagttatatctagaagaagccagttagactctgaaagcgctgttagttgccaagggctttaagtcacatttcacatgacttttcctgactgcccttccctcatgctctgcttgtttttctctgttactttctgttactttcttcattccagtctttccttgttcttctgtccactatccctagcctcaatacttttcttcttttctgttcaacctttccgagagcttaccagcctccaccatgacctgcacatttcagctgtagctggcctgtgtttatgtgtacatgggtctgcttctctgcattctgcacaaggcaggcagtgttcacggctgagaactattgattatcagctaaaatagagacaacctgtgtttctaaattgtatcaaagttgacttggtttaaacttggttaagttggtaataacagaacaaggaagaaaaaaactgaagatgtaaaataagaaaaaaaatgtaggtttagaatcttaaataggggatgaagatgtagctcagtggtagtgcccttacccagcacacatgaggccctgggaaaccaaatgcacagacaccagtaatgagaaaccccagtagtgaacggcatcacctgaggaaagctgaggctagctcagatgctaagagcattttaaagtttatttttatttgggattctgtactttgttttacctgtgtaagtttttccttccttccttccttccttccttccttccttccttccttccttccttcctttcttcctcttttttttcttcctctcctttttaaagaaggatctcaatggtaccttaggctggccttgaactcatgattctcctgcctcaccctgctgagtgttgggactgcaggcaagagccatcatgtctggctaccagtgcaggcgttggtttccctgtaggatttcatgtcttacatggtctgtattgagtattgcaacatgtaactcacctatagaaggcctaagcctttcaagatgttgcttgtcctccaggctgtgtgctgttgagataaccttggctcctctgtggtgggctaactgaatggctattgtgccaaatgcctgtgtggaaatacatatcaaaagataaaggtgagagggcacagctaatttacttcatagaccatttaacacatgtaattctttttttctttcttttttttttttttttttttttttttttttttttggtttttctagacagggtttctctgtgtagccctggatgtcctggaactcattgctgtagatcaggctggcctcgaactcagaaatctgccttcctcccaagtgctgggatcaaaggcgtgtgctaccatgcccagctaacacatgtaattctttagtattactttaatatattttaaaacattacataatagaaaaaaagaaataatttgctccaatttaggagggcaagctgattccctcctaactgcgaggttagactaaccacacacaataagtcacataaatttatttattttatttatgtgagtatactgttgaagtcttcagacacaccagaagagggcatcagatcccttgacagatggttctgagtcaccatgtggttgttgggatttgaactcaggaccttggaagagcagtcggtgctcttaaccactgagccatatctccagcccctggctgccccattttttaaaattgtgggttttttttttgtttttgtttttgttttttttttttaaagatttatttattttattttattatatgtgagtacactgtagctgtcttaagtcactccagaagagggcatcagatccctttacagatggttgtgagccaccatgtggttgctgggatttgagctcaagaccttcggaagagcagtcgggtgctcttaaccactgagccatctcaccagccccgttttttttgttttttgttttttgttttttgctttttggttttggttttgttttgttttgttttgttttttgagacagggtttctctgtgtagccctggctgtcctggaactcactttgtagaccaggctggcctcgaactcagaaacccgcctgcctctgcctttttttttccccatttttaaaaattgatcatacatgtagcatcttagggcttttctgtgacatgtaaaacacttcatgtgagcccagtctggcttctctgcggtccatctgatggataccacgactcttacgaggtgagcataatcaaggggttagagctcagactttgtggaggcttctagatgactctataggctcatgaactctcactcagagtaacagtaatgaataaaatggcctgactgggacgaatcccactggccgagcaatggcctagtgtgtaagccttggggggtgatcatctctgttggaaagaacaagagagaaacaaaaatcttgccttgcttttaaacttactggtgagttcagagtagtcagcagtagccacaggaagtctaactcttacgtactatttataaaagctgtctacaaggataaaaggggaggatggaaaagaaatctaatgatttaatgacaaagaaggacgtctacagggggctggagagatggctcagcagttaagggcactaactgttcttccaggggtcctgagttcaattcccagcaaccacatggtggctcacaaccatctgtaatggcatccagtgccctcctctggtgtgtctgaagaaagctacagtgtactcatatattacgtgaataaaaaatctttaaaaaaaaaaaacaaagaaaagaaggacatctgtagacaacttctctacagtccccatgtttatggtatattggactaatttttttttttaaacaacatcaactgggactcacacttgccccgtccatgatcagcacagactttccaggagagagttgagaaagataatacagagctgtgcaggctcggactccgtcccggatgacgccagcagcttccgtccatgacaccttttctggcttatgaactattatgacaaaggacaagaagaaagagctcattaataagttccattagtacctcgtctgtcccaccgtgggcgccgaagctgctgcagtcctccctttgtctcttctgtccctgtttctgtccacaggcactcaggaagcacacagaaggtcaagcacagcggtggggctgaccagaaaacacacacaggtcacacacattgccttcctcctgaccagtccccgctcgctcgctctcacaggtcctgtttctcttctaccttccgttcatcacgtggccactcaacagttaccagctctgcctgactctgcacttgatctttttttttatatcatttcatatttaaaatgtgtgaatacatgtgtaagacacagtgtatgtacaaacagcagagggcacaccctgagccccaccttgggttttctctgtataattttttttacttattcactttccctctctctcactcagtggccccctccctgttacccgcttccacagttcatcttccaccctccttctccttctcctctgagggagcagagatcccctgagtatcccccaccctgggacttcaagtctctgcgagactaggcacttcctctcccactgaggccagacaaggcagcccaggtagtagaatataccctacatacaggcaacagctttgggatagccccacatgaaggtcaagctgcatctgccacatatgtgcggggaggcctcggtcccgcctgtgtttgctctttgatggtggttcagactctgagagccgcaggggcccaggtttgttgagtgtgtgcgctgctgaaggccgcacctcccctgagttttaaacagcttttccctgtcctgcttaggagaccgtggtggagctttcacttttattattttatggcttgggccacatagaagtattggaagtatttgtccgttcttagctggtgaacgcgtttacagtcttgggctgtcaggcagtggctctgagcaatagcacctgccgccagaacagccgctggccatccttgactccgagtccacagcccatcacttggacatgtgacattcttactgtgcctgtctaataaaatgctgaggatcccccctctcatgtttgccgcctctagagtacttttatgaagtgacgaagtctcagcattttcttgttttttgttgtatgttattttcatgtatttcagatgccttccactgcacttagaaaaacagtgaaattcccaatatagttttaaaagctcaacatatagctgggtatcatgacatacacacttaatcccagtacctggtggggaagggtgtgcagggaaggcagaggcaggcaggtcgctgagtttgaggccaacctggtctacatagtgagttccaagcaccatggctacatggtgagaccctgtctctaaattaaacaaagaaataacatccctgccccgcaaaccctcaaacggggatgacagtctaaaaagtgagcgttctgtatgacctgcccaggaagctgtttcttcacatttccactaatccttgttcaaataaattgtggtgctgttcccactaaaagcaatcctttctgtaaaccacgctttccataagagctgctcacaaagcagtcagccatgcagcacaagagactaacaccacctggtggggaggcggagcctacaccccaccctggagaaaatgctgggctgaaacaggaggagtgtttctttatgacactctctggagcaggcatgatttatagatctgctttcacccttggttcctggtcatatctcacactgcctgtcttattttctaaatgatgataagtgtatctttcatcaaagaatttggaccttttgtccttggttgcctgctcagtgaaggtaaaatacgatctttttattgctggggtgtgtcagttcagaagcaagcttcagagagcaaagtccctgactctctgtgctctgatcttgctgctctggtcttggagccataaagctatgacatgttttgcctgctggcagatatgaagaccttcagtttttatttttatctatcagtctgtctgtctatcatccgcccttctatctgtgtacctctgactgtcctagaacttactctgtagaccaggctggccttagactcaagagatctgcctgcctctgcctcccgaatgctgggagtaaaggcgtgcgccagtaccaaagacctccaagagaaaaagacattgtcctatgtatttcatttgtttatttgtatcctttaatctccgttacagtaagccagtaaatgtattatctgcagttctgcatttcatgcagcagcgtttgcttgcatttatgtgcatgcaccatgtgcatgcctggtgctcctggaggtcagaagagggcaccagtttccctggatggacctagagttacagacggttatgaacgaccatgtgggttctggtaattagacctaggtcttctgtaagagcaacaagtgctcttaaaacttaacatgttgaccactgagcatctgtctctccattccctgtcctcgctcactcagccactcttacaaactaaacaagcctgaagtggaaacctgaactcttatcagagtcccgaaggcccacactagtgaccatgccacaaatgaaggcacttctgtgggactgaaccctcaaactgtagcatctctgctatctccaggcagacagcaccaagcttaaagagacttagataggaatagagcatgtctggtgtgtccagtgtagaagtgattgccatagggagagacccctgcattctgaggtcaccacctcaggagtgacccacgttcagaacactgcagaagaagtgcattttgtttttttctttctttcctctttatctacctaatactatttttctaattttgctgattattaaattaagtacagaatagtaattgatttacctaaggcctcataggtaataaagtgaatatatgaaaaagactaaagtagacctatctattctcatgttcatctacgcatattttacttatatggcttttggggaggcaatatctccccaccataagatttcagtctgccatattttatcaaaatgttattcatatgacataatccccacacttgtaaaagaatgacaaatctgagaccagctgtgggtacacagccttatcttggaagagagagagaggtgataaaaacagggcatatatataatcacatatgcatgtgcacacacatctacatatacacaccattcatgtagtccttcaaaaaacattaagggcaataaaactacatttaagaatctaaaagttttttttttttaagttatttttagctgggcatggtggcgcacatctttaatcccagcactcgggaggcagaggcaggtggatttctgagttcgagaccagcctggtctacagagtgagttccaggacagccagggctacacagagaaaccttgtctcgaaaaaccaaaaaaaaaaaaaagagtttaagatttatttttataatttatgtatatgtgtgcactcaagtaccacaggagcccataagagggcgagatgctccttgctgctggagtgacaggaatctgaaggctgctgagtgtgggggatgggctctgaagcccagtcctcaggaagcagcaagggctctcaagggctggcctccagaggttctaactaactggtaaggggccttgctttgacggtagatgctcaatgcttattatgttagaaagactaacaaacaaaataaggatcaatggtcgctacatgaacactaagaataaaggacagagttgaaagtatatgcccaattttgagtgaatgaaattatttttaagcttggcggaaagccttgagagctgagagcagctggggctatggcgatggttccgtgctaacacacactctccccaggcctgacggccaagatccacccatggaacccacgcgcagaaggaaggagagaaccgactacagactacaagtggtcctctaagctctacacatgcaccctgcctgctcgtcacctctccacccatacagacaacaaacaaacgaacatttaaaaaggagtctaagctaggtggaaggagcccagttttgaagtgtcactgatattgtgaaacggtgctcacatctggtggtcgtttggaaccacatacttgggtttggtaaaagaacaagattcaggtgaacgcaatcgcaatgactgaatgctgagtcttactgcacagtcgctcaagttgaatctcagatttcccagtgcagtttccggaaatgtattgaaagcagcctctgcccataaaaagctggagctgcaaacaacagcttctagctgaacagcctcattctgcagtgagtgtggccaggacgctcaccgagggctcataactttggtggtcatttgttaattttttaaagattttttatatggatgtgtgcatgtatctgtgtctgcaggccatatatgtgcacgtccatggaagcctgaggtgtcgggccccctgaagctgaattgcagatggttgtgagctgccagatatgggtgctgggaactgaactcaggcgctctggaagagaggcccgtgttcttcaccactgagacgctctaaccccagtggtggtcactcttagaggctgttctgagttaggtccttggtttgtagcccgggtcctgaactctagatcctgtctctggcctaagtactaggaacacagccatgttctaccacagctgcactagaggacccacccacccctaaggaaacatcgaatcccagctctgtcctcaaagactctcagcacttgtctactccatagacttccgacactcctggactataatccaccttcctgacttataaacagaaccaggaaagagcatcatttagaacacattacagctaggccccaaaagtcagtgctcatttcctgctggactggggatgcagatgatggcagagcacatgactgcaagcacgaggccttggggctccatctccaacacctcaaaggactcaccctgcctatcggggctttgtcttgttgctggtattttaaaagccatttggctgtatgtatgtgttcatgtgtatctgggtgtacatacccatgcacatggcatgtggaagccagcgctacatgtggcgtgtcttctcaaccattcacaatccttctttttgaaataagatctctctcatcaaagttggtgtcccccagttggttagggtgcctggcccacaagcctttggcaaccctgctgtccctgctgtcctcggcactgcagctacgggtctgcaccactgtccctagattttctgtggcttcaggagttccgaatcaggtcctgagggctgtgcagcacgttcttcactgcccgagctgcctctccagctcagctgtctctccttatggcttcagcttctacagcaagtgggggccacctatcagctctagttcctaaatgttctttacctactccaattgcacaggagatgaagtatcttttcattattttcaggacgtgtatatgcatttacgaaatgttcaaaatgtaatttctcatgaaaaataaaactgaatactgatcaaagtctattagcaacaaaaaccaaatacaagcttttaaaattttttcctgtttcagctttgacaaatactgtctaaattgtgtacattttttttgtttgtttgttttagtcagtaatgaagagttcaatggtatagttcttgcttagcagactggaggtcctaagttctatctctaacaacacacactcgagtacacacacacacaaataagccaagagcaagacatttataaattctgatgtgaaagattctacagccatgagcaatgttagtaaatctcacaggtctacacaatgcttaatctaagcactaatttataaataacatacgccagaagtatcacttggctaaggaaaggttatgctctcagtggaatagacttatatagttctgaaggacagactgccacgtacccaggtaatgctcatgtactcgaataacctcacagagcccggggtcttcggaatccaaaggcagaattcctaaaaattaaaacaagaagcttaaggggaagtctgtgagtgaactcatttcctgggagatacgttcatgtaaactctgtacagtgaagttgatgtaaaggtggccgatgtcatgcagcagacctggagtgctggggtccctgagcctccttcccccagtatgccctgaacagaaccctgcgtttctggaggctactcaagttctaagtctgctctcttacaaaaggaaacgtaggcaatacagagtattactgagtgcttggataactaagactacaatcatcagttcttcgagtcagaggccccgtgaaagctggagacacgctttcccgtccctctgatcttcaacggcctttcccaaggctcagaggatgccgtctatgaagacgaggaagaccaagacagttatgaatgtggcgttcacacgtagttgcaggactgtctgggacacaggcatgagcagatgttcccaaaatgcttgcagtgattatagatttaagaataacaagggggctggcgagatggctcagtggttaagagtgccaactgctctcctgaaggtcccgagttcaaatcccagcaaccacatggtggctcacaaccatctgtaatgaaatctgataccctcttctggagtgtctgaagacagcactttagtgtacttacatataataaataaatctttaaaaaaaaaagaataacaaattcagggctggagagatggctcagcggttaagagcactgactgctcttccgaaggtcctgagttcaaatcccagcaaccacatggtgacttacaaccatctgtaatgagatctgactctctcttctggagtgtctgaagacagctacagtgtacttacatataacaataaataaatctttaaaaaaaaaaaagaattaacaaattcagccgggcagtggtggcgcacgcctttaatccaagcactcgggaggcagaggcaggcagatttctgagttcaggccagcctggtctacagagtgagttccaggacagccagggctatacagagaaaccctgtctcgaagaagtaaaaagaaaagaataacaaatttgcttcaagctaattttcatttgtaaaagtacagcagagagctttgtggggtgaacagaggttctacggctcactccatggacaatcttcaagcacaggcctgtgactttttctagaaatttcagtctgaccaagcagtagggactaggcaggagagcagaacatggagggaagggtgcgtcctgctggctttgtctgtgaccgctcggccagcgcctggcaggcttgatgtgctctgctgaggctaagctctctgttttcttcagtagtcagtatctgaggactaattccaaaagtcagaagagtatctttacttttggaatgtgaggattgaatgtactacactcccagtcgaagacagtgtctttatctgacgtgcggtcacagtgagcattactatttacacagaagaaagacagctgacgacagaggactgaggacctgggcaccaccacttaccgaccacttcgtcgtctggctgaaagaacgttaccttcctgccaactaaagagcagaaataggtaggcattagcatcacaaggaaactgcatttaattatttacctgcttattttattatgtgtgttctggcaacatgtatatctgtgtagaatgtgtgtgtttggttccatggaagccaaagagggcattggattccctgatactggggttacagacagttgtgagccaccatgtaggtgctgggaagaagcaaaactgggtcttctgggagagcaaccggtggtctcaactgctgacccatttctctagctccctaaatttaatttttatttgactatgaaaacaaatgaaaaagccaaatatagtgggcaatacctagaataccagcacttaggaggtggagtcacgaggctcgagaggtcagggtcatccttggctacatatcaaatgttaagggcagcctgggctatacgagatcctgtcccccagacaaatagccaactaaaattaaagaaatgaaatcattcgcagggtggtaaaaatcactcaatccaagagccaggactgtgtgggtatagggtggcctatgagttgcatcgggtagaacatgtcaagtctagtttctctagaaaatctgatgcccataggggttgacactgtggggaaatacggctctgtgtcactgccaacagatgaaggccctgaatgcctcccacaagaggctacagaagctgcaaacacacacacacacacacacacacacacacacacacacactcctctgccaacagtcaattcgtttgagtatttttgttctaggagctatgagatgaaatgggaagaaaacacttcagtgttgtgaatactttgggctcagaaccttcctataaactttataaaacagtatgccttatctcatgtcttatagtatgtcttacaatataccttatagtattccttataccttatagtatgcctcgtagtatatggtattattcttctagtctacagataaggaaaacgaagtaaaatggcctcataatcaattcatcctttggtaccaagatagtaagtgtttaagttcgcatcccctcttgctcgctttctctggggacccatcccgtgctgtcacccccacttcttctggctcccatcccactacacctttcctcctgtctcctgggatcacatgcttgcttttgctggctccttccacacttctctttcttccaccatcctttaatcgctggtgttccaaaaggttcctctgtttctactgcctccctagctcactaactctgtcttgtttggttttgaagtgtacacacggacagctctcagacggaatcctagctgcatagagtgctcatcctgccaaatcagcccaggctctgctcactagtgattccacacactagcaattccacacggtaggtcatcattgcccttcttgaactcaagtgcaagtgtaagtgtgagctcacctggctatgccatgtatcttactcataaacctcttcccatcgccctgaggccaactgcttatcacctcctgctgacttcctttcctcactattgcttccgtcggtcagtccctcttctgtcatcactgtttagcttatggactttgtgacatgattcatgttggtttctgaccctaccaatcctcttcctagggactggtctgtcactccctttaacagtaatctagtgatctcatttgtaatgctcaccaaaagacgggccggctctggtctaccctcctgtttgtgtctttctgagaacacgtctgtgttcatacattcttttgttctcctatatttgaggaataattttcctttttttctgccagctctcaggactgaacccatggccttgtgcatgctgggcaagcactttaccaccaagctacacactcagccccaagcatcgtccttctgtaggatgcttacacacaagcccaagttacttgcatcagttagctttagaccaaagcatacataatcatcagcaactgcatcaaatcaagttttcagtttgctttacaccaaggagggaaaagccaagcagtttgtcctggagatgcaaaagtcagagttgttctttctgatgagaatgaccagtgagcgtttttcatcaccctgaagtatttttaaagcaaaaaacgattttaacagacagaacaagaagcctgagtatctgaagtaacgtgtttctaggtcgagcccgaccactcactaagaggctttcatggccagggttcacccactccgctcacacactccgctcacacaccaatcaatggtaacttctgaataagtttatggggtggaccgtatttaaatcttttttattattattattattattatttattatatgtaagtacactgtagctgccttcagacactccagaagagggagtcagatctcgttacggatggttgtgagccaccatgtggttgctgggatttgaactccggaccttcggaagagcagtcgggtgcacttacctgctgagccatctcaccagcccccgtatttgaatcttaattgtgattttagttaaacacggatgataattttacttatctaaataatcgtatgctcctttaatctggtcagattataggtaaaaagtgtaattagatgaccattcagtccatctgttgcttacccattccacatttcataagaccgtgcctagccttgagagttatcaataagaaaaacacatatacacaaataagcagatcattataaaagctcaaaagcaagccaggctctgggattcaggtgccacatcacaaaaattcaatacaattacatatgagtcaaaacctagattttactgaagtataaagttcttcagtcataaactcaatcctactttcaatttttaaaaatgaccttttagggctggtgagatggctcagtgggtaagagcacccgactgctcttccgaaggtccggagttcaaaacacagcaaccacatggtcgctcacaaccatccgaaacaaaatctgactccctcttctggagtgtctgaagacagctacagtgtatttacatataataaataaataaatcttttaaaaatgaccttttaataaatttatattataaaacatattattttatgtgttggtaatcttattagctattattaactttccttctttcttctgagacagggtttcttggcgtagttctggccatcctggagctcgcttggaagacaaggctggcttcagactcatagtgatccacctgcctctgcctctagtgtgctgggattaaaggcatgcgccaccagtgcctggcctaaatgtcttttatatagaaaatacagataatacttaccctctaatacaattccagaaacttctcttccaacagggaagaaatccttttccatcttcatttctgctagaagctaaatcatgacagagtgtgtcagcacattactgtcaggaatagagtctgggtttacatgctaacacattatataatcccgacacttgccttaacaccagcatgctggagagataggcaggagaccttaagttggagggtagtctaagcaacacagtgagttctcatggccagcctgggctacagagtggatcaagaaccaaatgacaacaaaaccaagcaataaaaacctatttctgacatgtgagaaagagggacaacaaaaacccaagccacagaacagcaaatacaattcaccttcagaatgacaataaatataaaaaaattacaaaaaacatcaaaaaatcccgttccagagtgggaagcatgagctgctgaggcccgtgacacagaaccgagtcctgggtgccaggacacctgtaacattttctctgtggagatgaagtgacgttcacctccaaacaatctcaggtggccaagcacagcttccctgtcccccgttcaagtgaggtgagggagggcagacagagactgctgacagacagacagacagacagacagacagacagacagggcggcctcctcacaccctcaggatccgctagagacactgctcagcaggcagccttgctgagcacgcaggaagccctgagtcccacaaggcctgagtactaccttaatgtactgtcttcagaaagacacctgtctagcagcacgtgacagtttattcaactgctacttgtcacttttttctgttagcctacaatcccagcaccaccgaggtgggcaggggtgtcaagatcttatgttaaggccagtctgaggatttatggattctgtcttaaagaaaagcagacaccattgttttcctcggtcccaggttagagggcttggggaggagtggtggtatgtggctgtgtggtatgtgtgcatatatgtgtgtgttgtgttgtatgtatagtgtgttgtgtgcctgcacattttcctaccttaatgtactgtcttcagaaagacaccctgcctagcagcacgtgacagtttattcaactgctacttgtcacttttttctgttagtggcagagcgcttgcctcatgtccacaaggtccaggttcaagagtcaacaccacacacctggaatctgtgcggtcctgtaacgttgaatagtagccgcaactggacagcatctcttcttagtagacacattagatatttccccagatgtagtcatggacatataaaacgtgtgcccaatgtgactggcacggagaaggactttacgaaggtaatcagcagtaagtgaagttgtggggtagactcctaactgtcaggactggggactaggacgacgagacaccagaagcagctcacactgaagaaaggcacgaggacacagccaggacctcattcaaaccctgaaggatggacccgagacaaccatgcttgcacagtgatctcggcttctacccttcaaatctgggttaaaagaagtgtcagtggttcaagtcaaaggaccaagtaagacccacaatcaaacaaacagtaagtcccccaaaacacaaacaggagaaagacccgatgtggggttgtacacacctagaatcccagttcctgggaagccaaggcaggagggccatgagtttagggtcaccctgggctacacagtgagaccctgtctgacaacaaaacctgagagaacttatcacggtgcacttaactgtcactattaacgatggcacatttactcacttatgtctactaactgtttacttgttttttacgacaaggtctcactgtgtggccctttcttacttggaacttgccgtgtggaacagacctgcctcagcctctcagaagctagtgcctcctgggtaatgggtttaaaggtatgtgccgccatgcctgcaccaaagacacatgctttatggccaatactaaagataactgtgggcgatatgagactggagactgtgagacagaaacatgacaagaatacaaatcatagctgaaaatatgttaactaacaatacatacaactcgtggtcaataactgttcctactttttttttttttttgagacagggtttctctgtatagccctggctgtcctggaactcactttgtagaccaggctggcctcgaactcagaaatccgcctgcctctgcctcccaagtgctgggattaaaggtgtgtgccacaactgcccggcttctactttctatttttattgtacttgtgaaggtagtttcttccttgacctataggacttaataatatgctttcagatgcttccaaaataaattctataaaatattcccacataacgatataaaacacaaatcaaaccacttacctcggtgtggaaacactcgagcttcaagctcggtttttctaaggagtaatttcctggctagcactgagcacacagttaccaccagacactaactacaccgtgacaccctcgtccccgctggcacccgtacctttgtgtttatgtggctcagggcacaagctttaacttgaactctcacaaagttatcctctgtgacagggacattttcctggaaccaaataacagaagctcgagttacacatcccaagaggacattggttcatcttgtgagaatgtccacatacaactgaaaacatgaaactgacgccaagtctcgagagcatcctgagtttaaaagacacaaagaaatacctaacagtacatgatgagaaaaggagaaagaaaaatcaggggctgtaatttttaaaagtgttcgtatctttattttagaagcactcaaaacaccagcagagatgccatacacacaaactctgcttcataagccaggaaggcagacacagtattttaacttaaatactccaagctgccaagactttacagtacacacaacagacagattttactaaaatttggaatttccataaggtgaccaaggcaagactgaagcattcagagccgtccggctaagtgatgtgacgtcacttctgtagtccagaccgtgaactgacacatgtccctgagtgacgtgaggaaagaccctgcacggctcgtgacccatcacagggacctctgtgcttttttcgccactcagcatccggggcacacttttactgcatctccaattttctctttagtgacaaggatgaaggcattagtactgatgaacttgttaattagacctagagacgagttttactgggatgtagccaagcctaggttcttttgctgactgtggctggaggttagctgactgcagctgagaccccagcccctgctttcatcctgaaacccacagggagatgatctggcttgatgcaaacctttctaacaatcaccactaagtcattaaaagcttaatgagacc

SEQ ID NO: 68 - DNA, 9141 bp, Mus musculus
ggaaggaaaacctgcgttcaatagccttcacctcctctgcagagatgaaatgccgaacattatagctgacacccactcggttcaggtggccccggacatggttggctagcccgatactgtagtctcccctcccccagcctgaaacctgcttgctcggggtggagcttcctgctcattcgttctgccacgcccactgctggaacctgcggagccacacccgtgcacctttctactggaccagagattattcggcgggaatcgggtcccctcccccttccttcataactggtgtcgcaacaataaaatttgagccttgatcagagtaactgtcttggctacatttcttcttttgccccgtctagattcctctcttacagctcgagcggccttctcagtcgaaccgttcacgttgcgagctgctggcggccgcaacattttggcgccagaactgggacctgaagaatggcagagagatgctaagaggaacgctgcattggagctccacaggaaaggatcttcgtatcggacatcggagcaacggacaggtacacatgctagcgctagcttaaaatttcagttttgtaaagtgttgctgaggatgcggtaggatacgaattaagcttgaatcagtgctaacccaacgctggttctgcttgggtcagcagcgtgttaatcggaactagaaacggaaacaggcaggttagccgcagctttttaggaagctgcttaggtggaagaagaaagggtttaaagtcatggatcaggcggtaggccgtagctctccgaagctacatgaggtgtgagaaaagaaagggtttattaaaaggaataggcgtattgccccagttaataaaaaatgcatcataagggaggaaaatgtcccaaaaagcagagagaaatatctctctgggccttatagcaggagtactctgttcccttttgtgtcttgtctaatgtccggtgcaccaatctgttctcgtgttcgattcatgtatgttcgtgtccagtctatatgaatgaatgttctatgttttgtgttggataataaagatggtataaaaaactttatctgcaaagccgagagctgccacatgtttcagccaggaatcagacacgtggcgagagggcccctgctagaaaaactgttcgttttaggaaataaggtcgagtgcacagcctctaagtttcagagtaaaaaagctaataaatggttcatgattaatgtgtttgacaatggtaaagtgttttttatttttatgattgtagctacaaaaattattattctctgattggtctaaatgtaactgcttcatttggttcttttttattggtaatgtgctctaagtgttttcacaatcagctcataagttgttggttaagattaataattgttacattgctacagatggttagtgttaaatttgataactcaagtttagagtccttccaacacatggcataaggcagcccaagaggctgggtctctaaagatatttctagtttaggtaataattaatgtggttcgtatcctaaatagtaaaatttaaaataagatttaaagcaatgtctctttattaaagcattaaagcttgttttaataggtattcatagatattaattgacatccaaacttcgtaatatgatagtaatgcttctaatattgattttaaagataataaattgttttaaacttgggttttactttcccaaggttataggtattatcctaaccttacacaaaaaacttaaaaattatggttaaaactgctattgttccattgactgcagcttgcagtttgatttcaaatttaagatctttaattcacctgtatactgtaattaagataattacaagagtaatcatcttatgagagcgctcatacagctcacttcatacaaaactgtgacagagttatctagttatgtttgtctttgtgaatagattagacaaacagtttggttatagttgctgcctggcaggaaactgcagtacgggcaattttttcacaacactaaagttgtgaagaacgttttaactgtaagtcatcttaagaaagagtatcataatttagaggcgtagacagttatattgtttctctaaaatcggtccttattacaggagggccaagatgctcagattaaaaagtgtttcacgtttgagtcaatgcagggctctgggcagccccagagcggcttgtggcctttcttttgttttgcaaacagtgcctgaaaaaaaaaaaaaaaaaaaaaattttttccctgtgttcaagagaaattctttttaacagtgttgcagatctattcagatgtttaaaataatgcttaaattcaaagagttttgcttctagtgaactgtaatcactagaaaattttgcctctaagtatggctaatgtaactttacattatgtaagaaaaaattttattgtttctgcttctatacaagaagccaagagttttaatctttcagtgtatattgtttcctaagtgaaaagtattttattaactaatgcttcttgaagtttaccttaaatccttgctctcacccaaaagattcagagacaatatccttttattacttagggttttagtttactacaaaagtttctacaaaaaataaagcttttataattgttattaattggtaattaaaaattggttgtgcccaaaacaattctttggccaaaaagaaaacattattgtaaagtcatttttctcatcctcccagccaatcgttggcccatgtgggcccaactagcttctgtggggcggagtcttaagacacagtttcccctgttccagcacagatgatctagttgtgtgctgtagatggtgttttaaaatactgaacaatcaaaccttaatttgtatattaatagtcaatgccatatctctgagctcgcaattgcttaaattgttcatccctcagatactattaattctcaaatttacaattgcttatgcatatttctagttaataaataaattatgcacatgtaactcttaataactttgcaagccttctagttacaactgctccttaagaaaattgattaaaagtgcaattagtcactgcccctttacagccaagtatttaaaatgttttgtcaactagttattaattcaaaagtttaggtattgtaaaattttaaaactttaacttcttaaaagacaaaaaagagagaaattgtatccccgtgcatactatttagtgcattcccattcacactatctaagtcttacctttattttcaaaatctaatattttaatgtcaaagagtttaataaaggctttatagtatcttaaagggatctacttattggcttatagattgatcctaaaacagctaccttattagaaaagggaaaaacaggttttctccacagaacgcttcagaaacatattaattcgtgtgatgagctggtaggtaagttgactcatgtcctgattaaattgactaaaaaactaaattaaattcatgttttagatccatccttacttgtcatttttccagtttagactagcttctagccttttaactttatgacaatagtacatcagagactgtatattcagacttagtaaaattagtcatttaatagagtcataatgatttttctcctttcttcagtgtgaccagccattctaactcaatcttagactggtcctaatattcagtccaatgttagagattcctatattctaaattacctagcaagttaattcagagcacatcctccacttcccctagatccctaacctcagaaggattactggccttacagctagtggaaaaggctattgaagaacagtttgtcacttacatagattactccctgccgctgcacctgttaatttttaatacgactcatgtgcctacgggattgctatggcaaaaatttcctataatgtggatacattcgaggatttctcccaaacgtaatatcttgccatatcatgaagcagtggctcagatgattatcactggaaaaaggcaggcattgacttattttggaaaggagccagatatcattgtccagccttacagcatgagtcaggacacttggctgaaacagcatagtacaaattggttgcttgcgcaattagggtttgaaggaactctagatagccactacccccaagataggttgataaaattcttaaatgtacatgatatgatatttcctaagatgacttccttacagcctttaaataatgctctattgatttttactgatggctcctctaaagggcgagctggatatcttattagtaatcaacaggttatcgtagagactcctggtctctcggctcagctcgccgaattaacagcaatactgaaggtttttcagtctgtgcatgaggcttttaatatttttactgacagtttatatgttgctcagtcagtacccttattagaaacctgtggtacgtttaacttcaatacgccgtcaggatctttattttcagaattacaaaacatcattctcgcccggaaaaatccgttttatattggccacatacggtctcactctggtcttcctggacctctggcagagggtaatgatcgcattgacagagctctaataggagaagccttagtttcagatcgggttgctttggcccaacgtgatcacgaaaggtttcatctttctagccataccctaagactccgacataagatcacaaaggagcaagcgagaatgatcgtaaaacaatgtcctaaatgtattactttatctccagtgccgcatctaggagttaatcctagaggccttatgcctaatcatatttggcaaatggatataacccattatacagaatttggaaaactaaaatatatacatgtttgcattgatacttgttcaggatttctttttgcttctctgcatacaggagaagcttcaaaaaacgtaattgatcattgcctacaagcatttaatgccatgggattgcctaaacttattaagacagacaatgggccatcttattccagtaaaaactttatttcattctgtaaagaattcggtattaaacataaaactggaattccttacaaccccatgggacaaggaatagttgaacgtgctcatcgcaccttaaagaattggctttttaagacaaaagagggtcagctatatcccccaaggtcaccaaaggcccaccttgccttcactttatttgtcctaaatttcttgcacaccgatatcaagggccagtctgcagcggatcgccactggcatccagttacttctaattcttatgcattggtaaaatggaaggaccccctgactaataaatggaagggtccagatccagttctaatttagggtaggggctcagtttgtgttttttcacgagatgaagatggagcgcggtggctgccagagagattaattcgtcagatgaacacagattctgactcttctggtaagtatcattctaaagactaaaattccttttgtgcttaaaattcagctgagagcaacagctctcaaagctgtttgtgtctccagctactctctgaaccagctcccgacaggaggcaggagactagcctcagatttacaatttgcatttgaataaagtacctagacttcccggaaagaagttctgctttcctactttctcactgtctttcaagattttgtctttcaagcaggtaaatcaacattcccgaggcggaccagtagatgtgcatccccgccccccctagaacacacaggtggcagctgttacccccagtctcaggacatttccagcatgtggctttcagtctgagttaaaaatttaggtttacctagagggctagaagagtagatttttctatattaataaagattggtttttattttgatagacaggcttagccccttagctgacctctggcttttcacccttgctgttaccgcaaggtgtccttagctcggtaggctgtggaaaaaacagggatgaggaggatcgacttccagctcctattttacccacaaatcgtggtgttattaacgacataattcttgcttaggctttgctaattctgaggttgataattctcctttaggagctgcacagcactcagaactgtgcatactggtttgtgattgtacaaattcagtatgggcaccgcttggtgcagagatacttactgcaaggaaaggtccggcttgaccatttctgagtttcctgtgagataaacccggtttgaaagaggttggtaccaaattttggttaaaaataaaaaatattctccggctctacctcgcctccccaaaaggtaccgagagccacatgtgtgggttttacccacgggaggaatcgggtccatgtccacccaagccaaggttaaaagcccactcatctacggatgagaaaatcatttgatcacctcagttaagcgttgccttatttaacttaattaataggggggagagagattggagacgtactattgaaagggcaagcccttcactgcctcccacccaaataaaaaggccaattggccttgtactacaagagccggtcactccttctccctgtttcccacctatcttccaaaaatgcggaggaatatcaacttagtgctattttcacatcgttcagtcaaacttagccagagttccaacgccctacttaaaattcaactagaaagttacctaccaagtactaattagcattataaagtcagagtctgcagctccaggcctttcagttagttgtttactagaaaggacagtcttaagccagatacagtttaccataagaaaagttaaagaatcccagtgaagcaagttttttctttagccctagattccaggcagaactattgagcatagataattttcccccctcaggccagctttttccttttttttattttgttaataatagggaggagatgtagtctcccctcccccagcctgaaacctgcttgctcggggtggagcttcctgctcattcgttctgccacgcccactgctggaacctgcggagccacacccgtgcacctttctactggaccagagattattcggcgggaatcgggtcccctcccccttccttcataactggtgtcgcaacaataaaatttgagccttgatcagagtaactgtcttggctacatttcttcttttgccccgtctagattcctctcttacagctcgagcggccttctcagtcgaaccgttcacgttgcgagctgctggcggccgcaacacgataccattgtggaaacgatcaggacagtaggggcatttccgctcctcatgctttagtgccatggctgggtccccttctaggagtgtgttcagacccagtgagccacccaaaggtgcatctaggagcaggaagtccagcgggtgggtgcttctcagctcgggctcctcaggcggcagctgtggggatgctcgggtggtggcagctatgacttgtggcctgagctttgccatcagaacgataggtaccattccttggagctgttgctgctgagtttctgaggcatcgactgcctgcagggcatcttggaaagtctgcttcaactcaagggctggctgagggatgaggctagggatggctaggggtggaaaggctccattttcaggagtaaaatccctttcagaagtcagcactacatcttcatcttcttcctcttcctcttcactccaaagatgactcttgtcttccattctctgcaggtggacagtgcttttgtttctattgcgctgtatagaataggaagcagatgccataggggaaggaaaggccagcttcccaagagactgctggcctgaatttaacaatgggaaatttctcatgcctggctgctgatagtctggaccaaaggcaaggtcagggtcatatccagaagggttctcttgccagacagaggccaagagaggctcagatttgctaaaatagtccacggtggcagtgtcgggtgagtgagtatatgcatcctggctagtacagggctggctagtgaggtcctcaaaggcctctccaacctcctcccagtgggcgtggtgggcgtggactagcctcgtgtgctccctgagcagactcttgctaggtgctgtgaaaccacagtgaacacaggtattgaggcctgaggagtctccataggagggatagacgagggtgctaacatctaagactgggctgccacccctgaaaggttccgtggcctgccggctgggcagtgacccacgcacatgcagcttggcatgctgcatgaaggctctagaggaattggtgccaaagacgcacttggagcattgcagtcgtgcctcacggccctcatcacctggaaactgctttagcttttggatctcttcaataatcttctcccgggaagcctggtgcagttgccagtgctgttccagggcagtgggttctgtgaaggcccagccgcattcgctgcaggccagtggagccaggtcagctgggggctcctggcctggtgctcggcggtgctggctcatgtgttctaggaggtgttccttgtgcttgaagtagatgctgcactcgatgcaaggaaacacagctggctcctcttcctcttcttcattgctgtccactccaccagctacttcctgcaacagttcacacaggtatggtcctgtctggactggggacagtaggggctgcagtcgctccacagatgcttcagagttcactgtccaggtctgggtggccacttctgaggctgatgtgtgaagaccccactcagaaggctgggccacctgcccaaagtcctctaggtcctctctggtacccataacttccatgtccaaggtcttgggagtgttatccactggcacaattaccctcctaaaggaagtgacagtcgggggctgggcaggaaggtccaggtgcaaccctgtatccttcaggggcccctgttcatctgtatcttggagccaatcaaacttgtggtggcttggagagtatttctctaagaacttcacttcaccctggtggtgcaagaactttctagagcccttgagcttggcataaggtttcatagttctcacaataactgagtccttgaacctctgctcagatggggtaccctccctggcctcctggaccatgggatgttcccaagacccctgaacatcaagggatgcagggaagggacccagaa

SEQ ID NO: 69 - DNA, 14117 bp, Mus musculus
acctgggtgctgtaccggataggtgcatttgctgaagaactgttttaggctcctgcctcccaagggctggcattaaaagttcatcactatcccagtctttattctgttttccatcctctggtaccttacagaggcccggaacacacagtgttttatgatctctatgagattgaggccagcctggtctatgtagagttctagccagggcaatggagtgagacccagtatcaaaacaacataaactgtccacatgctgacttgccttaacatcaatttatacctgaaactaaatgcaagctaaccattagtcagttcattagaaatagggtcaatttacacaaaggacaggggagaatattcaggagtcaatgggacagattttatatttgattcatcagtttatccagtaattatatgcccccaaacaggtgatgggatagaaagccttgcatgtgctagacaagctccctgccactgagctatagccacagaccttttaaagcttatttttattttttaaatattttttaaaaacttttatgtgcattggtgttttatctacatatatatctgtatttatgtgtcagaccacagggcgtcagatctcttagaactggagttgcagctacttgtgggtgctgagaattgaaccaggttcccctagaagagcacccattgctcttaacctctgagcaatctctccagccccaaaatttatttttattaatgtgcatgtgtgtgtgtgtaggcatacaagccccatgaagctggagaggtgccaagatacccccaagactactcgaacaggcttacctgccttttcaagtttctgtctttcaagacacaagcagccaaacgccaccctgcaagggaaaaaaaaagcccaacatcaagccatacaatcccaccaatccctcagcttgccccaagatcaggtcacaaaatcccaccaatctgacaccacctcgtaagtcttcacccactccccccaagaaaccctatatacagcctgcctcctgctcagtcctgtgctgggtcccactagaaaccctatatacagcctgcctcctgctcagtcctgtgctgggtctcactagagcaagggctgtcaccctcttctgtttttcccatgtgaggtttcttgtacagtgtgactttgtggtatttcttggctccttactgccaggatacctttccccttagagctctttcatttacatatgcatacacatgaaccgaatcgggaacagagtgtgggtttccccactaagttctatcatttggaggccccagcgagatctgcgtgacacccaggaaccctgaaagaccccttggaggtacgtttgtttgtgtgagtcttctatgttgtctgttaagtgtggcaccgctgaatttgtgtcttggtttttcagttctgagattgtgggtttgagtcccaccttgtgtcttggtttttcagttctggtattctgtattctggcagctgccactttggaccgtgaggacctagtggctgcaggaggaagacgttctaaggccccacaggctgcaactctggaagacgttccaagggtgaccctggaggaagtgcccagggtgagggacagtcagaaaggtctgactgtcatctggcagagtgagaaaaataaggtgctttttctgccagaaagggagtcgatgtggaatctgacccccatcaagtagtgtttggctggttgtacaagtccaggagagaatgagtgtgcttggatatactggtgtcttttttctctgttgctgtcttgtttttgtttgtggttttcgtcatgggacacagacaccgtacattggaggtaaagtggaatccctccctgcctgtctgtctgtatgtctatgtgtctgtctgtcttgttcacttgtgtgtcctccattagaccaccttctgattctgttttgcttttggtttgtctggtttcaggtctggttttgctctcaaggggttgactgattatcttggtttggccccaagagacttttcactcctgctggtcgggtgaaggatttccagcagtctatgtccctgtacaaagaccagcatctggcagtcatggggccaaaacagttgaaaatgatatccatgcaaattcaacaagacctctgattggacactgaaggtgagcccctctccctcccaactctggagaaaagcaacttcacttctcctgctgtgctttcagtcagtgccatcatatggatttggacaactgagatttcttgccagagctactctctggtgtagacagaaggtccctttagccccttgctaaaacatgacagcccctaacaggcattgccaaagactctgtaactttgtttttttttaagatttatttatttattatatgtaagtacactgtagctgtcttcagacactccagaagagggagtcagatctcgtttcggatggttgtgagatggttgtgaaccaccatgtggttggttgctgggatttgaactccagaccttcggaagagcagtcgggtgctcttacccactgagccatctcaccagcccaactctgtaacttcttaaaacaacagaacatcaacaaaccctggtacaacagcagccagttaaaagataccaggtggctgccagtactaaaatctatgggaaggcttagtttttttggacccctgaggaatcccaatgactggatggaaggagtgggactctccagcctacaggcaggctaggagacacagaaagggattcaccatgctttggagggagagagagtctcaccagccatgtgagatttcgggtggaatggccattggcttcttctccaggcgggagattagaaattccactaaggactagagagatggctcagtgggtaagggcactgactgcttttccagaggtcctgagttcaaatcccagcaaccacatggtgtctcacaaccatctgtaatggaatctgatgccctcttctggtgtgtgaagacagcaacagaatactcatatacttaaaataaataaatctttaaaaaagaaaaaagaaattcaactaagctgagggcagacacaggtgctgagcaaggagaaggttaagtggacagctaagctaagggcagacacagagttgaggaaggagtaaaggaaaaggcacactaaccatgggaggcttagaagaccccagccactgagctgtaaggcaggttaaagatgagcagagtgtgtgtgcgtgtgtgtctgtgtctgtctgtctgtctctctctctctctctctctctctctctctctctctctctctctctgtgtgtgtgtgtgtgtgtgtgtgtgtgtgtgtgtgtgtgtgtgtgtgtgtctttcatcctcagatccaaggcaaccagagtagtagctggtattgtggtctatccggagcctaaagcagggtagtagaaactacacacttcatcctccctcctccctaagtgaacaaagccagaaacctaccaaaaacatagacaaaaacccacataaccccacagctccccacactcaactctctactatgccacagttttgtaattttcatgactctgttgcaaaaacaaactcttcctcccattctactaaggactgctaggtgaagccagaatcccaaaacacccaaacagtccctgttaatgttaaccccaactcgaaacaaaactgctcaactggtataaaaagccatcctcctgaggacacaatccaagctctaaattctgttaatgcagctataaaagacatgactcttttgagccagatatgacccaacaatgcccatacagctccttgtctttaactcctcccctacactcatgggagccccatatcaaccccagggtgagctgaaatggctccacaccccaaggggtagtgtacccagaattctaaatgaggcggatgtactagctaatatgattaaaaatggcagggtcagagccctacaaactttggaaaaagaaattgacattcttgtcaccctctttttccctcgccaatattcaatgtctaagcaaaactcactctccctttgctatcagcttaataggattcccgggacaaattaacaaccattatcctgacaaaaaaaatggacctctgccctccctctgttgcaatggctgcctccaaactatttaagacaacaacaacaacaacataattggagccctataggaaaaaaaaagttttaaaaatttatatgagtacactaacactgtcttagcacaccagaagtgggcactggaccccactagagatggttgtgagccaccatgtgggcactgggatttgaactcaggacttctggaagagcagtcagtcctcttaaccgctgagccatctctccatcctggaaaaaaaaaattgcaacctacttttaataagggttcaacctctcctctagccaaccacccaccagaggtggtggaagagaaaagttattcagatatgggggaagtggacctgcttgtcagtagttttctttgaaggtgagtttgagagcttgatcttcttgggcagcagttcagtcccatagcagacatcaaatatgatgcagcagctgcagaccagtcctctaggcaggccgacaccaggcacaaaccagcagccacagtccagtctttcagcaagtagacaccagtcagctgtagttcagtcctgaagaaaatgccaggtttgccaactggcctgaggtgaggcctcacaagtggcaagctgcctcaagaacctcatgagcagttcttggaggagtttttctcaatggctgagttgagctcagcaatgagttgtaaggtaggccaatgcatccgtgtcattagtaaagaatagcgaagcaaaacaaaccaaaggaaagcccccactgtctgtggcaccgtgtttacgctccctcatcacgggtcctttcatgtgttgctatatccaaacatcctttcacctgtggctgcttcaggaaaacagtctttctttcttttcttttttttttttcaaagatttatttatttattaaatgtaagtacactgtagctgtcttcagacacaccagaagagggcatcagatctcattacagatagttgtgagccaccatgtgtttgctgggaattgaactcaggacctccggaagagcagtcagtgctcttaactgctgagccatctctccagccccgaaaacagtctttcatgtgtttgcttttttttttccccccagacagggtttctctgtgtagccctggctgtcctggaactcactttgtacaccaggccagcactgaactcagaaatctgcctgcctctgtctgcctcccaagtgctgggattaaaggcgtgtgccactacagcccagctacatgtttgcttttagcaagaccctttcacctgtgtgccccagggagacatttgacataagtaactttacaaagaaactagaagtttccattgcagagccccctcaatatttactgatggaggaaagaggggtgctgcagcagtaatatactactcccctgaggatgaaccccctattctacaattctgagagatgccccatcactctctgcaatagaaaggttaaggggtcccaaaggaagtcaagtggtcccttaacctcttttcagacagtgcatatgctgtcaatttgctcccctgactgtccagacccttggtcaaactagatgccaacccactttctcctctaatcacacgggtttccacctcttaaaggaaacagcctcccccatctacatgtggcgtgtcagatctcacagttccatgccaggccagatctctcagggaaatgcactcgctggccaaactgcctcaacaggaccattcctagcctgcactgagcaagcagaccagttccattcacacacacactcaaacataaaggaacaaatgtatctgcttcctccatacccctcttgttcagctcagaggacaataaaggcatgttcctcttgtgcatccctcattaccaccccaactttacagttggtgggcaccgatcctcaaggccttaagtccaatgccttatggcaaatcaatgtcacatattccccaaatcatagacaaaaaaaaaacaaaacaaaacctgtttttgttgccatagatacatacattgtatatggtctacagcccaaacaggtgaaaactcagaaaggttaattctccgtatgctccccacctttgccatggtgggcattcctttttgttgttgttgttgttgtttaattgttttttgttttgtttgtttttttttaagacagggtttctctgtgtagccctggctgtcctggaactcactttgtagaccaggctggcctcaaactcagaaatccacctgcctctgcctcccaagtgctgggattaaaggcgtgtgccaccaagcctggctgtttttgtttgtttgtttgtttgtttgttttaatttactttatgtctgtgagtgttttagtttttgcatgttttttggtgtactacttgcatgctggatgccctcagtattcagaagagggcatcatatcccctggaattggagttatgagaagctgtgatcagccatgtggtggtgggaatagaagctgggtgctccacaagtataggttcttaagcacagagacatctcttcaggtctgggaaatggaggatcttagtgtagtaagaaaaatagtccaggataaggacagacatcctctcgcagctgcagaaatgcaagtggtaactttgcatgcatggatgtataacctgtgaagctcagtagggcctcttcatacaggcacacatgtaaagctgtcttcagaactttcagctggcattaggcaaggtacacactagtttatgaaagaaatgagcttttctcacctggtacaatgggtacattttgttgttgttgttgttttagcagacttaattcatttatttttcttgcataaaaacccttatgtggtagccacagctggagcctgggtcctctgaacagagactctggtgtgggttttcacaagatgatcagtgaattcctgataagaagacttggtgaacacagtctctttccagaggtcaggagtctagctgtaggtcttggagatggcatcaaaggtatccttggcaaagttgcccagggtggcagtgcagcccctggctgaagtggagcagtcatctaaactggccatcatcagttggttcttgggcacaggagcagagacaatgccagtgcctctgggggcagggatgagtcgtatcagcacagagccacagctgcttgtcactttgcctggaacaatgtggggcttgccaatcttcttcccccagtagcctctccgcacagggacgatggaaagcttggccaagatgatggcccctcggatggcagtggcgacctagttggagcacttaacaccaagaccaacgtggccattgtagtccccaggagcgatgaatgccttgaacctggtctgctgcactggcatgattttcagaacctcatcctttagggatgcacccagactccataatgggcagggagaacaggtagatctcctcgaaggacttgatcttcatgtccttaaccaggcggcccagaactcagaaatccgcctgcctctgccttcccagtgctgggattaaaggcgtgcgccaccatgcccggctggggttccactccttatcttcagctttacctccatgagccccgaggccttgaccatggccactgcctcgacctcgaccatggccatggcctaaaccttgaccatggccacagcctcagccacgaccacggccgcaaaccctaagactgctgccaaatcctccgcagagctgcggcctcctaatcctggccccacccccccatccccgggggtcctccgggtccttctgctgtaccggcagcggtatccaccatttggtgttttcccaaagaagaagccaatgggtacgttttgttttgttttgttttgttttgttttgttttgttttgttttgttttgttttgttttgtctttcggtttttcaagatagggtttctctgtgtagctctggctgtcctggaactcactttgtagatagaccaggctggccgtggtgaactcagaaatccacttgcctctgcctcccgaatgctgggattaaaggcatgcgccaccatgcccggctcaatgggtacgttttaagtaagccaacaattaccagaaatggtttcttccaaagcagtaaggactttcagaaggaagtgtctttcagtggggagtcggcagagctgactcagttttatgcataggcccttgaatgcagaattgaagcaacctgaactctcatggttgggaagtgggggaaggcgttccactaaacagagtatcctcttaatttattgaccaatgtgagtgtgtcagttgttctacagagactgaagaaaatcctaacaagagaaggcaatgtagtagtaagccggcccgtggcctacatgaaccaggtatttctggaaggcaggctggggctgaaagagagaatagacagcgagagaaataatgaagccaagacaaattttctctgatcaaggcctgcgagtttactgagactgtgcttaaaagggggaaggcccattccaccaccaccaccccccccagccagtccatccttggtgctttgtcgctatgctgtcagcacttggtcgccaggctgttgcttattcaggaatgtctcaggaagacaggttcagcttctccgcaggtagcagcatctcggagaagagcagggcagttgtcacttcaaaggaagccagccaagtcggaaagctgtactgcaggtggccccacctcagtggcaacaaggtctgcacaagcccgcttcaggctgggggaggcttcaaggcacaacacagcagctcccagagaagcctatgtgagatatttctaacattggaagaggtttgacgttgctggagtttatggttgtctccacctgctgagaatttggtaaagatggtatttatttatttatttattcatttatttttaaggtttatgtactttactggctatcctggaagatcctctgtagactaggctggcttcaaagtcacagagatcctcctgcctctgccttccaagtgttaggattaaaggtgtgcactatcactctgggcttccttttctttttttttttaaatgactttttaaaaaatatttattttatgtacactcactgtcttcagacatgttagaagagtgcattggatcctcttacagatggttgtgagccaccaagtaattggtgggaattgaactcgggacctatggaagagcagtcagtgctcctaaccactgagccatctctagagtcttccccaccccccagcttgcttttttttttttttaaattaaaaacaaacaaacaaagatgagcctttgaagccctagaactctggaacttgctaagtagactaggctggcctagaactcaagagctcctgcctctgcctctctgcctctctctctgcctctctgcctctgcctcaggagtgttgagacttaaatgcctcgtcacaactcctaggcaggatgttgctaaccaggagctttacagctaacacaagccctacacagcattttccatataatttgagcacaggaatcatttgacagctaacaaccagcacagagtgctaacattagacctcacaccatgtcaaaacccgggagttatgtatgctgatcattttaataccgagctccattctggctctccttccctagctctctagttgttttgttattaactagaaattttaatgtcaaatgggaaatattttcttttaggacagacgtcaagaattgagacatctctaactcttttggaaaacatgtcttacttgctaaattatcttgctggtccaggaccagctacaacttatggtcataggctttggttcctgaatacacaggcagctttttttatgcctcatgaagtcctagaaagtattttaaagctttgtctatcccaagctagccttgaagtcttgatcctcctgcctacaccttccaagtgatggtgaaatcataggcaaaggacattagttgatgctctcatgagcagaactcttataaatgggctacttcctagggtgggttttttttttcagtttaattcagaagcatctataatctactgtctacactgccacttagtctaaatttgtctggttatttaaacagagaaggctgcacacatttcacctacgaccagaggaacagcatctgggttggagtcaagatgcctaaactacaggccaaagtcattgtgctgcaaaatgctttactgcttagaagcacttgggaagtagaggcagccttttaagtgcatccatattcttttgacagcatttcactatgtaacaatgctggctccctgtttggctcttaagattaaaaccaggacttaggctggagagatggctcagtgttgaagagcactgactgctcttccagcggtcctgagttcaattcccagcaaccacatggtggctcacaaccatctgtaatgggatctgataatctgttttgggtcttctggtgtgtctaaaggcaactacaatatactcacacacacatttatgtttgtttatgtggagtatactgtagtgcactgaggcactgcattaagactctataccaaaacccttccagacaagccatacaaagcaagaaacccctctgctccattttgtagttgatttgttgttggggtattttgcctgcacgaatctgtgtaccattctgtgctggtgtcagaaggcttcaaatccctggaaccgtagttaaggggaggcctcctggaaccggttgtggaactcttgaaaaattattgagctgtagttcttgtggtaatatatattttgttttcttattccttttatctttatttatttatttatttatttatttatttatttttacgacaaaattagtcacttttatttcaaagaaaacagtacaaacaagtatgcaaaaattaagtttcatgattaaatacacataaggtaacatgcatacttgacgtcaaatccacagttagccgattacaggagcataaaggaactggcagagctgagagcctgttgctgtgcacaatttaaatgtttgcaacctgaaatcaaaactgcaaaactgagcttcttagaagatatgtaaaaaaactaaacatatacctcaagtggtacagaaacacagactctccagtctgtgccagtaccaggatgtgcctgccatcccaatgttagtgtgttcctatggatgctgggagagatgagacaggacaaacgccacaggccaaggcagtaccctccacaccgacgggaggtagaggcacatggacactgcactgagaaggctcctcagtaaagcaatgctctcttctgggactgatttttaaagactatgtgttactctgttccctaaaaataatgggaaagttctgttttaacccaaacaaaaccagaagacccagcaccctgctgtgcctcaaatgggtgccacaagcattctgctctctggtaggtctgggatgtgactcactctaatggccaaagtcagaactccccagtgtgtgctctgaatagtgctcctcatgtgaggcagggggtgctctaccagacaagctgatagtgttatctcattagaactgtctagtgtttgagccccgacacactcatcctacgagcttctgttgattcgtgcctggatcgttcccagggattgcagggagtctactgtcatgaatatggtggtgccactaatgctagcatcacaggtgaattgaagggaagtggccagaaagggcacgagtcacccagagccacggagtgtctgcagaaccataatgatgatcctttaatatgggatgagaagccttgctcaggaaggcagacaaccacatatggcttcaagaccaaggtcctctgggggggccttgagcccctcacccacaggcctggggcactggcaccagccccaggagtccacaggttgactgggtggtggcatcacctgcgctcacaggcacagtcacagcttgtcatcggtcatctctaggaactgtgcacacacgtccaggacacacttgcccttaggactgaacaggaacttgtagtagctgccatctgcacagatagcgatgactgcattgggctctgttccaaaggcacagatgcatggcgagcctgaaggaacctgaaacttggaaaaactccatttggagctgaagtattttggaaggaaagtggctgatgccaaactatactgttattgctttttggatcttcggctacaaaaatgtgcacagtgccgtgatcactggacacacagatgagagaagcatcctgattgaagttgatgcaatagatattggctgcttgagatcctcttcgtagctcctggattaaatgccccaatgaagtatcaaatattcttataagggtccctttttcagatgcagttgcaattcttgttccctgtaagttgagagcaatacagctcaggacaccctcatgtgcgggaatgtcctctggtggcttttcagtgttggcaggtccacaaactgtacatggccagtgtgagtgtcagggaaggcaagaagggagttgttactgttgggacacaggacacagaggcctttaggattatagcaggtttcaaagacgtgcaactggtagggattgtgtgtgagtgtgaacaccttaatcatggagtccagaaccaccacaattctatctctgcaacttgacagccttgacctctgtggagaattctctcaatgactgtcttcttcctcagatcatcaccttgttgggagggtatttcagttttttttccaccaccaactaaagctaaatagttacagcaaaataacatttccacatggccaactcctcctcctaaaaattcttgtttctctttttgagtggatcagtattatagactcggaatctattttccattccacatgcaaaacacccgtgatcctggttgaagccggcgtacagcagcccattgccatgggggttacatgataggagggtctgtgaaaccaggtcgagcggtgctagggccaccgcggtcggaagccagggtcttatttcttttatttacatgttcctgatagcctaggccaagatcttaagcgagaatggtaaaaaaaccatcccttgagattgggtcactagtatgaccttattccccagggaaatcaattcttgactttttatatcatttataaaatgtagtctcccctcccctagcctgaaacctgcttgctcagggtggagcttcctgctcattcgttctgccacgcccactgctggaacctgcggagccacacacgtgcacctttctactggaccagagattattcggcgggaatcgggtcccctcccctttccttcataactagtgtcgcaacaataaaatttgagccttgatcagagtaactgtcttggctacattcttttctctcgccacctagcccctcttctcttccaggtttccaaaatgcctttccaggctagaacccaggttgtggtctgctggccggacacaacaataaaacagttatgatagattaaaaactttcccaacaataaaatttcatatggctacacctgtgttatcagaggtgggttttggtatatggtaaagaaagtcttaattagaaagaattagtttaaatttatgcattgaagatttataaaaaatcaggcactagatgttgaataattgaccatatggggctggagagctagctcagtgattaagagcactatcataaagattaacctgctcttgcaaatatgccagtagccttgaatgactgcctcactgaatacatccttttagaattgttatattttgatgatttatattaataatgatgttacctgttctgtatgtgattcactgaatacatagtttcagagttgtaatgcttggatgatttttgttggtatttgtgattgattcactggatacagtttctaagagatgcaatgtttggattttaatgtataaaatcccctgcttgagagctccaaaatacagtcggattcaaattgc

SEQ ID NO: 70 - DNA, 4389 bp, Mus musculus
gattttcctggcatttttattgtagtaaaacatatgtagcataaaatttgccattataaccaatttttgacggcgttaaggacattcacactgatgcagtcgtcaccatcattcatctgcagaacactccggagcgttttctcaactgtcccaagctctcaacattgaacacgaactccctatccctcctcttactcattttattcagtctaaatatgtattccttccaggacatgtgtcctgcaaatattctcccccatcctgtaggttgcctttttcctttgatgcacaaacttttcaagtttggtgctggttttgcagctcagaggcagaacattttcctagtgcacagaaagaagtgttttcattttcataaagaatgaagctcagtttgtcccagaagcatttctgcttggtgtttggagtgcggaataggagtagctggtttgcttgtttgtttgtttgtttgtttctctttgcattttggaacagcaaggacaaccgccactcacctttgcagaaggtataattgacaggcgtcacgctccgtactttttgaaactaaaatatattactgactcttttgcataatgatttcccattaaatcttcctttgaatacttctggaaatgtcttagaaggacaatctcacgtgctccagaacaaacgtcttgttccatttctgtttttccacttcaggctcctttattttgcctgggctactgttgaccctcgtggggttttaacatcgctgatgtcctctaactgtgcttgcttttgacgcctctcaagtgccctctccatcctgaaccaggtacctcgggctcccttgcgcagaaacctgtcactttcctgccctggagaagtcacagagactagcaaagcccatgatggactgagtgctgagttgcaggttagggacccaaagtcctgctaaagaaaatattgacacatgctaagtgtataaaagactttgttcagaaccactgtgaaaggtgtcaagattattacaagtggggagaagactgggctctcctccaaacacaacaagggcaggattcataaccaaagagtgagtgcttctgtgaacagaaaggccagagaatggaaaattacatcaagggctcctagttaaactgactcagtaggattcttgtagaagatgggctatagttatcaggtgccaaaaggacagaaggaggaatttaattagatagtcagattgcctctgaatgactcaacttaattcttagaacaatgagtgcaggttaggaacctggggacagcctgctaaagaagagaacttgacaggaagcctgactataaagttcattccagagagagaacctctgtccaccttttccccactacccccttcaaagcaggaagacccagtgcagcccagggacaatttcctgtgacacatgtgtggttactctactctgatactgtttgcaaaataattctggtctaattagagttgtcctggtcactacatcaataaaacacaaatggtacagagccacattggtatttagagttttcttggctggtattttccatatggattcagactatattttttaaatgcttcctaggaagtcagggaaacggctcagtgaggtaaagttcttgctatgcaaatgtgagaccctaaactgaaatccccagcatccacgtaaaagttgggcaaggtagcttgtaagcccagttctgtcagggcagacacagggggatccatggacatgcctggccagccaacacagtcggatctgtgaatttcaggctcgttcgtaaaaaatactatgggaccagacttggctcagtgattgaagatgtctgccaccaagcttgatgacctgagttcagtagaaagagagagttgatttctgtatgtagtcttctggcctttgtgtgaataacacacacagatactacacacaaagccccttgacactaggaagccataccagaacaaggcttgggactagttctttctcttgaatgcttcttttcctaggtggcacaaaagatacactgcccttctcctgaatacactttcaaactcccttaacctgtctgatccctgttgggtgctttgtcagggaggtgcattaggggaggcgaccctaacctaaggtcacctcgcccagttctgcagtaagttattataaccgtgtggtcatatctgatgtttctaccactttcctgttatactctgtcacaaaggggacgcgttctcactgaatgtgttgcaaataataagattaccatggaaataggaatattcaatcagaatttctgaatttggaaaggatcaagcaaagagaaaaatgtgtttcatttctgtttacaaaggtataatcattgccatgagttatagatagcttaggattaaaaaaaaaagttccttataactccctcccccacctccgctacaaaacatcaaagaattaaaaaatacccaaactaaaggcaataatcccccttcatcagttgcccactgcaaggcagttagcctgtgcttgctccgcttgacctcaaggcagcagctttataagatgaatgagcttcttgctgtagttggaagtcctaactgtaggggccaggctcacagccaccacactgtgaaccctgggtgcctgcctgccaagttcctttccttgagtctctgaaacattccctgcttttgaaagcaggagttcattctagagctatagcgtaggctggcctagaactctgtgtatagtccaagctagctccaaactcgccatgtacctgccactgcttcctgagtcctgacgatgcagacatataccgccttgccagctcactgacagttattttatttattattatttttgtgtgtgtgtgtgtgtgtgtgtggagtattgctcagagcagattgcagtagataatcagagtaaaacagtaactatctgtggaaggcaaaacttgtagcatggtcatgcttaaagacttaatgagagtttgtgcaataagatatttaggggtctggggagatggctcagtgattaagtgtactggctgttcttccatagggcccaagttcaattccaagcacccacatggtggctcataaccatctgtaactccagatcccgaggatctgatgaactcttctggccttctggggcaccaagcaagaatgtgacaaatagacgtacatacaaaatattcatatgcataagatgtatgaattaatttttataagaaacttagttatttctctgaaatattttattttttgatatttctcttttgtttattttgagacagggtcagggtctcttaaagcccagagtagcctcaaactctccacgaagtctgcgaatgaccttgaacttctgatcctcccacacccatggctgctggctagagctctttcaccatgcctggttttggcaaccaaaagattagctgaatccaggacattctggctgctggccagcactgtaccaaccaaactacacccccagcctttgtttactttttttcccctaatcttctttaagagggttttcaaactgacctcaaatttttcttttcttttttcttttttccttaggatttctccccccccctttttttatatatagtcaactttttaaacaatttatttatttatgtatttgtatgcatgtgagtacacagttgccgtcttcagacaccccagaagagggcactggatcccattacagtaagccaccatgtggttggtgggaattgaactcaggacccctggaagagcagtcagtgctcccaaccactaagccatctcaccagacctctttagggttttcaagatgatttttgtagctctggctgacctggaatatattgtgtaaaccaggctggcctcaaattcagagaccacctccctctgcttctgcctcttgagtgctgggattaaaaacgggttctatacacacacacacacacacacacacacagagagagagagagagagagagagagagagagagagagagcattgatatctaacttttcaagctccctccccctttccaaattctaggaccacaaacaggcatgtgtagcggtactttggctaaccacgttgctcccggatggtcacatgtgctcgcttcaccccaccctccccacacacaccagttacttttaatacacctttactagcccaaaggctgggcagttctaatccttcccgcagctagcaaacaatcccctctgttactcccgagtaaacatcttttaaaatctctattttatctctgctacctcaaacacagctgtggaagtggcccgtgtggccactttccctgattctcacatgtcagctggcctttaggtctcctcttccttcttccccatcatggcgatctc

SEQ ID NO: 71 - DNA, 1018 bp, Mus musculus
gatgacgttactcaccatcaggattgagaaaattggtttgaaagatgcggggcagtgcatcgatccctacatcacagtcagcgtgaaagatttgaatggcatagatttaactcccgtacaagacactcctgtggcttcaagaaaagaagatacttacgttcactttaatgtggacattgagctccagaaacacgttgaaaagttaaccaaaggtgcggccattttctttgaattcaaacattacaagcctaaaaagaggtttaccagcactaagtgttttgccttcatggagatggatgaaattaaacctgggccaatcgtaatagaactatacaagaaacccactgactttaaaagaaagaaattgcaattgttgaccaagaaaccactttatcttcatctacatcaaagtttgcacaaagaatgatcctgatacaaataaccaagaacttgtgtgaattttaccactcagaacccatcatagctctgtgtagcataatcacccttcaacaggcaggaagtgagccctacccatgccagctgaccgagccagtctattgcacaacaggcaggaagtaagccctacccatgccagctgaccaagcaagtctattgcacaacaggcaggaagtgagccctacccacgccagctgaccaagccagtctattgcacaacaggcaggaagtgagccctacccacgccagctgaccaagccagtctattgcacaacaggcaggaagtgagccctacccatgccagctgaccaagccagtctattgcacaacaggcaggaagtgagccctacccatgccagctgaccaagccagtctattgcacaacaggcaggaagtgagccctacccatgccagctgaccaagcaagtctattgcacagccgaaccccagaacaaaagttcagcacatcactgacctatcactcctttggatacaggtttattgtagatttggaaacgttttcacttttctattaattgtgcaatgaatagtctattttctc

SEQ ID NO: 72 - DNA, 1426 bp, Mus musculus
cacaaacctaaaaatatctaagacaggaaagcggaccttactctagatctgctctctatgatgtagttgtgaaaacacttttatttgcatttacattcatttatttacatttatttgaacaggatttccaagatggccttcctggagattttaacttggacttagtgacttctatcatatttaccttctaatgtcttaattccttcatctacaaacttccttgcagcagatggtctgtaacaacaacaacaagtaaaaaacaccatctcaatagcaggagaaaaccaaagtctttgtgataatcgggatgtcttctattgtcaggtacagagttaatactcagctaaacaggaactgctggatgctgcatggtaactttgctaatgcccattttatccaaagagtgtttgaatcttcagtcaattggtggacaaccatgaccttgagcataaaaagacacctaagtagctagctgtcataacactcatacacacctgtgggcactagaacattcattaattcgacagattgtttgagggcctagtatgtgctgaaaacgctacgtagacaagacacttctaatgccaagatgtagagagagacaacagatacacatataaacaagcacaatgtcaggtagatgcatatagtgtgatatcagagtagctatgtcttactttagactggacaggaagtagagacctgtgagatgctaaaactgacatacgaatgaagaccagatatttgagagaccaaaggaaaaccatttcaggtagagaaacaattcatgatgtttccatggataagaactatccttggagcttgacttgttcaagaagaaaattagtaattctgaatgatttaattgtgaaaacacttttatttgcatttacattcatttatttacatttatttgaataggatttccaagatggccttcctggagattttaacttggacttagtgacttctatcatatttaccttctaatgtcttaattccttcatctacaaacttccttgcagcagggtcatatacaattagggtcatatacaataccacggagcaatacataggagccacaagctataacactcactgagccatggaggcaagtttgggtcttcctcaagcacaatgaatcgctattagaaatgagtaaaagcgggctggtgagatggctcagtgggtaagagcacccgactgctcttccaaaggtccagagttcaaatcccagcaaccacatggtggctcacaaccatccacaacaagatctgacttcctcttctggagtgtctgaagacagctacagtgtacttacatatattaataaataaatctttaaaaaaaaaaaaaattaaaaaaaaaaaaaaaaaagaaatgagtaaaagccaatcataaaacctgctttaggggctggtgagat

SEQ ID NO: 73 - DNA, 9363 bp, Mus musculus
cctttcgccagttatcaccaagtggtaataaaggcactgactcttaagtctatactttaaaagtaggggttccaatgaaaaacactcatcagatacaagctctctgtaaacagttcaagtgtgttttaaatttaaactctgccttaagctgtctatcacactgcctttgagattcttggaaacctatgtagctctcgggagaagacttcaagaatatgtaattttaccaaggctagtttgtgtactctattcagtaatgtcttcaatttccctgactggagtaaagctctcttttatctatggttattggtctattatgtttattacaatcttgatagtcaaaactacagaaaacaactgtcatcgaacaaactcttccagaagccatagactgttgtctgatggatactaaataaaacccaccagcatggggctatatagaaaagcaatttattccattataagcacttacacagttagtcatggagagtaacaggcctgatggtgagacaggtcaaccaaaatggagatggcatcaaactatagtggtcaaagactaacccctaaaaaagcaacttttatcaaggattaatttaatcttaaaaacaaacacaaactagcaatccactctttctcaacttgacagttcaccagtggaacaactgccaggtaaaaacatacatctttacaacttggtggtcccaagtttaaaaaaagaaagaaagaaaaaaggaaagaaagaaaaagaaaggaaggaaggaaaaaccacacacaacaaaaaccagactttgttcagctacccagccacaattggagccaccaacgaggctttgctgacttaaacccccagttaagatttagaaaacaccggtggtttgggcttgtagcattgttggtggcacctattgtagctgggtagctgaacaaagtctgtgcctcaaaccaatgttaaatccatctcggggttcagaggaaaacaaggagagtctaggatcacaggtgcagacacgtctaggacccttgtccctctggatccacacttccttcaggatcttcatcattgtaaatgttctccgcctgccataaagaaataagaaagaaagaaagaagaaggtatttagcatgaagacaagtttttataaaatattatgccaaggcgcctgataacatttcaaggacggccatacatttctaactacttaataactactgttgaataaaaacagcaacaacatgcaaatagtatcaatcacaaattggtacggtcaattggtgtgtcaataaaaacaggagaggccacagcctcctgtaccgggcacttttacatgaatatggatgatcatcattcccaagccctttaaccagatggattattgctaattgctaaaataaaaaccataaatgtctctatgaaatacacagaaagtaatgtttatgagtaaagaatttctttttggaaagatagaagtgtttttgtttttttttttaatttttgtgatgtgcaattctggtgcatgataaaactcactgaatggtaaagctttctatccaaacctcaatttttcgttttctgggaggggtttttgagacagggttcctctgtgtagccctggctgttctggaactcactctgtagaccaggctagcctccagttccgcctgttctgcctccccagtgctgggatcaaaggcacgcgccaccactgcccagcctaaaccccaatttttaaatcttttggaaaaaaaaaaaagaaaaagaaaaaacaaaataaaaaaacaaacaaacaaaaaaaacttttacataaactaacccctacctctacaaggtgatgaaacagattaatctttttttttttttaagtttttcgagacagggtttctctgtatagccctggctgccctcggactcagaaatccgcctgcctctgcctcctgagtgctgggatcaaaggcgtgcgccaccacgcccggccagattagtcttaaatacccaaaccacctgggcaaaatttattcttagcagctactatctgtaagtttatcatactgggtgatgcagaagatgagacaatcttatgtggtctggccaaagagacaatgaatatataataaggctaaaaccaagccatgtggtggtgataaatgccttaacaccagcagtccagaggcagaggctgaggcaggtatctctgagtttgaggccagcctgggctacacagagaaaactgtctcaaactccctcccccaataacaacaacaaaaaccccataactaaatagagggaggggatagtatttcatgttatactcatcaatagacttaacagataccatctcagagggtcactgcaagctccaatttatagaattctttctattcatcattgctataaaatttggaggtcttgcaagaaacttcttcacttggtttgaaaatgttctgattccacagaacaagagattttgacatttatgtattgtgcgcgtacaaatccctcttggttcagtttctccaagaactaggaatacagggctaccatacatacaccttgtttattatattgggatataactgagagaccaaatgaaagagataaatacaatagggagcagacagggttgcttctcacgctgctttccaagcaaatcagtgtgaacacagaactctagaagctcaaacttctcccatccccacaggggaggctgagagttccaaatgtttgtcagcaattttgctgactagcccaactgcaaggctacctagagttccaccaaaattgccttactaacgggtctcggcacgaccacaagggagcatcatcaccaacaggacacactgagctggaaatcccattgctttcttggcagtcctatgccaataatagaacacagcctaagcatgtactccttcttatccggatagaacccacaatggaacagtaagcctggaaggatctagtttaccccataaccttttctcttcctctgagacagggtttctctgtgtaaccctggctgccctcaaacccagagattccaaatgcctctgcttcccgggtgctactgggacgaaaggtgtgcgccactgtgggaagccacatgtgtcgttgcagggtggcgctggcttctgcttgccaccacacatacataggcagtaaagtttttttttttttttttgccaagatgaggttttgagaattaaccaaaattaaccaatcagatgaaagagaagttaaccaatcaaatgcaggcatgcaaatgaggtggtaagcataacccaagcacaaccaatccgggtgtgagacacgcctctcctaggcctatataagcagcaccagttctgggcttggggtctcttcacctctgcaatcaagctctcgcaataaacatgtgcagaaggatcctgttgctaagtcgttcttgctggcaagccagggcatgcaagacaccaccactgccagccttcttcttcttttttttttttttttttttttttgagacagggtctctacacaggcccagctgtcttggaaccacagagttacccgagttctgggactcaaactgtatacctcgcaccacattttcagaaatagcactgcatataattttagacaggtgtatgacaaggaataaaacttttaaaatataatgtatcaaggttagagaaatgtcccagtggttaagaatgcttgttgctcttctaaaggaccatagttcagctcccagcactcatgtcagacggcttacaactgcctgtaactgcagctccaaagaagcctctgacaccagcacgcttgtggcctgtgcacattcacatattcattcattcattcattgcccccacccccgtctcaaatttttaaaaaataaatagccacaggtaacacaggacataaaaccagtttgtagtaatcaaaataactattgtacacttaaaatttattattttctgtgctccctttccaagaatactctcacaagtgatgaagataagatttttttttaaaaaaagattatttattattatacctaagttcactgtagctgacttcagacacaccagaagagggtgtcagatctcattatgggtggttgtgagccaccatgtggttgctgggatttgaactcaggactttcggaagagcagtcagtgtcctttacctgtcgagccatctcactagcccgaagataagatttatactaaaggtatgatgtaaaacaaaaaacatgcttatgaaaaatcttgttagaatttccatgtataattcaaatgccagagacacaacctcgatagttccattcctaggctagggtggcttggcctatgtaataaaaatggctatgttatgaaatctttaaactaatcttacactttaaggtaagatttaacttgcagctatgatatttatacataaagatctactgcctgtctactggtgttttcttcttttgaaaaaccagggcttagatttaggcagtgttggtggacacctttaatcccagtacttgggaggcagagacagaggatttctgagtttgaagccaatctgatctacaatgtgaattccaggacagaagatggctacaccaagaaacactgtcttgaagtaaacaaaataaactctcaccaaacccaacaatcatcatctaaaaaacaagctgccgccatccactcagcccacttggagacaccaagggttagctctgtgtctttgagaagtctcagaagcacagttaaagactgcttactcctatgaaaaaaataatcagactttaaaactgataagcattacaaatggaaaaaaacaaaaacaacacttacacacgtctgtctttctatggttcacaagctactgaactgggagttcctgctgggtttgctctccatcctaagggccatttcttaaacaggcagtaatgcagcagaagggccgagtgagtcagttaaattttaatttttcttttgagatttttaaacaaagacagttcaaagggtccagagaaagcaaacaaaataagcccaattgattttcctgctgcttctgagaaacctcagattgaagattatatataggacgacacttgccaaaactatgaaaaccaagagaccagaaatgaattgctccttagccaggttctaagaaacagactcacacccacctagaccacagtcaagtatagtgtcctatcctctaaggaaaggataggccttgagtactaatgacagctgccctcaaacactagtagggttcaaatggcctaataaagtttcactcaaaacaattttaggtaatgaccaggtgtaccctggatggttaacaggacaaacatctaacaggggtttagtctttttctggataatgtaggaccctttataaatgagcctggctagtagccaatgataaagagaatgcccaaagccaaaggaaatttgttgtcaatgtcagtcttggggaagtgaattaacatatacatggcccaataagaaaacttcacctaagtttacagctttcttttccagcttaaatgtcaacatgcaaatatctagaacaagtctagactttaaagctaatgcaaagctgacggttgaacctccgatggatcatctgatgtttactaaaatttggctcagtggtagagtttgtcgatcatgcacaagactgtgggttctataacctggggatggtggtgcatgccttaactcctagcactggggaggcagaggcagatgatgaattcaaggccaggctggtccacaagagtgagttcgaggatggatggccagagctacatagtaagaaaaagggagcaccaataagccagcttgtcctctcctctagtccttaagccctggcatttggaaagctgaggcaggtagatagctatgaattaaatccagcctgcttcacacagtgaaatcctatctcaaaaaacaaaaacaaaaaaaccacaaagcaacacaattctttactgggggacagtggtaaagaacccaggtacagttctaagcacccactatcatcagtatctgcacgccaaggggatctgatgccctcacttcggcctccaaaggcactgcatgcaaatggggcacataaaaaaagcaggaagaacactcaatcaggtaaataaatccaaaacaaaacctgttaggtctttatggtctcaagactatcttaaatacaaggctgtgacatcacaaactgctaaaagattttaaaattctctttaaagaaataacatcttgtgctgatctcggcagcacatatactaaagaaataagtacatcttaacatcttaaacaaagctctaaaagtcaggcatagtggtttatgcctttagcccagcacttgggaggcaaaggcagatctctgtgagttcaaggccagtctggtctacagaactagttctaggacatccacggccaccagagaaaccctgtcttgaaacaaacaacaaaaaacccaaacagagcaacacacccaaagctctatgactctatcagtagttgtagcctttactttatgttttggttttccttatttttctttaatggttacaccttcactattatcacttaatacaatacaatctaccactggattcctttttaaaattgttatttcaccacattctcagtagaaaagcaccagaaagcatatataatattttaaatagtccaacatcataccctacaagcacacccaagaatagctctcaagacaagcacggccagactctcctggcttttgtacactcaggtatacaagctgatataatcacatcattattgtaacctcccatcctagagggtttctctgtatgtagttgtgtagtcctggctgtcctggaacttgctacatagtctaggctaaaactcaagagatttgttgtcttctgacataatgtgccactataccccacctaaatcttgtatttttaatcttgcatcacactaagacaacttcaagctacacatatgatgcaggcatcccaatcaatttgtactacagggagtctaaagcttcctttgtaactacaaatagacctatgcagtgtaacatgtcttaaacagacactatggcccttatcagtgctgaatgaatgaaattatagaaatgtaatcatctttcagccctgaggtacaatttttgggaatacaactctcaagtgggatgtgggacagcaaagtatataaagaatcttaagccgggagtggtggcgcacgcctttaatcccagcacttggaaggcagaggcaggcggatttctgagttcgaggccagcctggtctacagagtgagttccaggacagccaagggctacacagaaaaaccctgtctcgaaaaaccaaaaaaaaaaaaaaaaaaaaaaaagaatcttaagatcaacatgtaagctgggtgtgtttaacaataacaatgttggtgaccaacctacacagcttgaaactaatactggatccccagacagagacattaagaggctgtcaatcaaagtcaggtaagattctgcaccaagtctcatcaacctaagacagaaatgcattgcttttgataatgcttcttgtcaaaacaacctaagtcttgtttataaaatcaaaaagagggagatgtggagagctcttggggccacttctagaaatttggcaggaatttgacactgggctaggagaaggagtaggctcaagatcttgattatcttgattaagtccctgaatgccatgggactttttttattgacttgttttttccttgacctagaactgaccttattcttcgcatgtacttagaacggtataaaagcagactgggaaaaaataaacctacttcagccttatcactggctggagtcatattaaaaaaaaaaagccgggcgtggtggcacacgcctttaatcccagcacttgggaggcagaggcaggcggatttctgagttcgaggccagcctggtctacaaagtgagttccaggacagccagggctacacagagaaagcctatctcgaaaaaccaaaaaagaaaaaaaaaaattaaaaaaggctgggcatgaaaagatcaatttttagttaaactaaccagtggcacaatcagataaaggaaaagaaggaaaagaaaggttgagccaggtggtggtggtgttgcacactgttaatcctagcactcgggaagcagaggcaggtagacccagcctgatctacagagtgagctctaggatagccagggtcacacagagaaaacctatcttgaaaaactaaaccagccgggcagtggtggcgcatgcctttaaccccagcacttgggaggcagaggcaggcagatttctgagttcaaggacagccagggttacacagagaaaccctgtctcaaaaaagaccaaaggaaagaaaaatgacacaaatatggaagtcacattgaaagaaaaatctgaacacagctgacagctgcatccacaaagtgtgtgtaaatgtttgtatacctcgatcatcatatatgcatacataggtatgaaagaaataatgttgtctcatagatctagtttcccatagtaaataaataaaccactcaccatctgccacacttgcatgatattgtcttctgatacagaacaaatcacccaaggctcattgggattccaggagaagtcagatatcttggcagtgtgaccaccatgaataaactggaaggcccaaaacaaagacattaaatacagaccactttaagtcacagcccactcattatttaaacactgaagatcccaaagtgtctgacttgtaacataccaacaattctggtgggccatcctctgcatcttctggggactgctcttctccaattttactttaaaacaaaaaaccaaaaaagtcagaaattgagctggtgagatggctcagcaggtaagagcactgattgctcttctgaaggtcctgagttcaaaccagcaaccacatggtggctcacaaccatctgcaatgagattctggagcatttgaagacagctacaatgtacttacgtaataataataataaataaatctttggcctggagcgagcagaggtcctaaaaactcaattcccaacaaccacatgaaggctcacaaccatctgttcagctaaagtatacccatacacataaaataaataaattaaaaagaaaaggtcagaaatcattacactcagtacctgtcattgaaaaatgtagacagtaactttgctaagctgggtggcactcaggaagcagaggcaggaaaatctctttgaatttgaagtcaacctggtctacagaggggatcagaggacagctgttcccaaaacacccccgacccaaataacttcagggatagggtaactaacataaaactcac

SEQ ID NO: 74 - DNA, 14475 bp, Mus musculus
ctctgcctcagaggtcttctcaagccactactgttcccaaggtgggtttctggatggctaaacccatgtcaagtgcctttatccaattgtatatttcacacagttatcccagtgtccaagctaacccacacacgacttcctaggacatttctgattttttggaaagaccagagacactgttgggagattctgtttaaatgtttaaacatactggctggcttctgttttggttagtacctaattctaccatggaagaacaactagaagcagccttggctagttaaccttcaggatacagactagaatgggacccggaacattgtgagcctgtgttgagttatctgtagccattccataccctgaagtgaagtctctgaagatgagctcagcttcacccagcatccccaggacaacctgccttgcaaacttgtgtttgctgtgggtatggctctgccacctttgacttagtaaacattgcatgacgagtcaaaaatcaccttcctcttggcgcttatttggggcccataaaccagaggttggccagagagcatgggtctgattgggacttaagccacttggttcacttattctcagagtcctgtccattctgtgtctactcccaaggtgtccccctgtgaagaagatgcaggagtgctgtgagaagtgccatcccctggtacttggagggaggttgcctcatagtgagcttgcattatttaatgatgcccaatacaggatagacctgttttctgtatcacatcttaccaggtgcttccttggacctgatatcaatcatgaggaagccacgatcctggtggggtttataccatcgtccttgaacatgtggttccttccagtgtcccctgaccccatccagtccctccatggagggcattgtcagcattgaggtagatacccatgttataaacttaagacatggatgtggtggcgctcatggtacctctggctttttttatctatttgtaaagaaaagtaacaaattttgctcccccacgtctccactagttaatctcgtcttatagggaggacttagacctgttgagaaatcctggagtggggtccaggggtcagcattttttggggtggggatataagtgagtggtgattttccttgtctgttggctgggatctcagaagaaatttgaggacagtagaagaactatttttcatttcttcattttctttgtaaaaggaggatttattctacttattactattttattaaaaagatgtatgctcgtgataaaaataaaagcaatatgaaacaattaaattaaagaaattagaaaagtttctacccacacataaataacttcaggaatatcaaactcctttctgagacttatatacaaatggaaaggggagtaaagagagaaatattttacaggataaatattccctgtgtctaatcattttatttcaaatataaatcatcatttcacttgtgcttaacctaaggaacgatgtcaggaagactttatagatgtgtccaaaaagatcccagcccagctgagaaagcttaagttgaaagcattcagtagctcaatcagattttctgctgcttctgactgctacaagatatgaaatgccccacgacattgctttctttactgttgcaatgtgttttaatttttctgttgaaaaaaaatgcaaatgtaagtcttacaagtgtttgagacgggtcctcagtattacaaacagcttcactcgtggctacttgtttgctttaaacgggggcttctatttctcagctcttagtgtatctcagtgcaatgaggatttttgtcattcctacaaggatggctcccagatgctacctacccttcctccctctctgccctctctctactgccccctctcctcttcttttttcttttttccaaaatggggggtggtggggtggggtggaactcagaccttcacgcacgcacagagaagacccactcactgaggcatacccacgcatagcttctgtccttgctctaatccatatcctgggaaccctccagaatgcccccacccataggtccctagggcagggagagagcgtgttttgagttaagttctctcttccttaacacaagggtcttcctttctttcagatgtagctgtgcattatacaccgactagcttgagctgtgggtgactgtctccccagagtttttacacatgtgtggcgctttccttatgcagtcttgttactgggttgagcctttagctgaacagtgggttaacctgggtagcattcctgtgttccttctcctttgctgtctgctggtcatagccttagtgtagcctgcttgatacctgatgtctgaactacagtccttcctcgtttgtttggtttttttttttttttttttttgggttctaagactttcctattgggcactggtgactttgccagatgataacccagccagtgttttcccatcatttttttttctcgattgtaattttcatttcttctttattagagttagttgtagcctttaaaagacgttctctgcggttcttttcttgacttaaaagatccaaattgtctgtgtagttctttagtcagtctccgccccctactgccaccttccctgcatccctctctggcatcctttgcatcatgaatttatttgattaaaggtatcagttcccctttcccactgttattttcccccttggcaggatgcctaattgcaatgccagcttctggggtgaacatggacccactgtcatcgggcaaggtctaggatggacatggagacccaccatctgggagattccagagtggacgtgaacccaccatcatcaggcaggttttgggatggacatgggcccactgtcgtcaggtagctatgtgaacttactgtcaaccaagcaagttttagtgttcgtttctttgttgtctcattttcagtggatcataagctaaaaagtacaacctattattaggaaaacaccctgaaagtttgctcaccccaagggacgaggccatgacttgagtgtcagtgccatttagtgctgaccttacctttataatgagtattgccaagtcagcctctctgtgaacttttcaggaaatccctagaaacaaagcctatgtaaggcgagggtcattggtgtttgcctcaatctcagtatgaagctaggaactttccactcctatgatgaacacaggatgaaatctgtgcatctaggacctccatcaccagacccttgtaaggacccttagacactgtatccttggcagtggtgccaagactagataaccatgggtgtcaggggttggggaggaatgggttggacctggggtgcgtgatgccttctcaagccctctcacagtcaatgcagtaacctgctgtgttcactgtgcttgggggacttcctggaggaagccagcttcagagaagagatgctggtacccacgtgcggtgcttgaagataggttatccgtgttgccttcgctttattcgtgacgaatcatacacggttgacctatttttcagtaccaaatcccgccttggaggaatttctggggtgggactgtggtgttagcgtctttccagggtaagtgaagggatggttcaccatggttggatctagtaagaggtatgctgtccatgcccagtgtatccctggttctctggtggactcagggagggacatactttggaatgatctggagtattctgtagtcatccactttattactttgacaaatcacataaagtccaccttctaaggtgtaaaatgtgtccctcaaacatattagggaaaggtcaaggtcagaactaggaattgcattcacagcatctaccatgatgactacatcagcccctctggccatgtagtctgagctccctagaagaggcagttgagttccctggtggtgttccgataagaagccttcccaactgctcacaactgacacatccatgtgggcgtggcaagctcctgtggcttcttctggtcagtgatactaaccaccacatgcaggagacaagaagtgacccctaggccacatggcatatgtcatatagctagaatatgtagccatctgcccaactctcagggactccatcctcagatgcctgagatgtatcaacacaagctctcgaaatcaagtgttcgaatggaggttgcccatggtgtgttcattttatttatgatgagtattacatggccaatctcctttcggcactaaaatcttcctgggagagcttcttcgactgtgcgggttaaggaaataaattgttccctgtactaagtgctgtctgggacttatgtcacctggttgtcaaagtaagatttcccagaaatgacaccaactatttcggtgactctatcgttgtttggccatggctatcaagagcatagtgcattgtgtcaagcactgtattcagatgagaaaacatcacagtgttaggcatgctgtagggaagagcaaatgtcagtcaccagtggggtggggctagctacaagccactcagttactcattccttaccagtttcaccagtccagggaagatctctaagaagtagaaccagatgtcaggctggtgaatggggagaggtggctcacagtgacatttagtgacatgagaatgctgatgtcctttccctgctccagtgtcccttgggaaggagagaacccagcagcattcattaccacccgatgcttgctaatggtgtgaccttgaatgagtcagcctgtcacctgtctgtgcctccgtttgtctgtctgagagtgttaatggctgcttataaggtatgtattcacgctgaatgtgtgttcagtattttgagagtgcctggtttcccccagaaagttggaaaaccattggcttttataatgatagttgttgcatgaatgtccttactctgtggatctcttcccaccctctagaacacaggttccttgagctcagaaaccccatctaatgctcgtaggtgcacacaggacgaatgatgctgagtgaatggcagttggacatgttttctttgttgaaccctctttgaggcctctcagaagccagagagaatagaggacggtgcagacaccttgtaccctgatgctgctggtttgtctgtgcggtctctcaggatactgccttggaaagggagttatcctcttttaggtcagccttcattggtgggcaggatggaccctactacacagagagtcatggtttcttctatgtcaaacctacctcaggacttctctaggagaaacactttgggattcagacttggtgtccgtgtgcttctgggtgagtgaccagtttctggccaaagcctggatgtctgtacaagtctctggccacctgtaggcaggagagaactctgcaagtcagtccattgctagtctgctttgcagttggacctgggggctcatcggaggtaatgccagcctccctagagggtgggagtcagggagccagagccgagggaggcagggctgcctggggaagaggcgccctgctcaactctcggcctgtgctgacgtttgattcttgagcagaggttgcccttggtgaattcgctttattgatgttgaatcacacaaaggcaacttttgtttgagtatcaaagcctgcttggggtggcattggggacacgttacaaagttctggggtctctgcaaatgtcatgtgctagaatggaaggtgtggatatggggatggtcaggaaggggtgtggctcagaacgccacgtgaccagacatgtagtcccaggaaccaatggagagatgccaatatctactccctgactcttctcagcctgaatcctctttgtcacaccagcacctagcccccctagttgcagacacactcgctgttctatctctactctgaagataccttgacaaaatgaactctgtcctttgacagtgtcaaggacaatggcagccttccctccccacccccttcctctcctcaactcactgggtcaggagtgctcacataccatctgtttttcccccctcccaccccaccccctcaacacacctctgtctgtttctctttcgtcctcatcgctcaccaaaccttgttctccatttttggatgggttaggaaatgaatagaggcgaccagcatttcatcccgtttacattaaataatagtgataaaataatcacaaaataacaccacaaactaccagaatagcttggaggaaaatgtgttcaattgactacaaattggcagaagaatccaattttcttgacaacatttgagctgcgacatttgacctggggaaacagtactctgtagacatggcagccgcaaggggcagcttcagtagtggcggatgctatgagcagtaatatttgtggtagatgaacgcacattgaggaatcaaatcttcgttcagatttttaaatgggaaagaattgatcctaatgaaaatgatttgaggaaataacaagggaaataaaagaaatgaaaatggcccaacagcacagtcaaggaagctaaacagggaattggattagtttaatggaatttactttaaaaaaaaaaaaaggaaagaaatgcatgtttttttatgaaaatcaatgtgggtgtggtgtttgagatggggaaatctatggatatagactagagctagtggggtgataagaaggactggtcaccatgtgggtttttttttttaatgtggctaaactttattttcccatcccaaacctttacagagagcttcatggagtattcagaagctggcgggtgtcacctggaggatgtgactgggtaccagtgccagagcacgtgcccactgagcagtcttcttcactttcctcgatcctcatgaaacattccgggtaagacactggttctggggagtctgctcttgccgagcagttggtacctggaacattctagggcctgcccttccttgggtttccatgttgccagctcccagggctaggcttaaagacgtacccattgttggtgctgaagggctaggcccgtacgggaggtcattttagagtggatgtatccagggtctaatatactatctggggtgtgatgagcaccaggtttcatggtggctctctttccaaaaggatctttacctcaaaggactccagaggctacatcattgtcttggaactggtcagtggctggagctctctccaggacaagtgcttggaggaagaacctggacaagcttccctccccatactgttgactggatcttgtagctaccgttagccaccatcatcgccattgtgtgcctcttaggagcatttccaggaggtgatgccagctggggaaagagcctctgtcccacaggtcagtttccagaacacctacatgaagctgcccgtggcgtcttttccccgtatgacacactgcatgtgaccagtctcttgctgccctgcagcaaggctagaagcctgtgtgaactcttgccaaaatcagagaagggattctgatgttggtcacactccaagagttttaaaatgagtggcgaacacagaatccatactctgcttatggcctaagtcaatggatcctgacccttactggagagccctccctggcgtgctcgtgcggggcagccatacacactggcacaaggggaccctgcgggatctccttccgctgttctttctctcctccctccatgtttatctttgaagcattacttgcttggtttataggactggatggtcaagcagttcttgctatgacatcaccgtggggggagggggcaggtgacagggcggggatgccagggtcgtggggctgcagtggttgggtgggcccaaggaggagcatctctggatgatgcagtcattgcctcctcgcttctggaaggcatcgtctctgggagggtggtgtggtatatgcgcagggtctcagcatctccctatctccagcttacaaaggagagatagagtaagcagagttctgcacccacttctgccccgagtcagctcctcgctacctgggtctcaaggttgtctgggaaggctttagatattcttggaaggtgaaagggtggtagattgcactggggaggtgatggaataattgctttcacgtggtggagggtggctcctcactgaatggggagttataatctctgaggggctccaggatggttcttctggaaactcagccatcggcctcgttctgagcatccgagcctctccgtggtactcggagagaggttacccgagcaactttgcatctggaggacgaatgttgctcggtgaaccccttttcggtatcaaatccctccagggaggccacctcagggaagaccatggactcatctcgctctggggtatgggacggatggtcgaccagctggaaagtaattgtttctaatgtacttcacctggtccactagccgtcggtgcccgctgcagcctgcgcccaggatgtcacagcctcagctcaacacctctgctggtacttgaagggagatcgaccgtgttatattcgcttggctgacttcgaataatacatggttgatcttttctcagtatcaacgctcagcttggagaagctcttggagttgcagcccctgtgggggtggggacagcatggtgcttctaggttgctgcctccgcggggaactgggctgggtggaacaggctgtgtgctgcctgtgtcaaccctactcaccatttatatgcaatcccccccttccccccaggacagcttcaggtggtgattccagctccagggttgctgcggtcaacactgggtacttgaggagaggttgtctgtgatgagttcgctttattaatgacgaatataacacagatggcctgttttcaataccacctgccactccggtcactcggcagtacataccaggtgtcacaccactgcccggtaggtaaatgcatggactctgtatgacgcttgtcaccccctcttcactgaacctcagctctgaggagcctcctgggatcgcaccaaccttgtaggctgggccacgaagcattggccagatgtgcaatggatggctgtccactttccatgcctctttcccgccacaacaatgggtgtttgtccctgtctaaggcttccaccgagggctgcatgctcaaatgccctgtaccctgggtgcttctcaataccatgagggcttggaggggctagcatgatacttagggaagagccaggccagttggttacacgtgcagttcctagtatctgaggtgagattgcccgtgacgggtttccattcttaatgctggtacagtgcatggtcacctctctttatcattggctcttactgtgtgagcatgggtgtcaggggagggacacactttgctgacccactggacaccactgatggtcaggcatgtagctgactcatcctgacccagagcctcacatctcctgaggtgggggttgggaagtccagaagggcatcttagaggaagaagcatcctaagtagagtccgtgctggtggtacctgagctagcttgtctctgagacgtttgttttctatctgatgactatcccacagcctacttctctgcaccatgtcctaccctagaccatttctactttgaggcattgatgccaagaactgaagcctttgtgttggttgactctctagtctgtatgtgagaccatcccttggcctgtcttgtcctcagtgccaccctgttggaaatagcacagaatgtcctcctgagtctacaaggcagtgatacccaagctctgtccctgcttcacgagcacagggggcccagtagggattagcctgcacttctttttttttttttttttttttattttttttttttttttcattttttttttattaggtatttagctcatttacatttccaatgctataccaaaagtcccccttacccacccacccccactcccctacccacccactccccccctttggccctggcgttcccctgtaccggggcacacaaagtctgcgtgtccaatgtagcctgcacttcttcatgtttcctccaacttaacactctggctctgtcagactcctgtgagcttactgtagaggcttgacctagagtctcaaggaccccagaaagtacctgatcacacccagtaggagcctttgaaagacaggctatagatttttggtatttagtaaggctccccagggtggcaaagagctctttctgattgggcttgctccccattggagcaagtagcaccctcaccctggcaactccaccctgcatgctttttctcctcttctgggcctcctcagcagcaaaatgctcttccaacagagatagtggctgcgcaccctggcttgtacctagcacatggtctcctttagatttcttctcttgttcaggatggtctgcccaggcgccctctctctgggagttggtcctggttactgtctcccacagtccatcccccttccttggtcctcaagcttgtaggccccctccacaggagttcaagactcggaggggatcgtgttccctgctctgcagtgacagtgcaggcagcctgacactcttatccagctccttcctttgtgatatgacatcagactgcttgtcagctatggctccccaggtgcctgctttcccaaactgcctagtaccttggttcccagcctctccctgaccccaaccaaaacaaaacaaaacaaaacaaaacaaaaaaaaaaaaaaaagaagaagagaaaagaaaagaaaagaaaagaaaagaaaagaaaagaaaagaaaagaaaagaaaagaaaagaaaagaaaaaagctttaagatttcccaaggcagacgaggacctttcctttgcgtcttttctctttcctctgttttactccctaccccttccctccctcccatcttacttccctgacttatcttctgctgtattctaagccttaggatccaggccaggtctatagtgacagaataatggagtgtgctgattgactaatagagtccccaaaggcagaaaccatattaggttaatccccaggaaggtggtgagcatgaagcaggaattccataagatgtggtggctgattccataaatatagaagctgggttcacttagtctttgcatttgttagaggcctcccaccccagctagtcaccgatttttgagacgtacagcgataggggacagacaggtcagctatgtctgcgggcttttctttacttttgtagctgggggtctcatgctaggcttcaaattcatctgagcacaacccccaccctccactccgtgaacgtctccgtggcagcaagccagaggcccctcagaggccctcgtgcagcaggcctgagctgctgtcagggctaatattttatgcatggacctaagcaaatgggaacatttggagatggaaattgctgttaatgacacatctttggaatatattaaacgcgtgcaagaaggctgctgatctctccatttaattgctccagtgtaagcgcagtcacaccacggcatccacagataggctacccctagtctctgcatcaccgatggggaaagccccaggtacctcagccaccaagggagtattatgtacaagatggaatgtcagctggggtgccaagcaaccaccgacacgcacactccaaattcattggagaccctaagaggatggtccctcctgctcggtgcagacttttattaaaagcaaaattactagatttatctattgtttgagaagaagaaaagacaaataaaggacttttctcatccagtgagtcaagtgaaaatgtctgcccctcaggcagacaggaggaaagcctctggggtgggggactttcagaggtcagagaattcaccattcccaagatagcgtgttaacctaatgtgccaaggtcacaggacacaggctagttcaggtgatcaagtcagtttgcctatcccacagttccttggggtgtggttagactaaggcagtggtctgttcctttactattttcaaggagatggtgtgtagcttgtgtgtgtgtatgtgtgtgtgtgtactggctgtccccaataagcatgtgtggagggtgaggaaagattggctcaaagaggtggagttgtcttcccaggatcacacagctagagacagggctccaggctggatgtccttaagatctttgcttgtactgttttgtgtctctccagagaagaccccatgttccataggtgatagacagctcattgacttgctccctgttctttctgaacagtgaggcaggattactttccccaagacattgcttgctggaattgtcaggattgtcgttttccccttttagtttacctaagttaactaagatgctttctttcatgtgtggcctgaggaggggctgcctgctccatcacaaaaccgccatgtgtgtgcgggtgtgaacctgatgcatctggtcaatggctagagagctacacacccttgtgtgctgagctggctagggctgtcctagagatagagtgagtcagtaaagtttctttgtcaagacttgaggggctgtggcaacctgtgtacccctcgagctgctcatagtcgatgctcaggagatgcctgtcttccttgcatcaaatgggtttaggcatcagcagcaaggaggtgaaagatggatggctgtgggaaagctcagagactgtttgtggaatgaataagtaaaagcacaccctttttgaggaaattaagaaacagggagaggaagaaacgtccagggaaagacaacataaatctctagcaacattaccaacaccacagctgggcctgttgaaaagaccctgtggaggtggtggggtcatttgtcatgggcaaggacaggcttaagggctgggacatggggcctgatggaggctcgtccatcattttctcattatccctgcaacgtggagggcagctagcagatcacagaacaacagcctcccaatgaaggtggcagggctgttgagtgcgagggaccccgagggagggcaggctgccccaggccctgccccctccaggaagccttcttgctccagcccaacacacaatctcactttgtcctcggatgttcatcatgtgatcttttatcaacgcaactgtggcggggcccttgctaacttgcttccgcgtgaacctgtgcttgcctacgtgtggtaaagcggaaacactgtgaacacttctgaccttgtcttttcaattttaggcaggtgacaacgctgaattggtcctcaggagcggatgttcaaggaaccctgcctatgcaccatgctagctgccagtcctaggttgggacattccactggggacatccatgggagagctatggccattaacaagtcctgagccctgacctgaagccatcagtggcctaggtgagtgtttgccctcaggatttatacttaatttatagcttggagcaggggtggggttttcccagggcacaaggggtccagaagttgtgtagaaaatgcacacaacggggttgaaggcacacgtcccagccctacacacacacacacacacacacacacacacaccaccccacgccccgatgccgccatctgcgacagcttcgttttctctaacactcaaaaatacatggttctgctccgttctccttggcaggcagggtagccagagctgtggggctgccaaggcctgggggagccgccagcctgcaaagtttactgtacaaacagttggggtggggggtgcctctctgttaactcaaaatccccatcagtaaacatgccagtttaaaagtgtaattaactcaggccggaaaagaattctgatttggactgcttttcacagttgagattgtttttcttttatttatttatctctttccgggtgtggtggtgtctgtggagggttttagccaggaaaaatagaaatggggagggcttggtgggatgagccagttgggactgagaatgctggcagggaggggcaaggggagatgggcttgccacaggaagcctggggtctgaatctggtttctgtcctgggcggtgcctgtggctccttgaagatggaggaactatgctagaaggtgtgccaaggccactgactgagagggacacaggtaacttagggattatagggttctggggtgactcagagaacctcagggctccctctaatgtctccttgcttctgtctcacggcagctgctctacctgactttgtggcctcccttcctggatctctcgcttacgacaaccgacaacaaagatgtttgactccagaagatgctccccgcggcccacctgagaggactgtccacaccccaccccactgcgccctgtgccatctacctctgagtccccaacttctcacccatgtttcaactcccaccccagagccttgtattccagatctgagcagcccttgcttaggaacctgaggtggggggtgggtaggcagacccaggggactgagcagggaggggaaggaggggtttctgctcttggctttcaaagttctcagtgtgtgtagccctttgaataataaacatatgtcatataatgt

SEQ ID NO: 75 - DNA, 888 bp, Mus musculus
cccaacagcctttattgcaggaacacctcgatgctgctaaggggaccttgggaacccagggaggtctgcttatatactctcagcccccatccactcaaggcaggccaagccacctcaccaggcatgcagcttcagccaatgggggcagcaggggcacgcctccaccaaatatggacttgtttacaccgccagcattatggtgcacctgctctcacgatggtcgatggtcatggcttattttcaggtgtatgaggaagtcaggtgcaagtcataagacttagctgcagtcccgggccgctcctcacatgcctgtaaacattctctgttgtaaacttctatttcagtttatgatttaattttctgtgtaaacttttgatgaactttttaacaagtgatcatgtatgctgaaagatgtttaggggctgaggacaaagcgaagtgtcagaactggggggcgcgggtgataaattagtaagcctattaatttctataaactattgttacccaaaatctgtcttggattgttagtatcttgtgcacccttccgcttatgggacagattgataactcccctgcaagttgagtaatgggctatgcaagctccctaccttgattccaggagtaagaaggcaaacagcctacagagggagggaagctcaggctgaagtcaagacctggtgatcacagggttactgcccacctaggggagaagcaagcggctgagcagcggcaggtggagtagtggagcctccctggggctgcgcggggagacagatgggtaggctatcggaggacaggcacaaatactacagaaatacaaatccctgtagatctggaaaaagtcaggcactggacttgaagctagggctgagaacctctgcactgtgt

SEQ ID NO: 76 - DNA, 1823 bp, Mus musculus
aataattaaaaataggttttattttcatgtatatgagtgtttgcctgcatgtgtgtatgtgtactatgtgtgtgcctggtgcctgcagggaccatgaaagagagttggatcacctagaagtgtagtgagggtggttgtgagctacccaggtaggttcctaccatgtagctactgggagccaaacctgggtcttctgcaagaacaagaagtactcttaactgctgagccaactctctagacacaattaaaatatatacatatatgtgtttgtgtgtatgtgtaatatatgtatacacacacatatccatagctattatagtctttaaaaatgacagcaacaacaagagatacttgcccaacgtgcacaaggcccttttcttgtactgggaggggaaaaaaaggaagcctggcccagcctggtccgacaaacctcaaatggctgcatttgagaggccaagacagaaagaacacaagttcagtgcctgcctgattccagagtgagttctggcgctgtggattatgtaatatataatatggaatttcattaatctgaggaggatcactcaggaggaaaagacttggggcagcagacgttggggaaccttttcagctctgtgtaagatgtgatttgggaaaacagccatggatctgtgagatcaggcacaggacagaaaaccaagagcttatcatttgccccagggtgtctgagctgcagaaggaggcctgagggagcttactgtgttcagttttgaagttgagcctcagaatcaattgctggcttgttctagattctgcagcctgacatctctgcctaagtctgacctctctggctccactcttggaaggctgaggacatgcaagtgtgtgacttcacccatccacagtcaatgtcctggggaatcacagtgcacctgtgggaaaaaggaaaggaagagtttatagcaggtggccactgccacttaaacctcagtgatgggcaaagcaaggtttgtcacttaggccaggcctgaatcaagttggcagggctgtcctttttcagtagtgcccaccttttttttttttttcccagacagggtttctctgtgtagtcctggctgtcctggaactcactctgtagactaggctgacctcgaactcagaaatctgcctgcctctgcctcccaagtgctgggattaaaggcatgtgccaccgcgcccggcttcagtagtgcccaccttaacgaccatcctagggacctattttcctcttcttccctttctgagagaccagagacttgaagaacaggcttcaagttggacagatagtatgacgccccagctatgcaccccacatgtacgcttacacaccttgtgaggctcatgcacacggcacatatacattcaaacatacccaaccccttgggactcacacgctcccacatgaaccgaatgcatggtgctattacatcatcttttgggctcagatgcctgggatgctggtctactcttatcatcctttcttccggctccctcttgattccagcccaggttgatttgcaccatgtgccctgctctccactgagcctgggcctccagccccccccccccccccccagttccctgcatgtgcctgtgctcacttgctgtgggcgtggagctcttctcaccgttctcatctggcagccctggttatggttcccagactgggggagaacttccctttgcaaagttagataacaggccgggttctctgtcagaggattggtgctgtggctccacgtgctgcagctggcacaaggccaggtccgccctgccaagcagcgagaagggaaggcctggctgct

SEQ ID NO: 77 - DNA, 1396 bp, Mus musculus
agaagccaccctgacgctttgctctgcgcagttctctgtatttaaaagacaacgtgaaattctaggcagcatcgccgggttctaggcgcgcgcacgctcagccctgtggcagctcgtgactttaatagccaaagactgcacaggagcggttgcggccactgaaaactgatccgaggactgctgcagtgacagagggagctctggtgctccgtgccttgtcttcccaagtgtttcctctagccatcggccataccattttacgtttgacaccaaatgattgttaaatggtgcgtttaactccccaagccgcctggaactaagcaaaaagagctgcctactatgtatgttggatgaggaaaaaacactgcaaacaagcactgcttaccaaagttctcacatctaggtaacgtaacaaagtctggtagctcagcttttaaaacttataacgggccgggcagtgctagcgcatgcctttaatcccagcacttgggaggcagaggcaggcggatttctgagttcgaggccagtctggtctacagagtgagttccaggacagccagggctatacagagagactctgtctcaaaaaaaaaaaaaaaaaaaaaaaccagcaacaacaacaacaacaaaaagttatgacggaagtagaaatgctggttacagaaaatgggtgtatttgttaatgcgtattaatgttaattctaccagtatacatttaaacaaggacactagggtttcatcagttctgagttgttttgcagtggctcctgccttgaagctctacctagactagacttaaccagtaaacggaacgataaaagcaaataaatactgtatctcttatactttattttagcgttagattttccagtcaccttaaaatcaaattgatgagtagtatacaggactgtattttaagctactgctaattcttttctccctaaaaaaacagtatccttttatttggggctagctttaaaagaagggggaaaggctgaactgtcctggtgaatagaggtaggatagaaaacaaactggcatttatatctgtttaaattaggaaatgaaatataggaaggaaggcaaatcagaaaataaagaaatcctggcaacaggtgtagattgaattaagtttcctagtaactgtttaaaccaaaggatggccctgctctctcattgcaagataggaaaagcacaagtaggttgagtacagtttttctgcactatcaaatctgctaagacaatagatacatgctaacaatggattttctcattaggtccacaccagatcactggttctgacctacaaaggatgcagaatccagccattcatctgggccaccacctctgccccattccggtttctatgtttcttgaataaattatttccatcagc

SEQ ID NO: 78 - DNA, 57768 bp, Mus musculus
gggaatgcatcatggacaggttgtagggcttctcctacaaaaagttgacacatagtaggtctgtttgccaccccttgaggtaaaactatccactgataccatttatcaggctcttcattattcacagaaggaagagtaaaggcaaagtgttcgctatcacacaatgcaaggggaatagagaaaaaaataatccttaatatcaatgattataataggccactctttgggcaaactagaaagtaggggcagacctctctgtatggggcccataatctgcatctgattattaatggcttgaagatcatgcaggagcctccatttgcctgatttttacttagtcacaaatatgggtatattccaaggtgactgggaaggtttaatatatcataatttcaattgttcctctactaattctttggcagctactaatttttcagaggaaagaggccattgaggaacccatacaggctcctctgttttccaagtaatgggtataccaccctcaacggcccctaggaaaaacccaatccctttttatcttgtttgaactttgcaggcactggcatagtcatgccttgtagaccgtgttgtgtcttccttgccagacgaggtgggtgcgacactccactgctcttcagcttccaactcttccttagttggtagaagttccacatctcgtgtttagtctgggggagttcaagcaacaacccaagcatttttcaaacagcctggatgtctgtccctggctaggtttcctcctccagtttgtcttgatatgtccatatatgggtcgcaaaaatttgattagattgcagagcataacataggatcctgtcaataattctacacagatggcctgggaccacacaccagagaggaacaatatatttcccttgccattctgataaaaggtgaaaggtttgaatcttccttatttagagaatatagattggatgtagttcaaagacataagaggatgcttgaggatacatggcgtgatacactgctattcaaaagagcatatctaatgtcacctttggaataaaggaatgtgtaagcttccttttgtcaaagacagcggttaacattccctcttgcagaggtgggcaagatccgaggccacattgttggggaatggaaggaccaaggcacagttctctagacaacagtgtggagtatttgactaacacaggagttctaataactgtttctcagaatgggaaattcttagaccaccttcaacagaagagaaatcctgaatgtcttggttcccaaggtagaggtccccagtcatactttgtaggacagaaatatctagttcacccatggtcagcagaggaaggttctagactccattgggtactggaggaatgttcagactctgcctcactagcttgctagtattttccccatatgcatactctgtgtaacatctttgagagtccaggcaatggtcacaaaaatcttccaacaggataagtagttatgcaagcacttatgtttcctcgacgtgttcagctgcacacatctgtgaataaaagatatgaatagtgcattttgatgaccaactttgaggcacaggatgtgagagacaatttcagatttctgtcttctgtcctatgagagagaattgtgaggtatctctggttgcaaatgtgttgtatggatatcttagacagagaagttagctttgaagcaaacttcattaataggggtgtttgtgaggcatgggcaaaagacaggctctggtggttggttctttagttgcagaggtggacctgaagtccactagtgtagagggtagaggtctgaaaaaccccttagacacaggagctagttctgagagtcctttcaatagactttgatttcccaggacccctttgcagaaactgaaggtctaaaatccacttggtgaatggaagtagacaataggcccagattcctactgggaagacaggaaatgttagatgctcttttatgtagaatgagtggaataagtctcccatggtctgacagcactgtaaggaaaaaagactcaaagctacttgggaggaataggaatattccatgtaaggcataatacatgttttaggccacatttggacaatagggtttagggcaatgttagtcttaggagagttctgacattctattcagtgtagtgagaaaaaataagttaacattgggaaatgtgagccccatgtaagagagaaaatctccgaggccttactgaaagaggaggacagaatcttcctgaggcagactgtgaaattgccatatacacttctgtcaaagataaaggtccctggtaccttatacagtggagaatgtttccagcaatgatcgtaagtttccaattcttattcagagttttgtattttcatagtttgtgctcattcgggagagataaggcagcaacatatttcttcttccaaaggctaggatacttctttgactttgttcatctatccaggtctaggtagaattaatgaagttattacatttcttttgacttgcctgaaggcagatggcacaggttctttgctctgatttgtaacttggactgtggaacctcaaaccagagtggactagggtaccttgtttacataatgagtcacatttggaaatatacctaatcagttaggtataaaactactttgaccatatatgggaatgttatttttgagaaagagaatatgttgggaggataaggaagagcaggaaggtcacagaatctctcaggcaaaagtttaccttgcgaattggaagaagatgtcaaaaatagcttacaaagtgcaaatgtcctcatagtccagaatacccatgtgttctgagactttgaggtgtgcttgccagcaatcagaacatttttcttacaaattgtttggtaatctctagctctatgttctccacaagctgtacagcagcatcgcaggcatgggcaactaagatggaactgctccatttcaagtgacagccttaaaaatagaagttagattagggatcatatttttactgtcatgtcccagaacatcatttcagagtgtttgacatccttcttttatttgagcatgcctggccaccaaggtcagaagggaaactttaggacctcctagaggaatagacctcaggattctatggataaaagtggattttctgaagtacacatggttaagagatgttaatttcaagtatccttgagaaaaaatgaacatctgcttgagtttttcatgtcagtggcttttctgtaggctccttaagcagcagaatttgtattaagctccgttcaaatttcagggtgtgtatttttccctatttcaaagataaaatgtaagtttcttccttgacagagtatttatgtcaaagattcttcattgaaacctttttaaacctagagtttaccttgatatgaaggaaaaatctgggaaacattaggaaaaatatctaagtttcagtccataatatgagcaagttgtgtgggattcctcgacctaaatgaatgtcgaagccttctttggacaaactggtatgatcagagggtcccttttcttcagtgggaagatgtgatgcctccttaatcaaaggtagaaggagtaagtagccctggggataaaggaggtgctgatatccttgtaacaggagagatgatcagagtatgaaaatccccataatatttagagcaaaaattaaatcgcttaccttagctcataaggtcctagcattgccacacctcctaacagttcttcacagcctggggtatccatatctttagctgaattagcaagacaccaagtatagataccatgattcataaaaagcttgggtttgtgtcctcaggatgattgcctcctaagaattatgttcaaccaaccagaactgagttagaatggtgatttcacaccatgtcatgtgactgtacacaaggaagtggcataaggttccaggattggcctcctcctcttgatttgtgtgaaatttgaccagagggagcaatgttccttggtcagaggtaaaatatcccatgggctcctgaacagaagggatttttatgagagcccattgggtcaaaggggtacattttatgacctcgatcatcacaggaagtttgaaaaggagaaagtccttcaaccctgttggactgtaggggagtagccctgttcactttctgtagaggaggttggtccagggactacaggcctccacatcttcagagaactctaaaaaattcttatctctgaggactccactgcagatttaacagcaatctgagttttcttctgacaagttggctcaaagtccctggatttgttccctattaaacttacaacaggccacacaggtgtgggtgttgaggacagttacctttctgatgaccagcttaaagagtgccttggataaaggctgaggtttttatacattggccatgggacttgaatctggagttctctgaggttttttgttttgttttgtttttgtttttgtttttgtttgtttgtttgtttgtttgtttgttttttggtggtgaaaggtgtattccctaaccaataaagtctgagggagaagctctggtctttcttagttgaatggtagtcctgagtcagccatgaacaaagagcaaagctcctgtgaattcttggtaccaaggattcagtcttaaacacactagagctgagcctgaatatttgagataaactcctcactcacaaggtaagttctataccttcatgcctcagacccctccagtgcaaaaggaggaagaataaactgtttttacttaaggtcagctgacccccttggcatacccataatgtcaggggctactatggttagaggttgtaaggcctaggccctcttcaaaagataaaccaactgagtgtcatcccccatgaagttatgggatactttacttctgagggtgcatgacttcatggagttggatttactctggagatataaattatcctgggtctagaagggtacatctgagtccccattgtgacttcatcaatgctattgcatggtgatagtaaaagagccatatttgtggccttcttaagatgttgttgaggtctgaagtcctttgcttatcatgtcatatgtgtcagggcatccttagtcattgaggaccaatgtgacacctttgttctgaagtggtaattctgagggcaattaaagaatttctgaggtttctgtttctcatatgttagtgctgccttcaacactggggagtttctaacatatttgatgttgaggaggtacatctgaaacccccttgagttattggtgaaagttgtgagtcacataggttctatttcatgtatgtgggtatactgtcattgtcttcagacacaccataaggtggcatcgggtcccactacagatggttgtgagacaacaagtggttgatgggaattgaactcaggacctgtggaagagcagtcagtgcttttaactgctgagccatctctccagcccaagcacattggttctagacaggtaagattaaggtcacttaggctattggggaagatctgaggatccctggttcagaataggcagatcagatgtccccttggtccatacagtagtttggaagatctgtggttcttaagttgtaggtctgaaccttactagagaagaatgcctggagtgtatttgaatttctggtttagacgaagtgtacctggtgactccttgagagagatttaagccccacttcaagcatgggggaaaactgtgagtcttcttggtgctgaaggaataattctgaggtttctgtgtcagaaacactatttggagtacccactgacagagtgagaatgttgatgtatccacaaacaatctataaaggatgccatcctttagaggcagaaagtttcatataatgttggggaaattagaaatgccaaagaagaggacaggtgtctgcctggctcggaaggcctcagccgcaggagcagcgggcatcaccttggttccgggactcctccgaacttaggaaattagtctgaacaggtgagagggtgcaccacagaaccggacagcttctgggacaggcggagccacagagccgctgagacagcacccttttcgggccacagacagccggctaccatcccgaccagaggacaggtgtctgcctggctcggaagctctcagcctcaggagcagcgggcgccaccttggttccgggactccgccaaacttaggaacttagtctgcacaggtgagagtgagcaccacagaagctgacagcttcagggacatgccaaagcaacacagcttctgggaaaggtcctgttttgggccttcttcttcggccaggagaaggtccaaacacaagatatctgcacaccttccctgtaagaggagagcttgccagcagagagtgctctgagcactgaaactcagaggagagagtctgtttcccaggtctgctgatagatggtaacaaaatcaccagaagaacaatctctaaacagagtcaactataagaactaactccagagattaccagatggcgaaaggtaaacaaacgtaggaatcttactaacaggaaccaaggccactcatcatcatcagaacccagcaatcccacttcgcccagtccagggcaccccaacacacccgaaaacttagacccagatttaaaagcatatctcatgatgatggtagaggacatcaagaaggactttaataactcagttaaagaaatacaggagaacactgctaaacagttacaagtccttaaagaaaaacaggaaaacacaatcaaacaggtagaagttcttacagaaaaagaggaaaacacatccaaacaggtgatggaaatgaacaaaaccatactagacctaaaaagggaagtagacacaataaagaaaactcaaagtgaggcaacactggagatagaaaccctaggaaagaaatctggaaccatagattcgagcatcagcaacagaatacaagagatggaagagagaatctcaggtgcaaaagattccatagagaacatctgcacaacaattaaagaaaatggaaaatgcaaaaagatcctaactcaaaatatccaggaaatccaggacacaatgagaagaccaaacctacgtataataggggtggatgagaatgaagattttcaactcaaaggaccagcaaatatcttcaacaaaattatagaagaaaacttcccaaatctaaagaaagagatgcccatgaacatacaagaagcatacagaactccaaatagaccggaccagaaaagaaattcctcccgacacataataatcagaacaacaaatgcactaaataaagatagaatactaaaagcaataagggaaaaaggtcaagtaacctataaaggcaagccaatcagaattacaccagatttttcaccagagactatgaaagctagaagagcctggacatatgttatacagacactaagagaacacaaattccagccaaggatactatacccagccaaactctcaattaccatagatggagaaaccaaagtattccatgacgaaaccaaattcacacattacctttctacgaacccagcccttcaaagggtaataacagaaaaaaaccaatacaaggacaggaaccccaccctagaaaaaaacaagaaggtaatctctcaacaaatctaaaagaaaacagccacaaaaacagaatgccaactttaacaacaaaaaaagaggaaccaacaattacttttccttaatatctcttaatatcaatggactcaactccccaataaaaagacatagactaacaaactggctacacaaacaagacccaacattttgctgcttacaggaaactcatctcagagaaaaagatagacactacctcagaatgaaaggctggaaaacaattttccaaacaaatggtatgaagaaacaagctggagtagccatcctaatatctgataagattgacttccaacccaaagtcatcaaaaaagacaaggaggggcacttcactcttatcaaaggtaaaatcttctaagaggaactcacaattctgaatatctatgctccaaatacaagggcagccacattcattaaagaaactttagtaaagctcaaagcacacattgcacctcacacaataatagtgggagacttcaacacaccactttcaccaatggacagatcatggaaacagaaactaaacagggacacattgaaactaacagaagtgatgaaacaaatggatctgacagatatctacagaacattttatcctaaaacaaaaggatataccttcttctcagcacctcatggtaccttctccaaaattgaccacataataggtcacaaaacaggcctcaacagattcaaaaatattgaaattgtcccatgtatcctatcagatcaccatgcattaaggctgatcttcaataaaaaaataaataacagaaacccaacattcacatggaaactgaacaacactcttctcaatgatactttggtcaaggaaggaataaagaaagaaattaaggacttctttgagttcaatgaaaatgaagccacttcatacccaaacttatgggatgcaatgaaagcatttctaagaggaaaactcatagctctgagtgacaacaaaaagaaactagagagaacatacattagcagcttgacaacacacctaaaagctctagaacaaaaggaagcaaattcacccaagaggagtagaaggcaggaaataatcaaactcaggggtgaaatcaaccaagtggaaacaagaactattcagagaatcaaccaatcaaggagctggttctttgagaaaatcaacaagatagacaaacccttagccagattcactagagggcacagggaaagcattctaattaacaaaatcagaaatgaaaagggagacataacaacagatcccgaagaaatccaaaacatcatcagatccttctacaaaaggctataatcaacaaaactggagaacctggatgaaatggagaagtttctagacagataccaggtaccaaagttgaatcaagatcaggttaatgatctaaacagcctgatatcccccaaagaaatagaagcagtcattaatagtctcccaaccaaaaaaagcccaggaccagatgggtttagtgcagagttctataagaccttctaagaagatctaatcccagttcctcacaaactattccacaaaatagaaacagaaggtactctacccaactcattctatgaagccacaattactctgatacctaatccacaaaaagaccccacaaagatagagaacttcagaccaatatcccttatgaatattgatacaaaaatcctcaataaagttcttgctaactgaatccaagaacacatcaaaacaatcatcgatcctgaccaagtaggtttcatcccagggatgcagggatggttcaatatacagaaatcatcaacgtaatccagtatataaacaaactcaaagacaagaaccacatgatcatctcgttagatgctgagaaagcatttgacaaaatccaacacccattcatgataaaagtcttggaaagatcaggaattcaaggcccatacctaaacatgataaaagcaatctacagcaaaccagtagccagcatcaaagtaaatggtgagaagcttgaagcaatcccactaaaatcagggactagacaaggctgtccactctctccctacctattcaacattgtacttgaagtcctagccagagcaattatgcaacaaaaggagatcaaggggatataaattggacaggaagaagtcaaaatatcactttttgcagatgatatgatagtatatatacgcgaccctaaaaattccaccagagaactcctaagcctgataaacagcttcagtgaagtagctggatataaaaataactcaaacaagtcaatggcctttctctacacaaaggataaacaggctgagaaagaaattagggagacaacacccttctcaatagccacaaataatataaaatacctaggcgtgactctaactaaggaagtgaaagatctgtatgacaagaacttcatgtctctgaagaaagaaattaaagaagatctcagaagatggaaagatctcccatgctcatggatcggcaggatcaatatagtaaaaatggctatcttgccaaaagcaatctacagattcaatgcaatccccatcaaaattccaactcaattcttcaaacgaattagaaagggcaatcggcagattcatctgtaataacaaaaaaacctaggatagcaaaaactcttctcaaggataaaagaacctctggtggaatcaccatgcccgacctaaagctttactacagagcaattgtgataaaaactgcatggtactggtatagcaacagacaagtagaccaatggaacagaattgaagacccagagatgaacccacacacctatggtcacttgatctttgacaagggagctaaaaccatccagtggaaaaaagacagcattttcaacaaatggtgctggcacaactggctgttatcatgtagaagattgcgaattgatccattactatctccttgtactaaggtcaaatttaagtggatcgaggaactccacataaaaccagagacactgaaacttatagaggaggaagtagggaaaagcctcgaagatatgggtacaggggaaaaattcctgaatagaacagcaatggcttgtgctctaagatcgagaatcaataaatgggacctcataaattgcaaagcttcggcaaggcaaaagacactgtcaataagacaaaaagaccaccaacagattgggaaaggatctttacctatcccaaatcggacaggggactaatatccaatatatataaagaactcaagaaggtggactccagaaaatcaaataaccccattaaaaaatggggctaaagagctgaacaaggaattctcacctgaggaatacagaatggcagagaagcacctggaaaaatgttcaacatccttaatcatcagggaaatgcaaatcaaaacaaccctgagattccacctcacaccagtcagaatggctaagatcaaaaattcaggtgacagcagatgctggcgaggatgtggagaaagaggaacactcctccattgttagtgggattgcaagcttgtacaacgattctggaaatcagtctggaggttccttagaaaattggacataatactactggaggatccagcaatacctctcctgggcacatatccagaagacgccccaactggtaagaaggacatatgctccactatgttcatagcagccttatttataatagccagaagttggaaagaaaccagatgtccctcaacagaggaatggatacagaaaatgtggtacatttacacaatggagtactactaaactattaaaaacaatgaatttattaacttcctaggcaaatggatggatctggagggtatcatcctgagtgaggtaacccagtcacaaaagaactcacatgatatgcactcactgataagtagatattagcccagaaacttagaatacccaagataaactttgcaaaacacatgaaactcaaaaagaatgaagaccaaagtgtggacacttcaccccttcttagaattgggaacaaaacacccatggaaggagttacagagacaaagtttggagctgagacgaaaggagggaccatccagagactgccccacccgggggtccatctcataatcagccaccaaacacagacactattgcatatgccagcaagattttgctgaaaggaccctgatatagctgtcttgtatgaggctatgccagtgcctggcaaacacagaagtggatgctcacagtcagctattggatggaacacagggcccccaatgaaggagctagagaaagtacccaaggagctgaaggggtctgcaaccctataggtggaacaacaataagaactaaccagtacccccagatcttgtgtctctagctgcgtatgtagcagaagatggcctagtcagccatcattgggaagagaggccccttggtcttgcaaactttatatgccccagtacagaggaaacaccagggccaagaagtgggagtggatgggtaggggagcgggggcagggtataggggacttttgggatagcatttgaaatgtaaatgaagtaaatacctaattaaaaattggggaaaaaaggaaatacaggaaaacaaaagcaaataggtgaaggtattgaacaaagcagtccaagaagtaagaataaaagtaaaaaaataaaaataaaaatggaaacaaccctggagatgggaaacctaggaaagagatcaggagttacagatgtaagcatcaccaacagaatacaagagatataacagagaatcccaagcatgtaacatactttagaaggtcaaagaaaatacaatgtgcaaaatgttcctaacccaaaacatacaggaaattcaatatacaatgaaaagactaaaactaagaataacagggatagaagtaaagattcccaattcaaagggccagagagcatgttcaacaaaatcacagaagaaaactctcccaacccaaagaaagagatgaccataaacaaactttactaatgctcaaaacacacactgaaactcacacaataataatggaagacttcaacaccaactgtcatcaatggacagatcattgaaacacaaactaaacagaaacacagtgaaaccaactgaagttacgaaccaaatggatttaacagatatctatgaagcatttcaccctaaaacaaaagaatacaccttcttctcagcacctcatggaaccgtctccaaaattgaaaataaaattggtcacaaagcaggcctcaacagataaaagactgaaatattcccattcatcctatcagatcaccacggactaaggctgatgttatataacaacaaaaacaacggaaagcccacatacacagggaagatgaacaattctctactcaatgacaacttggtcagggaagaaataaagaaaaaaaatcaaacactttatagaattcaatgaaaatgaaggtacaacatacccaaacttatgggacacaatgaaagagttttcctcttagcactaaatgccctcataaagaaattggagagatcctacactagcagcttgacagcatatctgaaaactctagaacaaaaaggaaaaacaaacccaagaggaggtgaatgcaggaaataatgaaactcggggctgaaatcaaccaaatagaaacaaagggctatacaaagaatcaacaaagctaagagctggttctttgagaaaaccaacaagatagattaacccttagccaaattaactaaagggcaaagagacagtatccaaattagcaaaatctgaaatgaacaacagaaactgaggaaattaaaaaaaaaataacatcacatcttactataaagccaccaaccaaagagcattcatgggctggtctgtgtccctgtatgcatttgtagcagagggctgccttgtctggcctcagggggtgggagtacacacttgctcctgtggagccttgatgtgccaaagaagaggggtactagaggggtgaagtgggaatgggtgggtgggtgagctccctcttagaggtaaaggggaagggggatgaggtggagtgctggtggaagggggaccagatagggggacaacatttgaaatgtaaataaataaaataatcagtaaattaaattaaaatcgtatcttaaaactcaatgacatgattgcaattatcttagatgaaaataatttaaacatctatacagtgcatcaaaagcacacgcatcatatttaactatccaaaacattatttaaaagaaaaaacacttgaattctgagaattctataatgaaaaatttatttttttgttttccgagatcatgttctaagatagaaagattgtgtttgagagaaataaaattttattaagtctaaaaaaaaaatccagaacagaaacaaaaacccatcactgtgtgagtctttgcattgcacaggcataggctgtaagcattgctgaatcccatgaaattcacaggtttccttatacaccacctgactaacacagaagcggtccttctgccagtatttctgcccattctgattaatactatttgtattgcccctctaaatacctagtgcggtgttgtctacatgttaggttctcaataaatatttaattatttgcatatcaaggaaacacagtcttttgatatactgggattttaccagtatcaattgtacactcaaaaggtcgttgctgggaagaatttattactaaagttttttggggcattacaccgaagcacataaaagcagcatggggtgtctgtgagggtgagtgtgtatttgcctgtgggggtggggtactgtgtggaaaatgcttgtgcagagtctatcagaaactcactgaaaagctctcctgactctggcttttcctacaaacctctgtagtttttacatggcgttggatacagagtcctcaagaggcagctctcaaaggtgttgtggaactaattttttaatttaaggatcccttatttatgaaacaaaactctagaacttattttccttgccattgtttcctactctgtgtggtaagggagagcagagacaattactttgtctcacttcatttgtgacaaaatatggaaatcgttttccttatctattaacaataatagccttgattatctgcttagaaactcaacaaaatcacagtgggcagagaaaaatctctgtaatcatgactaatcacaggttttgttcaattaattaatagtgcttcgaaactctctttaccagcaataaattgagtattaggatttaaagttctttcactagcttcttgcacctgctctaatcatatgcaattattttaattataccaacaattgtctcaggatttccctctgggttagtggaaaccatagtgctaccctttccccaacacaaacttttcctgttttaatgtaaatgctgacatcatgcatgggtttataaaagagaataaagcttggtatgttgaggcctgccaggaatccttgcagtctataatccttgtgctagagtggctacaggaagatctcaacagtacagggctagcgaaggctagatagggagaccctgactatatttttcaagcaagaagtgatggcacatatccagggatccaccccataatcagcatccaaacgctgacaccattgcatacactagcaagattttatcgaaaggacccagatgtagctgtctcttgtgagactatgccggggcctagcaaacacagaagtggatgctcacagtcagctaatggatggatcacagggctcccaatggaggagctagagaaagtacccaaggagctaaagggatctgcaacactataggtggatcaacattatgaactaaccagtaccccggagctcttgactctagctgcatatgtatcaaaagatggcctaatcggccatcactggaaagagaggcccattggacacgcaaagtttatatgccccagaacaggggaacgccagggccaaaaagggggagtgggcgggtaggggagtggggggggtgggtatgggggacttttggtatagcattggaaatgtaaatgagctaaatacctaattaaaaaaaaataaaaaaataaaaaataaaaaaaaaaacaacaaagaggaaaaaaaaaaaaaaaaaaaagaagtgatggcacacacctctaatcccactgcttggtcacatctccaagagttcaaaaccctgtttcaaaataaataatctagatagatagatagatagatagatagatagatagatagatagttagtttccccctccatgacagaaagatgtcaggtgaggcagatccatgtgtggaggcaagtcccttggaggaggaagggaagataaatagaacgccacaggctgaggctaagcttggcttgcttgcatagctaaatggttgttggtatggagtcttcactgatcttcgctttcttgagagaggcacagccaagaacttctcctggcattcctgttggccatggtgtcctgctaacttctgctgaggctgagtgtctctgttaggtagtgtcactactgctgatccatgtttgctatcccaactctaccatattggactgctgatatatccatcaagtgattggtagtggactgaggtgccactgctagcctgtgaactgaactgccaatttccagacaacacagatgggagttactccaaagaacttttctaaacaggttacccttcttttccactacctctggtggatggtgggctacaaaggaggttaaagtgtttaacaactatcattaaaaataggttttgaaaataattaaagttacacctagtgatttttttcaactatgtttttcagtgtttttttttttttcaaaaaatacactttgtacatttgttaaatgttagctcattactttgcgcaagcacttggattggcagctaggtagccttccttttttttccccctgtggcatgttagtgtccctatcatattttcagaactacaatgcttgtagaagcatcgtgactgttatggataacataagctgtatgcaaatgatttatatttttaatcagtcattagagaatgtgatggcataagatgtcttggctgcccttcgccctccgccctcggccgacacccgtgcgaccctcgtccctggcccatggccaagcggcgtgcggctgagccgctcacgttccgcgtgccttggaagcggctcctgctcagcgacttccccgaggagccgccgctctgggtcccgccgtctgggacggctcggcccctcaagcgccagggggacgcggggatcatggcggggacgacagacaggagctgcagggctgtagccgggagcccggagagccgcctcctggcgagcaggaggaaccccgggctgcgggcggcggcgacagagtagaaaacgcgggaagcccgcaggtagccgaccgggtgcacagccagcagcctgaagagttttggcagtataatacattccagtattggaggaaccctctgccctctcttgatctggcagctcttgaagatgtgagtgcaaacagcctgacagaaacacttgaggacaagaatgaaggagttgagattgacatggagtcctgacagaagcatctgaagaaatgggattctctgaatttgagttcttttccatccttttttcaaacctgaaaactgaggaagggttttgggataaataactaatgactactgaatctcctaatggagagctgttgagggtgtggcacagctgcagacaaaatacttcgtgtttgcatttttaatgaaaaagttttgttcatgctcttgactttgaagatgcttatcttggaaaaggaggttttggcagtttcagaggaagccctcaggtctgctacacttgctctgtcaaacaaagcttatttgtggtacacggaatgaatacgtttatacagctgatgctcataaatacttgctagtacatcttattggatccccttggttgaacaaataggagacttgagtatctatgcaaaattaaaatgtgagattgtttctgaaagctagccttgttttaaaagagtgtaaacttaaactcgtgagaacttccatttgggtagcttgttttacctttcgctatttgctgtttattaacagcataggcaatgaatctagccaaacaatggatagagaacagtaggaagcagatgcctgcccctcctccctttttctgaggtgaaagaaatgatctggtcagcttactgattttgttttgaggacattttttatattgtttatattactttagacctgtagttctcaacactgatagcactttaaccatctctgctcgagccctggtcctagagagatctcagtcaattatttgaaggtggctttacacataggtctttgttttattttgtttgttttttttttttttttttttgcaccgattctttatctctgtgttgtacagatggggccagaaccgctagactagcagcctttcctgtttaaaggagatcactagtgagctggagcaatgcctcttcattccttttgttggtatcttgttatgttacttgatttgtcattactaagttattctgttacaattttatttttaataaagtacactatttatgtttgaaaaaagaaaaaaaaagatgtcttggccgggcagtgatggtgcatgcctgtaatcacagcaattgggaggcagtggcaggaggatttctgagttcaaggccagcctggtctacaaggtgagttccaggagagccagggttacacagagaaaccctgtctcgaaaaacaaaacaaaacaaaacaaaacaaaacaaaacaaaacaaaatgacaagtcttccgaatacaaagcctctcccttctcacacacacacacagtgtgtgtgtgtgtagttagaagcattagaagcagtgagtgagccagaaatgggttccagaatgttggcagctttaatgagaaaataaagaggtaccatcgtgcctgctgattgcaattttagtttccagttaaaaccgcttttgatctgggtctgtttcttagatgctcatattattaaaatgttatgttcatatcaaattcagaatgggaaaagttcaccatcaaccatgaccttagctctcggtgaataacgttactggtaggatggattctggtgaaaccagcgtgctccctcatttctctggaacgttagattgctgtcattgcttcagagatgtactgctaggtttgatttctgcttttttaaactggagattggaaagacaatcacacaaaacgcttggaaaataattacacactgttttgtactttgtaaggaatttaccagctggaaggttttgtaaacttaattcttagccgcggccattttctggctctctctgccttcttaaagacattgaaattgttcccttccagtccagtcctaaggaaggcccattgtgatttgcttaatacaagcaccaaaatgccacaatgtaaataggattagcatctactgagaacatacaagaaggtagccaagtagaacttaggaaagaaagatcatacagtgatacacaatttctcccttccccacacctctcttttcttaggacttggtttctctgtgtaaccctggcctacctaggctctctctgtagaccaggctggcctcaaacactgggatctacctgcctctgcctcctgagtattgggattaaagaaaggtgtgtaccattgcctggctagatgatacacattctagtcgctaaaggtgaaaaatgtaaatatcctcaggggtgtcaacgatgtacaaaaatttaagagatattggttcaagtgagacccaagggttttaacttaatttaacttcttatttattttcttcttttatttgggcccagcttagtgtctctgaccgatggctatggtcacttagaaaaccaaattacacatcaggtggttgctgggtggggacaggattagaacaaagggagagagattaaatgttatttgagagatatttctgtcaagttttggcttcctgatgaactggcatttcgtctgttttgggtgctttttctgtattttttggtcttcgctgctaagttttgttttgaaaacactcatctaggattagagcattcttcctgcagttaatgtctgagaattagtttgtgcagtattttagagcattgactctagagcgtggggcccagcaatagagctcgtccttagcatgcataaagccccagtgctgggactaaaggtgtccaccccaactatccctgccttggcagaacttccctaatcaaattcctaatcaaaccatttccatcttggtcatcttggctcatttgcttatttgtagattattactccccttacattatacctaagctgcagtagcctaaaggtaattcgatcatttatagaatcttttttaatgtctggtttactcattactccatttttctcttgaattctacgtttgtcgtagaataacatttgtttacattattaactcaaaaaactggccttcaaagctgtgtttgtaaaggtgagttttgctgaggcaacacatggtgagacaagtcctgtggaggactagtgatgtttggagggactgggagaagggcttggcttgcttgcacagctaaacgccttttggtctcctgtcttcactgatcttcacttccttaagagaggcacagctgtaagtttctcctgacattcatgctagtccaatgcctcctgtagactactgtcttcagctgaggcctggttgttcctgctaggtcgtgcaactgctgctatctggactttactgaacggactgctggtgtatccatgaagactttgagagtggatcaagctgccattgccagcctatgaacggaactgctcaataactgacaaagcagatgggatttgctccaaataatcacctctaaatgggtccacttcctccgtatccgttcttttccaatacctctggtaggtggtgggctagaagggaagataagaaaagtcataaaaagtagtctttgaaaacttaaggttacacactgtctactgtaaccttaagatgaaaatactattgtattgaaagattaagaatatcatggtaatacactgaaacctagtaacttttttatcatttcgaccactaaatgtaattccttcagccatcagaacattcaacaaaacagcaaaagagaaacaggtacattaacataagacacagtcttagtagctttatttaatctgatgttctgatgaaaagatgagttctaacccctgaactagtgatatttaactgtcccattttgccagaagtgatcatattgataattaaaaggtaaaaaaaatgctttctgagtctgttgaaagaggcatttgcaattttgttttcttctctagtgtcatgaaatattccttaaggttcatggctaattgcataacccttttcccttgtaagcatttagctcagtccctgtagcatgtgagacaggcacgtggttttttttatcaagatgtaactatttcaggtgatagaaatacgaccaagatagcagtaaattatacatttttcactctatatgtgttaacaaattaataagagataaattgttaaaatagttattgctactagtctcagataagcaatatatcaataagaatactggctgcagttccggacaagatagggacaatacagtagaaacacaaagtcgaatagaaatctttgtgaagccagttgtactggaactggcatggcctattgactgccacagtgaatacaaaaaaaattagagtaaagtgtatacaggaggaaagtgataacaagaatgattaataacaccacatacaagacactggcgggaatatctataggaggtgaaagacagccacatctatatagatagagagtctaaagtggaacaaaggaacatcacaggcttgtcaccaacaggaagcaccacagtggacccagggaaatgggtggactgttgtgtgtacctgagaggcatgggaccctgcactgccttctggacctggaaggctgtgcttacctgctagaccctgtgtcccagacctgtcctaaaatcagagcacagggacatgcaggcgggaacctcaaaccaattccgcttgatggcagtagagcaccaaaaatggcaactgccaggctgctgggcgctctccctccccacttccagaggcaaaaaaaaaaaaaaaaaggccaaccagcaaccaccagccacaaacaaggagcctgagcactaggccttccatgaatggctctctgtgacctgctagtgccgaagaagtgtttttgtatgtgcttgcctggtgtgagtgagagagagagagagagagagagagagtgtgtgtgtgtgtgtgtgtgtgtgtgtgtgtgtgtgtgtgtgtgtgtgcaggtttgggagaagtcctaagtaggctgctgcctgcttggatgtcaatcatcacagcaagcaggctttcaaggacccaggaggatggtaccctggcagccttggctgtttaggacacccttggaaatacagcatagcctggctgtttctaagctgtttctcctcagtttcaccagaggccaggacactggctaggctcctggcccacatggggctcacagtgaggttgcttgcacaggatcatggtggagcctccaggaccactgaagggttctagggatgagggtgttttcccgaggggcctgggaccctgctctgaacccgcagcacagctcaaagagacagtctgttctaaaagagaggaagggaaacccaagatgacccgaaacataggaagggaatgaggaggaattgagccctgcagggagggagctaactggatgaaagaaatctatctggccacaaaagctacctgagatactgagacagagcagagaagcatgataacctgcatctctctctctctctctctctctctctctctctctctctctctctctcacacacacacacacagtttgtctctctctatgtatcacagggtggggggggggtgtgttggatgggtgggcatgactgaaagcagctgccaggaatcatcaaacaaaagcaaggggaacctggatctgtctggtgaacagtgactggcaggacacgttgcccacaagaacccaatgcagccttgggtgcacattgctgagtccagagatcccatgagcccttgcaaacctaacatgtccgcctgaactgtgctcaggacctggaaggctgtgcttcctgaatcaggctagccaaaccttttgtcgccagctctgtcccctagtgagctggatactgctcgatggctctcaggtctctcctgggccaagaaggtctcagggagcccccagtccctccttggctgccaggaaaagagcggggtcggccaccatgttaagagaggcgcagggatgtgcaggcggaaacctcaaaccaattccgcttgatggcagtagagcaccgcgaatggcaactgccaggctgctgggcgatctccctccgcccttccagaggcaaaaaacgccaacctgcaatgaccagccacaaacatggagcctgagcactaggccttccactgggcaaaatgtctctctgtgccctgctagtagtgcctaagaaatgttttcttatgtgcttggctggtgtgagagtgtgtgtgtgtgtgtgtgtgtgtgtgtgtgtgtgtgtgtatgtatgtgtgtgtgtgctggtttgggagtagtgatgatgagggtgcataagtctcccgggctgggtggagtgcagtgttgagacagaatgaatggtcactgatcacagacactcctcaactgcagggcagctgcaaagcactggagggcctggtcagagaacttgagaaaggcaagccctaaggggctggagcaggtctttggaactgaccatcagggagccctatctaaaccctgtgtaaatctgggccataggggcggaggctccgaaacaagtgagtgcctggactgtatgacaaggggttggtcctgcccatgcagtgcctggccaggccaagggcctggggctggcccagagatccagtggctgcctgcctgaccctgcccatctgggtgtcctctaaagctgacagtcagttacttctcttcctggggggcagactctgtggtccctgggcacactctctcaagtttccaggtccaggcacacagccaagaaggccctccctgcatgaccacgggctgcctggtagggcaacagggaagtggtgtcagagagcactgggcacaggcaaggttgatcagagcgcacacctggtgcgggtggggcaccaggcccagcactggcttcccacctggcagcaggaagtgcagcagtggacccaaggccatgggtgggcagttgtatgtgcctgtgaggccttcagtgtccctggcctgaaccccgagtccaatgggagatgaaaagaagggaccccggaagaaaagcttagtcttcttacccaggcacacaggttggtttctcaggcagccccctccatatgagttccggtgaatgctgccccagagagtcatccagtcatctgtccaagtcagaggtcctgaggggcggaccgcccactcccactatctcgccagcaggccgcctagccatatcaacctgacctgagaacaaggacacatcaagagaaggaacaattattccagcccaacctgcaactgtggctaccaggccctcaattcgaagctccaactaagtaagcatggccaggtaaccaggcaaccaggcaaccattatgaggtaagtcctgctccctacagtatctctcctctccctaaattctccaccccacctccactacaccccagccctttaccaaccagcagacagcactggaagcgtaagggggacaccacaatgttctctccttccgtcctccgaagtccccaagtcactctcacacatggatccttctatctgtgtcctcccacacagccacctacctacctgtgctggaactcgccatgcatgcaactcagagctctcgaaagacattcaagtgcaccgcaggtgacgggcacctacacacaaagcacaatgaccaatgcccacttatcccaacaggatgcctgcagcacatctactctcctgacctcctaggtcacttcacaccaaggtcgtctgaggggtcccactgacaattctaaaggcacattctaacgttctctccacatgctcactaacacagggtaataacaactggcttgcaacccacccacccacctacctacctacctacctacctacctacctacctattctctgcctctggatcaccaatatgtacagttccaggcacagtttccagggcagatgggtctctttggttccacatgatggataccatgaccatgtgggaaatgatttcacgacccacaggcaagccttcctttcatgagcactgagaatctccagaggaccagcctcgcactcctgagatcttagttcacagctggtggaagaagacccctctaacagtctcgaggagacaagcctgacattgcctctcatttctccctccctaccaaattgcaggagggatctgctctaatacaaccaagagagttctgtctgcacaggcaggcctgctctgagttctcagaggtgcaaggcctgcaagcacaaggaaggactgatccagccaccctccatattagtgttacacagttgtctcatccacctaaacagaactataggggacaatacccctgccttagccctaggatctttatgcacctcctgcacacctgacctatggcctggggatacatgaaaccttaaggtttcccctacagccaaacctgtccttctcacacaatactgagctcaacaccataagaactgccaaaccctgaaccaagatgtacctccttcagggacttgagtctcctaggtttttgaccatgggacacacactgaatacatacacagacacaaacagagagggagagagagagagggagagacagaagacagagacagagacagagaggcagggggacagatagaaaggacagagacagacaggcagacaaagaaagaaactcgggtctcccagtcttctaagatcctagaccactgcatctgtgaattccagaaccatttctattcttccagaaatccctggctatggcagagaaggtcaggtctcttttgaccctttatcctgcctcatctccctggatgttcaggaagggaaggtagtagggagaagtcctaagtaggctgctgcctgcttggatgtcaatcatcacagcaagcaggctttcaaggacccaggaggatggtaccctggcagccttggctgtttaggacacccttggaaatacagcatagcctggctgtttctaagctgtttctcctcagtttcaccagaggccaggacactggctaggctcctggcccacatggggctcacagtgaggttgcttgcacaggatcatggtggagcctccaggaccactgaagggttctagggatgagggtgttttcccgaggggcctgggaccctgctctgaacccgcagcacagctcaaagagacagtctgttctaaaagagaggaagggaaacccaagatgacccgaaacataggaagggaatgaggaggaattgagccctgcagggagggagctaactggatgaaagaaatctatctggccacaaaagctacctgagatactgagacagagcagagaagcatgataacctgcatatctctctctctctctctctctctctctctctctctctctctctctctctctctctctctctctctctcacacacacacacacagtttgtctctctctatgtatcacagggtggggggggggggtgtgttggatgggtgggcatgactgaaagcagctgccaggaatcatcaaacaaaagcaaggggaacctggatctgtctggtgaacagtgactggcaggacaagttgcccacaagaacccagatgcagccttgggtgcacattgcagagtccagagatcccatgagcccttgcaaacctaacatgtccgcctgaactgtgctcaggacctggaaggctgtgcttcccgagtcaggctagccaaaccttttgtcgccagctctgtcccctagtgaggtcgatcttgctcactcgcaggtctctcctgggccaagaaggtctcagggagcccccagtccctccttggctgccaggaaaacagcgggtcggccgccatgtttagagaggctcagggatgtgcaggcggaaacctcaaaccaattccgcttgatggcagtagagcaccaagaaaggcaactgccaggctgctgggcgctctccctccgcccttccagaggcaaaaaacgccaacctgcaatgaccagccacaaacatggagcctgagcactaggccttccactgggcagaatgtctctctgtgacctgctagtgcctaagaaatgttttcttatgtgcttggctggtgtgagtgagtgtgtgtgtgtgtgaaggtttgggagtagtgatgatgagggtgcataagtgttccaggctgggtggagtgcagtgttgagacagaatggccactgatcacagacactcctcaactgcagggcagctgccagccactggagggcctggtcacaagagctacctgagatactgaaacagagcagagaagcatgataacctgcatctctctctctctctctctctctctctctccctccctctctctctctctctctctctctccctctctctctctctctctcacacacacacacacacacacacacagaaacacacacagtttgtctctctctgtgtatcacggggtgggggtgggggggcagctgccagccactggagggcctggtcacaagagctacctgagatactgaaacagagcagagaagcatgataacttgaatctctctttctctctctctctctctctctccctctctctctctccctatctctctctctctctctctctctctcacacacacacacacacacacacacacacacacacacacagagtttgtctctctctgtgtattcacggggtggggttgggggggtggttggatgggtgggcatgcctgaaagcagctgacaggaatcatcaaacaaaagcaaggggaacctggatctgtctggtgaacagtgactggcaggacaagttgcccacaagaacccagatgcagccttgggtgcacattgctgaggccagagatcccatgagcccttgcaaacctaacatgtccgcctgaactgtgctcaggacctggaaggatgtgcttcctgagtcaggccagccaaaccttgtgtcgccagccctgtcctctagtgagctggatactgctcgatggctctcaggtctctcctgggccaagaaggtctcagggagcccccagtccctccttggctgccaggaaaagagcgggtcggccaccatgttaagagaggcgcagggatgtgcaggcggaaacctcaaaccaattccgcttgatggcagtagagcaccgcgaatggcaactgccacgctgctgggtgctctccctccgcccttccagaggcaaaaaacgccaacctgcaatgaccagccacaaacatggagcctgagcactaggtcttccactgggcaaaatgtctctctgtgccctgctagtagtgcctaagaaatgttttcttatgtgcttggctggtgtgagagagagtgtgtgtgtgtgtgtgtgtgtgtgtgtgtgtgtatgtatgtgtgtgtgtgctggtttgggagtagtgatgatgagggtgcataagtctccagggctgggtggagtgcagtgttgagacagaatggtcactgatcacagacactcctcaactgcagggcagctgcaaagcactggagggcctggtcagagaacttgagaaaggcaagccctaaggggctggagcaggtctttggaactgaccatcagggagccctatctaaaccctgtgtaaatctgggccataggggcggaggctccgaaacaagtgagtgcctggactgcatgacaaggggttggtcctgcccatgcagtgcctggccaggccaagggcctggggctggcccagagatccagtggctgcctgcctgaccctgcccatctgggtgtcctctaaagctgacagtcagttacttctcttcctggggggcagactctgtggtccctgggcacactctctcaagtttccaggtccaggcacacagccaagaaggccctccctgcatgaccacgggctgcgtggtagggcaacagggaagtggtgtcagagagcactgggcacaggcaaggttgatcagagcgcacacctggtgcgggtggggcaccaggcccagcactggcttcccacctggcagcaggaagtgcagcagtggacccaaggccatgggtgggcagttgtatgtgcctgtgaggccttcagtgtccctggcctgaaccccgagtccaatgggagatgaaaagaagggaccccggaagaaaagcttagtcttcttacccaggcacacaggttggtttctcaggcagccccctccatatgagttccggtgaatgctgccccagagagtcatccagtcatctgtccaagtcagaggtcctgaggggcggaccgcccactcccactatctcgccagcaggccgcctagccatatcaacctgacctgagaacaaggacacatcaagagaaggaacaattattccagcccaacctgcaactgtggctaccaggccctcaattcgaagctccaactaagtaagcatggccaggtaaccaggcaaccaggcaaccattatgaggtaagtcctgctccctacagtatctctcctctccctaaattctccaccccacctccactacaccccagccctttatcaaccagcagacagcactggaagcgtaagggggacaccacaatgttctctccttccgtcctccgaagtccccaagtcactctcacacatggatccttctatctgtgtcctcccacacagccacctacctacctgtgctggaactcgccatgcatgcaactcagagctctcgaaagacattcaagtgcaccgcaggtgacgggcacctacacacaaagcacaatgaccaatgcccacttatcccaacaggatgcctgcagcacatctactcccctgacctcctaggtcacttcacaccaaggtcgtctgaggggttccaatgacaattctaaaggcacgttcaaactttctctccacatgctcactaacacagggtaataacaactggcttgcaacacacccacccacctacctacctacctacctattctctgcctctggatcaccaatatgtacagttccaggcacagtttccagggcagatgggtctctttggttccacatgatggatgccatgaccatgtgggaaatgatttcacgacccacaggcaagccttcctttcatgagcactgagaatctccagaggaccagcctcgcactcctgagatcttagttcacagctggtggaagaagacccctctaacagtctcaaggagacaagcctgacattgcctctcaattctccctccctaccaaattgcaggagggatctgctctaatacaaccaagagagttctgtctgcacaggcaggcctgctctgagttctcagaggtgcaaggcctgcaagcacaaggaaggactgatccagccaccctccatattagtgttaaacagttgtctcatccacctaaacagaactataggggacaatacccctgccttagccctaggatctttatgcacctcctgcacacctgacctatggcctggggatacatgaagccttgaggtttcccctacagccaatcctgtccttctcacacaatactgagctcaacaccataagaactgccaaaccctgaaccaagatggtcctccttcagggaattcagtctcctaggtttttgaccatgggacacacactgaatacatacacagacacaaacagagagggagagagagagagggagagacagaagacagagacagagacagagagaaagaaactcgggtctcccagtcttctaagatcctagaccactgcatctgtgaattccagaaccatttctattcttccagaaatccctggctatggcagagaaggtcaggtctcttttgaccctttatcctgcctcatctccctggatgttcaggaagggaaggtagtagggagaagtcctaagtaggctgctgcctgcttggatgtcaatcatcacagcaagcaggctttcaaggacccaggaggatggtaccctggcagccttggctgtttaggacacccttggaaatacagcatagcctggctgtttctaagctgtttctcctcagtttcaccagaggccaggacactggctaggctcctggcccacatggggctcacagtgaggttgcttgcacaggatcatggtggagcctccaggaccactgaagggttctagggatgagggtgttttcccgaggggcctgggaccctgctctgaacccgcagcacagctcaaagagagagtctgttctaaaagagagaaagggaaacccaagatgacccgaaacataggaagggaatgaggaggaattgaggcctgcagggagggagctaactggatgaaagaaatctatctggccacaaaagctacctgagatactgagacagagcagagaagcatgataacctgcatctctctctctctctgtctctctctctctctctctctctctctctctctctctctctcacacacacacacacacacacagaaacacacacagtttgtctctctctatgtatcacagggtgggggggggtggttggatgggtgggcatgcctgaaagcagctgacagggatcatcaaacaaaagcaaggggaacctggatctgtctggtgaacagtgactggcaggacaagttgcccacaagaacccagatgcagccttgggtacacattgctgagtccagagatcccatgagcccttgcaaacctaacatgtccgcctgaactgtgctcaggacctggaaggctgtgctttccgagtcaggctagacaaaccttgtgttgccagccctgtcctctagtgagctggatactgctcgatggctcacaggtctctcctgggccaagaaggtctcagggagcccccagtccctccttggctgccaggaaaagagcgggtcggccaccatgttaagagaggcgcagggatgtgcaggcggaaacctcaaaccaattctgcttgatggcagtagagcaccaagaaaggcaactgccaggctgctgggcgctctccctctgcccttccagaggcaaaaaacgccaacctacaaccaccagccacaaacatggagcctgagcactaggccttctactgggcagaatgtctctctgtgccctgctagtgcctaagaaatgttttcttaagtgcttggctggtgtgagtgagtgtgtgtgtgtgtgaaggtttgggagtagtgatgatgagggtgcataagtgttccaggctgggtggagtgcagtgttgagacagaatggccactgatcacagacactcctcaactgtagggcagctgccagccactggagggcctggcaataagagctacctgagatactgaaacagagcagagaagcatgataacctgcatctctctctctctttctctctctctctccctccctccctctctctctctctctctctctcacacacacacacacacacacacacacacagagtttgtctctctctgtgtattcacggggtggggttggggggagtgttggatgggtgggcatgcctgaaagcagctgaaagggatcatcaaacaaaagcaaggggaacctggatctgtctggtgaacagtgactggcaggacaagttgcccacaagaacccagatgcagccttgggtgcacattgcagagtccagagatcccatgagcccttgcaaacctaacatgtccgcctgaactgtgctcaggacctggaaggctgtgcttcccgagtcaggctagacaaaccttgtgttgccagccctgtcctctagtgagatggatactgctcgatggctctcaggtctctcctgggccaagaaggtctcagggagcccccagtccctccttggctgccaggaaaagagcgggtcggccaccatgttaagagaggcgcagggatgtgcaggcggaaacctcaaaccaattccgcttgatggcagtagagcaccaagaaaggcaactgccaggctgctgggcgctctccctctgcccttccagaggcaaaaaacgccaacctacaaccaccagccacaaacatggagcctgagcactaggccttctactgggcagaatgtctctctgtgccctgctagtgcctaagaaatgttttcttaagtgcttggctggtgtgagtgagtgtgtgtgtgtgtgaaggtttgggagtagtgatgatgagggtgcataagtgttccaggctgggtggagtgcagtgttgagacagaatggccactgatcacagacactcctcaactgtagggcagctgccagccactggagggcctggcaataagagctacctgagatactgaaacagagcagagaagcatgataacctgcatctctctctctctttctctctctctctccctccctccctctctctctctctctctctctcacacacacacacacacacacacacacacagagtttgtctctctctgtgtattcacggggtggggttggggggagtgttggatgggtgggcatgcctgaaagcagctgacaggaatcatcaaacaaaagcaaggggaacctggatctgtctggtgaacagtgactggcaggacaagttgcccacaagaacccagatgcagccttgggtgcacattgcagagtccagagatcccatgagcccttgcaaacctaacatgtccgcctgaactgtgctcaggacctggaaggctgtgcttcctgagtcaggccagacaaaccttgtgtcgccagccctgtcctctagtgagctggatactgctcgatggctctcaggtctctcctgggccaagaaggtctcagggagcccccagtccctccttggctgccaggaaaagagcggggtcggccaccatgttaagagaagcgcagggatgtgcaggcggaaacctcaaaccaattccgcttgatggcagtagagcaccgcgaatggcaactgccaggctgctgggtgctctccctccgcccttccagaggcaaaaaacgccaacctgcaatgaccagccacaaacatggagcctgagcactaggccttccactgggcaaaatgtctctctgtgccctgctagtagtgcctaagaaatgttttcttatgtgcttggctggtgtgagagagagtgtgtgtgtgtgtgtgtgtgtgtgtgtatgtatgtgtgtgtgtgctggtttgggagtagtgatgatgagggtgcataagtctccagggctgggtggagtgcagtgttgagacagaatgaatggtcactgatcacagacactcctcaactgcagggcagctgcaaagcactggagggcctggtcagagaacttgagaaaggcaagccctaaggggctggagcaggtctttggaactgaccatcagggagccctatctaaaccctgtgtaaatctgggccataggggcggaggctccgaaacaagtgagtgcctggactgtatgacaaggggttggtcctgcccatgcagtgcctggccaggccaagggcctggggctggcccagagatccagtggctgcctgcctgaccctacccatctgggtgtcctctaaagctgacagtcagttacttctcttcctggggggcagactctgtggtccctgggcacactctctcaactttccaggtccaggcacacagccaagaaggccctccctgcatgaccacgggctgcctggtagggcaacagggaagtggtgtcagagagcactgggcacaggcaaggttgatcagagcgcacacctggtgcgggtggggcaccaggcccagcactggcttcccacctggcagcaggaagtgctgcagtggacccaaggccatgggtgggcagttgtatgtgcctgtgaggccttcagtgtccctggcctgaaccccgagtccaatgggagatgaaaagaagggaccccggaagaaaagcttagtcttcttacccaggcacacaggttggtttctcaggcagccccctccatatgagttccggtgaatgctgccccagagagtcatccagtcatctgtccaagtcagaggtcctgaggggcggaccgcccactcccactatctcgccagcaggccgcctagccatatcaacctgacctgagaacaaggacacatcaagagaaggaacaattattccagcccaacctgcaactgtggctaccaggcccccaattggaagctccaactaagtaagcatggccaggtaaccgggcaatcaggcaaccattatgaggtaagtcctgctccctacagtatctctcctctccctaaattctccaccccacctccactacaccccagccctttatcaaccagcagacagcactggaagcgtaagggggacaccacaatgttctctccttccgtcctccgaagtccccaagtcactctcacacatggatccttctatctgtgtcctcccacacagccacctacctacctgtgctggaactcgccatgcatgcaactcagagctctcgaaagacattcaagtgcaccgcaggtgacgggcacctacacacaaagcacaatgaccaatgcccacttatcccaacaggatgcctgcagcacatctactctcctgacctcctaggtcacttcacaccaaggtcgtctgaggggtcccactgacaattctaaaggcacattctaacgttctctccacatgctcactaacacagggtaataacaactggcttgcaacccacccacccacctacctacctacctacctacctacctacctacctacctattctctgcctctggatcaccaatatgtacagttccaggcacagtttccagggcagatgggtctctttggttccacatgatggataccatgaccatgtgggaaatgatttcacgacccacaggcaagccttcctttcatgagcactgagaatctccagaggtccagcctcgcactcctgagatcttagttcacagctggtggaagaagacccctctaacagtctcgaggagacaagcctgacattgcctctcaattctccctccctaccaaattgcaggagggatctgctctaatacaaccaagagagttctgtctgcacaggcaggcctgctctgagttctcagaggtgcaaggcctgcaagcacaaggaaggactgatccagccaccctccatattagtgttaaacagttgtctcatccacctaaacagaactataggggacaatacccctgccttagccctaggatctttatgcacctcctgcacacctgacctatggcctggggatacatgaaaccttaaggtttcccctacagccaaacctgtccttctcacacaatactgagctcaacaccataagaactgccaaaccctgaaccaagatgtacctccttcagggacttgagtctcctaggtttttgaccatgggacacacactgaatacatacacagacacaaacagagagggagagagagagagggagagacagaagacagagacagagacagagaggcagggggacagatagaaaggacagagacagacaggcagacaaagaaagaaactcgggtctcccagtcttctaagatcctagaccactgcatctgtgaattccagaaccatttctattcttccagaaatccctggctatggcagagaaggtcaggtctcttttgaccctttatcctgcctcatctccctggatgttcaggaagggaaggtagtagggagaagtcctaagtaggctgctgcctgcttggatgtcaatcatcacagcaagcaggctttcaaggacccaggaggatggtaccctggcagccttggctgtttaggacacccttggaaatacagcatagcctggctgtttctaagctgtttctcctcagtttcaccagaggccaggacactggctaggctcctggcccacatggggctcacagtgaggttgcttgcacaggatcatggtggagcctccaggaccactgaagggttctagggatgagggtgttttcccgaggggcctgggaccctgctctgaacccgcagcacagctcaaagagagagtctgttctaaaagagaggaagggaaacccaagatgacccgaaacataggaagggaatgaggaggaattgaggcctgcagggagggagctaactggatgaaagaaatctatctggccacaaaagctacctgagatactgagacagagcagagaagcatgataacctgcatctctctctctctctgtctctctctctctctctctctcacacacacacacacacacacacacacacacacacacagaaacacacacagtttgtctctctctgtgtatcacggggtttgggtgggggggggttggatgggtgggcatgactgaaagcagctgacaggaatcatcaaacaaaagcaaggggaacctggatctgtctggtgaacagtgactggcaggacaagttgcccacaagaacccagatgcagccttgggtacacattgctgagtccagagatcccatgagcccttgcaaacctaacatgtccgcctgaactgtgctcaggacctggaaggctgtgcttcccgagtcaggctagacaaaccttgtgttgccagccctgtcctctagtgagctggatactgctcgatggctcgcaggtctctcctgggccaggaaggtctcagggagcccccagtccctccttggctgccaggaaaacagcgggtcggccgccatgttcagagaggcgcagggatgtgtaggcggaaacctcaaaccaattccgcttgatggcagtagagcaccgcgaatggcaactgccaggctgctgggcgcgctccctccgcccttccagaggcaaaaaacgccaacctacaaccaccagccacaaacatggagcctgagcactaggccttctactgggcagaatgtctctctgtgccctgctagtgcctaagaaatgttttcttatgtgcttggctggtgtgagtgagtgtgtgtgtgtgtgaaggtttgggagtagtgatgatgagggtgcataagtgttccaggctgggtggagtgcagtgttgagacagaatggccactgatcacagacactcctcaactgcagggcagctgccagccactggagggcctggtcacaagagctacctgagatactgaaacagagcagagaagcatgataacctgcatctctctttctctctctctctctctctctccctctctctctctctctctatctctctctctctctctctctctctctcacacacacacacacacacacacacacacacacacacacagagtttgtctctctctgtgtattcacggggtggggttggggggagtgttggatgggtgggcatgcctgaaagcagctgaaagggatcatcaaacaaaagcaaggggaacctggatctgtctggtgaacagtgactggcaggacaagttgcccacaagaacccagatgcagccttgggtgcacattgcagagtccagagatcccatgagcccttgcaaacctaacatgtccgcctgaactgtgctcaggacctggaaggctgtgcttcctgagtcaggccagacaaaccttgtgtcgccagccctgtcctctagtgagctggatactgctcgatggctctcaggtctctcctgggccaagaaggtctcagggagcccccagtccctccttggctgccaggaaaagagcggggtcggccaccatgttaagagaagcgcagggatgtgcaggcggaaacctcaaaccaattccgcttgatggcagtagagcaccgcgaatggcaactgccaggctgctgggtgctctccctccgcccttccagaggcaaaaaacgccaacctgcaatgaccagccacaaacatggagcctgagcactaggccttccactgggcaaaatgtctctctgtgccctgctagtagtgcctaagaaatgttttcttatgtgcttggctggtgtgagagagagagagtgtgtgtgtgtgtgtgtgtgtgtgtgtgtgtgtgtgtatgtatgtgtgtgtgtgctggtttgggagtagtgatgatgagggtgcataagtctccagggctgggtggagtgcagtgttgagacagaatgaatggtcactgatcacagacactcctcaactgcagggcagctgcaaagcactggagggcctggtcagagaacttgagaaaggcaagccctaaggggctggagcaggtctttggaactgaccatcagggagccctatctaaaccctgtgtaaatctgggccataggggcggaggctccgaaacaagtgagtgcctggactgtatgacaaggggttggtcctgcccatgcagtgcctggccaggccaagggcctggggctggcccagagatccagtggctgcctgcctgaccctgcccatctgggtgtcctctaaagctgacagtcagttacttctcttcctggggggcagactctgtggtccctgggcacactctctcaagtttccaggtccaggcacacagccaagaaggccctccctgcatgaccacgggctgcctggtagggcaacagggaagtggtgtcagagagcactgggcacaggcaaggttgatcagagcgcacacctggtgcgggtggggcaccaggcccagcactggcttcccacctggcagcaggaagtgctgcagtggacccaaggccatgggtgggcagttgtatgtgcctgtgaggccttcagtgtccctggcctgaaccccgagtccaatgggagatgaaaagaagggaccccggaagaaaagcttagtcttcttacccaggcacacaggttggtttctcaggcagccccctccatatgagttccggtgaatgctgccccagagagtcatccagtcatctgtccaagtcagaggtcctgaggggcggaccgcccactcccactatctcgccagcaggccgcctagccatatcaacctgacctgagaacaaggacacatcaagagaaggaacaattattccagcccaacctgcaactgtggctaccaggccctcaattcgaagctccaactaagtaagcatggccaggtaaccaggcaaccaggcaaccattatgaggtaagtcctgctccctacagtatctctcctctccctaaattctccaccccacctccactacaccccagccctttatcaaccagcagacagcactggaagcgtaagggggacaccacaatgttctctccttccgtcctccgaagtccccaagtcactctcacacatggatccttctatctgtgtcctcccacacagccacctacctacctgtgctggaactcgccatgcatgcaactcagagctctcgaaagacattcaagtgcaccgcaggtgacgggcacctacacacaaagcacaatgaccaatgcccacttatcccaacaggatgcctgcagcacatctactctcctgaccttctaggtcacttcacaccaaggtcgtctgaggggtcccactgacaattctaaaggcacattctaactttctctccacatgctcactaacacagggtaataacaactggcttgcaacacacccacctacctacctacctacctacctacctacctacctattctctgcctctggatcaccaatatgtacagttccaggcacagtttccagggcagatgggtctctttggttccacatgatggataccatgaccatgtgggaaatgatttcacgacccacaggcaagccttcctttcatgagcactgagaatctccagaggtccagcctcgcactcctgagatcttagttcacagctggtggaagaagacccctctaacagtctcgaggagacaagcctgacattgcctctcaattctccctccctaccaaattgcaggagggatctgctctaatacaaccaagagagttctgtctgcacaggcaggcctgctctgagttctcagaggtgcaaggcctgcaagcacaaggaaggactgatccagccaccctccatattagtgttaaacagttgtctcatccacctaaacagaactataggggacaatacccctgccttagccctaggatctttatgcacctcctgcacacctgacctatggcctggggatacatgaaaccttaaggtttcccctacagccaaacctgtccttctcacacaatactgagctcaacaccataagaactgccaaaccctgaaccaagatgtacctccttcagggacttgagtctcctaggtttttgaccatgggacacacactgaatacatacacagacacaaacagagagggagagagagagagggagagacagaagacagagacagagacagagaggcagggggacagatagaaaggacagagacagacaggcagacaaagaaagaaactcgggtctcccagtcttctaagatcctagaccactgcatctgtgaattccagaaccatttctattcttccagaaatccctggctatggcagagaaggtcaggtctcttttgaccctttatcctgcctcatctccctggatgttcaggaagggaaggtagtagggagaagtcctaagtaggctgctgcctgcttggatgtcaatcatcacagcaagcaggctttcaaggacccaggaggatggtaccctggcagccttggctgtttaggacacccttggaaatacagcatagcctggctgtttctaagctgtttctcctcagtttcaccagaggccaggacactggctaggctcctggcccacatggggctcacagtgaggttgcttgcacaggatcatggtggagcctccaggaccactgaagggttctagggatgagggtgttttcccgaggggcctgggaccctgctctgaacccgcagcacagctcaaagagagagtctgttctaaaagagaggaagggaaacccaagatgacccgaaacataggaagggaatgaggaggaattgaggcctgcagggagggagctaactggatgaaagaaatctatctggccacaaaagctacctgagatactgagacagagcagagaagcatgataacctgcatctctctctctctctgtctctctctctctctctctctcacacacacacacacacacacacacacacacacacacagaaacacacacagtttgtctctctctgtgtatcacggggtttgggtgggggggggttggatgggtgggcatgactgaaagcagctgacaggaatcatcaaacaaaagcaaggggaacctggatctgtctggtgaacagtgactggcaggacaagttgcccacaagaacccagatgcagccttgggtacacattgctgagtccagagatcccatgagcccttgcaaacctaacatgtccgcctgaactgtgctcaggacctggaaggctgtgcttcccgagtcaggctagacaaaccttgtgttgccagccctgtcctctagtgagctggatactgctccatggctctcaggtctctcctgggccaagaaggtctcagggagcccccagtccctccttggctgccaggaaaagagcgggtcggccgccatgttcagagaggcacagggatgtgtaggcggaaacctcaaaccaattccgcttgatggcagtagagcaccgcgaatggcaactgccaggctgctgggcgtgctccctccgcccttccagaggcaaaaaacgccaacctacaaccaccagccacaaacatggagcctgagcactaggccttctactgggcagaatgtctctctgtgccctgctagtgcctaagaaatgttttcttatgtgcttggctggtgtgagtgagtgtgtgtgtgtgtgaaggtttgggagtagtgatgatgagggtgcataagtgttccaggctgggtggagtgcagtgttgagacagaatggccactgatcacagacactcctcaactgcagggcagctgccagccactggagggcctggtcacaagagctacctgagatactgaaacagagcagagaagcatgataacctgcatctctctttctctctctctctctctctctccctctctctctctctctctatctctctctctctctctctctctctctcacacacacacacacacacacacacacacacacacacacagagtttgtctctctctgtgtattcacggggtggggttggggggagtgttggatgggtgggcatgcctgaaagcagctgaaagggatcatcaaacaaaagcaaggggaacctggatctgtctggtgaacagtgactggcaggacaagttgcccacaagaacccagatgcagccttgggtgcacattgcagagtccagagatcccatgagcccttgcaaacctaacatgtccgcctgaactgtgctcaggacctggaaggctgtgcttcctgagtcaggctagacaaaccttgtgtcgccagccctgtcctctagtgagctggatactgctcgatggctctcaggtctctcctgggccaagaaggtctcagggagcccccagtccctccttggctgccaggaaaagagcgggtcggccaccatgttaagagaggcgcagggatgtgcaggcggaaacctcaaaccaattccgcttgatggcagtagagcaccgcgaatggcaactgccaggctgctgggtgctctccctccgcccttccagaggcaaaaaacgccaacctacaaccaccagccacaaacatggagcctgagcactaggccttccactgggcaaaatgtctctctgtgccctgctagtagtgcctaagaaatgttttcttatgtgcttggctggtgtgagagagtgtgtgtgtgtgtgtgtgtgtgtgtgtgtgtgtgtgtgtatgtatgtgtgtgtgtgctggtttgggagtagtgatgatgagggtgcataagtctcccgggctgggtggagtgcagtgttgagacagaatgaatggtcactgatcacagacactcctcaactgcagggcagctgcaaagcactggagggcctggtcagagaacttgagaaaggcaagccctaaggggctggagcaggtctttggaactgaccatcagggagccctatctaaaccctgtgtaaatctgggccataggggcggaggctctgaaacaagtgagtgcctggactgcatgacaaggggttggtcctgcccatgcagtgcctggccaggccaagggcctggggctggcccagagatccagtggctgcctgcctgaccctgcccatctgggtgtcctctaaagctgacagtcagttacttctcttcctggggggcagactctgtggtccctgggcacactctctcaactttccaggtccaggcacacagccaagaaggccctccctgcatgaccacgggctgcctggtagggcaacagggaagtggtgtcagagagcactgggcacaggcaaggttgatcagagcgcacacctggtgcgggtggggcaccaggcccagcactggcttcccacctggcagcaggaagtgcagcagtggacccaaggccatgggtgggcagttgtatgtgcctgtgaggccttcagtgtccctggcctgaaccccaagtccaatgggagatgaaaagaagggaccccggaagaaaagcttagtcttcttacccaggcacacaggttggtttctcaggcagtcccctccatatgagttccggtgaatgctgccccagagagtcatccagtcatctgtccaaatcagaggtcctgaggggcggaccgcccactcccactatctcgccagcaggccgcctagccatatcaacctgacctgagaacaaggacacatcaagagaaggaacaattatttcagcccaacctgcaactgtggctaccaggccctcaattcgaagctccaactaagtaagcatggccaggtaaccaggcaaccaggcaaccattatgaggtaagtcctgctccctacagtatctctcctctccctaaattctccaccccacctccactacaccccagcccattaccaaccagcagacagcactggaagcgtaagggggacaccacaatgttctctccttcagtcctccgaagtccccaagtcactctcacacatggatccttctatctgtgtcctcccacacagccacctacctacctgtgctggaactcgccatgcatgcaactcagagctctcgaaagacattcaagtgcaccgcaggtgacgggcacctacacacaaagcacaatgaccaatgcccacttatcccaacaggatgcctgcagcacatctactcccctgacctcctaggtcacttcacaccaaggtcgtctgaggggttccaatgacaattctaaaggcacgttcaaactttctctccacatgctcactaacacagggtaataacaactggcttgcaacacacccacccacctacctacatacctacctattctctgcctctggatcaccaatatgtacagttccaggcacagtttccagggcagatgggtctctttggttccacatgatggataccatgaccatgtgggaaatgatttcacgacccacaggcaagccttcctttcatgagcactgagaatctccagaggtccagcctcgcactcctgagatcttagttcacagctggtggaagaagacccctctaacagtctcgaggagacaagcctgacattgcctctcaattctccctccctaccaaattgcaggagggatctgctctaatacaaccaagagagttctgtctgcacaggcaggcctgctctgagttctccgaggtgcaaggcctgcaaccacaaggaaggactgaagcagccaccctccacacagttacacagttgtctcatccacctaaacagaactataggggacaatacccctgccttagccctaggatctttatgcacctcctgcacacctgacctatggcctggggatacatgaagccttgagggtttcccctacagccaatcctgtccttctcacacaatactgaggtcaacaccataagaactgccaaaccctgaaccaagatggtcctccttcaggaaattcagtcttctaggtttttgaccatgggacacacactgaatacatacacagacacaaacagagagggagagagagagaggtagacagagatggtgagagagacagagacagagagacagggggacagataaaaaggacagagacagacaggcagacaaagaaagaaactcaggtctcccagtcttctaagatcctagaccactgcatctgtgaattccagaaccatttctatacttgagagaaatccctggctatggcagagaaggtcaggtctcttttgaccctttatcctgcctcatctccctggatgttcaggaagggaaggtagtagggagaagtcctaagtaggctgctgcctgcttggatgtcaatcatcacagcaagcaggctttcaaggacccaggaggatggtaccctggcagccttggctgtttaggacacccttggaaatacagcatagcctggctgtttctaagctgtttctcctcagtttcaccagaggccaggacactggctaggctcctggcccacatggggctcacggtgaggttgcttgcacaggatcatggtggagcctccaggaccactgaagggttctagggatgagggtgttttcccgaggggcctgggaccctgctctgaacccgcagcacagctcaaagagagagtctgttctaaaagagaggaagggaaacccaagatgacccgaaacataggaagggaatgaggaggaattgaggcctgcagggagggagctaactggatgaaagaaatctatctggccacaaaagctacctgagatactgagacagagcagagaagcatgataacctgcatctctctctctctctgtctctctctctctctctctctctctctctctgtctctctctctctctgtctcttacacacacaaacatatacagagcatgtctctctctctatgtatcacagggtgggggtgtgggggggtgttggatgggtgggcatgactgaaagcagctgacaggaatcatcaaacaaaagcaaggggaacctggatctgtctggtgaacagtgactggcaggacaagttgcccacaagaacccagatgcagccttgggtacacattgctgagtccagagatcccatgagcccttgcaaacctaacatgtccgcctgaactgtgctcaggacctggaaggctgtgcttcccgagtcaggctagacaaaccttgtgttgccagccctgtcctctagtgagctggatactgctcgatggctcacaggtctctcctgggccaagaaggtctcagggagcccccagtccctccttggctgccaggaaaagagcgggtcggccaccatgttaagagaggcgcagggatgtgcaggcggaaacctcaaaccaattccgcttgatggcagtagagcaccaagaaaggcaactgccaggctgctgggcgctctccctctgcccttccagaggcaaaaaacgccaacctacaaccaccagccacaaacatggagcctgagcactatggcttccactgggcagaatgtctctctgtgccctgctagtgcctaagaaatgttttcttatgtgcttgggaggtgtgagtgagtgtgtgtgtgtgtgtgtgtgtgtgtgtgtgtgtgtgtgtgtgtgtgagtgtgtggaggtttgggagtagtgatgatgagggtgcataagtgttccaggctgggtggagtgcagtgttgagacagaatggtcactgatcacagacactcctcaactgtagggcagctgccagccactggagggcctggtcagagaacttgagaaaggcaagccctaaggggctggagcaggtctttggaactgaccatcagggagccctatctaaaccctgtgtaaatctgggccataggggtggagcctctgaaataagtgagtgcctggactgtatgacaaggggttggtcctgcccatgcagtgcctggccaggccaagggcctggggctggcccagagatccagtggctgcctgcctgaccctgcccatctgggtgtcctctaaagctgatagtcagttacttctcttcctggggggcagactctgtggtccctgggcacactctctcaactttccaggtccaggcacacagccaagaaggccctccctgcatgaccacgggctgcctggtagggcaacagggaagtggtgtcagagagcactgggcacaggcaaggttgatcagagcgcacacctggtgcgggtggggcaccaggcccagcactggcttcccacctggcagcaggaagtgctgcagtggacccaaggccatgggtgggcagttgtatgtgcctgtgaggccttcagtgtccctggcctgaaccccaagtccaatgggagatgaaaagaagggaccccggaagaaaagcttagtcttcttacccaggcacacaggttggtttctcaggcagtcctctccatatgagttccggtgaatgctgccccagagagtcatccagtcatctgtccaggtcagaggtcctgaggggcgggccgcccactcccactatctcgccagcaggccgcctagccatatcaacctgacctgagaacaaggacacatcaagagaaggaacaattattccagcccaacctgcaactgtggctaccaggcccccgattctcagctccaactaagtaagcatggccaggtaaccaggcaaccaggcaaccattatgaggtaagtcctgctccctacagtatctctcctctccctaaattctccaccccacctccactacaccccagccctttaccaaccagcagacagcacgggagagggaagggggacaccacaattctctctccttccttcctccaaggtccccaagtcattttcacacatggatccttctatctgtgtcctcccacacagccacctacctacctgtgctggaactcgccatgcatgcaactcgaagctctcgaaagacattcaagtgcaccgcaggtgacgggcacctacacacaaagcacaatgaccaatgcccacttatcccaacaggatgcctgcaacacatctactcccctgacttcctaggtcacttcacaccaaggtcgtctgaggggtcccactgacaattctaaaggcacattctaactttctctccacatgctcactaacacagggtaataacaactggcttgcaacacacccacccaccttcctacctacctacctacctacctattctctgcctctggatcaccaatatgtacagttccaggcacagtttccagggcagatgggtctctttggttccacatgatggataccatgaccatgtgggaaatgatttcacgacccacaggcaagccttcctttcatgagcactgagaatctccagaggtccagcctcgcactcctgagatcttagttcacagctggtggaagaagacccctctaacagtctcgaggagacaagcctgacattgcctctcaattctccctccctaccaaattgcaggagggatctgctctaatacaaccaagagagttctgtctgcacaggcaggcctgctctgagttctcagaggtgcaaggcctgcaaccacaaggaaggactgatccagccaccctccatattagtgttacacagttgtctcatccacctgaacagaagtataggggacaatacccctgccttagccctaggatctttatgcacctcctgcacacctgacctatggcctggggatacatgaaaccttaaggtttcccctacagccaatcctgtccttctcacacaatactgagctcaacaccataagaactgccaaaccctgaaccaagatggacctccttcagggacttgagtctcctagctttttgaccatgggacacacacatacactgacacaaacagagagggagagagagagaggtagagagagatggtgagagacagagagagacagaagacagagacagagacagagacagagacagagacagagaggcagggggacagatagaaaggacagagacagacaggcagacaaagaaagaaactcgggtctcccagtcttctaagatcctagaccactgcatctgtgaattccagaaccatttctattcttccagaaatccctggctacggcagagaaggtcaggtttcttttgaccctttatcctgcctcatctccctggatgttaaggaagggaaggtagtagggagaagtcctaagtaggctgctgcctgcttggatgtcaatcatcacagcaagcaggctttcaaggacccaggaggatggtaccctggcagccttggctgtttaggacacccttggaaatacagcatagcctggctgtttctaagctgtttctcctcagtttcaccagaggccaggacactggctaggctcctggcccacatggggctcacagtgaggttgcttgcacaggatcatggtggagcctccaggaccactgaagggttctagggatgagggtgttttcccgaggggcctgggaccctgctctgaacccgcagcacagctcaaagagagagtctgttctaaaagagaggaagggaaacccaagatgacccgaaacataggaagggaatgaggaggaattgaggcctgcagggagggagctaactggatgaaagaaatctatctggccacaaaagctacctgagatactgagacagagcagagaagcatgataacctgcatctctctctctctctgtctctctgtctctctctctctctctctctctctctctcacacacacacacacacacacacacacacagaaacacacacagtttgtctctctctgtgtatcacggggtgggggtgggggggggttggatgggtgggcatgactgaaagcagctgccaggaatcatcaaacaaaagcaaggggaacctggatctgtctggtgaacagtgactggcaggacaagttgcccacaagaacacagatgcagccttgggtgcacattgcagaggccagagatcccatgagcccttgcaaacctaacatgtccgcctgaactgtgctcaggacctggaaggctgtgcttcctgaatcaggctagccaaaccttttgtcgccagctctgtcccctagtgaggtcgatcctgctcactcgcaggtctctcctgggccaagaaggtctcagggagcccccagtccctccttggctgccaggaaaagagcgggtcggccgccatgttcagagaggcgcagggatgtgcaggcggaaacctcaaaccaattccgcttgatggcagtaaaacaccgcgaatggcaactgccaggctgctgggcgctctccctctgcccttctagaggcaaaaaacgccaacctgcaaccaccagccacaaacatggagcctgagcactagggcttccactgggcagaatgtctctctgtgtcctgctagtgcctaagaaatgttttcttatgtgcttggctggtgtgagtgagtgtgtgtgtgtgtgtgtgtgtgtgtgtgtgtgtgtgtgagtgtgtggaggtttgggagtagtgatgatgagggtgcataagtgttccaggctgggtggagtgcagtgttgagacagaatggtcactgatcacagacactcctcaactgtagggcagctgccagccactggagggcctggtcacaagagctacctgagatactgaaacagagcagagaagcatgataacctgcatctctctctctctctctctctctctctctctctctctctctctctctcacacacacacacacacacacacacacacacacacacagagtttgtctctctctgtgtattcacggggtggggttgggggggtgttggatgggtgggcatgcctgaaagcagctgacagggatcatcaaacaaaagcaaggggaacctggatctgtctggtgaacagtgactggcaggacaagttgcccacaagaacccagatgcagccttgggtgcacattgcagagtccagagatcccatgagcccttgcaaacctaacatgtccgcctgaactgtgctcaggacctggaaggctgtgcttcctgagtcaggctagacaaaccttgtgtcgccagccctgtcctctagtgagctggatcctgcttgctcgctcgcaggtctctcctgggccaagaaggtctcagggagtccccagtctctccttggctgccaggaaaagagcgggttggccgccatgttcagagaggcgcagggatgtgcaggcggaaacctcaaaccaattccgcgtgatggcagtagagcaccgagaatggcaactgccaggctgctgggcattctccctccgcccttccagtggcaaaaaaacgccaacatgcaaccaccagccacaaacatggagcctgagcactagggcttccactgggcagaatgtctctctgtgtcctgctagtgcctaagaaatgttttcttatgtgcttggctggtgtgagtgagtgagtgtgtgtgtgtgtgtgtgtgtgtgtgtgtgtgtgtgtgtgtgtgtgtgtacaggtttgggaatagtgatgatgagggtgaataagtgtccggggctgggtggagtgcagtgttgagacagaatggtcactgatcacagacactcctcaactgcagggcagctgccagctactggagggcctggtcagagaacttgagaagggaagccctaaggggctggagcaggtctttggacctgaccatcagggagccctacctgtgtcactctggaccataagggtggagcctctgaaacaagtgagtgcctggactgcaagaccaggagttggtcctgcccgctcagtgccaggccaggccaagggcctggggctggcccagagatccagtggctgcctgcctgaccctgcccatctgggtgtcctctaaagctgacagtcagttacttctcttcctggggggcagactctgtggtccctgggcacactctctcaagtttccaggtccaggcacacagccaagaaggccctccctgcatgaccacgggctgcctggtagggcaacagggaagtggtgtcagagagcactgggcacaggcaaggttgatcagagcgcacacctggtgcgggtggggcaccaggcccagcactggcttcccacctggcagcaggaagtgctgcagtggacccaaggccatgggtgggcagttgtatgtgcctgtgaggccttcagtgtccctggcctgaaccccgagtccaatgggagatgaaaagaagggaccccggaagaaaagcttggtcttcttacccaggcacacaggttggtttctcaggcagtcccctccatatgagttccggtgaatgctgccccagagagtcatccagtcatctgtccaagtcagaggtcctgaggggcggaccgcccactcccactatctcgccagcaggccgcctagccatatcaacctgacctgagaacaaggacacatcaagagaaggaacaattactccagcccaacctgcaactgtggctaccaggcccccaattctcagctccaactaagtaagcatggccaggtaaccgggcaatcaggcaactattatgaggtaagtcctgctcccacacagtatctcctctccctaaattctccaccccacctccactacaccccagccctttaccaaccagcagacagcactggagagggaagggggacaccacaatgctctcaccttccttcctccaaagtccccaagtcactctcacacatggatccttctactgtgtcctcccacacagccgcctacctacctgtgctggaactgggcatgcatgcaactcagagctctcgaaagacattcaagtgcaccgcagatgacgggcagctacacacaaagcacaatgaccaatgcccacttatcccaacaggatgcctgcagcacatctactcccctgacctcctaggtcacttcacaccaaggtcgtctgaggggtcccactgacaattctaaaggcacattctaactttctctccacatgctcactaacacagggtaataacaactggcttgcaacacacccacccacctacctacctacctacctacctacctacctacctatctattctctgcctctggattaccaatatgtatagttccatgcacagtttccagggcagatgggtctctttggttccacatgatgtataccatgaccatgtgagaaatgatttcccctcccacaggcaagccttcctttcatgagcactgagaatctccagaggtccagcctcgcactcctgagatcttagttcacagctggtggaagaagacccctctaacagtctcgaggagacaagcctgacattgcctctcaattctccctccctaccaaattgcaggagggatctgctctaatacaaccaagagagttctgtctgcacaggcaggcctgctctgagttctcagaggtgcaaggcctgcaaccacaaggaaggactgatccagccaccctccatattagtgttacacagttgtctcatccacctgaacagaagtataggggacaatacccctgccttagccctaggatctttatgcacctcctgcacacctgacctatggcctgggaatacatttgaagccttgagggtttcccctacagccaaacctgtccttctcacacaataccgagctcaacaccataagaactgccaaaccctgaatcaagatggacctccttcagggacttgagtctcctaggtttttgaccatgggacacacactgaatacatacacagacacaaacagagagggagagagagagagaggtagagagagatggtgagagacagagagagacagaagacagacagagacaaagacagagacagagaggcagggggacagatagaaaggacagagacagacaggcagacaaagaaacaaaatcgggtctcccagtcttctaagatcctagaccactgcatctgtgaattccagaaccatttctattcttccagaaatccctggctatggcagagaaggtcaggtctcttttgaccctttatcctgcctcatctccctggatgttcaggaagggaaggtagtaaggagaagtcctaagtaggctgctgcctgcttggatgtcaatcatcacagcaagcaggctttcaaggacccagaaggatggtaccctggcagcctgggctgttttggacacccttggaaatagagcatcccttggcagtttgtgtttctcctcagtttcactggaatccaggaaacttcctaggctcctggcccacttggtgctcacaatgaggttgcttgtattggatcatggtgaatcctcctggaccactgaagtgttctggggatgtgggtgttttcttgagcagcctgggaccctgctgctcagctcaaggttagagccttttttcaaaagaagggaagtgaaacccaagataataggagacataggaaggggatggggtgtggttgggttcagcaggtctggagttaattttttttaaacatatttggattttgtattcctgcaatatttcatttctctaaggaacataaccacatactcctttcaaccacagattgttgagacaggttgcattcgtttttactgttttccgtgtatataataatgtttattgcggtatggcatcctattatcctagaggtttctaagtagataaagtttgttagctccgtgagcatgacatctttagctcagctccctggaaatcctggacatacacccagggcctgttgtggatgtgttatccctatctttgtataggcagatacaaagcaaagagaacacaataaactcataatgtagtctagttaccctggcgtggacagtacagtggcagagagacaccatattcaaagaagattaaaatgttgtcttctgatgaacatgtacactgtcctttacatagtaaactcacgaatgcttcatacacacacacacaccaacatacacatactcacaaggttaaaacataaacacattataaaaagagttctacagtgctggatgtgttaacatagacccgtaatctcagtatcttgtagatgaaggatgcagggtattgggtgtaagacacttactttgggaaaacaacaacaaaaacctaaagagttagcaaggtcctaaagcttcatgggaatgaaatccaccacacatagcaatggctatgcaaaatccatggctttatgtctggttcactgaatacacctttataaactgtgtcagtatgagaaacaaataaatggagagggaacacgttttggttttttttttttgggtaccaggtcatttctttagcgttctagactctagaggaagcttacattttcctacatatgatttaaaactcagcaaaaaaagtactgtatttgaatatagtagttattgtggtaaataggaactatatctatcacttcattacttctcctttggtatgaataacaagaaatacaagtatcttgtatacactttcacacaaatgcagacattcctataaatacatagcatctgacctacttttaaaataggacttgctcgacttaggcacattgtgtattattatagaccttagtatctcaaatcatttcttttttttttaatttccaagtttaattattcctttactattacaaggagcatacaattctgcagcagagtggctttccgtgtatgtgcaaggcttcggtatctacaatcagtgctgcaataatcagcagaaccataatttcctacctgcccaggtccacaagtctagagtctagagcaatgaagatgtacatgggcaccaggcagtggcggcccacgcctttagttccagcacttgggaggcagagtgcagtggcatctccatgcgtttgagtccagcttggtctacagagtgcgttccaggacagccagaactacacacagagaccaccatgcctcggggaaaaaaaaaaaaaaaacaaaaacaaaactagaaaaagaaaacgaaaaacagaaagaatggccctgattattttgtgagaacttgccaatgcacactcacaaatgcagagggttttgctgcttctgtttgtagggtccgtctgtctgtctacttgtctgtctgtttaaaacatccctaatagtaaaagttcttagtggttaagtttggggagtcgaagcagccacccacagggcagcccatgctttaacaattatacagttcaaaccaccccagtacctgcacctccctagcggtgggttagggtgaaggtccctgaaacctctcagctttctcagcattctgttctagggaactgcttccgagtcccccatgaggctcttccaccaaggctctccagatgctgcccagagcacaaaactcactatccctaaactcaccaacaaggccaagtcacgtggtgttccctcctctgcccagagggatccctgcgcgctctaaagcccaaggctcccagctcagggttacacactcagaggggagaggagatgcacaaagaccgctctatccaccaactccttccgcatctcagaaggagtcagagagtagggataaacttacttggtccaggccaggctgtcctgtgatcgaatctccgacctttggagggcttcaatggacagcagcattgtctctgcgccatctccctgactctgcattcttagttgggagcgaagcagaaaagggagaaaagctatcctttcttactgagtgctcgctccgccctgcggatat

SEQ ID NO: 79 - DNA, 128305 bp, Mus musculus
aaagttataaaaagtccattaattttaaccacatattttatcacatagtcatatccccatcagataattacagcatttacccagtgtataaactatcttattttacctctactttgttttaatgttctgttttaggctcagtgtatatttcatacttaagtcacagttgagagcagccatacttttactagctaagtagccacgagtagacaaggaagaataatcagaagaccataaaccttttcatagaggagggtgatcaaagactttctggtgataacaatcctctgagtgaagaactagtgaattaagactgctgtcgttagttagttagttagttagttagacaactatttatttgggaaaacattcagatggcctttgaaatcagcagatcctaaaggagacactgggaaggtagatggagggaaagatgctcatgttcttagcctcagtagaagggctggattgggaacaagatctatgttttaaaaactttgaatgtgtgaaatcactgaaagtcccaaaattcttccactagtagaatgaataaatgaaaccatgatgaaatgaaaccatgtctgcttcaggttgggagattatgctacactgtaaattttcagaaatccagaattaaatgacaaggtaaagatgctcaactattaagggtttttttttttttttttttttttttttttttggtcttgttttgtttcggtttttttgtttgttttcatttcattagaaaaggggaaacaaatataggagctgatggctaacatttaaaactagatcaagtgagcctcaaacccccctactctctggagagagaaagaaaatatcaggaagtgaaaattaattttcataggattgttgtctcctgcattaaatatagttttccattcacgtcatatctatggaaacaaaatcctcagattcatgaagggaaatatatcttaagcaatctaagagtgctctttaaagagtcagaggtggaagaaataaaagatactgctctgtatattctccctagtacctgaggtttctcacagagctactgtcagtctgttttctgatagatagtgagagaaagtcttgtctgaagttgggcttcatccctaaaaaaaggcttgatgaagtcttgcaaactgatcactacaaccagggaagggagtgcctgaagtcaccaggacccagtaccagatcttctgtcagagatttataatccatggtgatagccacccagatccacaagcatcactttagctcaaccagaggaatgaggaatgcagagtcaagctgcttccaattaccagaagcctggttttctccagagtgtgggtgggctatttcagaggtctttttcttaatgttctgtctggaccaccccatatggctcagggcagtctaaataaaccatgggacatatttaaatgcctcttttatatgcctgtgtatattacaaaggatgtcttacccatttacttttagaaagcttcataattatctcactgttgtttcaataaatccatccattaaaacactcttttttttccttcagtaaattaatgccatttatcagaaagaatgggatatttttgaagtcatgatgaaagaaaagcaattggatacagcaaactcacccatgcctcctagtacttactaagcatgagcctaccaccctagacagatggaactttccaaggtaatgtcaagtgtcctttttgggtcacagagagaggactcatttaattagtttctataatcctaggttaatcctgctgagaattactgatgtgatttttacttatgtacaagaataatctattgttccacacacatttctggcaaaacaaattaaaaatcatgtaccttgtttttaatttattagtgccataataaagaaaggtttcccctttcattttcctcagttagaaatgccaatttcctttcctttggatcacattgttgattaacaaattcaaataggatgtttcaacagaagataatgtaggatacatttaattctccaaaattttagatggtaactcttcattactccttgctattgtgtacaaaggatcatgagaacaaattgattttaccttcaggaaattgaatacctagactatccactcttaccctggctgaacacctgaatcacctgggaaacttacaaaattccttaccacaccctaaatcaaacagagatagagtaatcccagaatatagtatttttaaggttctaaggggaccccattgtccatagctcttaaaattatttcacgttacgctttagtcccaagtgtcttaatgcactagttccatttaagtcactttgatcagctattctgagaggttattaaagtccctgtaaaacgctttagtagtcactcactgtcttagatgtgaaaactaacctctgaagaaggtaatgtttgttgatgaatgaagttatacaaatgatgctgtatggggcacctgatatctacgactaccttgctgcttcatgtcctcaaccccatcttcatgcctgtgaaatgaagggcttcgtatctcgggtgcccactaaaggaaatcatcagaaaaacatgacaaaaccaaattcacacattatttttccacaaaaaccagcccttcaaaggatgataaagtgagaactccaacacaaggagggaaattacaccctagaaaaagcaagaaagaaatctttcaaaacacctaaaagaagagagtcacatgaacagaatcttaactctcacaacaaaaataacaggaaaccacaattaaagaagatgagatggaaaggcaatagacatgttagcctggaagtggagatggggatatattacttcagggggaaatccacccaccaaggggaacaaagatactaaataaaattaatatgaaaaacataaaggaagaccaccaactattatttgtctgtacactatatgttaattcctttcatctactcagaatttcataattagtattattattgtctcattttatagcaggcacaaacggactgcaaaatgaagacagcttctggagataagaaatggggtcaggttcaaccccaggcagcatgctcaggccctcacgcttatgttctaagaggaagaagagcatagggacagatgctacatttcctttctttgtgaagcccggttcctgtttgaaatggggatgctgttccaacaaacctataaaactgaaggagataagcactaaagttaacgcagtcaccttagctttacacatgtggaagcctttcatatgagtcctttggtcatttgtgactgtcgccaactcaacgagaaggcattgatttatcacacattctccacacaaagagagaagacagaacaatgaagttccacagagatggaggaggcacctcctgtctaaaaggtaaccaactgtataggaggaaatgagctgtcatgggacaatcagtctgaaggtattcttcatgtagtataaccagtttctgggaagtcatgtgccatcgtaggagttgtactaaactgacatttagagaacctgcattcaagtcctggtgctgttagtcaagttaccacacaggtaagagcctcagttcggatgatctgctgggatagaagcttttctctcatgtatgtccactcagcacagaggcttcacagcgcctttaagagcatctgacctctttttgtttgttatgattttgaaagagggactatttactcctggaactatgtagatcaggctggtctcgaactcagagatcttctgcctccagagtgctgaaagagttacaggaataaagatccctaatgtttgggaagctatttatatattacagtcagtagacatggttacatcagaaagctcacacagtgagcacattcggtgtccctttgagggtccaattcctcatccataagataggattagtctttacctgtttaattagtagttagtaagttcttcagcaagttatttatcctccaaagtctcagctgcaatgtgagacatgtaaatgagacattttgtaatgctgaacagtgcctggcttgttgtaggtactctagaaatattagtcatcatcatctacctaagatgtaggctggccaaggacattcatgcaatcagttctttctaacattaattactgtgcttctgagcactaagagatgggcgttgctctaggaatcagaagtgtgcaatatttcatgcctggtggagctttgtcttttaaattaattccttaaggaatatttactacatgccagcgaacaagacagtaagtcctaagaaattctcattttacagttaactacgaaatgtgcagagatcccaaacgtgcgccacagtcccacaggtagtttctccctgcaattaggcaagagtggggcgtgggctaatgccctgcagggtttcccccaccagcacagcatccttgcagaagcggaattggaaggccaccgcgacctcggtggggctgcatctggaagccgggcactcgattccacccggccacccacaagcactcgccgcggcaggcatgtccccaggcgacgactccacgcagactgccgcagcgcccaaagtctcgctaacactgcgagcccgccggaaaacggaggccctgaaaagcaggccgggcccgcccgcgtgcatgaacttccaagccaggccggagacgcgtggcaagcgaccccagacaccatgaggcctgggccaggcagggcccagccccgcacggataactgtgcgcttcggccacgaaggaatcgcagagcggacgccgcactccgcattccgcagcccgcccgaagcggcccgcctcgcggcgctacctgcaggtcccagccagccgtctccaggacgaaacgagccctttcctcctcagtgtccgtcaccgccatgaactccctcaatgcctcctgctcctccgccgccatctttgccctgtgcacttcccaaaccgctccggcggacactgcaacagacccaaccccaggtctgcgttccgtccaccattctaccgcgtcccgagctgggcgcctggtcataggctccgcccaatgcggtgccacaggaaaagtcctccttgcgggaaacccatccgcctcgcgccctctggtggcccctatatgaacctcaccttaatggctgaagtaaaaggtagatggaagtgagtagggaggggctcgttttcccacaggatgaaggagtcccgaaatcagatcctgcaaattactcatggtctcatccctttatttcattaagtatttatttgcacattaatttcctttttgaagcattacactctctatggcttgatgctcttccaagggctgtggaaataacagagataaaacaaatgaaggaagatgaaatattgtaacttgtttaggagcccacagcccggatctgggactgagaacaaagcagaacagcccccaggcaggccaaggcagggctgttgttaaggcattcctaagaacatcttggccgtaaagatgaaaaggtattcaaggacaaatggggctacattatctaagctaacaccatctggccagaatcacccctcaatcaggggacaagcagggccatcttatctaaagtccacaccatctggccggaatctcctttctgtctattaccccttagcgccgagtaaagtcatatacatcaactggttgttagataagtcccaagcccaccggaacaaagctctgatgcccctttttgctgacaagtaatctttctgttaatgaatcaaccccgtgccttttgtcaaaattccttgtactcccaaccttttgcttctttaaaaacccctagcttccgagcctcagcatcgactcccctgcctccggtgtgaggtacgtgtcgacccagagctctgccaataaagcctcgtgtgtcttgcaacaagagaggattcttgtgttcgtgggtgcttcctgtccttggactagagtgggggtccctaaatttggggtcctacacaaagtatcctatcttcttgttgcttatgtcctttgaccctaacagttctatccgatgctcacatccccatggtttcctatcttatactagtacaagtctcagcctttcactttccactgcatctagcaaatcaccattgcattgccactggcaggctggcccaggacaaggagactcagagcagaggtaaggtggacatgtgtcacctacagagaaagtttagagctctgtctctccaacaatgctaccccaacaagtgaagtccccacatgtaaagctgggagcctcctaagtccatctatttatccctcattttcaaggttaaactgttaccatcctacaatctgctaagttggtgaacagcaattattctaccagaacttattgagtgttcagtgaggttcccgtcagctgattacatgctttgtttttctcctcttcttcctatacctgactcagagccacattcactgtgcatgaaaccactactaatgaatgagtgaatgaatgaatgaatgagtgaatggatgaaataacacatggatcagagaatgaggatctcacagggaatggtctatggaagagcccctttcagtctttttgtttcacagagtcattctatgagaatagaaagcaggaagtagctctgccaggggcatccccaacttctgagccagcctcaggcatggctgtaaacgggacagctctgggttggtgtggtataactgcagatcagtcccactgtaatcaactgaaaaggcccacagaggccatttggaacctaactcattgcagagaagcagtaaggagaaccctatctgcttttgatgctggtccaattcatagtcagcccttcttcccagcctgacagccatcaagacgactataggaataattgtgggtgcaggacattagggctcccttagcctgcggaaggtgctgtagtcacattgttctctatttcatcataaaataaacctctgctgggtagagattagtattcacattttacaggtaaagacagaacccagagattcagtaggatcacgcctaatgaaaagtacaacctgggccccgccatcccagcttctcaggtgactgagacagaaagtgaccctgcagagcatatttaaacaaaactaaacccagtgagaaagtgaatccatgctaaaaggcagaggatgcagcccagtgccagaggccttgcctgtcatgggagagactatagcttcaatcccagttttaaacaaatgtcctagcctggaagtttggagaaagactgaccaagcctccatcttcgctgtctctctacatatacacagcatcacccacagctccacctgtggtcaagttctggttccaatttaaagctgactttcttgccattcaggcatgaggtatacccagaacctatagcttccagttagaccattccacatgttctcccaaatacccatggcactccacacaacaatactcatggctttcacactcacacacacacacactttaccaccaccaccaccagaacaacaacattaccccaggagaacacacacacatatcaccaccaccatcatcatcatcatcatcacgtatggagtccatggcactctactccacgaatagcccagcttaagtgcacattatgcttttcagatttccaaacccacaccacccgatttcagtactcttattccaggtcactttgcacttactggctatttgctaccttcctggaaggaggttctgggcatcacagacagaccgggggggtttgttttaaaagtttgcatatccctcttctgtgaaagtacaggcaagggagtcactgagcagattctgtcagctgagggcaggtgactgcaaatgtttccactgaaatagtgtcaggtcatctgttaaaggtagaaggatatatcctaaagaatgatgtggggagtgctggtaggcagtggtgtgtatctctaatttcaacatttggaaagcagacaagtggatctctgagtctgaagccactctgatctgcagagtgagttccaggatagtcagggatctacagaggaacctacacacacacgcgcacacacacacacacacacacacacacacacacacacacacgcacttgcgtatggtgggctctgtggctgcctgtgaagagcaccagctaggagcactatacaaaagtcacaatcaggattacaaaatagagaggacctagtatagagtctgaagggcaaaatttccagccattcctcctaactcagaagacataacaaacattgacattattggagtgacaaatcccaatgtcattttatgtaattccctcagccaccttgggaagaggaagccaccagtgggggtaatgttatcccaaaatggcaatgagctccacaccaactatgggattcaaggggagaggagaaggggaaatgggggatggaggagagagagttatagcatcagttgttgcaacaagtgccagagagaaacagtgtaaggaggcagactttattttcacagttttggggtctattccagagtgttatattcagtggggcatgcctaccccgagatgccgtacttggaattaataatggtcaccagggtgacctatccatcctaaggtattggcagccatggggcacagtcatcctgaagtgacacctgcagtgaggtgtgcctgctctgagactctcctaacagtaggacagtccatcctgaggttagccacacatactccagctttttgtcacagtgtcttctatgtctggtatagccagagatagcagtggagaagagatttttgcatttgatgcctgtttcctagccagcaatgttaccctgggggctacaggaggtcaaggaatttacaagttaacaagttggagccacattttagaatttatttcaataaatttgctagctttcacccagttctcaaacctgagccccaccactctccccatccccatttcaatatcacttcctgagcagctctggcaggagactcccaggctccctattagcactgtggcctaacacatacacacacacacacacacacatacacacacacacacacacacacacacacacctcttcaatctggaagctttgattgagtgcagagcttagatgtgaaggaagtctagagatgttggtgaccagacttgagctagatgaggaagaggcaagcagtcagaagctgcagagacctagagagaaaggactccatcctaggccccatctgttttgggagcctgatggcgacttttgtataatgcttccagctgctactcttcacacgcagccagagagcccaccccgcgcgaggatagagagatagtgtatttcagagaagcaacacacagaccactcagccttagactgcagaagctgagcagaaaaaggatctgtccacagtgatgggtctgcctccagcagtgttatagggcagatgcggatgacctgaagccaaaaaggcccagctgtgctcagctaagaaccctctgtgaggttcacataactcccatgaatcctccttattacttagtttctttggggctatggattgtaacatgattgtcctgtattttatgactagtgtccacttataagtgagtacataccatacgtgtatttctgggtctaggttacctcattcaagatgacattttttatttccatccatttgcctgcaaatttcatgatgtcccccattttggggggggggggattttttggggagggttcaagatagggtttctctgtatagccctggctgtcctggaactcactctgtagaccaagctggcctcaaactcagaaattcgcctgcctctgactcccaagtgctgggattaaaggtgtgtgccaccaagcctggcaatgtccttgtttttaaatagctaaataatattccactgtatagatttaccacattaccttgatccattcttcagttgaaggacatttagtttgtttccagtttccagctattacaaataaagttgctatgaacatagttgagcatgtgtccttgtggtataatggggcatctttggggtatatacccaggggtggtatagctgggccttggggcaggactactcacaattttttgagaaaccaaaattgattttcaaagtagctgtataagtttgtacttccattagccatgtgtgggaagccaataagcgccattacaagatggcactggtttcaacaagctgacgcccatgaatatgggtaaacaaccaatgtgcgcatgtgcataagagtttgtgctgagtcatggcctggcctgaggcatgtaaatgaggtactgaaagcataaccaatcaggtgtagacacacctctcctaggcctataaaagcagcactagttttgggcttggggtctttcgccttcgcaatcaagctctcccaataaacatgtgcagaaagatcctgttgtggcgtctttcttgctggagatcgggcgtctcacagccatggagaaagtagtaattgcaagtgattggagagaggaaactgggtggatttgcattgctgcctgataaaaggtgggaagcagagagagctgcagggaaactaaagacaagagaggcagacacacatcttcatgtccgtaaatgctgctgcctctacattcagataccagaggcatgaacgttccactttagaaatgttatatggtatctttgtataatagaggtgatatgaagcatgctagctgatgggtacagaatgtgggaacctcttattgatcattttagctcccagttcaggagatagaatcttccacatcagagaaacaagcaaggagagatgaggtcccaacatcttacccaagaggacctgatgctaatgacctgatgccatggtttgctttgaaggtaaggcatcccccacaagctgtgtttgaacatttggtctacagttggtagcactctgttgggaggttgtggggcctataggagttgggagccttgctgaaggtagtgggtcactgtggggcgggggtggattctgagctcatacctagcctaagaagggctctctgtcttctaggccactgtcatataaggagcttcaccacataccagcttctccagcagccatgccttcctggttgtggaagattctatatctgagcaaaagtagaacccccccccattgtgtctatcagatattttatcacagcaataaaaaagtatttaatgtgcataagtccatcctaagagacacatcacaagaagtgtctatagccatgcaatagtccctttgggggacattcaagagccagactatctcaagggtgtcttaggctgtagtgagaaggccgccattaatcaaagtgacagtttattggcacagggaggcataccctgcaccctgagtatatggtcacttgtatgcagtctccttgatgcccagccattgttgaggagcaatctgcctctccctttaaaggtattgatgttttgattatagaattgataactattattaagtatggtgatgcatccacatttttttactgcatgcattgaagcttttcataataatgccggtgtgacccttctgaaacattcagactatttgttcgacttgtgctatattgctggatcttcttggttcccacagggcttccattgaatctgtaaaggtgatggcactcacgcaaatctatagcactgtggcttccaggagttgtaagccttgttacagacccatgcacctcaggtgctgatgtcacaatcacgagtgctcactgtgtttccagtggtaataacttctaagtcttgataccatattggcttaggtcacagagaagatcaaaattgtactctttgtagagagaaagccccaaataaaagagccctaaataaagggcaaaatcttatactcttgtgtcagctccttgccgcttgaagcctgacagtgtttgtgatgcagtttacaagcatttaggaccgatccaaatagctctgggtatcttacccaatggtcagtttcagaaaaggaagccaaccatgtcagaaaccatagttgtctgtcctcctaactactcaaataagaggccaaacaaacttcccaggagacaagtacagatatttcctaatgactataaaattgaccccattcactcttaggcaaaatagtctctttcaggattcacctgctgtgtgtctgcctgaagtgcctatcagtcattaaaacttccatatcaatcttggcatggaaatattttattgtgctccttgagctctttcatctcacaatgacaactttatttactggcatgtcctcagaccttatagaaggactttctactttgtctttgagattctgcctgatgtccatcagtggacctaatatgacttctctcaggcagaacacatgtaatggtaaccggctctagtttgtggggcatggtgttggaacatgggtccttccaaatttatgttgaagcaatgataatatttgaggcctttggagatatcaacccaggggttcaccataatgacagaatgtgtcacctatagaaaagggcctgacaccaaaccccaaatcttttgctgatgccatattgtgcttgcagacaggagcctggcatagctatcctctgaggggctcaactagcacctgactgagacagatgcagatacttacaggcaaacattggcttgagctcagagacccggatggaagagttaggggaaggactaaaggagatgaagggggtggcaacaccataggaagaacaatagtatcaactaactatacccatcagtgctcccagggaccaactcaccaaccaaagagcgtacatgggctggtccctggcctctggtacaattttatgtatgtgagtattttcatttcatgtatgtatgtgaatgtactaggggactgccttgtctgtcctcagtgagagaggatgtgcttaattctgcagagatttggtgctccagggagtgggggtgcaaaggggggatgaggtggggatgggtaggggagggagggaggtagagagtgggggggagcacctctcagaggcaaaggaaggggatgggctgaagaactcttgcaggggagtccagaaaggggaacaacattaggaatgtaaaacaacaacaacatggtccctaaactccatcaactgtttggctgtggtgcctgtatctgtctgtatgagtcagatgctgggtggagcctctcagaggacaccatgctcctgtctgccaacataatagagtatcattaaagtgttagggattggtacttgcccttgggataggtctaaagacgggctggttattggttggtcttcatgtaggtcccaaacagctggaatgggggctatcccaaaagctgttggctgtacatgggatatgttattttatctgggctgccttgtctggcctcaataggagaggaagtgtctagccttgcagagacttgaagtgccagggtggggggaaatacccaggggagcctcacccactccaaggagaaggggaggggagttggggaaaggattgtgtgaagagggtgactgggagggggttagtgagtaggatgtgaaatgaataaataacaaaattaaattttaaaagagactattcatcaggggcagagcctaggagacagaagtctggccccttctgagactcttcaaaatatcagcaatgataagcatttgaagacactgagtttggaaaaacaacagaggaactgtaaccacaggaaagcttttcaacaacgcaaagcccaaacaagctggatttgaatctttagaatacagtgtacagcatctatcaaagaaggtcaatactgagacagaaatggaggggaaatatccttctaagcccaaaactcaggaagctgaggcagacagagcactaactctaggccagcctagatctcactgcaagagcctgtattagaaaatccaggggagagctctgcaatttatcacaaaagtgtgaacctggaagacattttgttaaggaaaataagcacataaggaaaatgttggacctgcttaagtatgagacacatgtgtaaagacaaacacagaatgggagaggtgcagataagcaggtaggacaggaagtctgaggtcaaacaagaatgatcactaatgaattatggtgagttaccagagcttttaaccctagaacaaatgagcaaatgccagcatcaaagcatttcaccacgtaatttaccacaccaatcagcacaccatagtgtgagtgtatgatttaaatatatacaatacaattaaagaacaaaacgctttttgtgttaaagagacatatacaccttggaacattttgtccagtccctatgtgttattcccatgatagtaataattcacgttcagacagtgattctgtatataaaggttcaatgcaaggaaatccacctcagggaaaaagacagacactacctcaaagtaaaagggtgaaaaacagttttctaagcaaatggtgtgaagaaacaagctggagtagccattcaaataaaattgacttcaaacccaaagttatcaaaaaagacaaggaggggcacttcatacccatcaaaagtaaaatcttccaagattaactctcagttctgaagggaaacaacacccttctcaatagccacaaataatataaaatatctcggcgtgactctaacgaaggaagtgaaagatctgtatgataaaaacttcaagtccctgaagaaagaaattaaagaagatctcagaagatggaaagatctcccatgctcatggattggcaggaccaacattgtaaaaatggctatcttgccaaaagcaatctacagattcaatgcaatccccattaaaattccaactcaattcttcaacgaattagaaggagcaatttgcaaattcatctggaataacaaaaaaccgaggatagcaaaaactcttctcaaggataaaagaacctctggtggaatcaccatgcctgacctaaagctttactacagagcaattgtgataaaaactgcatggtactggtatagagacagacaagtggaccaatggaatagaattgaagacccagaaatgaacccacacacctatggacacttgatcttcgacaagggagccaaaaccatccagtggaagaaagacagcattttcaacaattggtgctggcacaactggttgttatcatgtagaagaatgcgaatcgatccatacttatctccttgtactaaggtcaaatctaagtggatcaaggaacttcacataaaaccagagacactgaaacttatagaggagaaagtggggaaaagccttgaagatatgggcacaggggaaaaattcctgaacagaacagcaatggcttgtgctgtaagatcgagaattgacaaatgggacctaatgaaactccaaagtttctgcaaggcaaaagacactgtctataagacaaaaagaccaccaacagactggtaaaggatctttacctatcctaaatcagataggggactaatatccaacatatataaagaactcaagaaggtggacctcagaaaatcaaataacccccttaaaaaatggggctcagaactgaacaaagaattctcacctgaggaataccgaatggcagagaagcacctgaaaaaatgttcaacatccttaatcatcagggaaatgcaaatcaaaacaaccctgagattccacctcacaccagtgagaatggctaagatcaaaaattcaggtgacagcagatgctggcgaggatgtggagaaagaggaacactcctccattgttggtgggattgcaggcttgtacaaccactctggaaatcagtctggcggttcctcagaaaattggacatagtactaccggaggatccagcaatacctctcctgggcatatatccagaagaagccccaactggtaagaaggacacatgctccactatgttcatagcagccttatttataatagccagaaactggaaagaacccagatgcccctcaacagaggaatggatacagaaaatgtggtacatctacacaatggagtactactcagctattaaaaagaatgaatttatgaaattcctagccaaatggatggacctggagagcatcatcctgagtgaggtaacacaatcacaaaggaactcacacaatatgtactcactgataagtggatactagcccaaaacctaggatacccacgatataagatacaatttcctaaacacatgaaactcaagaaaaatgaagactgaagtgtggacactatgcccctccttagaagtgggaacaaaacacccatggaaggagttacagaaacaaagtatggagctgagatgaaaggatggaccatgtagagactgccatatccagggatccaccccataatcagcttccaaatgctgacaccattgcatacactagcaagattttactgaaaggacccagatgtagctgtctcttgtgagactatgccggggcctagcaaacacagaagtggatgctcacagtcagctaatggatggatcacagggctcccaatggaggagctagagaaagtacccaaggagctaaagggaacttcaaccctataggtggaacaacattatgaactaaccagtacccctgagctcttgactctagctgcatatgtatcaaaagatggcctagtcggccatcactggaacgagaggcccattggacacgcagactttgtgtgccccggtacaggggaacgccagggccaaagggggggagtgggtgggtaggggagtgggggtgggtgggtaagggggacttttggtatagcattggaaatgtaaatgagctaaatacctaattaaaaaaaaatgaaaaaaaaaaaaatgaacctcaaaaaaaaaaaaaaaaaaaaaaaaaaaaaaaaccatccaagatctaaaaatggaagtaggaacaataaagaaaacacaaagggagacaactctggagatagaaaccttaggaaagaaatcaggaaccatagatgtgagcatcagtaacagaataaaaaagatggaagagaaaaaatctcaggtgcagaagattccatagaaaacatggacacaactatcaaagaaaatgcaacatgcaaaaatatcctaactcaaggcatccgggaaatccaggacacaatgaaaagaacaaaactaaggataataggtatcaatgagactgaagattttcaacttaaaggaccagtaaatatcttcaataaaattagagaagaaaacttccctaacataaagaaagagatgtccatgaacatacaagaagcctacagaactccaaatagactggaccagaaaagaaattcctcccaaaaaataataatcaaaacaccaaatgcactatataaagatagaatattaaaagcagtaagggaaaagggtcaagtaacatataaaggcagacctattagaattacaccagacttctcaccagagactgtgaaagctagaagatcctgggcagatgtcatactaaccctaagagaacacaaatgccagcccaggctaatatacccaacaaaactctcaattgccataaatggagaaaccaaagtattccatgataaaaccaaatacacacaatatctttccacaaatccagcccttcaaaggataataaaggaaaaactccaacacaaggagaaaaattatgccctagaaaaagcaagaaagtaatccttcaacaaatataaaagaagatagctgcaagaacagaatcccaactctaacaacaaaaataaccggaagcaacaattacttttccttaatacctctaaatatcaggggactcaattactctaataaaaagacttagactaacagactggctaataaacaggacccaacaatttgctgcatacaggatacccacctcagggaaaagacagacacttcctcagggtaaaaggctggaaaacaactgtccaagcaaacaagccgaagaacagagctggagtagccattctaatgtagaataaaatcgacttgcaacccaagttatcaaaaaagatgaggggcaattcatacacatcaaagataaaatcttccaaaatgaactcgcaattctgaatatctatgctccaaatgcaagggcatccacattcattaaggaaactatagtaaagctaagaccacacattgcacctcacaaaacaatagtgggagacttcaacaccccactctcatcaatggacagatcctggaaacagaaactaaacagagacacattaaaactaatagaagttatgaaacaaatggatttaacagatatatacagaacattttatcctaaaacaaaaggatataccttcttctcagcacttcatagtaccttctccaaaatagaccacataatggatcacaaaacaggcctcaacagatacaaaaatattgaaattatcccatgcatcctatcagatcaccacggactaagtctgatcttcaataaaaacataaataatagaaagccaacattcacgtggaagctgaacaacactctactcaatgataacttggtcaaggaagaaattaaaaaaagagagagagtaaagacttttagagtttagagtttaatgaaaatgaagccacaacatacccaaacttatgggacacaatgaaagcattcctaagtgtttcatagctctgagtgccaccgaaaggaaactggagaaagcatacactagcagcttaacagcacacctaaaagctctagaacaaaaggaagcaaattctcccaagaggagtagacagcaggaaataatcaaactcagggctgaaatcaaccaagtggaaacaaaaagaactatacaaagaatcaaacaaaccagaagctggttctttgaacaaatcaacaagatagataaacccttagccacactcaagagggcacagggacagtaagctaattaacaaaatcagaaaagaaaaggaagacataacaacagaacctgaggaaatccaaaacatgagatcctactacaaaagactatactcaataaaactggaaaacctggatgaaatggacaatttcctagacagataccatatcaaagttaaatcaggatcagattaatgatctaaacactcccatttcccctacagaaatagaatctgtcattaatcgtctcccaaccaaaaaaagccaggaccagatgaatagcctctagatccatccatttgcctaagaatttcataaatttattgtttttaatagctttttagtttcccttatgaatattgatgcaaaaatactcaataaaattctcactaacggaatccaagaacacatcaaaacaatcatcgatcatgatcaagtggccttcatcccagggatgcagggatggtttaatatatggaaatccatcaacgtaatagactatataaacaaactcaaagacaaaagccacatgatcatctccttagatgctgagaaagcatttgacaaaatccaacacccattcatgaaatatcagaaattcaaggcccataactaaacataataaaaacaatataaagcaaaccagtatctaacatcaaactaaatggagagaaagttgaagcaatcccactaaaatcagggactagacaaggctgctcactttctccctacctattcaatatagtactcgaactcctacccagagcaattagacaacaaaagaagatcaacgggatacaaattggaaaggaagaagtcaaaatatcactatttgcagatgacatgattttatatatatatatatatctctaaaaattccaccagagaattcctaaacctgataaacagcttcagtgcagtagctggatataacactaactcaaacaaatcaggggcctttctctacaccaaggataaacaggctgagaaagaaattagggaaacaacacccttcacactagtcacaaacaatataaaataccttggtatgactctatctaaggaagtgaaagatgtgtatgataagagacttcaagtctctgaaggaagaaatcgaagaagatttcagaagatgaaaagatctcccatgctcatggattggcaggattaatatagtcaaaatggctatcttgccaaaagcaatctacaaattcaatgcaatccccatcaaaattccaactcaattattcacagagttagaaaggacaatttgcaaattcatctggaataacaaaaaacctaggatagcaaaacctattctcaacaataaaagcacctctggaggaatctccatggctgacttcaagcagtactacagagcgattgtgataaaaacaaacaaacaaacaaacaaacaaacaaacaaacaaacatgatactggtccagtgacaaatagatcaatggaatagaattgaagacccagaaatgaactctcagacacacctatggtcacttgatctttgataaaggacctaaaaccatccagtggaaaaaaagacagcaagatactcaagaagaaggaagaccaaagtgtggatactttgttcctcctttgaatggggaacaaaatacccatggaggaagatacagagacaaagtttggagctgagacagaaggaaagaccatccagagactgttccacccagggatccatcccataaatagtcatcaaacccagacactattgaatatgccagaaagattttgctgacagaatcctgatatagctgtctctcatgaggctataccagtgcctgccaaatacagaagtggatgctcacagtcagctattggatggaacacaggatccccaatggagctagtgaaagtacccaaggagctaaaggggtctgcaaccctataagaggaacaacaataggaactaacccgtaccgccagagctctgtctctagctgcatatatagcagaaggtggcctagttggccatcattgggaggagaggcccttgttcttgtaaagactatatgccccggtacaggggaatgccagggccagttgggttggggagcagggtgggggaagggtatagaggactttcaggaaagcatttaaatgtaaatgaagaaaatatctaataggaaggaaggaaggaaggaaggaaaaaagaaggaaggaaagaaagaaagaaagaaagaaagaaagaaagaaagaaagaaagaaagaaagaaagaaagagagacagaaagaaagcgatcaagcaagcaagcaattctcaaattcctctggaataacaaaaggcccagaatggtgaaaattattctcaacaataaaagaacttctggggaaagcaccatcccagacctcaagctgtactacagaacaatagtgattaaaaaaaacaaaacaaaactgcatagcattgttacagtgacagacaggtagatgaatggaatagaattgaagacccagaaatgaactcatacacctatggtcatttgatccttgaaaaaggagctaaaaccatccagtggaaaaagacaacattttcaacaaatggtgatggttcaactggaggttagcatgcagaagaatgcgaattgatccattcttgtgtccttgtataaagctaaagtccacatggatcaaagacctccacataaaaccagatacactgaaactaatagaaaagaaggtgggaaagagcctggagcacatgggcacaggtgacccgtccagcaggtccagttattcgaggatctcgaggggacctcctcctaataaccaaatggggggtagagagagacgagggtcttgtacgaataacgacacggaaaccgttctgaagttgtatcaagaccccaatgtattgagaaaggtccaaggtttaaatgcacaagcaaagggggaagtacagatacttatcagtgggaggggtagggcaatacaagcaaaaggggaattatcagtgggaggggggcaatagaattgcacattcttaggcagttacacggggaagcaggaacttggtggtatcagggtgtggtcaggacatcggtgatgacctagggctggaacctcccatggttctcggaatccatgtgtcggtggcccgcttttgaccctcttttcttcttggggggagaggcccaattcagagatcaggacaatagcgttgccttaatggctcccaacatctcccccgttttaatatttttataaaggcatattgtataataaatttgtagccacgtttttaaagatcacctaaacgtctgtttgctcaccggatgattctctaaaaccaggaaggacacaaggacaagtcatctataaggcttgaattaatggttccagtcttttggatataacttgggctagccaagggaattaggaatgaagcaagctccgtgggtagaggtagaggtctgatccccagtgtgtaatgttagaggccatgtacaggattgactctcaggcccacagatctttacccagagtaaccctgacctgctcctgtgccgtttttttctggggaaaggtccctggggcactcaacctttatgcaatcagacatgcctctcagagactgtccaacagcttctagactaatctctgtgcagtacttagtcttacaactctcacgggcgacggctttaagttttaattttttgatgtgtctagcctgggatgactgtttagtttccaatgtggcgagaacgtatattaccatgtcggaaaagcacagactacggcaatctataaatgatttgtggcatgagactgatggccgaatttagggggaggtgaatgatcttacttaagcattttatggaaattgagtctctctccccgagaagagggtgatgaagcggtatccttgtctgcctcttctccagtaacctgcttgttatcaccatctgcctcttctccagtaacctgcttgttatcaccaacgtctagccaatggtaatgaactgaaacaaatgcgcttgaaagagatgaatcaacttgagatttaacaaatcaggtcaatttctgaaatgcccaaggaccgaaggagatcaataataggaattccaataggggtcccaaaagggagggcaacaaggtcgaaagccagggggaggttgaaaaaccagttttggtagtctaccttccctctaggccattgtaaatacttgtgtatgggtgtaactcagctatctacagttctaagtatctactctggttcctctttaggtcttaaacttcctttttcctagttgatggtaagttcctgtgtaaggcaatgacctagcttttattaaagtgatagtgtaatgccagagacaattctgaatgtcactgaatagtcaactttcttcctgaattctaaacccatggtctgctcaaggactttctaggacagtggaacaccggtcaaggcttggctatgtctaaaatttctacctttctagccttaatgtatgttatatcctgtcttcttactaaaactactactttaagacatcttttgcctctaaatttttatctatataatatgttgctctgacaaagctatggaaatatccctatgcttatcattaacaaaatgggcagtatgtagctgctgatctaaagctgtggtagataccttttaaagtttgcattttcagatttttaaaaccaaggatcattttctaactctaatgggcagcaaagcataagcaggtctctaacaaaaacataacagtagattccttatctaaattaggatctacacaattagttaattgacaagaattacaatgaatataaaaagacttgccaagattggcaatcttaactcttaaaattatctaacaataagcatataggtaaggtacacaaactttcatagctataaggagctggcctgagtggccaaaaacagtgtctctctgacgaaagcatcttgtacaatctctgtaccagtctttttgcctcacgagtcagcttttttagttgtttttattttaagttggcaccaggttggtactccttgctgcagcgcatggtggagatacgaagtttctttatctgtttgtaagtggatgctctccgatttctcctcttttgtgcactcagcacagctttttggtcaccactgtcaggcactcacaggtcacaggtcagcctgtcacattggaagctagcatgctcttgtagcattctgtggaaaaaacagaaacattcccccttttccccatattaagtatctgaacaggatcatggcaagtgccaataagtggatcctttttatctgccctagacactattctatccagtttttccaaaacaaatatgtgatccaaataatgtgcacggggatataatttctctcccccttctttgtttttaaagaaggtatagtttttaaagttttacaataccttgtctttgagaattataaaatatctcagtaacatgtgtaacattaaattgttgacaaaacatcttttggaggttttgaaaataaaaattttgaagcaaataaatttcttttttagattttctgtaactaaaatcctaaatattaaaaatatgttgcctctaaatcttatggagcaacgattactttttagaactttaaacttctctttggaggcattagctaatagaatactttttttttttcacttaggaaacaatatacactgaaagatttaaaatttgtttcttgtattgaagcagacaataaaaattttatacatattgtaaagctatgttagccatacctacaggcaaaattatctagtgatcaccagttcactaaaagtaaaactctttgaatttaagcattattttaaacatctgaatagatctgtaacaaagctaaaaagaactttttttgaacacagggaaaaactttcttaggcactgtttgcaaaataaaagaaggccacaatcttctctgggctacattaacttaaacgtagaatattttttaatctgagcatcttggccctcctgtaataaggaccagttttagaggaacaatttaactgtctatgcctctaatttttgatactctttcttaaggatgattactcttataattatcttaattacaatatacaggtgaattaaagatcttaaatttgtaatcaaactgcaagctgcagtcaatggaacactagcaattttaaccataatttttaagttttcgttgtaatattagaatgtatctataagttttggaaagcaagacccaattttaaacaatttattttctttaaaatcaatactagaaacatcactatcacgttacgaagtttggctgctcattcctgaatgcatgacagtgtgaattttaatgttttattaaagagacattgttttaaaatcttatctctataagtctattttttaggataagaattacacaaaattttatctcaatttagaagtatctttagaggactagttttctgggctgttttatgccaggtgcttttgtttgaaaatgactctagccttaagttattacttaagctaactttgtaaccagtgttatacctttttaatcatacccaaataacttataagccagttctctatgaccaagatatgtagatcatatttatacctttaagaccaatcaaaaaccaaatgaagtggcttcacgaatcttataaatttagatcaattaaagacttttactttttatagctatacttataagataaagacacactttgtcatttgctaaacacaataatcacaaaattgcagagaattttttttaggaaaaaacaactatcagcttatttgccttagaactaagaggttgtagattctaagtttttcagcaggacctctcctgctgtgcttgattttggctaaagggaagggcctctcagcctcagttgtgcaaactgagagtgattcagcaggtaaagttttaaccatttttttttcttttctttttaacatgaaacataaaacagccagtcattcagacaacgaaacagtcattcagacaacaaaacagaaaacatacatgaattgacacgtgattggtgcaccaaccagacaatagaaagagggtagagagcttctcctgtaggggccagagagaataaaacagggcgtcccccaatttctctctgtccctgggagagttctaaaatccattttcttttattcctttctttcctttcctgcttgtaagaagaggtagcttgtcaaaccaagattaaaatccaaaattttctaacagtttctggcaagcatctaaaacttttaatttatttaatctgagggcaaatttttgagaaaacacacaatctctatacactaaatgtctcaaatagcctaaaagtttaccatgctaaatcttttttgaagccattatcagtccacacttagttaaatattttatagccatctgtaaaaacgctctctattttctgcaaccaacaaaaacaccattgacaaaatgaattatatgtgttttaggaaatgatttcttaacttccaataaaacctaatctatgaattttttgacctttacgaagtctctttaaaacccatttttatttactataaatgtgttattgcaaatctctagcaagggcctcgaagcatgcctgggcccaacacacaacttcttaccccagagagttctgtcaaggtaagctgaactgactcaaggggaagctgcctagcgtctgaaagcagggtaaaattttcaaataaggctatgccctcataaaagtgcagggaagcagaaaagcacatccaacaatcttcagattctgacgcattatctctttgtgtcttatgcaacaaggctaaagcagaagcattcaatatagaccacagtaaatcagtggaagaggggggcctccccgcagggagagtgggctgaaacagggtcgtagcacaccctggggcaggaacaggggggcgggtgcctggaagtcctatggatcctttatgattgttagggatggttttaaaggtcaggccattgtcatagttatcttgatacaatcttaggccccaggtgagagagcgagaactttctcaagcctctaagttcctcctcttagcagtaaattttatgatcagtggattacaccatcccttagtgggctgtaagggccaggctgcaggccaatgtgttgagggaattactgtcacatctgccctggtatctaggagccctttgaactgtttgtcctctagaaacaaagtaggcatgggccatgaatcggttattttctgtgcccagtagacttccgaggatcccagggaggaaggtcctcgctcctctttcatataagggaaatggctgaatagtgggagtggtaaggcttgggctatgcgctctctagccctaagggtaagtggttcctgcatggcggtgactaagatttttatctccccatggtagtcggtgtcaacccctgtaggagtcaccattaggccttgtaaaagtctggacactcggccgatgatgagaaaaaacgtcttttgaggagggggcccaaattcacctgtgttaaccgctgttaattgaggcatataataatcaggggtgccccaggcggcatctatacccaatgtgaggacacagatgtctacttttaacttgggccaatggggcttgacaccaatcttggagctggagttagagcagccccaatggccaggttaatagacttagaaacttgttgagaaaacacatctacctcattacaaagcttgatcataccatttatatctaaactcttggttttacctctcagagcagccctacatgctgaattggcgttttcaagagcaagttgtcggactaacagaccctcaggtcccaaaattttctcagctgcttcctgcaatctggcaacgaactgcgcataggactcttggggcccttgtataatcttggttaggggcatagttagtgcccctgtagcagggacagcgcgccaagctctcagggccgcttgtgcggtctgggcgaggacaccaggggagagccctaattgttttatgtctgcagcgaaattgccttaacaacagattttgtcagcagtccaggaggctgtcttccacaaactctgactttcaagttaaatattggcctctagtgaggacagactgaataactttattttatttattgggtaccaagtagccttctgctaaaccttctaatagagatactgtgcgcaggcggcttagtcttgcttttgcgagatggcgattgggagttttctaaaaaatcttcagtaagggcaaagaggcgagcaccttttccgcccttttctgcctgctcaaggagatctctgatgattccccaataactaaaaaaggactcatggacatcttctccttgttttattaaactattgatttctttgcctactttattctaagtttcagaaccatttaataccagccatggacatctcttgtccacaaaacaaaaatattttattaaattccccttttttaaaaaaaactcttatccctctctccttaagagaaccctttatctcttcactaaatgccccatggttaatgggacaacaattgaatgcctaggcttacctcccgacgtccgtactcgacactcgagtgaagtgtcggtggactgtcccactgtttctcagtctgcgcggtacctctttaatccttaatccgttgtccggagggcagtcgtacctcgtgctccacgtcgggcgccacttgacccgtccaacaggtccagttattcgaggatctcgaggggacctcctcctaataaccaaatggggggtagagagagacgagggtcttgtacgaataacgacacggaaaccgttctgaagttgtatcaaggccccaatgtattgagaaaggtccaaggtttaaatgcacaagcaaagggggaagtacagatacttatcagtgggaggggttgggcaatacaagcaaaaggggaagtaattatcagtgggaggggggcaatagaattgcacattcttaggcagttacacggggaagcaggaacttggtggtatcagggtgtggtcaggacatcagtgatgacctagggctggaacctcccatggttctcggaatccatgtgtcggtggcccgcttttgaccctcttttcttcttggggggagaggcccaattcagagatcaggacaatagcgttgccttaatggctcccaacacacaggggaaattttcctgaacagaacaccattagcttatgctctaagatcaagaattggcacatgggacctcaaaattacaaagcttctgtaaggcaaaggacactgtcaataggacaaaatggcaaccaactgattggtaaaagatatttaccaatcctacatcggatagagggctaatatccaatatacacaaagaactcaagaagttaagactctggagaaccaaataaccctattaaaaatggggtacagagctaaacaaagaattctcaaccgaggaataccaaatggctaagaagtacctaaagaaatgttcaacatccttagtcttcagggaaatgcaaatcaaaacaaccctgagattccacctcacaccagccagaatggctaagatcaaaaattcactagctaggatgtgaagaaagaggtacactcctccagtgttggtggtattgcaagctggtgcaaccactctgaaaatcagtctggcagttcctcagaaaattggacatagtactaccggaggacccagcaatacctctcctgagcatatacccagaagatgttccaacttgtaataagaacacatgatccgctatgttcatggtagccttatctataatagccagaagttggaaagaacccagatgtccctcaacagaggaatggatataaaaaatgtggtacatttacacaatggaatactactcagctattaaaaacaatgaaatcatgaaattcttagataaatggaggaactagaagatatcatcctgagtgaggtaacccaatcacaaaagaacacacatggtatacactcactgataagtggattagctccaaagctcagaataccaaagacacaattcacagaccaaatgaagcttaagaagaaggaagtccaaagtatggatatttcaatccttcttagaagggggatcaaaatacccatgagaggagatacagagacaaagtgtggagcagagattgaaggaaagaccacccagagactgccccacctgggtatccatcccctatagtcaccaaacccagacactattgtggatgccaacaaatgcttgtggacaggagcctgatatagctgtctcctgagaggttctgccagtgcctaacaaatacagaggtggatgctgtcagccaaacattggactgagcacttccccaatggagaagctagagaaaggactgatggagctgaaggagcttgccgccccataagtgaaacaacaatatgaaccaaccagtacccccagagctcactgggactaaaccaccaatcaaagagtacaaatggatggacccatggcttcagctgcatatgtagcagaggatggtcttcttggactgcaatgggaagagaggcccttggtcctgataaggcttgatgcctcatggtaggggtatgccaggacagggaagtaggagtgggtaggtttgtgagcagggggaggggtgatggtatagtgggttttcagaggggaaacaagaaaggggacatcatttgaaatgtaaataaaaaatatctagggggtggtgagatggctcagcggttaagagcaccgactgctcttccaaaggtcctgagttcaaattccagcaaacacatggtggctcacaaccatccataacaaaaatctgatgccctcttctggagtgcctgaagacagccacagtgtacagacatataataaataaataaatctttaaaaaatatatctaatagaaaataattttttaattttccattttttaatggggttatttgatttttctggagtccaccttcttgggttctttatatatattggatattagtcccctatctgatttaggagaggtaaagatcctttcccaatctgttggtggccattttgtcttattgatggtgtcttttgccttacagaagctttgcagtttcatgaggtcccatttgtcaattctcgatcttacagcacaaacctgttctattcagaaaatttccccctgtggccatatcttcaaggcttttccccactttctcctctataagtttcagtgtctctggttttatgtggagttccttgatccacttagatttgaccttagtacaagataggaatggatcaattcgaattcttctacatgttaacctccagttgtgccagcaccatttgttgaaaatgctgtcgttttttccactggatggttttagctcccttgtcaaagatcaagtgaccataggtgtgggggtttatttctgggtcttcaatttattccattggtcttcttgtatgtcattgtactagtaccatgcagtttttattacaattgctctgaggtacagctttaggttaggaatggtgattccaccagaggttcttttatccttgagaagaggttttgctatcctaggttttttgttattgaagatgaatttgcagattgcccttactaattcgttgaagaattgagttggaattttaatggggattgcagtgaatctgtacattgcttttggcaagacagccatttttactatattgatcctgccaatccatgagcatgggagatctttccatcttctgagatcttctttaatctctttcttcagagacttgaaattcttatcatacagatctttcacttccttacttagagtcacgccaaggtattttatattatttgtgactattgagaagggtgttgttcccctaatttctttctcagtctgtttatcctttgtgtagagaaaggccattgacttgtttgagtaaattttatatccagctacttcactgaagctgttcatcaggtttaggagttctctggtggaattattggggtcacttatatatactaacatatcatctgcaaatggtgacattttgacctcttccttttcaatttgtacaagtggatattatcccagaaagtcagaatacccaaaatacaatttgcaaaacacatgaacctcaagaagaaggaagaccaaagtgtagatacttcgatttttcttacctgggggaacaaaatacccatggaaggagttacagagacaatgttcagagcagagactgaaaaaagcaccatccagagactgccccacgtagggatccacctcatgaacaaccaaaaacccagacactattgcagatgccaagattttgctgacaggagcctaatataggtgtctcctgggaggctctgccagtgcctgacaaatacagaagtggatgctcacagtcattcattggatggaacacagtgcccccaatgaaggagctaaagaatgtatccaaagagctaaaggggtctgtagctctataggagaaacaacagaaactaaccagcacccccagagctctctgggactaaaccaccaaccaaagaaaacacatggtgggacttgtgtctctagccgcatatgtagcagaggattgcttaatcattcatcaatgggggagagtcccttggttttgggaagattctatgacctggtataggggaatgccagggccaggaagtggcagtgaatgggttggggagcatgggggaggggatgatagggaattttcagggaggaaactaggaaaggggaaagcatttgaaatgtaaataaataaaatatctaatataaaaatggactgcttcttctcatcagaatcctccatggtgtacaactcagcaagtcttcctctaaagagccaagtctactctcctgcagaaggcctctctgtgctcccagccacagtttccaccaagccatgctgcctgccaggcaagccaaagactcttctcccagagggagacccagctggggctctcttcctccctcttttccctttagctctgggtaagatccagccctcaggccccaactccagtctcagctcttctgaggcatccagtggcatctggaatgaccaagagcctgagaacctgttgtcctcaactctctgccaactggcaggtctacaggaagctcaggctgtgctcccctaatcttggagaagggtcctagggcttcttgcaacctgacgccctcctcgcaccagcatgcattgcacacagtcaaaactgctcacatcccacctcacccaggggcccaagccctgagccagatgtaggctaccctttaacccactaactaatggaccctttgggctctcagagacttaaccatcaactaaagaacatacacagttgggctctaagtctatctgcacataggtagcagatgtgcagcttggtcttcgtgtggcccttgctaaaaaatctggagtaggggctatctcgaaaggggtcgcctaaatgcaggatatactgttctagctggactgccctgactggactcagtgggagtggaagcatctagcctccagagatttcatgttccaggtttggaagatgaccaggtggcccccacccactcaagaggaaaaggggagggtaagaaggggcaaggattgtgggagagacagactgggagggaacagtgagcaggatgtgaagtaaacaagtaaaaaataaaaacaaataaaaaaaacattttccagaaaacatcacatggcacaaccgagactccaataaaacaataatttttgacttcagtcttctatcagataaaacattttatttatatataaaatttttatatttacatatacataataaacttcctcctcacacactttgtcttcatatatcagtgtgtgttggagtgttcagctccagcggcatctagaagaaaagcaagaattatcaattgtatcatcagccacatcattggtggcactgtcaggagcagcagcatcagcagcatcagtgtcattatcatcaggatcaatgtaatgagaaacagtgagaaggtggaggcttgttttgttaattttattctcagatgttgcttcctttggaatgtttgtttccaggctgatactatcctcacaagtcagagttcagaagagcagagataaatagacaccaatgtttaatagacactaatgttttcaatgggagtgaaaaaaattttcctcattccaggatgggagacaaccaagtaccatggttagttgtgttggtctaaactggttttgttacactatgtgaagtattttcaataagttgagaaaaggaaacaatgttttctgattctaggtaatgctcaaatagcatgaaatgtattaatcatgactattagtatcaaagatatctacttttctatctaaaataaaagttcatctattttgagcagctactgtggtccaccttaccgggtttatcttttctcttggagggaggtccttggccattttcttcgtagcacacttgcgaattcaatttctaatccacatcatcattgataacaggaatgtaagaaaccacatcaagggcattaccggcagtagtagcatatctggttcccaaagaaaaccaggtacctggacagtggacccgctatggccagtgtgatcagatgactctaaagcgtcataaaaatcctcagctatatcttcatctgggtcagcaacaggactgggttcctcacctgaagaaagaatagcatacttgttttatgctccaagcagtgtcagaacattcagggcagttctttcttttttttgtccaattttttttaggtatttagctcatttacatttccaatgctataccaaaagtcccccatagccacccacccccactcccctatcgacccactccccctttttggccctggcgttcccctgtactggggcatataaagtttgcgtgtccaatgggcctctctttccaaggatggccgactaggccatcttttgatacatatgcagctagagtcaagagctccggggtactggttagttcataatgatgttccacctatagggttgcagagccctttagctccttgggtactttctctagctcctccattgggagctgtgagcatccacttctgtgtttgctaggccctggcatagtctcacaagagacagctacatctgggtcctttcgataaaatcttgctagtgtatgcaatggtgtcagcgtttgcatgctgattatggggtggatccctggatatggcagtctctacatggtccatcctttgatctcagctccaaactttgtctgggacacatgctccactatgttcatagcagccttatttataatagccagaagctggaaggaacccagatgcccctcaacagaggaatggatacagaaaatgtggtacatctacacaatggagtactactcagctattaaaaagaatgaatttatgaaattcctaggcaaatggatggacctggagggcaccatcctgagtgaggtaacacattcacaaaggaactcagacaatatgtactcactgataagtggatattagcccaaaacctagatacgcaagatataagatacaatttgctaaacacatgaaactcaagaaaaatgaagactgaagtgtggacactatgcccctccttagaagtgggaacaaaacacccatggaaagagttacagagacaaagtttaaagctgagataaaaggatggaccatgtagagactgccatatccaggtcagttctttcaatggaatctaaggaacatcaagtgcaggtaccaggagtaggctctgggtcacaatggggtgtggcccttgcatgctccatgtaaaaatctgaatcagttatgaagtccaacccaatgtcactacctgtttctgagtcatatttttcatcagattcagaactgtcagaaggacatggggaaggaattttatcaatatcagaaggagcaggactgtcaggagcacattgtgaaggacttggttctatgccagcaggaatcctggtgtcagcagcacaggtggaatgagtcggctcaacatcagcaggagcacccctgtcaggagcaagttgtgaaggagttggttctatgtgagcaggagccctgcagtcagcagcacaggtggaatgagttggctcaatgactgcaggatcctcacagtcaggagcacactgggaagtagttggctcaacatcagcaggagcaccactgtcaggaacaagttgtgaagtagttggctcaacatcagcagtagccccattgacagcagcacaggtggaagaatttggctcagcatcagcaggagccctgctgtcagcagcacaggtggaatgagttggctcaatgactgcaggatcctcacagtcaggagcacactgggaagtagttggctcaacatcagcaggagcaccactgtcaggaacaagttgtgaagtagttggctcaacatcagcaggagccccattgacagcagcacaggtggaagaatttggctcagcatcagcaggagccctgctgtcagcagcacaggtggaatgagttggctcaatgactgcaggatcctcacagtcaggagcacactgggaagaagtagttggctcaacatcagcaggagccccattgacagcagcacaggtggaagaatttggctcaacatcagcaggagccctgctgtcagcagcacaggtggaatgagttggctcaatgactgcaggatcctcagagtcaggagcacactgggaagaagtagttggctcatcatcagcaggagccccattgacagcagcacaggtggaagaatttggctcagcatcagcaggagccctgctgtcagcagcacaggtggaatgagttggctcaatgactgcaggatcctcacagtcaggagcacactgggaagtgttggctcaacatcagcaggagcaccgctgtcaggaacaagttgtgaagtagttggctcaacatcagcaggagccccattgacagcagcacaggtggaagaatttggctcagcatcagcaggagcccttctgtcagcagcacaggtggaatgagttggctcaatgactgcaggatcctcacagtcaggagcacactgggaagaagtagttggctcaacatcagcaggagccccattgacaagagcacaggtggaagaatttggctcagcatcagcaggagccctgctgtcagcagcacaggtggaatgagttggctcaatgactgcaggatcctcacagtcaggagcacactgggaagtattagttggctcatcatcagcaagagccccattgacagcagcacaggttgaagaatttggctcagcatcagcaggagccctgctgtcagcagcacaggtggaatgagttggctcaatgactgcaggatcctcacagtcaggagcacactgggaagaagtagttggctcaacatcagcaggagcaccactgtcaggaacaagttgtgaagtagttggctcaacatcagcagtagccccattgacagcagcacaggtggaagaatttggctcagcatcagcaggagccctgctgtcagcagcacagttggaatgagttggctcaatgactgcaggatcctcacagtcaggagcacactgggaagaagtacttggctcaacaccagcaggagccccattgacagcagcacaggtggaagaatttggctcagcaccagcaggagccctgctgtcagcagcacagttggaatgagttggctcaatgactgcaggatactcacagtcaggagcacactgggaagtagttggctcaacatcagcaggagcaccactgtcaggaacaagttgtgaagtagttggctcaacatcagcaggagcaccactgtcaggaacaagttgtgaagtagttggctcaacatcagcagtagcccctttgagagcagcacaggtggaagaatttggctcagcatcagcaggagccctgctgtcagcagcacaggtggaatgagttggctcaatgactgcaggatcctcccagtcaggagcacactgggaagaagtagttggctcaacaccaacaggagatccattgacagcagcacaggtggaagaatttggctcagcatcagcaggagccctgctgtcagcagcacaggtggaatgagttggctcaatgactgcaggatcctcacagtcaggagcacactgggaagttgtagttggctcatcattagcaggagccccattgacagcagcacaggtggaagaatttggctcagcatcagcaggagccctgctgtcagcagcacaggtggaatgagttggatcaatgactgcaggatcctcacagtcaggagcacactgggaagaagtagttggctcaacatcagcaggagccccattgacagcagcacaggtggaagaatttggctcagcatcagcaggagccctgctgtcagcagcacaggtggaatgagttggctcaatgactgcaggatcctcacagtcaggagcacactgggaagttgtagttggctcatcattagcaggagccccattgacagcagcacaggtggaagaatttggctcagcatcagcaggagccctgctgtcagcagcacaggtggaatgagttggctcaatgactgcaggatcctcacagtcaggagcacactgggaagaagtagttggctcaacatcagcagtagccccattgacagcagcacaggtggaagaatttggctcagcatcagcaggagccctgctgtcagcagcacaggtggaatgagttggctcaatgactgcaggatcctcacagtcaggagcacactgggaagaagtagttggctcaacatcagcagtagccccattgacagcagcacaggtggaagaatttggctcagcatcagcaggagccctgctgtcagcagcacaggtggaatgagttggctcaatgactgcaggatcctcacagtcaggagcacactgggaagaagtagttggctcaacaccagcaggagccccattgacagcagcacaggtagaagaatttggctcagcatcagcaggagccctgctgtcagcagcacaggtggaatgagttggctcaatgtcaccaggagcctcaagcacatgaattctatgcttccgaggaaaggtatggaaaataggtggtttatttcctcgcacctataaggaaaattggcaatgttacttttgatttaaagtttcactgattttattcattttatcacctgtctgctaatgtcagaatcttgatttatagtccccaaaatgtttctgtattcataccaacttcatcactaaggacactatctgatatttagcaacctctgcttcctttgtgcatgatgagtaaaaggcccagagtatctagaaatcttagatggggacctgcttagtgttatgcttttatcttctgctctttgctacctcacatcatcattctctacaaaatggaaagacataaaaagaaaggacaaaatgtgtcctctcctgtctttatgacctgaattttgaattcgagccagatgaggtgaatggggcagtgaggtgctctgaaaacaaaaggaacctctctcttctgcagtacactaacccttccccaatgaatgatcttccacagttgtccattagatacctgggatatcagaacagtggagctgaattgtaaaatgcatgaatcaagtatgtcactacctacagcagaggggaattgctgagttccatggatggattctatatatgccttccaaaatctcacctattagctctatgtcaaagtaacttttatgcactaggtgtgattgtaatctttgatgcttactacctccatctgagtgataacctagacctagtcctggaagcttctagcctctgtgaagcttagcataggcctagaatattttctgcctctcatacttactgctgaataagcacaccgttatttctggttctttttcatctctggctgactggttcaactcaggtgttctagctcaaagctgctccccatgctaactgattcagtctggattctctcttggcctctgatgttttttgttctgcttgacctcaaactaactagcaatttttttctaatcttctgactccttcatattctctggttcattctgccttcacccgtgtcttgctggttctctcttcaatgaatctctctaaaactgtctgggtaaaaatgcctcctctctctgtttctctctgcactacctctcaagtagcttccctttcctttcttcttgagagagttggacacattctatttaatcaaaactttctctgattcatcaacttctctgccatgcaattagacatcactttcagacaaggtgcttcattctacaaactaactttaccttgattgtttaggattatggtgtttactaaggaggtgtctgtattctggctagagggattaaagtttggtgcaaaggctgagtcacacaataactagacaagagtttattgagtaaacaacacaatcaaacacaagcacagcatgatcagctatcctgcatcaccatgactgttgttacacagagaggatgaatataatgacttgatccagcacctctgtggtggcttgaatgtcagaggcccataggctcatataatgcttgctctccagatggctgacctattctggaaaggattagaagttgtggcctttttgttggatatgtgtaactgggatgggctttaagattacactagacaggtgccattctcgtaaagttctctctttcctgtgtaggtcaatatgtgatcattctgctgctgcttcagtaccatgcctgctgcctgagccatgatggtgatgtgtgcattccactggaaccatgagcccaacttcaaacacaccctttcttctggaagttgtctttctcacggtcttttcttacagccatagaaagtaactaacataaccattatctaggtacagtaggagtgacttcaaatgtctgaaggattcattccaagctgtgaaggggttttgcccagtggatttggtcacaaaacaagtgatcaaattccataatgctagcttagataggctacccagagcactcactgattcaaccagatacacttaggaaatgtgagtgttgaaagtggatttgatgcggcatggcaaataaggtctccatatatttgttgctccttacacctccatgaaattcataacttagcagccaccttttacccttcagtaccaggtttgaggatgggatatgctacttacatgaaaaagtcacactccaaaacatactctgcatcatcaaacaatataacacagagaaggttcaacaaaatgagttaagcagcactgttgatcaaagggaaaggatgaggaagcatgcaatctctgtgtcttcaaactgttcaaatgttagaatttagttcactcgattcactgagaaacggacttgaatacagcaaagcatgtggaattttcagacataggcacgttttcatacaccacgtgttaccggactcattatccccttcctcattgtgtaaatatgcttgggacagttattaaagaagaataaaggaccatatgatgcaaaattaaatttccaggacatctgccacttccatgaagataacactgaagataaaggagaggaccctgaagaggtttccctgaattgttagtcacacaacaggtgtatattaacagcatttatttaccagtatacttaaattcatgattcaaaataatctttttcttaggggtttgtgcacatgtggttacattactcttcttatgttatgcttgtgtgtgtatttctcccctccctctctctgtctctctgtctctctctctctctgtctctctctctcttgtgtgttactgtatgtgtgtttgtgtgtgtgtgtgtgtgtgtgtagactggagagaaatttcaggagctggatatcttcttccacagagttagaaagaggctctgaccatttctgctgctctctatggtctaatctgtctagcttgtctttcagggctgttctactctcttagcctccaatctggatttaagggtgcagagattacaggctttttccttttttcaggatgaaattcagcttattagggttccaaggcaagtgcactaacccactgagccacctggttgctatattttatgtatatatacatgtatgagtccatgtatgtgtgtatatttttatacatatacatgtgtatatgaatgtgtatatatgtatatatattatgcatttatattctagttttaaaataaagggagagagagagagagagagagagagagagagtgtttggttgttacccgtttacaatgcaaatgaaatggagaaaagtatgaatttctcattgacatgaaaacatttcctttgccccaagctagttagcctctttgaaacatgcctgtgtcattgtcacccctgtctggctgtacctcttcataaagacttctattgggtattctcttagcatgcaatagagaactgttattatctagctcaggtccattttttttttataaattttatacgtattacactgcaattgccacataggcttctgggaagtttgtgttagtttgattttatgcaagtttaatatcagaaaatagcatctattttatttcaatcacataattcatttctttgaagaaaggaaactacctttggctaagttgtgcctggcatatatcactgctttaatgatattgtggattgtattctaataattggtatataaaagaagttgcttcatttcttgtcaactgtaactaatctgtggttaccatatccttcaccattattatgtacattctgtatcatcataaaaattctatttaggggaaatgtgtttgtattaggaatgttagttttgaaaactctaacggcttttcactgaacttgaagatgattgccaagtgaatttctgtgcataaaatttacctgaattctaccttcttgcttagttctctctagaacaaaatttactcggttcatcacatattgtagctaatattaacttggaaactaaattgagctaggctaaaaagaaggaacagttgagtttggtttctgacaatatgaagtctacactttctaaaggtttcactgggtgtaataattacatctaatctgaccctttcttaatggtgaatttagagggcttacattaagataattagctagctgttaacagtaggcagtggaggaagtggtgtaagatctgcaaacagaccctcctgtttgctttgtaacttctcagtggggattaaaacagaaaagagggctattattctttaacttgtttctgtagttgctgtgacaaaatgtctgatgggaaagtcagtcagttacttccagcaaggcaacagggtgtcccagtttgtggcactattctattgcttctcacatgctggtagaccaggaaacaaataacacagaactggtaccacatgtagtcataaccatgaaaacctaccactgacaaccttgtgctacctaggccatatcccgaatgttaaaccctctccctaagtgtggcccagtattaaaacccaggagaagtcatctctctctgtctgaacctcccatgcactgggtaacaggtgtgtcatgttataaacacacacacacatacacacacacactttttatatactctgtgtgtgtctctgtgtgtgtgtgtgtgtgtgcgcgtgtatgtgtgttcatactaaagcattttcagacaatgtgtaaatcagggtcagcgagatggctaagtagataaaggtacttgtcaccatgacaaacatcttgaacttgatacctgagactgaaatagtggaaggagaagactgactcctattagttatcatttgatacccacaattcaccttccttgaattgccttcctctacttcccatatcaattatgaacagggtgtccttgaactgacaaagacaatcctgcctgatttgtgggttcatgaattaaaggtgtgcccagcataccgagtctctattgtgcacaccctgcctattagtcctttggacttcaataggtaaaatgtgaaggctaaggcctgggtcccggaagttaacaattatcctaagactgactacttacttccccttatgattcttttaatcgttttcatatcaaacatattcactgtaggagctagaaaagggggttgaggagtttttaacatgttttgttcttgcatagcacctgggtttgatttgtaatacataaccgtttgctcacaaaattctggaacaccaagtccatgagatgaaataacctcttctgatgtctgtgggacacacacacacatgggacacagaaagaatacacatgcaaagcattcacacacttaaagtcagtcgatctaagaagagaaacacaagtattggttgcttccatgttgactgtacctaattccaggagcctgtattatttactttttgtcattttatgaattcttctcactgtgttacaaacatgcccatttttttggtttctttcttgttgtttccatagtctaatttcctaacacttacattttaacacagtggttctcaacctatctgtcatgaccaattggaggaggtgcacagaacaggctcacacaagttgcctaagaaagtctgaaaacactgataggacattacaactgataacattatcaaacctacagttatggagcagcaacaaaaacaattttatggttgggagtcaccacaacatgaggaactctattaaagaaagggtcacagcattagggaggtagggaagcactacctaatacagagcctgacaaggagtgaggatatgaaggagatgaggggactgttcaagctaggtttctcttccctgacactacttgcagtactcaaccacaggcacacacatccaacattttccttcataacaagcaaatatgttacttatcaaatgggggagaattaacattagggatgctttttcttcataagtgttagttattggctctccccaagaacacacataaactccagaactccaaaaacccacaaaatccttttgcatcctcctctgtggtctatgtaaagttttgctagattcttccagcaatgcaaaggtatagagttaactttttgtttggttgtgaaattaactcttttcttttggggtgcatgctttcaaatcaactttacttcttagtaatcatggggtattgacacataaaaaataaaaactgtaattaaacatgaaatattttctaatacgcttatctattttcaaattgctaggatatcatcaagatgtaaaaatatttaggctagactagattaagagaaaatcatgaaatgagaaacaggatattgttcttccgggttgagactaagcttaattcattatgtgccaaattttctccatcttatataagatgatcattaacattgctaaaacctcttttggcattctttctcctccattgctggggggaacaaaatgcacagtttaccattttaaataaatgccagttaaattgccactgctatccttatcatagtacctgtggaactactttatagaaacacattggatcacttagtcacattcaaaaatcattaaaatgtcacttatcagtcacacatcccctcactctagggctagaggttatacagaaacaagtttcctaaactccagtatctcatagtgattaagtagcctcatactgaatatggatgtatctaaataaaatactacaatattttaagtgtttgaatatggcacaaagaatatacatgtatatttcaaaaataagaaaaagaagaacttatatggatgtatatagcaattgactctctgcttctagaaatgctggctaactggggaaggacagttattgtttaactagatgaagaactttcaacatacccttataagaatcaaatagaaaatgctctaatctcttcataaggcaaatttgatgaacataattgctaaatatccacaatttcttctcagtctaaaaacagatgaaagagagaaaccaaagagaggctctcatatatgatcctgaaataggagtgcccaagggtagataaaacttatgggcattctgctgggggtaaaggcactttggagattgctggatcattgaaatatctggacttactaaatggtattctggtctattatcacggtcacatttttaagtcagtctaatgtgtattcatttctgcaaacattactttgtcaaacatcaaacaccttctattatgtgagaactgcactcagtcttcactccctatgtctcttgagtccattctcatattgggccactactacccataaggacttactgctcacttgcaattgatagaaagatccacatctacaatatggttttctctgaatcaccttttccatataaaactgggatagttagactactgctgaattaagacaattcataagaaacttgatttcacagagaagcattttaccttgatacaggaagtatacctgacatcttctgcttttgaacacctaaaaacaacaatgggaggtttgtcagggagccattagaatgcaaatatgcaaccttctttcaacattagatgtgtggctggatctcttgttcatggagaaaaaccccaggctaactatccagtaaactttagggattctctgacaccacctccagtctcaccataagggccccagcatacagcagcacatgagactgtcagacctcatgtggattctgggtatccaaactctcattctcacacatgcatagcaagcactttatccattggatcttcgacctagctatggatccttttgagcatttcatgctgcatgagagatatcatcagtaatttcaacatggtttgctctataaataattattcagcttgtgattatagaaaagtaaagagctgaaattgtcttacacagaggcaaagacagtgtcaggctctgaatttcatattttctacagattaatatattataaaatgcacactacattcttaccacagtgatgttcttcttgtaattttctcattaactacaaaagagggaggcaaaatttgtcattaaacaatggtagccagtgctgaagcaaatatttttgtgacctgatatgctttgacaccatttatgaaaagcttttaagatgaatattgatttgtaagcaacaaatatactagaactcttcctttcttcattcttgtatttttaaaataaaaaaagaaaattttatctaaagttactatttataattaattgtgcaaaatacccacaatcctgagccctatcagacacaaaaagtgtcatcttagcctgaagtgttattccacagtgaattgtgttgccattgctgctttctgtctctgccctagggatgctgacacaactctaagtgagcgaactcatcttggacagaagtgaagggacttctccaagtattgacttgaacttccttcactgaggggaaatatccattcctacaacagggaagctcagtctatggctatgcaacatagccaaatacaggagacccaaagccctttgcaaaggatttccagctgcaagtgtgataaagctctagagagatcagtgtgttactctactctagatcttctgaggaagatcctaaaggccctcagttctagcactggtccctagctcatgtgcaatgcaaagaagctcagcatcaacttccattgcttcccatggcatgagctgctggaaagaccccttagtagctatgcaaactgaagtattactccagagagaagcatggaagacacaatgaagcagtaattccaagggactaatgcctcgcatgaaacgtttttttatttatttctgcatataaaccattgagtgactcaggtttcactatatggaaaaagcctgctcagcaaacaagctaacaaataaacaattcttgtttacttcctttgcaatatgtaaaactccacagtaccctgctggacattgcccatggccagagcacagcctttgtcccaaacaagaaatgggctgagaaagtgaacctctggaggaccttatgctacacatgtatggggcctctgtcaatccttatcaccagaagaaaactctaatgctaaaataacttaaaagaaactcacccacattacactaatagtatttcatcctatgcttatgtgaagagagccatttagattcctctacactattctctggctggtgttttccaaaggcaaagtaggtgcgagagatgctgtggtgacagttgctgaaagcataaactgtgtggtatttctcccactgtgagaatcatattcagactgaaccaatgggcccttccatgctatgcactacaggatgataggattttctcaaccttcctcctactgtggcagttttttctgcaaattatgtcttgtagcatgtaaaccaagtatcactatatatttggtaactaatagaactacagggaaaatgtgctgtcagagtagcccatatggaggctgttgcatagaatactgagaatggcagttctcattccacagcactaccaacaaaactcacacaccagtcagttttttaaaagttcctattgagccagttatttattgtatcaggatattcacattaaatggaagacaaataaaaataaccagaagacaatgtataaattatcgaatgagtggaaattcagaaattctaggatggaaaaaaatccagagtgcccttatgacattaagtcctcaaaatacagtgaaagtaatttaatactctatttttgtttgcttaacataaccacattttatggacaccgatacacatacaacaacatgcagtcagtaacatatatcaattataaaacttaagtaaaaattcatttcataccaaagtcaacttgctgttatgtaactagagaggatctacattgtagaataggtgaaaaatctttttacttctaaaaagacactacatgcatcagtagttcattttaaataaacaaacatatttcaggtgatacaatttgaatttgaaatttctttgaaacaattcctaaataaacctgaatcctaaaaatgtttggcagcaaattaagaaaggctataactactattggcatatttgatttccttagtttctattctagcaggaacaaaattctttttatgattgggatagaatcaatagagtacttactcttaaacttacctgtattatactggacagtgtttttcaagatagatttaagctgtcttggtggtcttgcttcactgtggcatattttaagaatgttattttaatattcatataaaaattaatcaaagactttgaatactttgttgtttgatttcccaatttatgctacattacaaaccaataaaatctattaacttgttcttcaactagttgattacatttggggacactttccttacaacttctcctcatatgggagaagttagcatacaaaatatagccctacaaaaccactcacagatacagacaagcatgcgtgcacacatgcatacacactagtacctcttcagcctttattttaacagcttacagattttttgtttttaatgtattcactcaatttcagtctttgctcctggaagggcaaagtacttctctcatgatactttgtgcatatttcattgattatgatgttaccacacaagaggatgctttgtgcatcatcaagtagatttctagaactctaaacaacccaccacagcgttcataatgttcaagctgctccttctgttctcatgtatgactgagtcctgatatcgtagtctgcttgtttctattccaaacaagcatttctaggaacataataagatagtaacaagaacaaagaacaataaaatttagttgacacttgcagttttactgtggaaccgtttaggattccaaatagaagtcaacatgtgtatttttcaaggagtttctgaagagttttaagtactgaagatttttgaatcttcactttcaacattacctttgatgattttgggaattttcaaacatggattcagtaagctatttaataatgttttgaaaatgtttgttgatacatagcacaaataaagaggacaatataattgtcctctcttgtggaagtaatgaatcctaatgagcacagaattaccttgaaatacaacttttcattttctatcaaaccagtgtctaacctagcatcctggacaggagtggatgggccttcaactctatggtcatgtctaactgatgtggaagacaaatgccccctttatagagagataattattagttacactgtcattcagataatcaattgagagtcaaaggaatcattccggtggaaaacagatcatgtgaacagatcattgatggatggaacattctggaagacatgggtgtcttctaacagctatgaaagatgctacacctgacaaaaaaggtcctttgcatgtaaagtaaagctctgtcagaagtggaaagaaattttttggcatcctgtagtgatgactgacaactgagaatcatcctaaattatgtaaacactcagacaagagaaatgcctgaaatgatagctcctagtgtgggtcttagttcacgaactgaatccagtaaggctttgaaaaaccagtgaatcttagatggacatccatatgcatagctaatcccagcaggctctttttccaaacttcagagttggttcttggaaatggtgggtgactatcgtgttcatgttcctatgaactacactgagcaagtttccaagctaaaaaatatattcataatattgtgggacttgtaagacacaggtctcaaagtactcacaacaagaatttgcttcttatttttgaatttacctactactaatgaattgttaaaccttaccaggacaaaggcctttcctctttaaagtataagacttctgaaaagaaaaacaaaatatatcttattacaactatagaaaaacattacatataaaaatgatcagaatcattgttagtatcaatttctatgagaccaatctagggactattcaagagtaaatatccacttttagcaaattactttgcatagaaatattcattccctgtatatttcaaattgaagacgacaataatttatcaaacattaatgcctaacaatatacacacatacacatttgtaatgatcctaaatgaactctcacagtctgatagcgaggacaatcctgaccagaataaacaactgtttcaaaaataacttcttgtgattctttttaactctgggctaatggttctggaaagaattatagattgagtctggtggcacacaatttgaatctcaacacttaggaggcaaaagcagatggagaaactgtgactccctggacaaacagagctatatttagtgagaccgtgtctcaacccctcccctaaaaagagtaaagtccagagctgatcttaaagatgttctcccctgagtgccagtctttggctacaattaaacccacattaagcaggcctgctgcagcaggaacatccactgctctgcccagtttcctagagacatacactgtcacctgatttccaatgtccaggcaaaggtagcccacctcaggacgcctgtgacagaaactacccgggataaccagttggctaaaggccaacataagaacacaatcaaagagaactaaatcaatatgacatatccacagcccaggtattctactatagcaagctctggatatcctaacacaatcaaagcacagtaaaatgtctttaaatccagtcttatgaagatgatagaggcctttaaatggggaaattaataaatcccttaaatatacaggaaatagaatcaaacaggtgaagaaaatgaataaaacaatccaatatctgcaaatggtaaatgaagcagtaaagaaaatacaaactcagggaaccttggagatggaaaacctaagaaggacaacagagacagaagcacagccaacagagcaaaaataatggaagagatgatctcaggcatagatgatataacaaaagaaaatgttaaacctaaaacaatttctgactcaaagtattcaggtaatctgtgacactctaaaaaaatctttttatgaataatgggaataaacaacaagtcaagagactaccagctcgaaggacaaggaaatattttcaacaaaatcataaaagaaaattcacccaaactaaagaaagaatgcctaataacgtagaaaaagcttacaaaacaccaacttcattggtgttctcaacacataatcatcttccctccacatacatcaaaataacaggaattaacaatcattggttattggtagctctcaacaccagtaaagtcattttccacaataaaaagatataagctgacagactggatatgaagtcagcatctatcattctgcttcatgcaagaaacataccttggcaaacatacagagatattacctaagaatgaaggactgtaaaaagttttcctaagaaaaggtactcaggatgaaagctaaggagcaattgtaatatctaaataaaagagactttcaaccaaaatgaatcaaaagagatagggaaggatatttcacactcatcaaagaaaaacacaccaagatgacttctcaattctgaatccccacatttacaacttaaatcctacttttaaaggtgctaatggggtttgagggccacaaagctagcagtgcacaagcagtagaacagatgagacagtgttctttctgcctccatctgcacccaggagctggggctgttccacagccctctgtgcatgggccctgccagggtgagctggtctcccagaagtgctgacacagacttacaggcccacaggagggacaagctcaacccagagacagcaagaccaactaacaccccagataaccagatggcaaaaggcaagcccaagtacctaaccaacagaaaaaaagctacatggcatcatcaggatccagttctcacacaagagcaagtcctggataccccaacataccggaaaagcaagatttggattgaaaatcacatctcaggatgctgttagaggactttcaggaggaaataaataagtcccttaaagaaatacaagagaacatcggaaaacaggtaaaagaacttaaagaaaaaacacaaaattcccttaaatcattacatggaaacaaacaaacaggcaaaggaattgaacaaaaccacccaggatccaaaaatagaagtagaaacaaaaaaagataccacaaagggagacagctctggagatagaaaacctaggaaagaggtcaggagttatagatgcaagcatcaccaacaaaatacaagagatagaagggagaatctcaggtgcagaagaccatagaaatcattaacacaacagtcaaagacaatgcaaaatgcaaaacaaaacaacaacaacaacaacaacaacaacaacaacaacaacaacaaaactcctaagccaaaacatccaggaaatccaggaaaaaatgagaagaccacacctaaggataataggtatagaatagagtgaagacccccaatttaaagggccagtaaatatcttcaacaaaactatagaagaaaacttacgtaatcaaaagaaagagatgaccatggacatacaagaagcctacagaactccaagtagattggaccagaaaaaaaaattccacctgtcatataataatcaaaacaccaaatgcataaaacaaagaaagaatattaaaagcagtaagggaaaatggtcaagtaatatataaatgcataactatcagaattacaccagacttctcgccaaagaatatgaaagccacaagatcctgggcttatgtcatatagaccctaagagaacacaaatgccagcccagggtacaatacccaataaaaatctcaattcccatagattgagaaaccaaggtattccatgacaaaaccacatttacagaatatgattccataaatccagtccttcaaaggatgataaatcccagaagatggagagatctaccatgctcattggcaggattaatatagtcaaaatggctatcctgcctaaagcaatctacagattcaatgcaatccccatcaaaattccaactgaaatcttcactgagttagaaaaagcaatttgcaaattcacctagaataacaaaaaacctaggatagcaaaaagtcttctcagtgataaaagaatctctggtggaatcaccatgcctgacctaaagctgtactacagaacaattgtgataaaaactgcctggtactgggatagcgacagacaggtagaccaatggaatagaactaaagacctagaaatgaacccaaacacctatggccactggatctttgacattggagctaaaaccatccagtggaaaaaagacagcattttcaacaaatgatgctggcgcaactggctcttatcatgtagaaaaatgcaaattgatccattctagtctccttatctcctcaagtctaagtggatcaaggaactccacataaaaccagagacactgaaacttatagaggagaaagtggggaaaagcatcgaagatatgggcacagggggaaaaaattcctcaataggacagcaatggcttgtgctgtaagtttgagaattgacaaatgggacctcataaaattgctaagcttctgtaaggcaaaagacactgtcaataggacaaaacagcaatcaacagattgggaaaagatctttactaattctacagctgatagagggctagtatccaatgtatactaagaactcaagatgttagactcctgagaaccgttcagaatggctaagatcagaaactcaggggagagcagttgttggtgaggatgtgaagaaagaggaacattccaccattgctggtgggattgaaaactggtacacccactctggaaatcagtttggtgattcctcagaaaattggacatagtactaatcagaggactcagcaatatcactcctgtgtatatacacagaagatgctccaactcataatagggacacattctccattacattcatagcagccttatttatagtagtcagaagctggaaagaacccagatgtccttcaaaagagaaatggatacacaaagtgtggtacatttacacaatggactactactcagccattaaaaagggtgaattcatgaagttcttagtcaaatgaatggaactagtaaatattatcctgagtgaggtaacccaatcacaaaagaacacacatggtatgtactcactgataagtggatattagcctagaagttcagaatacccaagatacaattcacagaatacatgaagctcaagaataatgaagaccactgtgtgactatcagttcttcttagaagagggatcaaaatacccatgggaggagatacagagacaatgtttggagcagaacctgaaggaaacgccatccagttactgtcccatcagggaatccagcccatatacaattaccaaacccagacactattgtggatgccaacaagtgcttgctgacaggagcctgatagagctgcccctgagaggctctgcagtgtctgacaaatacagaggtaaatgcacacaaccaaccattggactgagcacagggtctccaatggaggagctaagaaaggacacaaggagctgaaggagttggcagctccataggaggaacaacaatatgaaccaaccagtaactccagagctcccagggactaaaccaccaaccaaatagtacacatggtgggactcatggctccagccgcatatgtaacagagaatggacttgtgggacatcaaggagaggagaggcccttgggcttgtgatgggccccagtgtaggggaatgccaggacagggaagcagtagtcggtgggttagtgggcagggggaggagggatgggattggggtggtggtggtggaggggaaatgaggaaagaggataaagtttgaaatgcagataaagaaaataaataagtaaattcaaaaaataatgtgaatgactgaaaacaattagattaaattaaaaaaatacataagaattatagtccggagacacagctcaacagttaagcacacccagtgctcttccagaggactgcagttcagttctcagtactgtctctaaaactccaactctaggagaatgccttcctctggcttcaagggtcacatgtgcacatagaatttttaaaataaaaattattctttaaaaatggcaaaagagaatgtggtatgtgtatacaatgaaattctattcaactattaatagtaaagacataatgaattttgcaggcagaaggatagaacttgagattatcatcctgaatgaagtaacccagatccgaaacatggatggtttgtattcacttataaatggatattagtaataaattacaggataaccataccatattccacagaccaaaaggagataaacaaggggtaaggaccaaacaaagttgtttgaacctgacttagaacagagaataaaatagtcataggagcaaaatggaaggagagaactaggtgggagtggggatggtcagggaaatggggtgtttcagtatcagatgtacggagacacaggggagatgacctgatgtccatgagaatgaagggatatccgcaggtggcaggggttggggtttgggacataattcacatgcttgtcacattgcatggtgaaaaaaaaaactttgataaaatcaaacaccccttcatgttgaaagtcttggagatttcagtgataaaatttgcacatctaaccaaaatatgacaagtcaatagccaacaacttaaatggagagaaacgtaagagactaaacaacgctgcccacatacataagagacctcaaacaatctaccaaagaatgcctacaccaaaggtgataaacacctacagcaaaatgactgaataaaaaaaattgacccaaagaaatcagtagccctcctttatacaaaagataaaagggacaagaaatgaaacctttcacaatagccacagatgatctaaaatatctcagtataactctaaccaacctactgaaagacatgtctaccaaaaacttcaattccctgaaaaagaagttgaagaaaacatctgaagatggaaagatctcctgtgctcatggatggacaggattaacatggtgaaaatagccactttaccaaaaccatcttcccaccaagtacatttcccaccaaaattccaacacaacattacttacagaatgagaaacagcaattcttagcttcctatcaaaaacaaaaaatgcaagatgactatatataataaaataattcctggatgtatcatcatacctagtctcaagacgtaccacagagcaatcagaataaaaactgcatggtatacctatggaaatgaacaagttggtctgtggaatcaaatcgaagacccagaaataagtcacacacccaccaacacttgattttgacataaaagtcatacaatggaaaaaaagaaagaaaatatcttcaacaaatgttgcaggtctaactggacgtctacaagaggatgaatgcatatagacctatatttatcccccagcacaaaacttgagttcacaggcaccaaagacctctagaccactaaaccagatacactaaatttgctaggagacaaggtgggaaatatccttgatacattggttcagtagacaattttctgaacagaacaccaatgtctcaggctctaagatcaatacttgaaacatagggactcatgaaactgaaaaacttctgcaagacaaaggacattgtcaataggaaaaaatggaagcctacatattgggaaaagatacccaccaaccctacacttgagagagaactaaagtccaaaatatataaagaacacaagaagttagaaactcataaatcaatttaaaaatggggtaaatagctaaacagagaattcaacagaggaatctcagaagtttgagaaacacctgaatgttcaaagtcttcagtcctcagtgaaatgaaaatcagaaggactcgaagaatccaccttacaccagtcagaatggctaaaatcaaaacctggagtgacagcacaagctggtaagaatattgggcaaggggaacactcttctattgctggtgggagggcacatgtttacaaccccttttgaaaagtaatttgggggacacccccaaggaaccacacaggattccccatgggatcctaagacctctggtgagtggaacacagtgtctgctccaatccaatcgctcgggacctgagactgcattaattaaggaaggagataacccggcctgatcagggacacaagtcccttccggttcactccagcagtggagttccttgtgcgcggagtttctggacacccccaaggtcctcacaggaccctccatgggatcttaagacttctgatgagtggaacacaactcctgccaggaggcagtttcgaacaccagatatctggacacctgcaatgcaagaggagagcttgcctgcagagagtactctgaccactgaaactaaggatagagctagtctcccagatctgctgatagaggctaaaataatcacctgaggaacaagctctaaccagagacaactataacaactagctccagagaataccagatggtgaaaggcaaacgaaagaatcctactaacagaaatcaagaccactcaccatcatcagaacgcaagggcgaaatcaaccaagtgtaaacaagaagaactattcaaagaattaatcaaatgaggagttggttctttgagaaaatcaacaagatagataaacccttagctagactcactagagggcacagggacagcatcctaattaacaaaatcagaaatgaaaatgaaaagggagacataacaacagatcctgaagaaatctaaaacaccatcagctccttctacaaaaggctatacccaacaaaactggaaaacctggacgaaatggacaaatttctagacagataccaggtaccaaaattaaatcaggatcaagttaacgatataaacagacccatatcccctaaagaaatagaagcagtcattaatagtctcccagcaaaaaaaaaagaacaggaccagatgggtttagtgcagagttctatcagacctttaaagaagatctaatccagttctgcacaaactattccacaaaatagaagtagaagatactctacccaactcattctatgaagccacaattactctgatacctaaaccacagaaagatccaacaaagatagagaacttcagaccaatttcccttatgaatatcgatgtaaaaatactcaataaaattctcgctgactgaatccaagaacacattaaagcaatcatccatcctgaccaagtaggttttattccagggatccagggatggtttaatatacagaaatccatcaacgtaatccattataaaaacaaattcaaagacaaaaaccccatgatcatctcgttagatgcagaaaaagcatttgacaagatccaacacccattcatgataaaagtcttggaaagatcaggaattcaaggcccacacttaaacatgataaaagcaatctacagcaaaccagtaaccaacatcaaagtaaatggtgagaagctagaagcaatcccactaaaatcagggactagacaaggctgcccactttctccctacctcttcaacatagtacttgaagtcctagccagagtgattcgacaacaaaaggagatcaagtggatacaaattggaaaagatgaagtcaaaatatcactctttgcagatgatatgatagtatatataagtgaccctaaaaattccaccagagaacgcctaaaactgataaacagcttcggtgaagtagctggatataaaattaactcaaaaaagtcaatggcctttctctacacaaaggataaataggctgagaaagaaattagggaaacaacacccttctcagtagtcacaattaatataaaataccttggcgtgactctaactaaggaaatgaaagatctgtatgataagaactgcaagtccctgaagaaagaaattaaagaagatctcagaagatggaaagatctcccatactcatggattggcaggataacattgtaaaaatggttatcttgccaaaagcaatctacagattcaaagcaatccccatcaaaattccaactcaattatcaacgaatcagaaagaggaatctgcaaattcatctggaataacaaaaaacctaggatagaaaaaactcttctcaaggatgaaggaacctctggtggaatcaccatgcctaacctaaagctttactacagagcaactgtgataaaaactgcatggtactggtatagagacagacaagtagaccaatggaatagaattgaatacccagaaatgaacccacacacctatggtcacttgatcttcgacaagggagctaaaaccatcaagtagaagaaagacagcattttcaacaaatggtgctgggacaactggttgttaacatgtagaagaatgcaaatcgatccattcctatctccttgtactaaggtcaaatctaagtggatcaaggaactccacataaaaccagagacactgaaacttatagaggagaaagtggggaaaagccttgaagatatggccacaggggaaaaatttctgaatagaacaggcttgtgctataagatcgagaattgacaaatgggacctcatgaaactgcaaagcttctgtaagacaaaagacaccatcaataagacaaaaaggccaccaacagattgggaaaggaccattacctctcctaaatcagataggggactaatatccaatatatataaagaactcaagaaggtggactccagaaaatcaaataaccccattaaaaaatggaactcagagctgaacaaagaattctcacctgaggaatactgaatggctgagaagcacctgaaaaaatgctcagcatccttaatcatcagagaaatgcaaatcaaaacaaccctgagattccatctcacaccagtcagaatggctaagatcaaaaattcaggtgacagcagatgctggcgtggatgtggagaaagaggaacactcctcctttgttggtgggattgcaagcttgtactaccactctggaaatcagtctggcagttcctcagaaaattggacatagtactaccggagcatagtgcaatacctctcctgggcatatatccagaagatgttccaaccggtaagaaggacacatgctccactatggtcatagcagccttatttataatagccagaagctggaaagtacccagatgcccctcaacagaggaatggatacaaaaaatgtggtacatttacacaatggagtactactcagctattaataagaatgaatttctgaaattcctaggcaaatggatggacctggagggcatcatcctgagtgaggtaacataatcacagaagaactcaaatgatatgtactcactgataagtggatattagcccagaaacttagtatactcgagatataagatacaatttgcaaaacacatgaaactgaagaagaacgaagaccaaagtgtggacactttgcaccttcttagaattggaaacaatcacccatggaaggagtcacagagacaatgtttggagctgagacaaaaggatggaccatctagagactgccatatccagggatccatcccctaattagcctccaaacgatgacaccattgcatacactagcaagcgttggctgaaaggaccctgatatagctgtctcttgtgagactaggccagggcctagcaaacacataagtggatgctcacagtcagctattggatggagcacagggcccccaatggatgagttagagaaagtatccgaggagctaaagaggtctgcaaccctgtaggtgcaacaacattatgaactaactagtaccctggagctcttgactctagctgcatatgtatcaaaagatggcctggtcggccatcactggaaagagaggcccattggacacacaaacgttatatgcccctgtacaggggaatgccagggccaaaaaatgggaatgggtggatagggaagtggtggggagggtatgggggaattttgggatagcattctaaatgtaattgaggaaaatacgtaataataaataaataaaatgataatataaaattagattcttaagtataaaaaaaaagaaaaaaaaaaagaaaagtaatttggcaggttttgttgctgttgttgttgttgttgttttctgaaaattaggaatagttctacctcaagacacagctatatcactcatgggcatatacccaaaagatgttccaccataccatctcaataactgttgctcaactctgttaataaaacctttatttgtcatagccagaaacaggaaacaaccaagatggactttaactgaaaaatagatgaagaaaatgtggtatacctacacagtgaaatatcattccactgcttaaaacaaggaatccatgaaatttgcaggcaaatgggtaggctttgaaaatatcatctggagtgatgtaatccaaacccagaaacacaggcatggtatgtattcacttagaatgagtactttttcagacatagtacaggataatcatgctaagatccacagacttaaagaagctaaaacacgagggcacaaaaggaaaatgcttgattctcactcagaagggaaaataaaatagacattaggatttgatttagggagggaaatttgtgggagatggagagggaactaaggtggggagcaagagtagggtggtatcagggagaagagatacctgaggagaggcacctctgtgatgaaacaaagaccagggactgtgggggctcttaggaatctataggggtgagtcaactagcagcaggtgatatggagccctaagcaatcttctcctgtagccagaagggacttccagtggaaggaggggaagaccaatgccctcacaaaaacatcaacccaaaatttatcctacctacaagatcttcagggattacaatggaacagagattaagggaatcgccacccaataactggcccaatttgagacccacactgtgggagagagccaggctttgacaccattaatgatgttctgctatgcttgtagacaggagcctaggataacacttctaagaggcttcatccagcagaggacggaaacaaatgtacagaaccacagacaaacatcaaggggagtttggagagtcctgtggaagagttggggaaggacattgaactcaaaggagaacattgtgactgaggggtcagggacaccacaagaaaacctacacaatcaagtagcctgggcccatgagggctcacagagattgaaccaccaatcaaagagcatgcatgggctgcacatagaccccctccccatatgtagtagatgtgcagcttggtcttcatgtgggttctctataaactgaagggaggaccgcttcacactgttgtctgcatttggattcctttctgctagttgagctgccttttctggactcagtgggaaagaagcttaatctctactcttctttagggtaataggactggctactatataccatatttatattcactataaaaaccttaccttcattgaacctgacatgcttcacttcagttctctgagctgacgatccagtactgtgacatagattttaaagttagcattattgtgctattcataagaaaaatatttagcaagtgttttaagtactttatatttgtgtcccttctgtatcttactttagatgtttacaaacaacatttttttgaatcaggatctcactatgtatccatgctggtctgaaaactgctctatggagcatgttggccttaactcacagaaatctgttcatgtcctccttcccaagttctgggatgcaatccatgggccaacaagactagacaaaacgttgaattcacttttcagcaattgactatgattgctgactgctctcctcccaccttttctcaagagaaattatgaggaatacttagctcttaattaaaacacaaacaaaggtgcacgcgcacgcaaacacacaaacacacacacacacacactaaaaagaattaaagacaagatcgggcatgctcagggtggtttggctgtagacacttatggaagtctaaaaggaaggattccaggcctgaaggagataggaactccagagaatgaccaaccaccagaatcaaataacatgaaccctcagggcactcagagatggaacaatgaaacaaagaacaaacatgggttggacggatatctccgagcacctatgtagcagaggggcagctaggtcttcacatgggtcccaatcaactggaatgggggtatcaaaaaaagctgttcatcctacctcagttttattcttctagctgagctactttttctgtcctcagagagagaagaagtgccagggtttggacatacagggagtcccaaactgctcagaggtgaagtggaggaggggcagggagagactgtgggactgggtgaccaggagggggtcactgagctagatgtaaacataagaaaaaaattaaattaaatttttacagaaatcattaaagttttgaaatgtatcttcaatcacagaaagaactgttatttggaaataatggctcaacataaacaacagatatacacgtctactaaacagaaaatttcagcataaacagatgtattccatatggaaaaagcatgtggcattgtaagagcaaactctttcagagctatatattcacagaattcagtacaagatttataacgctaattaaagtagtagactctgcggaaagaaatgaactacttatatatccactatgaaagctccatctgaaatggggaagaaaaatgtcttgaactgccgaatcaccaaagttgctgggtacctgtgctaggacagtttaagaacatctcccagtgaaaggtagttttctgctgacttggacatttcaagactcaaacatcatttggaaacactgcttggtacctgtgattacgtatggtataattctaaagaaatggcttatgctgtcatctttgaggtcacaggttataagttttcagacttagggactgtgggtgtttatcatggtagaacacttgccatagacacctatggctcttaattcagtgacaaacactttcaaaagtaaaaatacaatggctgtggagcagcaaccgatctttgttatcctttggcttggtggatggctcatgaggtgaactcctgaactaggcagtgatccctactgcatgctgttctttgttgtggtgaaactgtctcttttccagctcccacttcatgtgtgctaagcttcctaactatgcctctgagttgcttacaatctctctatcattttaatactcctgacttaagcaattgtcaccctcaagagcagcactaagattgaagaaaggaagaaactgtacctttttgcacactttgctgctaaaaattctaccatttcaggtttctgttcaaatgttgcaagttgcaatggtgtcaagccatactataaaggaaaaaaataatgcattttacaaaactacttgtttctcaacaatctgctcatcaccgattttgtgaagataagtagacaagagtcacaagggatcattcatcctacaacacctgctgaactttcccacacacagctgtcttttccctttgacacaccttttccctgtccaacactgcctataacagggctcccttccagaactctccccaaacactcaaggattgcaatcttcttagctccgtggagtggggcctccattgccacagcccagaatacagagtacactgtgctatgcccctgttgaaggagtgtgctcaggaggggtctggggcagagtttctcaacctgtatttcaaatatatttcttttctaaactaagaatttatctcagaagcttgacagcctctcccatgtacatcaaaactttttaaaccttaaataacttttttggcatattttctccagtgaccaaatttcttcatttgcctgttacctctctcgttttccagtctacccttatcctaagccaaacacatatcagtaccttctttgcatcaacacatttctatttattctacaatcacttaacttgaaatgaatttatttttattgtctgtgcgtatgtgatgtttgtgtggtcctaaatcctttatttttgaattttaaaatcaaggccaattctgagacaaaatacactattttttttgaatggactaccaaaaatatgaaaaaacatatttggtgaaaataaaagtgttccactgaacagatacagtgaaaatgcatgagcttctgtgtgtagaaaatagatgtgcgtgtcactgctagaggtgccctgggaatgaagttgagtgatctttacctctgttttggcttcaatgtctacgttgtgctcaaggagcatttttacaatccttatgttacccctggatatagcatggtggaaggctgtgttcccactggaatctatcagatttggatccgcattgtgggtgagcaatacggaagcacaatccacattgtctcgttgggtggcctgtaaaattgtacaaagaaatacatcttaaattcaaggaagtcaagagagatgttttctaccattgcactgaatagtttccctaaaataaaacatagagttccacttctgcatattatcactctctttagacacaaggtctttcaagaacccccaggcttgcttgcctaactttataatctccccaccacatctctttcccagtggtagagtttaaggattctgccaacacacctagatattctaagaattcaggctctgtgctggttcgttgttgcagtgcagagattagttgtttggttaggttttttgtttgtaggttggttttgtttatttgtttgtttgtttttctttttgccagtgtaacacaggcttaacacacctagaaagattctcacttgaggaaatgcctctatcagactggcctctggttaactatgtggacttttttttttttttttaattttaaattgagatagaagtaggaaagtctaggttttaggagttggggcatgcctgggacaaagtcctcaattttgttaaaaaacaaaaacaacaacaacaacaaaaagtaaacacctgagcaaggcttggtagaagccatggaaaagctgcattctcctgtgaactccagttcagttcttccctccagttcctgatttgagctcctgccctggttccccttgagaatgatctgtgatgtgtaaatgtaagccaaataaccacttcctttcctgagttgtttttggtcagtgttttatcacagcaagagaaaccaaacaaggacaacctctatccatttcatgtcaaaacagatggccaatagctaccttaatcaagggtgtgcagccttcatcatcccggatgttaatgctggaattattttctaataatagtgtcaccacgtctggatggttgtgggcacatgcataatgcagcgaagtcctgcaaatggaaaggacatttagggacattcccaaatgctaaataagagccccatctcctttaagcaccacatactatgaagcaaattttcttctgatgtaagaaaataactggaattgccttatttatttataactactcaaatgttcatttactgtgctagggataatgtgcatggctgtgtccacataaggcaggtgttctctcactaccttcatctttgtacaaagcatcatagaaaagttcccagtaagttcatctcagcatgaattcaaatcctactctaatatctggtactcactagtgactacttgggatttctatgagctccatgactccatttccagatccaaagaatggagattaagcatagctgttatcttacccggggctgctgggaggcttcaggttggatgagcaagtactctgctagaacattacaagcatttacagctcctgagagttcagcatttgctcatcatgataatgatttctcttccttgttataacaaacacaacatttcagtgaaggtaaaacaggattctatcaacagtacacatataaaacttttctagtcaaggaagtttacatgtctttaaaaataactctttttcaccaaccaagtcttgaacatgataatcctcctaactcatcctaaatagtggccagtgacactgggctcactgtcccttttcattcacattttagcctctctaacattggaatgtcattcatcatttctattatttagcaactataattgccaatatttttaactttgtttctctacaaaataaagggttatcatgaaacccattgtgccttacattgaacaaaatatggcacaatccacaggtaaatggcaatgatacagatcacttgtatctatgtaaattcttaaaaacaaacaaaactctaagacatcagccatcaattctttgtttgtttgtttttcatttctacagttcatttttttatgcccatgagtagtgtttccattcctggtagcagggggagcacaacctagtccttaggtaatagatacagtatccatggtaatccaggcactaaatggtagcaaaggaggacctcatgctttgccataaaatggtcaatgtgctcctggactcacaccaaaattgggtcaatatccctacaaggtgataacctatgccatcctagctcctatgcttgatattcaaaaggctataagcacaatgaagcaagggttccaatgagcatacttcagttcatttaacatttaaatttatagaatgtaaggaagcttgactgggcagagaaacataatggtataagactggaaagatctggagagatagcagaatgtgtattctacacagtagatatctaagttatgtgtggggaacgaatgggctgacagaatgaaaaactacagttggacaactcagtgtttttaaagaaaacattcattaagcaaacgaatatcctcaactataatttataatttattcatctattatttatatgaagttccaacttcaagcatctttgaactacaaaatactcaaaaagcttgtggactacagaaagaaaatctacagttgtgtcattgattccccttcataacctagtatgacctaaaaataggaaataagaatgaggggctgggatggttggtaaaactcaattggtaaaacacttgccctggaaacctgaatgcagatgtggcgatatgggaatccccaatccttacttgcttacaagtctgagaattagtgtgctccaagagagtaaatcaaacataccatgggatttgggtgagtgaacatgtctctaaaactgagggaccattgggtggaacccaccaggggccctgatggccagagttcagtccccagaacccacaatgtgacagaagagaactgtcaagtggctatttctctgatcaccccacacttagttccacatgtgtgggacacagaaaagtgagaggaagacaatgtcagtcccttaacatgtgtatcaatgcacaaataacatgtacatatgatgagaaccgggattggtggtggtgggggaatgtatcattgttccagttcaaaatgtctttgatccattataaaaataggtcatattgatctaagatttcatagtgattttttccatttcagttgatgatttatcttatgataaatttttcagtgttgtatattagtgctaatgttctatatattgagacaaatctagacaggcagcttggcagttaacagctctaggtatgttttctagagggctcagctttgattgctagcaccaacatggcagctcacaactgtgtatagctccacttccaggggaccaagtactgattgtgtcacacatggttcaacgaaaatgcacatagaaaaaacctttgtgcgtgcatgtgtgtgtgttgctgtgcatgagtgtcttcaaagatttagtgtaacataaaaataaaatgatgtagtttgatcaaggcctaggacctgttgtttcagggtatgcaggtctcatattactaagagcattaaacacaatgtaggggaccccagtggaaatgaccctaagcatgacatctctcctccattaggatgtggccctgaaagttgatttttctgtttatctctgagtacacctgacagatcccacccacctctgtgtacccccccaccttcaccaatttcaagccccattaccttttcctcctatcagattcatccacatgatgttgactggagtggattaacttctctgttgtatcaaggtcacccacgctggccgctcgttgtaatgggcctataggatcatagccaatcaagtagaggggatatttcttctttttctgaggatgcatgcatctaagacccagacatgaacgccacaggtgagtgtaccagcgtctccttctggggatgttcattgtctgggaatcatagttgatttcttcctccattattggagcctagggtagcccacgaaccttcttccctctcttcccttccctttaactgatatctgactctcaaattctataattaaagaaaaaaaaggcaactcttgtatctaaaaagcaggagagcacaaccagttcagtgtgaagtgaactgtacttcagcaagtagcagcagcacagccctgctagcaccaccacagtgacatgctctgagcacacaatggtgctatctatgatgcgtgtgttctatgcatttcttcctcagagtgcagtggcaggagcccaccctcctgggtgcctgggcaaagcactgtcagttttgactctgcactagatctacgtgcatggccttcaaagggaatactgagggcagataggtgatggtttagatactttgcaaccctgcagccctgccaatatgtggacctaactggcctgatggggcaaaaatgatcatcctgtgttgccaaatccagacccaacaccacaaatatgttatgtggcctcttttaaggatgttagtggttaaggatctgagatgagaactatgatctaaataaccgcacaggattagtatcttgtaaggaaccagtgggagaatgctatctcccaaggaagagcaagtagtgtagagtgttataaagagagacagaaaatctagagcaggagggtttaataagaggcaattgggagagacaggtagaggcatggggtacacccttccacagccctcacctctttcaggctccgttacctgcccctcctattatattcatcaacatgatattgactggagttgatgagtctctccattgtatccaggtcacccttcttggctgcccagggattcctacctgaaaatgtagagggtcagtttcctttggttatacaagcacccacagccctggcatgcaggcctagctaaagtaggaaataaggggagggaccacaaacactaaaggccttttgaaaagctatatggaaatcagctactctagcagcttcctatacatttatgcaagggatccttatggagccaaaaactgacagaggagacaaggctccaactacacatcctgtgccaccaagtcacacctccagtaacaggaatgggttgcaacctgttgagtcattaaccaaagggtcctacattaagcctcaactatcagcacaggctagtgccaagagtattgggtggtctacacaatctgatggttaggactgatttctgaaggtcacctttctgtcatcacagtgcaataggttgagctgggtctaactagactcttcaccctactaaccagagttcataagattggaaggaaacctgttactactggagaacaaaggaaatcctcaatatctgtcagctacaaaccctgaaacctacaataacacctacaaggcagctcacaaccatcttcaaagccaattataggctatccaaatcctcttgcattgtcacaggcccagacatgcccacagtgcacacacatacatgtaggcaagacatacatacacatgaaataaacataatttatctttcagtaataatgggtttacaggtatgtaatatacttatgtttaagttcattctaagaaagaatacaatctagtagtgctttcttagtatgtcattaaaattatgcacccatcactctgttttaaaaacatttttatctttaagaagaaaccctagcaatgtatcgaatcattcctgcatccctggatgaagtgtacttgatcatgatgggtgatgtttttaatgtgctgctgtatttgttttgcaagtcttttcttgagtattttttcatcaatgtttatgaaaggaattggtctgaagttctctttcattgttcagtgcttcttggtttaggtatcagggtgactgttgcttataccatgagtttggcagtgttccttctgtttctattttgtggactagtttgaggagtattagctcttctttgaagttctggtagaattctgcactaaaaccatctggcatctggccctgggcttttcagttgtgagacttttttttttttttagtatagaatggagctcatggggaggggagttaagagggtagcagagtcagagaaaggcagacagaaggagaaagtagagacatagaggctggccatggtcacatggagagagaggggaagggagtgagagagggggggggcacaagagggaagagagaggcaagagagcaagagggtaagagctggttgtgaggcttttaatgcttctacttctttagggattataggactgtttaaatagtttacctggtcttgatttaactttggtaagtggtatctgtctagaaaaagaaagtccatttcattgagactttccaactttgtgaatacaggtctttcaataaaacctattaattcgttgaattttctgattgtctattgttatgtatcctttaacacttctgatttttgtttatttggatactgtctctatgccttttagtttggctaagggtttgtctatcttgttgattttctcaaagaaccagctcttgattttgttgatcctttttgttgttttctttgtgtctaattgattgagttcagtcctgatttggattgtttcctgctgtctactccttttgtgtgcgtttgcctcttttactagagctttcagatgtagttttaaatttttagaatgagggctttctaatttctctagggaggccattagaggtatgaactttcctcttagcagcacttttattgtgcccctgaaatttcaggtatgttgtgctttcattttcattgaattctagaacgtctttaatttctttatttcttccttgacccagagatcattgagtagagttgttcagttcccatgagtgtgtaggctttctggtttttctgttgttattgaagtccacctttaacctactgtgttctgataggatgcaaggggtcatttcaaattttttgtatctgaagaggctttctttgtgaccaatgatatggtcaattttggagaaagttccagaagatgatgagaaaaagttacatgctcttgatttggggtgaaatattctacacataatgcttaggtccatttgattgataacatctgttagttttattatttctccatttagtttttgtctgaatgacctgtagattggtgaaagagaagtgttgaagtctcccattaataatctatggggtttggtgtatgctttaagctttaatagtgttctcttacaaacgtggttgtccttgtgtttgaaacttagatgtacagaattgagatatcatctcagtagatttttcttttgatgagtatgaagcatactcatacagggaagcctgtatgaagtatatgaagtatatgaagtatactcatacattatgaaggatactcatacagggaagcctgtctcttttgattacctttggttaaaagtctataatattagatattagaaggttttcgtcttggtttgactcagcttgatacttaggtctgcttgcttgaaaaattttggttcagcactgcactctgaggtaatgactatctttattgctgatgtgtgtttcttgtatgcactacaatagtgtatcttgttttcacatccattctatttgcttgtgtttgtgtgtgtgtgtttaattagaaaattgagtcgatttatattgagagatattaatgacctgtgattgatagtgcctatttttttttgaagcttaaaaatgaaagctttattttctgagtgctcatgaagttggacatttcatgatctgaactgtatcccggaatggagctgtacaacatttttatagaatggaaacaaaaagcaagggtgggctgttgcattgaccaattttgacataagggcttaagcaaggaaattaacaaggaagttaacattggtgacattcttggccttatctgggtcacgtgtttcagggtccttgatttagcttttgctgtcaggtccccttctggactctggcccagaattttagaatgttaagggaacaaaggagtgggcaaggtacacacatcaattaagtcaagacaggcagcacacttatgacttatgtgccttagtttacataaagggataacagctgtcttccctttttacatcctccactggccatcagacaaacctggaacacttgaaggagcagaacaggaaggagttagcttctggagcctaggaacataaactcagttttgagcctgtcagcaaggtattccaaggagtttctgagatgactggactcaggaaactgtctcctaacagggtggccacaggctgcatgtaggataaaaggatacatgtaagagccctaagtaacacaacacaatgctgctgaaagctcagaacattctcaaaggtctcagtaagctgaaaaggtaagaaacctcccgaagtttcttgtctcacatacctgcttcccatccccattcctcattgcctctagggcttgcagtctataggcccagcctgggctgccttaggagcatgtggttcaggtctcaccctcgcctcctgggaaggcaggtcacccatgtggcaagctagtggctctgaccttgaatgcctgtgtggtgtttgcctcatgagcccaatctaacaaacatgcttgacaaattgtttcaaagtaaaatgaacccgagtgtccctgtttaaaaacagccttcggtcctttctctaactcctcacttaggacctgggttcagttcaatagttggctgtgagcatcagggttgcagggagtgagggggggggggtgtgcagggaaggaaccaggaagggggataacatgtgaaatgtaaataaaacaattaagcaataaaaaaattaactcaagtcagtaaatcaaataaggagtctcatgaaaaaaaaacaacaataacagcaagcccaccatgtaggcccatccctgactgcagggcctgagagccaggtctggtcattgataattcagttacatagtcctctcccctctgcctttatcaatatttgatggcaggcttcagcatgcttttggtggcaagtccttctggagcccccttctcatgtgacagtgatgcaacataggtctcagcaggagctcacatcacaagtcacctccttcctgaggtcaaggtggcccatgattggctgggcagctgtggctggagccaaggcattatgttgatgaatcctaatgatgtgggaaggccctggcaagccaccatgcaattagaagcctgttcatgtctgggtgggttccagacagaggcagggctaggagcaggcaggagcaggcacatctagggggactgctttgcaggtggatgggggttttacatgggtcatcatctccaagagaaaccctcggagggccatttaattaagtccagcagctgctcagaaaccatagtcacgccagagcagtacatgatgtctctttacaggttacaaggaggagggcactccccactacaatagcacaggtggctgcccgcaccctcggaacaccagcctctgtgaagttcatcactatctgcctccattaaaccgcatctttggcagtgaggcagctctgtctgctgacagggtctgttggtaaataagggtgtagtgacatgttctgattggccagaaatgaatatacaatgtcagtttctgacctcatctcagataaataggagggggcaacaaggcaggagggtcaatttgcggctgctaggtgtctctggtctggattcctagtccagaaataactcagtgccttcaggaggccagacatgctggctgtaccaggagcctacgtaaagggtcacagctgactgtggagcaggcactgttgaactccacagttctttctctgatatagaaatgttccctggcttggagagtcttccgaacttggatttattattctataggaaagaagcctgacattctgttggctcagaccaaggtacttgttttagggccagagacctgagcttacttctcttgatgttggcacccagacctggctcactcacatagatgggagtgccccaagaccttctcaggacacagggagaccctacaagggactccatttcatgctcattaacctggactggccagaccattcacagatggcttgatccattcgctctacctctacctatggtaagttcagcatactgaagagaactggggtttttctcatccactggcagctgtgtgctcctccggatgggcaggtagggtagaagagggagctggcaaaaatcttggagtcaggtgcccttctctggttcttcatgatggtcctgcgacactgtgagtcacttcatgttcttgtgctatttgctcctatttatatttggtttttttttcttttatttttttctttctttcttcttttttccagtggcattatttttttttttgtggtccaatatctattgacaaattcagacagtgcttaataaaactttagttaggtcactgtacaaattcctgataaaatttgcatattcaccttccgtttatttttttgtagaacatgattataatatttacaactgtcaatattcaacattaaagataattttaaagacatattttgttattatgtctccattgtcatttctgattttattaatttggatactgtctctgtgccttcttgttagtctgcctaagtgcttatctatcttgttgatattctcaaagaaccagctcctggtttggttgatactttgtatagatctttttcttttcttttttttttaagatttatttacttattatattatttagtacattgtagctgtcctcagacactccagaagagggcatcagatttcgttatggatggttgtgagccaccatgtggttgctgggatttgaactcaggacctttggaagagcagtcagtgctcttaaccactgagccatcttgccagccctgctccttttcttcctatttggttgatttctgccctgagtttgattcattcctgccttcatctcctgttgggtgtattttcttctttttgttctagagctttcagttgtactgtcaagctgtaagctctcttcagtttcttcatggaggcacttaaagctttgacttttcctcttaaaattgcattctgtgtccaataagttttgttgtgatatgtcttcattttcactaacttctaaaaagcctttaatttcttatttcttccttgaccaagttatcactgagtagagtcttgttcagcttccatgtgtatgtgtgctttctgttttttgttgttgctattgttgttgttgttgttatttaagaccaaccttagtacatggtgatctgatagggtgcatgagattatttcattctttttgtgtctgttgaggcctgttttgtgaccatttatatggtcagttttggagaaggtaccatgaggtactgagaagaaggtatgttcttttgctttaggatgaaatgctctatacatatctgttagaaccatttctactgttagtttcactgtacctctgtttactttctgtttccatcatcagtccattgctaagagtatcccactattattgtgtggggtatgatgtgtgctttgaactttagcaaagtttcttttgtgaatgtagttgcttttgcatcttggagcatagatgttcagaattgagagttcatcttggtggatttttcctttgaccggtatgaagtgtctttccttgtcttttttgataacttttggttaaaaattgattttattcagtattacgatggctaatccatcttctttcttgggaccaattgcttggaaaattgttttccaatattttactctgaggttgtgtctctctttgtcactgaggtgtgtttcctgtaggaagcaaaatgctggatcctgtttctatatctagcctgctcacctatgtcttctggggggaattgagtccatttatggtaagagttattgattaaaagtaattgttacatcctgttatttttgttgttggaggtggaattatgtttctgtggatatcttcttttgggtttgttgaaagattgctttcttgctttttctagggtgtagtttccctcctagttttggagttttccatctattattctttgtacagctggttttatggaaagatatggtgtaaatttggtttgtcatggaatatcttggtttctccatcaatggtatttgagagttctgctggtaaagtagcctaggctggcatttttgttctcttagggactgtatgatatctgcctaggatttttctacctttcagtctctggtgagaagtctggtgtaattctgataggtctgcctttatatgttacttgacatttttcccttactgcttttaatattctgtctttatttagtctatttattgttctaattattatatgacaggaggaatttcttttttggtccaatctatttgcagttctgtcggcttctggtatgttcatgggcatctctttctttaaattagggaagttttctcctataattttgttgaagatatttactggccctttaagttgggaatcttcacattcttctatacctattatccttaagttttgtcttttcattgtgtcctagatttcctggatgttttggattaggaactttttgcattttgcattttctttgactgttgtgtcaatgtttcctattgtctttttctgcacctgagattctcttctctagttcttgtattttgttggtgatgcttgcatctataactcatgacctctttcctaggtgctctatctccaaggttgtctctctttgtgatttctttattgtttctacttccatttttagatcctggatgatggttttgttcaatttcttcccctgtttgttgtattttcctgtaattctttaagggatttttatgtttcctcttaaaggacttctgtttaactgtgttttcctgtatttttaaaggagttacttacatccttcttaaagtcctctatcatcatcatgagatgtgattttaaatcagagacttgcttttgtggtgtgttggggtatccagggctcgctgtagtgggagaactgggttctgatgatgccaagtaggcttggtttctgttgcttatgtttttgcccttgcctcttgacatctggttatctctggcgctagctggtctcactgtctctgactgtgacttgtccctcctgctagcctgtgtgtcagtactcctgggagaccaggtctctctgagaggaatttgggtatgaaaagctgtggcacagtgtcagctcctgggtgcagacagaaaccagaaggacctgtccatggctgttcttccgatcctgtgtcctgagggttctgggcaggtccctccagtcttacctgtgctcacaggtatgtctgcactccagtgctacccacactatccctgcggtatttgactatcagctatgtgcatttctcatggatgattctcaagctgtggggaattcctatggatgattgataggatataggtttttcctcaagatgattgccaggttgggggtgtgccatgtgtataactaacaggctgtagctattttctgtggatggttgataggttatgggcttttcctatgaagactgaaaggttgtgggtatttgctatggataattgacaagctgtaattgttacgtatgcctgataggctgtgggaatgtcctaaggataattgtcatgatctgggtatatcctatgaatgattgaaagtctgtgggaatttcctgtgaatgactaacaagctgtgggtatacattgtgggtaaatgacaggatttgggtactttctatacatgattgacaggctgtggacatttcctatggatgatttgcaggcagcggccatttactatagatgagtgacaggctgtggacatatcctgtggatgactgaaaggctgtgcatgtttcctgtgtgtattgaaaagttgtagatgtgtactatgtatggttggcaggctttgggtatttcctgtgaatgattgacagggtataggcatttcctattgaagattaaccgattgtgggcttgtcctttggacgagtgacagggttggtatgtgtttactgtggatgattgacagtctgtggccaggacatgtggttgaatgacaggctgttggcattgcctatgaatgattgacaggctctgagatatcctaggaaagattgacaggctgtgggtgtttccattggatgactgacaggctataggagtttccaatgcacaaatgacaggctttgaacactttgtatgcaaaactgattagttgtgggcatgtcctatagatgattaacagaccatggccattttttatgcatgattgacaggctgtaggaattttctgtggatgactggcaggctgtgattatttcttctggttgactctcaggatttgtgagttgcttgtagataactgacaggctggggacgtttccagtgaatggttgacaggacttgggcacttcttatggatgactgccagcctgtgggcttttcctatgaataattaacaggctgtggggggttgttgcacagattttgataagctgtgtgtgtcctgtggatgactgacaggctttgggtcttgcataggaatgacctatagatgcaattctacagatctcttgaatctatataaatttttgataacaaatgaaaatctaaaccctaagtcatcattactttgattttttttcatttcttttgttctatgcccatgagtagtgtttccatacctcactaccagcaggagcacaacacactcctaaggtaatagataaagtgtccatggtaatccaggtgctaaatgttagcaaagcaggacctcatgctttgccataaaatcctcagtgtgcccctggaccagtaccaaaattgggtaactatccctacaaagtgataacctatgcttgatattcaaaagactttaagcaaaatgaaactagggttccaaagagtatggctcgttccatttcataatataaatttatagagtgtgttaaacttgactgggaagaggaacataaagatataagaataggaagatctggagagatagtaaaatctacattctacacagtagctatgtaagttatgtgtgggaaataaatggactgacaaaatgaaaaactacagttggacagttcagtgtttttaaagaaaacattcaatgagcaaaagaatatctggaaactaaaatttataatttattcttatattatctatatcaagctccaaagtaaagaataattagccccttagagctacaaaatgatctagaagcaaggggactacagaaaatctacagttgtgtgattggttccccttcataacctagtgcagaataagaataggaataagaataaggggctagggtggtcggtaaaactcaactggtaaaacacttgccctgaaatcctgagtgaagatgtgggatccccaaagcttacttgcctgcaagtctgagagtcagtgtgcttcaagagagtaaatcaaccacaccagggttttgggtgagtgaacatgtctttaaaactgagggacccagaacacataatgtggcagaagagaactgccaagcggcaaatcctctgaccaccacacacttaattcctcatgtgtgggacacaggaaaatgagaggaagacagtgtcagtctctgtccttcacatgtgtatcaatgcacacaccacatgtgcacaaggtgaatatgggggagcagggtcatggttacagttcaaaatgtcttcatttggtccattagccaacacgagacatattgacggaatgtttcttagttatatttttgcattaaagttgacaatagaccttatgataaaactttccgtattatctataacatcgtataagtaacataaatattatggagagatggcttggtagttaagcgatctagttttgtttgtagtgcattgagttttgagtgctattacccacatggcagctcacaactgtccataactccaattccagagcattccccactcaattctaccacatagtgcatagaaaacacatagcagcaaaatactcctctatataaatctacaaaagttaagcatatacaacaaagtaaaatgtatgtagtttctttaactaagtcatgttaaagtatccaatacagtacttcaaaagagacaatgggaaagtatttataaactaactgaattttttggtttcctttccttatagaaggcctaggagctgatgtcttaaagtatgcatgtctaggtgcccaggaccctaaagcaggtaaataatctagtgaggctcagtataaaagagcctaagggaagcagaaaactgccctgaccaggggcacaagttccttccagtcagaaccagcaccctgtcacctagggagcagagttggcagacaccaccatggttgctagaggactctccactcgatcttaggatcattggtgagtggaacacaacatccgttccaatccaatcgtgcgggaccttacacagcagaagggaagtagaaaaccggcctgaccaggggcacaaatcccttctggtcagtgccagcacccagtcacctaggacgtggagtctgtggacagccccacagtccccagaggactctccacgtgatcttaggatcactgactgcatggcaacaccacttccaggcactgtaacacgtgcaggatctcaggacaacaggatctcaggatatcctaaggtgggtcacaccagtatttcagggtctcagaggaagcttgactgccaaaaactctgacacacccagaatctcaggttaacaggagtccacaatcaaaggatcacagagaaagctggactctgaggagtcctgaatcaactgggattataggaaggacatattccaatcagatatactgagggcagcaagcacttgagataatcagatggcaggaggcaagcttaagaacagaagcaacagaaaccaaggttacttggcatcatcagaaccaaactctcccaccgtagcaagtcctggatacaccatcacaccagaaaaacaagacatggatctaaagtcacttctcatgatgatgatggaggactttaagaaggaaatacaggaaaacacaggtaaacagctagaagcctttaaagaggaaatgcaaatacccttagagagttacaggaaacactaacaaacaggtgatggaattgaacaaaaccatccaggatctaaaaataaaagtagaaacaataaaaaacaaaagcacacaaagggagagagctctggagatagaaacactaggaaagaaatcaggaaccatagatgtgagcatcaacaacagaatacaagacagacagaatctcaggtgcagaagattccatagaaaacatgacacaacaatcaaagaaattacaaaatgcaaaaagatgctaattctaaagatcaaggaaatccaggacacagtgagaaaaccaaacctacagataatagtagtagatgagaatgaagattttcaacttaaaggaccagcaaatatcttcaacagaattataaaagaaaacttccctgacctaaaggaagagatgcccatgaacatacaagaagcctacagaactccaaatagattggagcagaaaaagaatttctcctgacacataataatcagaacaacaaatggactaaactaagacagaatattaaaaggagtaagggaaaaaggtctagtaacatataaaggcaggcctattagaattactccagacttctcaccagagaccatgaaagccagaagatcctgaacagttgttatacagacactaatagaacaccaatgccagcccaggttaccatacccaacaaaactctcataaactatgaatggagaaaccaaagtattccatgacaaaaccaaatgcacacaaatccagcccttcaaaggataataatgggaaaacaccaatacaaggacagaaactacgccctaaaaaaagctagaaagtaatccttcaacaaacctaaaagaagacagccccaagaacagaatctcaactctaacaataaaaataacaggaagcaacaattacttttccttaatatctcttaatatcaatggactcaattccccaataaaaagacatagactaacagactgcctacacaaacaggacccaacattttgctgcttacatgaaatccatcacagggaaaaaaaacagacactacctcagagtgcaaggctggaaaacaattttccaagcaaacggtctaaaaaacaagctggagtagccattctaatatcgaataaaatcgacttccaacccaaagttatcaaaaaagacaaggaggggcacttcatactcatcaaaggtaaaattttccaagatgaactctcatttccgaatatctatgctccaaatgcaagggcagccacattcattacagaaactttagtaaagctcacaggacacattgcacctcacacaataatagtgggagagttcaacacccccactctcatcaatggacagatcctggaaacagaaactaaacagagacacattgaaactaacagaagttatgaaagaaatggatttaacagatatctacagaacattttatcctaaaacaaaaggatataccttcctctcagcacctcatggtacctcctccaaaattgaccatataattggtcacaaaacaagcctcaacagataccaaaatattgaaattgtcccatgcatcctatcagatcaccatggactaaggctgatcttcaataacaacataaataattcaaagccagcattcacatggaaactgaataacactctcttcaacgataccttgggcagtgaagaaataaagaaagaaattaaagactttttagagttgaatgaaaatgaagccacaacctacccaaacttatgggacccaatgaaagcactcctgagaggaaaattcatagctttgagtgcctccaaaaagaaactagagagagcacacactagcagcttgacagcacacctaaaagctctagaacaaaaggaagcaaattcacccaagatgggtagagggcaggaaataatcaaactcaggggcaaaaatcaaccaagtaaaaacaagaagaactataggggtttataagtttgttttttctaatgctgggactcaaatccgaagctttgcagactagacaattacccataagctgtgtccccagcccttggcatccgtgcgttttaattctacaaagctactgggaaaaactgagagtctttataagaaaggatcttggggaaactccagaaagatgaactatcgctcattggcgccatgactttgagtgagtaaagagactcttctgggcctccctgtgtttctctataaagcagacgtaggcagcaacacactagaatcagcttccttggagtcctgagagagttaagtgagataatatgtgggtggtggacgctgcggtgtggtgtgccccaacttcggcacattcctcctctccccctctctgtgaccagcctgctgccaggagacagtgttaagctacctgctacagaaaacttccggaagtttgagttgcacctccttccgaaggagcctgtggcagtgatggagcagtgaaagagtgtgaaagcctgccctaaactcaggctacccagagatctttgaggctgtctgggctcttgcttgatgctatgctgagtcacagctaagcctctgcttcttcccacccctggtagctgctgattgcttccccggggtgtggctcccaaacatcccccccttgctcacttgcaaactcccaccatgcccatctagctgctgcaaggacaacacaggctgacattgagagctgagacaaggctggggcacataaggatcactgtttttaactgtgtcttgtcggacccaaagtgagataaaacagagctcagggggcctccgagtcttggaatcaagtaatgtctggatccaagtttgccttagaagtgaagacttctgggaaggtcttagaacagtggttctaaggtcccaacctgtgggttgcaccccttatgcccctctcccccaaccccaacgccatcatatatcaggcaacaggagttgcctaagaccatcctgcatatcagatatttacattttgactcaaaacagtgggacaattacaattatgaagtagcaacaaaaataattttattgttggcagggaagggtcgtcacaaggtgaagaactgtattaaagggtcatagcattaggaaggttgaggagcacgggcctaggctaagtggatgaagcagagcctgggggtgtgctgcctcctcaggagagccctgcccaactccctgatatggacagaatggagatagacctgagggcagctctgctcctcttggcccggaaaccatcccacatagactggtgaaaaggaagactgtgtgacttcctgtctcacttctttctacatgtgtatttttcccatttattctcccactctcactcatgcatacaaactcatgcacgtgaaggtcagttctctctctcctctcctcttctctctctctctctctctctctctctctctctctctctctctctctgccatgtgagttccaggaatcaaactcaggtcatcagactcagcagcagagcgccttgaccaactgagccatcctgctggtcccctgaagtttccagtttaatatgaactctccagatgacctatgctcctacagttcagtgcagtcctagagcaagaacagcttggggaggcggagaggcaagacttagagcagatgtcaagaacagctcctagccacaggggcaggatgtgaagcttccaatgaaactttccagtgctcagcttctacaaaagtatctgtagcattgtgtgtaggagagaataaatgtaacaacaacagcaacaaagggtagagaggtagaaccactgctgcattgacagacacaaatgagcaggagattccagaaaaaaatgtaggtgatttgtttgggcaggaacttgtacaacatgagaacagtcttgagaggaagtcatgaaattatggattctgtccctgagtcccagaccaaagagtttaaattttttctctgacaatgacagtacatttgcaggcactctgaaacacaaagtatcatttggatgatgaagccacaacctcacctttggacaaggtgccttgcttgattgggctgatcagccagaaggcaaagaccagtgtcttctcttctaagtgaaagccagaacacacacacaggtttggggaagccagaaggcccccagttggaagaaggcaagaagctggaactgttttcccccaagcagctgtggcgtacgagcacttggatttggtttgattatttaaatagaatgtgcctctctctgtctctccttgttttatatcaacatctgaggtggccacaacagtatccaaattacccaggtacttgctctgcaaacagcagactttcagccatgagccacagctggaaagcccgtcttgatgtggaattctcagctgtaaaagaatccagatgttctaagatgatttgggggggatgccaaaaggatgccagatttttacaaagacctgccaagtcttgatgtgtgctccttaggaaccattctggaagagatgctgggaagtgcacccccccgccactccccctccaccccctcccccaagcaagatattcgtgagaaagggaggaagacagagttgggtggacagaggagctgagcctcaatgttgtagccactgaggtctaagccagttctacaggagctggggaggctccaaactgtgaggagggggtccttagtaccacctgtgtcagctttactcactacaggctctcatctaagacagtggttggagttttaacacagctcctcctgttgtgaggactctcaaccataaaattatcttgttgcggttctctcgacagctgtccctctttataagttggcactccgtaaggatgaagccatgttcagctccagtgacaagactgtgaagccaaatggggagaagccggatgagttccaagtctggcatctctcaggtgctgcttgagctggagatgaacgcagatgtcaaggctctgctgcaggaagtcaacatcaccacaaccaaggaaattgaagttggtggtggtcggaaagctaccataatttttgtaccagttcctcagctttaagtctttccagaaaattcatgtcaggctagttcgtgaattggagaaaaaattcagtgggaagcaagtagtgttcattgctcagaggaggattctgcccaagccaacctggaaaatccgtatgaaaaataagcagaagcgccccagaaaccacaccctgacagtagtgcatgacagcagacttggtcttcccaagtgaaattgtgggtagaggatctgtgtgaaactggatggcagccggctcataaaagttcatttagacaaagcacagcagaacaactaggagcacaaggttggaactttttctggtgtgtacaagaagcccacaggcaaggatgttaattcggaattcccagagtttcagttgtaaagaaaatgactgataaagtgtcattcatagtattagaagtactatcttgttgctgcttcataactgtaaatctgctactgctataaatcataatgtaatatctgatatgcaggatagcagaccccaagaggatcactacccacaggttaagaatctaggattttcaagtgtccactagctgacagcaatgcccaccaaatgactgcctcagctacagagaaatggatacacgcccggagaagggaactggacaaagacccctatcatagctagcttcagttgtcaacttggcacaagcttggagtcccctgaaagggggaaccttaactaaagaactgcccctatcagatcggccagttgtcatgtctgtggaagaaacatttcttaatttctaattggtgcgagagggctcagaccactgtaggcagtgccaaccttgggcacattctcctgggctgtataagaaagctgtcggagtgagccacatagagcaagccagtaaacattcctccatggtctttgtttccattcctgcctctgtgttccagccttgagttcttgcacaagcttcctttgatggtagactgtgacccacaacccaaattaatccttccctctcctaagttgtttttttgatgagtgttttatcacaggaacagaggagcaaactaaagcaccttcaaccattggaaccgctggtcagcctcctgacccaggaattctcaaagcacttggactctatagccagtgctggattcaaggatagacccacgcaggagagaacactgctacatctagcatggctctggggacatggccctgactggggtggcaagagaatgaaaaacacaaacaaatccagaagcagaaaagccaaggttgggtggtctgagctctcagttgaagaaacttcagcacataatggaaacatgtttttattatataaacagagaggcagggtgagtgcatatggctgaacaaggaagtggggttagtaggtacagataaacaaaggagacagggtgtatggtatacagctggatcaagtagacaggtttacctaatcttagtaggaatggtctttataggggaacagtcttcagactataaatatccagggagagaaagctacagtggacatttcctgtgcacactctcaatatctacatttggtccagaggaaggctttgccattttcctctgagcctctccccttagaggagacattgccattttctccataggtctgagattctgaggtctgtgacaacatgtctttatctgatgtcaacaatacacattcactgagactctaggctttctccgccacttcttacatgatacctagttcaattcactaagtatggcctctgatgtcttctggatcagaaaggacatccaaagtgaggagttgactgttagatcatgcgacccggaacctacgagcagccacaaaacccagctagaagcccaacagtctctagagcagtggtcctcaaccttcctaatgctgtagccttttaatacagttcctcatgttgtggtgacccccagccataacattattttattactacttcatacagtacatttgctgctgttatgaatcacaatgtaaatatctggtatgtatgcaggatatctgatatgtgacccccaacggggtcgagaacaggttgagaaccactgctttaaagggctaactctgccatataggagccaggaggagcaacctatctgaataaatggttctcagtcagtgtatgatgacacacattgtcatggcttccttgagtgctctctcccagacaagcttaagctagctagttcctagattttcataggttagcacagaccaggggtggggtcatacactcagatgctcaaaggaaccaggtgaccatcacagtgagaaaacatatactcacttctggagaggacacttgagactcagccccaaacagtagcatcacaatgggaactgggtccccatgaggacaatgttgtccagtaaactggaaacccaagtttctgtattaaacttcttggtcttgaaatgtcaaaaacaatttgaatattttcaacacttcataagctacacaaagttcatctgtgagtgtgtgctttttgttcttggaatattagtgcgtgacttcgggcatccatcactccacaccaagtgaatgggataaaatagaccacgtattgaccaatatgggtagactatcctgtatttgatagtcctgagttggaaagtctagattctaatggattatccagtattggtagtcataaattggacagtgtggctccagtattctcaatcggaagtcccatttagtggatatttgttcaactttagaaatatatgctagtatccaaatcttgggagtgaagtatctcactggccaaatgaccagtgcttgtgtgtggtgtgcatgtgtgtggaggctggaggacagctcagatttcactcctcaagcaccgcccacttcattttaagagcggatcccccagtggtgtacctaatcagtgagctaggcaggccagtcagcaagccccagggatccacctgaccctgactccccagtgaataaccaaatggagatgatttcatacagatgcaactccttacactgtgggaagccgcaaacaccattataagatggcgctggctaccactggccaccacccatgattatggataaacaaccaatgtaagcatgtgcataagagttttttgctgagtcactgcctggcccgacacatattaatgaggtactggtagcataaccaatcaggtatggacacgtcactcgtgggcctatataagcagcgccatttctggggctcggggtcttttgcctactcagtccatgctctcccaataaacgtgttgcagaaggatcctgttgtggcgtcttacttctaggcaagtcgggcgtcccacattacaccaggtcatggtgtgtcagaagaggaggccagggacccagaattgccatgcaatttgtccaaggtccacagcaggcaggcagccaagctgggcttcaccctcaggtctccttgactccacattcacggttgtttattcttcctcacatcgttttcaaacgaggttgcacaacaaaacggtttgagcagctgacagcccaactgctatggggaccaacagacaagagaacttgaacttgtttgtaaaacatccaacccgccacttccacgacctccccaccccgctgcccagcacaggaaagagaggacagagctcagcaaacacagctttctggcattcccctgaggctgctggccatcagccacaagcaaagcactgccaggggactcgggaaacctcttgggattgagcattttgaaagtacccattgctgccctccagtgtccccattaagaaggtcagcctcttctagcctttggtatcagtagttcaaaaggaaagagaaaatacatgtgggaaacaaagaaagagcaggcagagcttgctttattcatttatttattttcactaagttggattacactgggggaggagggaaggttgtgtatgtatgtggcttgaagccacccagtgctgtcctctaggggtggattctatatcacagccactagtcacagcaatttgaatttaaatgttaattaaaattaaactaaaatctggtctcaggttctgagcgctctggccacaggtaaatggcatctgccatattggcccttgcaaccagagatgacttctttgagacacggaagcacagagagtagttttctcaagatcaacacagctaaaagtaacatgttacaactcagatttgcgtgcatggtcaacagacattcaccatctcttctaagcactttatcaccctacagcattaagtgggggtcccccagatcctgccccttccaaacatagctcaagcccatgttccctgcctatggcaggagctaaggtatttgttgcctgtggctacgccatgggaaggggcagaataaacatggatcttacctctttcatctacaaagaaggtgttgccttgatgttagtcaacatctttgaggggacaaggaaggaagtggagaagatacctttaaaacaaaaccacactgtttaagagaaatttcatatttattgttttgtgctgttttcttgagactcggtcctgttctgtagcccaggctggccttttacctacctgccccagcctcctggactccgagattatacacacacaccatcatgcctagctaagaaaaaacattttatgataacatacaaattaaatagatgcatacttatatgcaggaatgcacatactactagttgtgtgcacccaagtatacacacacacacaaagataaaaacatttagggacacccatgcttgttaatactgacagacagtaccataccacgaacgttttgggaagacagccaagaatgtgtccccaaggcagcacagagctgcatgtctaatggtgctggctttcctgatctgtctctgataaatatcccagttccagaagcatccttgaaggctcattggaggcatacaagaagcctcccaactggctgacagccaagggatgcagacaagagttaggcaagagcaaccagtgctaaaaggtggcccacagatgttagcatcagcaagaatagagaagcaagcccatgaagcaagtctcagtctccccagactaagactgtcacagcttagagccacagctctaagggactaagagccacagcttggccttccaaggtagtgtgagaccccataggaccatcaaaggtccaggtcaaacaccctaagtcccagcagccaaataggttcccagagagagaggaaagcaggacagacagccaggaccggaacacaataggacaatgctaggcatggaacagaagccctgagtggaggaaatgccctatctgtaattgcccccacacaggagaagaagaagaaaaaagcccaagtacaaacggaaagctgggtaaacaaaaggtaccagtttgcattgtatatagcacataatggagtatttcccagcaagttaaaaatccacacagtcactacaaagaagttgcacaggcacaatgctgagaaagaacctgtacacagcggatctgggcctggagaccctgtttatacacagctccataactctcaagaagaatcggcatggtccgtctcctgtgcacctctggctgggaaagtgtggatgtggacttggcagggacatcaggcaacttccgggtgattaggaatttattccccccgcccccactgaaccatatatttaagttctataaactcacagtgtgcatgtcactcttcagcgatgtgttttttggttttgtttgttttgcattatcaactctattctttttgttgttgttgtttttccattttcgaggcagcttttctctgtgtagctctggctgtcctcgaactcactttgtagaccaggctggcctcgaactctgaaatccgcctgcctctgcctcccaagtgctgggattaaaggagtgtgccaccacctccaggccagcgatgtgttttaaaagagagggagcctgctcactatcttagccaagtgctatctgaaccaagggcaagaggcctcactgtgcaagtgaacctactggtcttggcctgaagagggcgcagttgttgtgtcgttccctgtttccgatcctgcaggaagtgttccaagacaaacaaacctggctcctacaagaagggagctgtctcatgtttatcccataccccatccatgcctcaaggccaccagagagccctgcttcaggggtacaggagcaaggggcaggtaggacagggtgcacccttggtcattttaaacctctcctctgtccatgtaagaccatacaagtaggacctgcagtaaaagaccctcgatgtctgacacgccccccccatccctcctgagctcccatggaggtgggaggtcccttggttctgagggtcctgggaaaatatttccacaggtagaggggtattagatctgcaagtgatgtgcccaggtttgcataagggacagatcactatggcaaccaggctggagtcttgagagtgagaggacagctaagttttacctcaagactggcctgggttctgaagaagctccaggagagaggtggaggtggggactagagagaggacttcgatcatgagatacttaagagaaaggtttcttataaataatagctgatttctgaagggtggaaaggggaagacattgaatgatagaactgttccaagcagctaaacctgagaacatgccagaaaccagagctggtccataattggagggtccattttggaactgtgtggaaagccatgaactgaatgggcctgacagtataaagaatactgtcttagttagggtcttactgctgtgaacagacaccatgaccaacgcaacactcatttaattggagctgacttacaggttcagaggttcaatctagtatcatcaagtcgggaacatggcagcatccaggcaggcatgatgcaggaggagctgagtgttctacatcttcatctgaaggatgctagcagaataccggcttccaggtagctaggatgagagactcttcacagtctcctggcacaaaactggagactttcttactggtcagtgtttcccaaactgtgtactttggaatttttgcttccctccaagtggtgggtgtgtttggggctaaaagatcctagacaaaataaaaataataataatgttagcaaacaagggcaaatatctcatggagacttccataccaggccttccctccagccatactagttcttaaatcagttctgtccacactgaactatttttattgaaaaaaaaaaaatcacctcttcctttgtacacacccaggctcacaacacccactttctcctcctgaaagggttttggttttttcatgtcctgatggagtgaggccctggagcatcccagtcctgaaatcctttctgaactcttgtctgtccccagcaggagctatctgccataatcactttgagcccatgtcaagaccttgaacataaagtctaggagctgcttccttccatggccaggccactgctcctcctgcttcctcgccccaccccgccccaccctgccctgccctgccctgccctgccccgcccaccccaccccacgcagctccctggaagccttttctggtcacaacccatttgcctgctccttgaggcactaaacacctggaataatccatacacctccccagacatctgaaagccagccccttcctccagctgtttgtcaaaggaatgtcagttagccctgagggtaggaagagctgtccttcctagagagtgtccatcattttctgtgcagcctgggacccttatctccagttccttttagttgttctgaggctgggtggctaatgtgttgaattgtgtgaccaaagaaagccatgaacttcagatccccctgcctcttagctccccagtgatggagtttccagcgagcgccaccatggccaggttttaagtctggggatcaaaactacagctttctgcatgctaaacaagcatctgacaaactgggattatcatcccaatcaccagtctttaaactccttcacaaaggaagccttttgtaaattagactcagttctcagaaacgtctgtctcaccactggccgctagatggcgacgtcaaaattctttttcttctcccaaatgaactcctgtggaatctcacggggttttgtattaaataaaggaatagtaagatgggggaaggaatgtcagcatttaggactattgccccctccttcctcctcggtgccatccttcattcagagatgtttctccaccaggggactgaccttggaggccagtcctccccagcagggatctagttcagggtgcacactaggacgcactcactcaagcacacaagcacgcacacaagcagggacctttaaaaccagtgaggtccagccatcccatgctaagtagatcagaatttctagatatgcacccccttcctagtgctgggggaaagagccaaccccaccccacccccaacaattctactacagcccaaggcaagagtcactcacttcctgggaccctggcgccaaagcctggtaggccttcaggatttgccaatgttgctagtcaacccaggctttcagagtcaccttagagagggagaaatttctggaattcaaggtgctgggctgccccgaaggaggctgactggttttatttctaccttttttcagactgcagcaccaacttcacacccaacaattcaagcaagttctgatggtaaccagggatctagggcaagatacaggttcagtcccacaaggtcagctccagctctgaaccagtggttcatggcagcctgggcgattcacactgagaacagaccacaatcacagctttccttcatttcctgggactgtggctccttccaacggatgctgtagttcaaaacatggacctttggcgattgagagataagcagagggtctctccaggcctctccctaaagtaggtcataagaccattagcaaggcctccccttctgcgtgcagtctgctggtgcaagactataatcccaacactagggaggtagaggcaaaaggatcaagagctaaggtcaacttgggctacatagggacattctatcttaaaataaacaaaaggaagtattctccttatatgaagagcaaaggagggccattatttcaggagagactcagaaaggaatctgaacgcacaggcctggcaagactccctcagttaatgacccttggcttacatctccattgtccaccacagctcctacaactatccacactctggcaaatgtcaccctaaaatactgaggtttccctccgccgttggttcttcgtgtctgtcacaatgtgaaacttacggcaaatgagcattcatctttatcttcctgtcgctgttataggatctcagcccatataggctgttataggacctaaaatgggaagaaaaatatttcttttcccccttaatatcaaaatacagcaaaaatagataatctggacttccttaaaactaaaagcacttgtatttcaagagatactaccaatacaattaaaaggcttggggtttagttgaaaacatttataattacatatttaatgaatttcatgacaggctaacacccaggacactttagaagaaggaggaggaggaggaggaggaagaggaagaggaagaagaggaggaagaggaggaggaagaggaggaaggaggacaaggagaggagaaggaaaaggaggaggaggaagaaaaggaggaggaggagaagaagaagaagaagaggaagaagaagaagaagaagaagaagaagaagaagaagaagaagaagaagaagaagaagaagaagaagaagaagaagaagaggaggaggaggaggaggaggaggaggaagaggaggaggaggaggaagaagaagaaagaaagaaagaaagaaagaaagaaagaaagaaagaaagaaagaaagaagccgccgatgccaatgccacccagtgctagaaattgaataaaggcttctcccatgctagacaaatactcatccactgagctaccttctcagtccctgcaaactctttaacacccagcaatgagagggcaaacaacccaattaaaactttaaaaggcagatgatttgagttgctattttcccagagaagctatgcatattcatatacatatgaaaagtccctggtgagatgcaaatcaaaaccaaaatgagatgagatttcgagcccaccaggaacagtccaataaaaaagataacagcctgcattcctgaagaaacagagaaacaccatcctgaaacatcatagcctctgcttgggaaaatagtttgatgaagcctataaagattcaaaatggagttgcgagttcggtgattccgtaaatccactgttagatctgcagtgctggaagaatttaaaatgttcacacaaaaaacactgcacagccatgttcagagcagccttactcatgatggtgaaagggaggacaggacccagatatccatcagctgatggatggaccaaccaactagggtagacccatacagtgaccatgctctgtagggtactgatgcatgctacatcaccatagcccttgaaaacattgtgcagtgtgaaagaaaccagtcacaaaaggccacgtcataaacatgagaccatttgtgtgaaaacccatgtgacagaagaaagattaccaccaggggctgggggaggggttgggattcttcaggaggtgatgccagtattctttaagtactgaggatcagtgagtacacacacacacacacacacacacattgaatcctatactataataaaaggatgagcttcatatatgacttccagttcaattaagctgatatatatatatatatatatatatatatatatatatatatatattaaagatttatttatttgtttattttatgtataggagtatactgtctgtcactctcttcagagacaccagaagagggcatcaatcagattttattgcagatggttgtgagccaccatgtggtttgctgggtattgaactcaggacctctgcaagagcagtcactgctcttaaccattgagccatttcttcagcccaaagctgttatgttcttaacaaggtaacatattaggctgaatgtaaaggagtctgggacagggagatggctccatcaataaggtgcttgctatgcaagtctaaggacgtgagctcagatcccagcacccacataatcccaactcggaggtggacatagatggatccgtgaggctcacactgctcagataatcaagcccaatcagtgagctccaggcttagtgcaagaccccgtgccaaaaagaaacaaaaaggggaaagaaatatgacacccaatgtcaacctccaacaagtgggcttctccagggcagaagagctcagtggatgagagcagcaggcccagggcttccttaactgcaggatcttccccctggtggcccaggctacctccatctacttttggagtgactgagtccagatctcacaggcaactcgatgagtgacagctctctgagaactccagaaactccaataaaggctctctccttccttgtttgttttgttttgttttgtttttgtttttgtttttattcagtctgggatgccagcccataagctggtgctgcccgtatataagatgggcctttctccttagtgagagctctctggaaaccctctcacagtcacatccagaggttagtcttctaggtgactccaaatctagtcaagttgccagtgaagaggaaccatcacagagctctgggggcaggctttgccactggacagatgaggactagagttgagggggggggggcgaggggctaggagaggactttccaatgggaatgggaatcagatagactaggtgaaaggtgttgcatttgggctgagcattaaagggttgggaggccttggctggcacagtgaggaaggaaaatcatcccagaagcaaaggacagcttgggcaaaggctcagaggcaggaagcatgtatggctatcctgggctgatctactgtgttcagcaaggccaggcagacatatccaggaaggagcttagttggagctaggcacaagtacatgaagcaatacttggtgctgtaatagattagatctaacccacactctcaaggccatcctatctgagagaagttataaagcctaggacacagagtcacacagtaggacttgtactaggagcctcagaatagcttctgttatcagaagcatcatatgaagaaaaggaaaattttggagcagccaaatctgactgcagagagactatggggaggtttgctgccaccaggcaacttctccgaaggagatctgctccctgttcttcagcgacactaagctcaggcaggagtaccaagtagtcagcccacactggcaaaaacaagacaaaacaaaagggcatcaagagccaggcatgactagtgtaaaccctgtgaagtcagtatctgagagactgaggcagtaagatcatgagtttgtgcccagcctgctgggctatttggggggaaaggaggaggagaaagtggaggaggaggaggaggaggaggaggaggaggaggaggaggaggaggaggaggaggaggaggaagatggaaggaagggatggaaagaggggaggagaggaggggaggggaggggaggggaggggaagggaagggaagggaagggaagggagacaagaccaaggcgggtaagacaagctagtagtaatgatggtcatacaagatacagctgatcacttggctcccaggcaaggcagcagtgggctaagaggggctgggaggaatgctgggagccccactcctgagtgcacgtaggcagagtggggcatgggactcactcctggagactctgtggggcatacagtccctggggacccttaagatcctccctcagtgtcccacccctcattcccatgcttgctcaactccaagacctcactgagggagaactccacctgtgctccacaccaggccaagcacatcagggagacacacctggctaggagaagaaagaggagccaggggatgagctagtgaatcctaaagctggtacagaggaggcggggtcagagagaagatcaagagagctctgcaaacaagattaagatctgaatgcaggaactggaaaagcatgggcagaccccagaaggtggagctcccatgcctttatgcccagcacctgaaagagtagtaaactcagtgctccaaggtatgctaatcataaaacagatagagacattcctccacccacaagcttcctgggttcaaggagtgtacattcaaagaaagtcaccctgacccaccctgaccattgctggaacctgcaatgcaaatgtactatccttaggggctcttagaaactgtcttgagagttaacaattaccaggtattcctagtgacacctgtgactttgtacttccttgtgactcttaactggtatttttggtattttccaacaacgcccttcccacatccttaagtcgtggtttcttcctttaaataccccctaatccagctactcggggcgccatggtcctctacccctgcttggtgtatgaccatgggcccgagagcgctcttgaataaaaatcctcttgcaattttcagcaagaccgtttcttgtgggtgattttggggtgtcgcctctcttgagtcagaacgtgggggagtcctcacgttgtgggtctttcacaccaccactgatgaaaccaaaggcatccccttcctgccctaacgttgaatgcccacacggtgggaaacttttattaacagagaattactgtgacccggaagagttccactgacacaaggcctaagggcaggaaagcctggcgggtaagaagcttccctgagagtgaggaaggcctgtttcggaattggtattgtgctaacagcaagctctcaaacctcaggcagtgtctaattcctagctatggtttcgtgtctgtgtagcaaggctaacaacaactaaccacaggcttgtctcagggggctaaatgaggagctctaggcagcggcggcagcagcagcagcagcagcagcagcagcagcagcagcagcagcagcagcaacatagtgtttcatagtctgttgtgatttcaaacagttctatgccggctccatcaatgatattgtatgtgactaagccattttctccaatgtctgggtcttcagccttcacccttcctacttcctcccccagggacagctgcttctgaaacagacatctggtacacgcctgaaagaaaaagacatctacttttattttactttttatttggcagctgtaagacttcagatttcattgaatcccagcaaatttctcaaagggtttaaaatcgaactttttattggtagacgcagaagtgaagtggatggatgggaagaggatcccagatggccagcatgcaggagcaatgtgttccttccaggatgacaaaacaacattggggtcctggtaagatgatgaggtcacccacaacacgagagaaaggaaaacagtgacaaggtcctatgcaagagtccacatgctggaacacctgaggcttccttttcagggtgtcccacaaactaatgccaaagattccttgaactaattgctcaaagaaaagcagccacagaagagtaaatttaccccctgcttaaaaaggtttcatcacttcatatttattttagagacaaatacaaatctttcaagaatctttcttgagcaaagagatatttctctcatcttactcttcatcctttgtactaggtaaagcatggaatgctctggaagcttttagacagtcaactccctttatgtttatatttttcagaaataaagaatggtgccacacctatttatatttatgtttacagtatttatttctcatgaatgcaaatgatgatatattactcttttagctctgaagctaagtaaaggaagagttatcattctcaacatgacatttaaaaaaaagagaaaacaaaacatatctagatacactatgatgttataggctaagtagtattgtatggtaagggataaagggaagtagggtgtgtgtgtgtgtaagcgtttaagctacacaaatgagtgtgtagttatgtatgtgattatgctctatacgagttagtgtgaagatggggtatgatctgtttttctatgacaatgtatgtgagtggacacctatcatggttaagtatgtgtagatgagaaggaaatcgggatttattttggacaaggtagagacagaaaactttcgttggaagaaatctgaactccagtgaaggaaatgagcaagacaagtgtatgaatatgtgggcaataagtgtcacagaacaaggaacaacaaatgtcagaaagcctcaggtgaggctgcaaattctgaagattctgaaaatgtacagtgggacttctgttacgggagaataacagtaggacggaggcatgtaaacggcattgctgaaaatagtcaagatgttgagttccatttagggaaagcactggacagttttcagtaaaggaatgagctgtagcaccatcatttgacacatttgaaaagcaacctgtctaagacacactatgcgtgggcggaggaaccctctcctgcagtgctcagcccactggcattaggggactcccctagactcttcctttcctctactgcagctattatatgctgcagtgctgcattcttttcgtgattatactgtacccattttctacctaatcttgtattgtattcacaggcaaggcacagggagtgtgactttctgtagaaatgaacaatgtataacaatgttcagaagatctgttgcaaagtaattttctccaaatctcattcaagcccatgactgtgaaatattaaaactgaaatataaaatttctataccactctatataaaaaagggcattagtggacatccatgaataagtctgtctgcctacttttctggcatatggaacaattgtacattgtgcaaatggaataggcagctttgactatgttgtatgtgcctcaatattatcaaagatgcatacctttccatctgacaaggaatagcatggttgacccatctcttttggagtcctcaagaactaatatgtgtctcatgatcctctaccatgatatcttcatttggtagattgttatcttgggtaactttgaataaccatagtgcctccttaattggtatacttaactgacttcctttgggtttattatttttttatattgtgtgtgtgtgtgtgtgtgtgtgtctgtctgtctgtctttgagtgtacgctatgtgtctgtctgtctgtctgtctttgagtgtacactatgtgtatgtgggtgtctgcagagaccagaaagtgtgtcagactctctgtaactggagccatggatgtttttgtcattactggaaagctcagagtcattatttttgtgttataactctggactgccctttgcacatacacactaaaatatgattccagaaattccttagtcccctcaatgtcctttccctaggagccaattatatctataaaacataggctctttttagatatttataacattagtgaccagatattaaaattagcagctatcattaatttcaatatttcaataccactgtctccaaagagttgttttgtttggtgctagagtgatggctcagaactaagaccgtatgtttctcttcctgctgaccagagtttggttattcccacccaagtcagctcacagtcacacataattacagctgcagggaaatctgacagtcctggcctctgtgggtccctacagataggaaacaaccacatatagacacactcataaacacataattaaaatagtaaacctaaacattttaatgatgtatcttacttttaggtatgcatatgcctgtgtctatgtggctctgtgactaggaatgcagatacaacggagaccataagaaggctacaggtcctcctggcccgaatttcagctgttcagagccaataatattgttgctaagaacctaaccatggatttctgcaaaagaattatataccctcaactgccaaataatattttccctcagtaacttcataaatattgtacagtattcaaaataacaatggctgaacaattattgccggtttttttttcaaatgatataaaaattagcactagctggattaatctgaacaaagattgtatttaggttaaatgctagggtatcatcttctacaaggatactagtatagctcgtatcccacaggcccctccaatgttactttatggtcctctcatagaactgtgaggtctggctgagctttactgctatgctggcagccttaaggctacagggaaagaagtcccatggcttctggtatcagctcaaaaaatggtcacggagttctcatgatcagaactcagccacagaaaggcccatgtggagaggaagcacaagctaatctcaatttgccaggcttataaggaatcttagaagtgggtttttctgccacaggagaactgccctgctgatgctggagtgacaacagagtagctatttctcctatgctctgtacaaattaaagtcaagaaactaataagtgattgttacttacaatcatcaagatgtgggggagtttttttatggaatgataagcatcagatcacggttctgttagcatcagttaagaacactgagacaggagaacgttaattgatgactgccttttatgattaatacctaataagtaaaatatctcaagactcagatattctggtctccagagttacacagttttaatgacttccttacttctcatgatctctatactgtttaactttcctcggtgtgtttttaagtctttgctatcttgttctagttttttgcaagaatcacgaaaatgattcttggatttccagactcttccttttgaaagctgggtaaattaggagtgaaagaaaagatgaggctctcgctgagcagtggtcattatcaaagaccagcttcgactctttactctttggaaactttgctgagttgtcgttgacatcagtcagagtgatcgtcactctggttgtccctgagagtccacccatgtgtccacccatgtccttagcctggatcaccacatggtactcctccttggcttctctgtccatattgggaagggctgtcctgatgattcctatcaaacgaaaatttaaaaatcacaaatattcatttatgacaagatttaaaaaaatatgttacatcctgggaacctaaagatacataaaatatagcctgctcaaagacaagtcattttaacatggcaaacatagcagaaagtgttgaagataacacctgtgtattatcaagcaaataataaaaattacttacaacatattagtttttttttcactctgcatgcaagtaacaatgtctttcctctcagacacaagaatcctgaagactggaatgacaagagcctattgtatgataagtcatatctgaatctatacttcaggacttctagcaaaaagcttcagaaatcaagtcctacataaactagtagaaacatcactatggggttggagagatggctcagcagttaagagcactgactgttctgccggaggtcctgggttcaattcccagcaaccacatggtggctcacaatcatctgtagtgggatccgatgcactcgtctagtgtgtgtctgaagacagctgcagtgtactcataaaaataaaaactaaataaatcttttttttttaaaaaaaagaaaagaaacatctcttcagctcatattaggtttacagaggaggcataaacttttttgaacacattaaataggtactattaattttttgagtgagtgaacagaggagttagaaagatgaacaaaatttgtgcaaagattcagtggacaatcacatgtcctgaattactgaaaaacaggataaattcaggattgaaatattcatgacctctgtatatttaaacatgatgttcataaaaatatgcttacttacatctctagggatcttatggaagcttttacactcagtcaataaagcagtatttatagtgtaaatacaaagagcaaggaagaagtgctgggctatgttacgcagcatcactgagcccagtgttgaggtgtttctttgcaacatcctaggacttatgagacatcatgttccttattggttagtttcatgggttccaactgttagtcactagccttggttccctgagagaaaaaaagaagactagagtttttactattttaagtagtctagatgaaatcccacatttatccttagtttacccaaagactaaaagcaaagatctccatgaaaccatagacaataactccacaagctgttgtttgaagtaagaatatgaaaaatgaattaatatgtattaggtaagagttaagaaagcaaataaaaaataataaattaggaattcatgtaaaagttgcaaattgtatgaaaacctttcaagagtacagaacatattaagtaggaaggaaaagtgtaatactgctgcagaagaacaatgttataggactgtagtgttcactcttgttgacaatcaaattagtgtaaatgaagcgaaacattgttttagtttctgttgtatactgactcactttactggtctgctctttatcttacagcatcctttgggaacctatgctcagagcaggagattgggaatgtgctggatcttctagtagggtgaacatttacagttactcctgacacttcttagtttacccagtggtcttccaaggatgttttaaaggctaacactactttgtaacaaccttcgatccttttaatatggatccacaagtcaaggcatttccaattcataaatttaattttaaatatttgtaattatcatcttagacactaataaatgtgtattattccattcatccatatgcacagaacatacataggccatctcgtactaactgccaagtggccctttagttccattttaatttaaggaattttaaagccaaagagttaaaggacgaggcatagactccttgtttaaaataagtcgtgacttacaaagatgatgtaatcaaccatacctgtttgggcctccactgagaagtagggttgtccttcaaggatgctatacactaacttggcactttttccataggtgggattatctgcatcagaggctgtcacttggataactgatgttcctgaataaaggggggtcagggggagcaattagcaacatccaataaactttgcaaatttcattgctgtttacagaatttcatttaaaatgaagacctgtaaggaagctcacaatgactctacatgatcttattgtcctatagttcaagtgcagaccactcctctccctgccaatcttccctctctagtttccttcttctatttcttttttatcagcaaggtcaaactaaggtttaaaaggaaactttctactttcacagttcttcctggttggtttgctatttaaaataatatgaacattcttgtcaaatactcctagaaccatgtgaattcactgtttagtatatcacataatcaaataaaaatctctcctgagagtgcaataaatggtaattaatgaagaatggcttttcatgaaaggagagagggcactttcccatctgtgacaatgaacaaatcatttcactgttgctttgcatgcaagaaaattacttctgatactaaattttaattaatttgtggctataaatattctatagaatgctgttccccaatgtcatgaaaattacatgtttccctctctgtaggtagggtctgtatccacgtcacagaaacgatcagtgagggatcaatacgatctaagacattcctatgtcagaagacatgaaaatcaggggattaaggaatgggaggaactttttttcctttacaagctctactgtcacaataagcatctgagacatgccatgttgagcttcaacagagagggaaggagggaagaggcaattatccaggatgcctctgtcaggcactgtctgaggtaaattccaggtaaagtgcctccattctctgctggacattttggcatctgttttactttgggaagatttgggatgagaaatataacatcttaaaatccccttttcatgttgtttgttgtcacagctgggaatctgtcatgcagggacatctagcaagaataaagcccaagtttcccctttgacatttaggcagaatggtgggagggaggtcctcctggcagggtacagaacctgtttacacaacttacaggtagctatcctttacttctgagggttttctgtgacttctatgagaaacgcaagacaatgttcactctttttcaaaatcaattttctatacccactgtcttttgtgaatgtcttcctacaaagtagggattattctagaaaatgggtgttataccagagaaagacttcatggaatgctaagaaagttataaatctttataatttaatggaattctattttttaagaatttttttaaaattctaaaacaaaaattctaatattgaaggagttatcaaatatttctatttgacctatatacccagaactcattagtaactattatcttgatttcatagttgacgaaatgataaattaggaagggatacaaaggagcactggttcacacagctttctgatgacaaagacaataatttcatatgtagagtagaaagtctgagaactgccatagtctccaaagtgtcctgtaaggagcaaaagtccacctgggttatcagtttggatgactagcttcctctgcttcttccatcctttcttctcattagaattcacatctgaggatagtgtagtcaagggaccagacaagaataagtaaaaggaaggaaggagacaatgactcagcctggctttttctcagtaaaagaagatcttatgggatagatccccaggtggggcagtctctgaatggtccttccttcagtctcagttctgaactctgtctctgtaactccttccatggatattttgttcccccttcgaagaaggaacgaagtatccacactttggtcttccttcttcttgagtttcatgacttcagcaaaattgtatattgggtattctaaactattgcaacaagattttgctgacaggaccctgatatagcagtctcctgtgaggctatgtcagtgcctggtaaatacagaagtggatgctcacagtcatctattggatggaacacagggtccccaatgaaggagctagagaaagtacccaagaagctgaaggagtctgcagccctataggagaaacaacaatatgaactaaccagtactacccagagctcgtgtctctagtggcatacgtagcagaggatggcctaatcggccatcagtagtaggagaggtccttgatcttgcgaggattctaggccccagtataggggaatgccagggccaggaagtgggagtaggagagttggggagcaggaagagttgtagtcacatatacatatatatatatatatatgcgtgtggggggtatgcatatatatatatatgcatatagataaatagatagagatagagaaggaggagggtatagaggatttttggagaggaaacgagaagaaaacatctaataaaaaataaatctaaaaaaaaaaaaaaaaagatcatcttagtagacatcttagggcaatggcagttgtgtcacaggaggctccacacacagactggagtctctcagagccctaaagtcacagctgactgtcttgagtaagctaatctttataatcggtgcttggtttttctctaaatggtaaaatgaacaatctatccctgatggcttttagattcacttggggccaatgaatcagatttactcaaaagaccacattctagaaattcaagcagaaatgataccaagaggcatgtgttagagttccatcttcaagcaaagcagatgtctttaagcatatttgaaatcagctgatggcagccttatatgcattgtgggtgaatttagtaacacaaattcgttcatctgtttctgcttcggtttctcatttatccaagaccaactggaatgactgctttgcaaagtttaatcatggggaggttaaacacactggggtgtgttcgccatcaattaatgtgaagcccaaagcagcaaacattatcattgctgttacttattcgacatcaatgccctagtgattggatgaatataatcattactctttgaagactggaaattgttattgctcttctacagaggaagagcaaatattaaatggtgtcacttcacacagctgaacataagtcaggatttgctaaactgaatctcatttttcccccttccagacttcctagctaataggaagttgatagtcgactttagagcctcaagtctaatataaacatttgaaaacctgagtctctatatctgttatgcacttttccttggaggcccttcctttctgtttgtttcttctgttcaatgtgttagggttttctttttttaatcttaaatattcttttctcattatcttttaggagtctgattgtttactatggagacagaaaagaaagggtgcatctggatggcaggggatgtgtggagtaactgggaggggtggaaagagcagaagccataatcatgatattttgtgcgaggaaaagaaaactatttaatttttaagaatctaacaaagcattttttccttattaatgtgcaataatgattgaacacaagctctgcttcctgggttgaagggcaggcaccagcctgtcaacctgcagacataccagatagaaagagaataggtgaccaatacttacctacccacattggacctctcaggcacattggtatgatagatttcatgcagaaactctggagggttgtcattaatgtcctggtccttatcaatgaattctgaaggtggccccagtggtttgttggtgtccctgtccaccgcctgagccatcagtgtgtactgggctctctcctctctgtccaatgtcttggtggcatgaatgttccctgatttgtcatcaatcacaaaaatggttcccgctccttctcctgagagaatgtatttaatgtttccatcaccggcgtcaatgtcagaatgaagctagaaaacaaaaaagaaaagaaagaaagaatgtaggatttgtaatttcatgaggaacacaataaaaacacataggctgatagttacactacgtacacatgtgtgcacatacatacagtcacacacatatcatgagacgaagtgatttccatcaccattttctgaatagagaaatggagtcttagataactgctatgacctgggtaatgatgaagctgatggatttgcaaatgtttaattctcaggttcatgttctccccctcttattctctctttgactgcatatatgcatacatacaaaatatatgcatgcacatatgcttcagtagttatttgggaagaaatgcacatatatatttcaaaaagatttaagcatgattttatgcagcatatttctctcagtgtttattcccatttcatcactgcttcagctatgaatcacctttttgccagtttcttatgactcctttatgagataataattcaagcctatacatatacaaacttatttccacagattcttaaaagctctttgctaattttacataatcagggctataaattgtatattataaattgtagattcctgtaactgtgacttctgcagctccatcaacatctaggtacaaagggcttccttattcaccatgtgatatcctcttcaaaggacacttatatttgttactacaaatacaagtccaggcatttgttattacaaatccttcaactaatcagatttttctagatccactgtctagtgtccagagtgtaatgtctggagctattatcttcttgggagaagaatctcctatgaccctatgatcatagtggacagtggggcaaagtgatagacatgttgtccccagacccttgaaagaacttccaatgtccttgggattttcatgttttccagaaagcctttagacaagatgatttttgcctaaatctgtattgatggagtcaagaatctactatggtcttttagctgccaattcgaccagcagctctgcccgaattctgctgtgtgtttcagagcccacgcccatcaaagacttcattgattttcctgcagcaataaagcctatgcactcacttattgtcctcatgatttcggaggtccttaacctcctttatattaatgttactttaattgttatatgaaattgttacatggtttgaacaaatttacatattttaatatgtgaatgctattatatgagttattttcattgccttctagtattgaaaattagctagatttaaaaacactaatcgattaaacctgttgtgtatagaaattcagaaaaataaaataaataagtaaacaaaaacttatattcaagcatttactacaataaagattgtaactaatttttatttaatattaatgactaataatttataatttctatcattattataaaaccaaggcctacacagtttgctcgaggttcacaaagaaaaactgaatatactactttttaaaatggttccatcatttaaatttcctaaatatgtttaattatttgtagagttttagtgaaacaccaaaaagttcagctccgacatggatacacaggcataatctacaaccattttggttgtgtatcccaggacttctcgggcagggacagtaggaaaacatttgcttctgaaaggtaagaaaatataatccaccattttaatgcaatatgactgatgtaattcttaagagtttggccattcgtggagggaaatatgaagttacttgatggatttcagtgaactaatagaatatccacaatgttcacagtttccttagtgacctgtgttcccctctcctatccagcctaggattgtggtgtttgttctttctctgtgcttcatgggtatcaaatgttagaggttaagtcccgggggctggcgagatggcttagcaggtaagagcactgactgctcttttgaacgtcctgagttcaattcccagcaaccacatggtggtttactgctacctctaatgagatctgacgccctcttctggtgtgtctgtagacagctacagtgtacttacatataataaataaatatatcattaaaaaaaaaagaaatgtactggagcacataatctttgcaagaccaagggcctctcctccctctcctcccattgatggcctactaggacatcctctgctacatatgcaaatagagacacaagatctgggggttactggttaggtcatattgctgttgctcctatagggttgcagacccttttagctccttgggtactttctctagctccttcattggggccctgtgttccatccaatagatgactgcgagcacccacttctgtatttgccaggcactggcatagcctcacaagatgccacggccaggaagcaggagtgggtgggttggggagcagggcatggggagggtataggggacattcgggatagcatttgaaatgtaaatgaagaaaatatctaatagaaataaatgctaatttttcataaaaaaaagaaatgatataaatatgaatgtcaaggtactgaaagtttctaaggaacttcatgcattacacatgaaaacataaagaggcatttcatagaggcaggcagatttctgagttctaggcaagcctggtctacagagtactcacccaggacagccagggctatacagagaaaccctgtctcgaaaaaacaaacaaacaaacaaacaaacaaacaaaaaacaaaacaaataaaacaaaaaagaggcatttcataactagccatggagctgaaatttttactaagcatccggcttatcccatttccactttgtttctcctccctccaagatttaaaagttgggtatgtcttccctagttttcctctgtcacaaagatgatctactgtactgacaatactatttattaggttctacaggaaagcagtttgggaacacagcaagtgctatcaaggggccagttcctgactccaaagactgattgcttctcgctttgcacagcacagcatgacacaggctgaactacaggcaaactctaagtcttctgtgctttgccaaattctaccttttcagggaattttcaagcattcaaccttgaacgtcaccattcagactgttagtgaacaagccaactattcctcctacttagctccatttcaaaaggaagattttgccagatctgagcaggcacatatggacacaggcgcacacacgcacacacacacacacacacacacacacaccccccatcgaactaagtcctttcacgaaccttacttttcaaggtcatacctgggatgatgccagattttcccttcctctctttattcctcgtcttctcccgagtgcatcatatgacatttgttatatccagagacacaaagtcatctgactcactaagccctctacccctgccaccaccaagcctaaacactctgtcccccactgagacagtgacaaagcagagggtcattttctcagagcaatttgatacccagctctacacattgcttgagctaagttgccacgctttactgtggctgtctttttcctcttcctttctgtggacacagcacagctctttggttacaggattctgctggtcaattattttcccctacttccatgttatcaagactacgtctacatctttttcacatgaatgaaattatttagaacattatttctaaaaacacttatttccaattctaagttatgttgagattatcatgaacatttttgagcataaaaaataaacgatataaaaaatggactgttgtttcatataaaaacaacgacaaagataacttgttggcatccttggggttcaaaactaggaatctcagtcatctgtccttgcatttctctatattgaatcagttctgtttaacttcaatgtcaggggttattagatacttgcctctatttttcataagggttaaggacataaactaaatttcattaccctcctcattatattatatcttcttccttaaatgaataagtggctgcctctttttcttgcttgtttggagtcaggtattgcttcaacctgatttactgtctgtctaccacttccacataatagagcttcaatttgtacatattaaaataactatctcctgtgaactagtgtcaatattacctaaaagactgtctcttgttttatcataataagtagtaagaagtcagtttgccaaatgtgttttgccctctctacatttatatttccaatggagttgaataagcagtgcataaccttagaagaggaaatatagcaaaaacatacctaaagacaaaatggataatatcattcctatcctaaagacacatattcactcatttcattggagttggtattagtgccaagacctgaggattcaaggctaatctaattcctcatacaaagtaaaacgaaatgaagtgacagaggcagacatgtaaaacagcaaagtaggatgaaagggattggtgagacatgggaatataaaagtgggaacaggcaagttggggttagaatatagtctgagaaattcctccagttgaagaatggttcaataaattaaggcagtatttcttttagtagactctaaagcaatccaaagtcaaaatggagtccttatcctataataagtgaacattagaagcattctcagtgtggtttggtctatgaatgaggaggagaagactggatgcgtatacacataatatgattctctttttaatgacagtagatcattcttgttctctttttctgtttcattgttttagttttacttatcttgctttcgcctattcattagtttgcctactgttgttctgtcttgtttttttgtttgtttgttcatttgtttgtttgttttgttttgacctggtcatgtccttctgcactgataatgagcacatatagacacatcaacatcaaatataagcagccttaccctgcccaccagcacagggttgggcccagtgtactcgtctatcacaaagaactgattccagacccaacctctcttggagcgttgcagcatctgcccctccttgcccttctcatggtgtccatggaaagagggatgcaggtggcttcattgctccagggcaaacataccaggcataccagggcagcttgtaaacagtagttctccttcatttttggttatgcagtaggcacaggagaatgtagctgtcacttcctacaccaacagagtggctttcttttggatggcggcctcccagatgtgacctcctctggaatggagtatcttcactcactgaggacatcacaccagggttgttcacctctgcagtcagcttctgcaagcagagaaagagatgagattagctgcagcctccatccacctattgtttcgttttcatttagcaaacatgtggtttgagtatcagtttaccacttgtcagctttgggaaagctgacagctttctctgaacccagcttgctcatttcagaaatgtagataagaataatattcgttgaaaggttgctgcaatgatcaagagaaatgggaatataaagccactaatacaatgtctagaacccagaaactctattattcattgatcatatgtgtgcatccacagcaaggatgccagaggccagcacagcaaagagaggatgcttaaaggatatggtgactgaattgaatactaaagcaaaagcttctattttaagaatggagaagataggataccatggaaaaaaaaaacaccagaattccataaccattacagttggccaaccacagcataaaccaagacttaagcacaaatggaaaataagaggaatcttatgtcatagtctgtgagatggaaggaaagacaaggcagacctcaggaaatgatgatggtaatgaaaataatcaatgaagaaatgaatgactaaggtatgtgtgtgggaggggtacaggtatggaatccagagctctgtagacaggcacagaaggatcacagaaattttaagaagtcagaggctagtttgatctaatctgactttcatagtgaattccagcacagcccaacctagcaaggtactgtatttatagagaaaaagtttaaaaaggcaagtcttcattgagctttgtgaatcaattaattaaattatgctgatcaattaacactacagtgtcaactaataggtcaaattcccattgactcactggaggatctattaatgctactgaaatcaattacagctaccgcatcaatttgttcttttatggtctgacatctccctcaccagctcagcatcctatcttgctggacagcttttcataggatgctatccagtctcaccccaatcacaagaagaaaaattgaacagttaacctgttgcaggcagcatattattgcttcttcaaacccaaccagcacactcctactcattagcagtaagatggagccattggcatagtttaccttcccagattccttgtatttctctgacctagagtccctctagctcccagacttcttgaatttccccctatataacattctttgattactcctcccacttaaaattcatctttccttgtttagaaatatctgcttcttcttggtggtatccagagtccaggtgttctcaaaaacacatgcattctctattaacccattacccatggataaacacagagtgagaacctagattcctctcatttttccagggaggcaaaatgcaagcctgtcactgttgctaaccacattgtgcacatgtgccttgaaactggagatgacaaaaaccaaaccaaaccaaccaaaacaaaacaaaaaacgggcagggaagcactcagagaaaaaggaagtagagttacttagccatttggctttagtagtcttgggcacaagagggctggtagactttttttttttttcgagacagggtttctctgtgtaaccctggctgtcctcaaactcagaaatccgcctgcctctgcctcccgagtgctaggattaaaggtgtgcaacaccaccgcccggctctggtagacttcttattcacatagcaaatcccttttctcttggtagtctgacttagctttttcaagtctttggtcttacaccaagataatatttggacatgctgcagatacaaaggtgtctgctatcatccaaatacaacttctccataggattactcctgtctcttctcaagaaatagggagttgaagaccttacttagtatttgttgtttacagatgcattggaatgtgtaaaatgcagtatgaaggaataaaggcaaaagatgccttgctgtcacacaccaacctcattcctcacatgaaatatatttatagattcacactgacatctctctctgtctctctctctctgtaagtgtataatggtgtatgcgtgtgtctgtgtatgtaagggtgtgtgtgtgtctgtgtgtgactcatgaggggaggttgttgttcttatcattgttgctgttgttgtgtacatgagttcagatgttcacaaggccagaagccatcagatccactgaagatggagctctagatggttatgacaggctggacatgagtgaagggaacccagctcaggtcctctgtaagatcagcaaatgttcttgaccaccgagtaatctctactgcccagaaaagcatcagtataatgatgcacaaagtgctgcttgcggcaagtccagagcactatgtggaaaaagcacagagaagtctgcagcaggaaaagatcttaaagtgaggccacaggaaacaacagagagaagtctggcttaactgaggacaccaggccccaatgctgatttgtacctgaagctctgaagttcccctctgcctcctaattggggaaagtcctgaataaaattttctaccagtggcttccatcttcttatatgtgattggggttttgatgaatgattgtggggagtgtcttttctgtttcagatgctagggctgtgactggtagcttcttaattagttgtatttactacacatggattaggacctgagttcaaaggggccatccataacaactcagtgtatgagatcaagcacacccttgaacttcaaacttaattctgtctctttggaaattctagaagagaaaggagagaacatatggtgtagggttcctgcccattttatatcatgccaagtattaagtgttcattcacaaggtgataaattattcctgcatataaactgtgaagtgtaattgaaagaaagggtttaattaaagttgatatttctaccctcttttttttgttgccatgttgctgtaaagcacaattatttctgacactaaagtgctgaaattacatgacaacttttctactttatataaacatattaaaaaaaccttctagtttcatactaattagtaagagttccaatgtgaccaataaacaatgaactttactctttttataaaaaagataacattataaaatttctgttgaaaacaatagcaaaactaaatgcataaaattaactaattggtcttgtgatttttaaatgcttatatgactgaatataattcaatatattagctaccttgataattaacccttgttttatagaatttgaattttaagtcaattattctctttagagtaaaataaacgtgataaaattagggtttattagccatcattctaaaagcttcataattattaagtaatttattgattaatatgccaaccctattaatgggtacagtgaatattctgttaaaaggatattaatattgagatctagacaaattaaatacaatttgtgccactataaagttctgttgatagccaaattgatttgagcctagactatctaactctgctgtctattttgaaaaacacaaaacaaaactaaaaaccttcttttcccttttctctttttttaatgtttaatttttaaaatatttacttatttatctattctacatgagtgttctgtcttcacacatacccaaagaaggaatcagatcctatttattacagatggtcaaaagccaccatgtggatactgggaattgaacttgggacctctggaagaacagttagtgcccttaactgctgagccatctcttcagcccccctttgtctgtttttaaagtgcataaagaaatgaaaaatattacctaagacctatcaaactgaagaatgttagttcattgtctggagttggctagatagcaataacagacctgtgattaaaaaaaaaaagaatagctagtatttttagtattatcctccaaacctcctcaagtggactttccatgacttaagttacaaaaaccacacaaacataaatggtattgtcatgtccattacatatgcaagtggaataaagcacacagaggtaagtaacttttccaaagtttttgagaatgccagggaaaaagatgggattgaatcctgtgggataacagatcccagacctggattctaccctctccagttctagctaattctgcatctctaagagaaggtgaaagaccaaacacagagagatgcctctgcctcagtatctacataattgccttttctctctctctctttccttgtctttctttctttctttctttttctttctttctttcctttctttctttctttctttctttctttctttctttcctttctctctctctctctctctctctctctctctctctctctctctctttttctttctttctttctttctttctttctttctttctttctttctttctttcttgtttttttccagacagggtttctctgtgtagccctggctgtcctggaactcactctgtagaacaggctggcctcgaacttagaaatccacgtgcctctgactcccaagtgctgggattaaaggcatgtgccaccaccactgcccagcttataattgccttttcttgatactaactcaagactgaggaacctgaagtgagtacatacatgatcatatttaaaaaaaaaaaaatgtcatcgcttctctgccttttggctacgatcaagtgttaaaaaaaaaatcagaacagaaagtaaaggagaaaatattccatagaagatattgaaatgaagatggacacaagagtataaattatcaatattaagtgtaataatgtagtataactaatctttattttcttatccttaaatctctatcttaaaatttctaaaggtagcctttaaaggatggattcagggagttttgtttatttaattctgtgatttttttttttttttttaagaaagacctggaacttctcaagactggactgttgaatactgtagaaatttagcacagatctcacaaagaaattaataaaaggctgccctcctaaggagaccttgatgtgggtaataattagagaaatctatcaatgttctaattaatattaataaaaaaccccaaaggacttgccaccccaatggcaatcttcccattaaagctcctcctagcagctggccaggatgcctaagcatcagggttccactaacacatgtaagaagacttcactttacgaagggagcacagtgcttggagggaaaaaataaatgttgttgaaagtcacaagagtaatagtgtgacaggaaaatggatttgcaaaatcaccagttctaagtggaaggctcacccctctatctagagagcagagagtccttcttaagcaggctgctgagcctgcttgtctccttaaaagaaaatgacatatatgggtgtttaagtatatttggactcctgctggaaattgttatcgggtaggaaatgaaagacaaaaacagttagcaaaaagcaagcagatttggttttcagttttctcctccccacagagctggaagaatcagacacactgacccaatctttttatatctagcgagctaattgacagctaaagacaggttattattatgcaaagtatattatcaaggttctcaccagagctcaaaatcctatttttgtatctgcaaggtttccatgtgggtgagcaaagggactctggtctctccttcaacaaacacagctttgtaactaatcggattctattatgcaaattaactcaagaatattttattctgcgctcagatctcatcactcagcgcagagctggtccctctttcaattcaaatcacaggaattatgccttctctgtgaaaatcatagaggagggagagaggaagtgtcagggcactctggtggagtcagcttgtgaggcagaaatgccaaaaagctgctcatgagaaatgaatttctaggactttcctcctggatgtctggcgaaagtcaactctccagtttggattggtttgtcaggcgaaaagcctggaagctgttttatgagaataagagttccatggaaattttcctcccagagttatggcatttctttccctaacccataatattcaaatttctaccacattagtctagtgtatagattcacgtgcactctattaagcattaccttatagtaaatgccttttaagattgaattctaacatagctaaagccttttcccagtgttcttagattcctgatagcagcaaggagtttaacctattcagtaactaattaagctctaccataaaacaataaagcacttgccattaactcagctgtctgcagaaagagactaaaagtctcactgagatagaaatcttttactacaggctatattccatgtcaagtacaagttgatatactaccctgataagggggaactctgcagacaggataagttttactagacctaagaatttagagctctgtgataacacattactcttaaggcctgtcaagagttaacaaccccctgatgcttttaaccttaaagtgtgaaattcttgcctggcattaggctgatcctaggcagggcttgttatccctaatgtaaacatttaattagtccctgcaaattcctttctgctgtaactggtgaatttcagtgtatcttgtcttttgtgatttgtatcctctgataattcgttgtaatataagtctgaagctcaaccacaacattacattcagattcaacacctctcttgcgtgtgtctgattgtcatttcatccgactcttttgcccatctgcttaagtaatcgcgttcctcgcagaccagggacccagagggtctgcgacaaggaagtattacaagaatggttgaaacgtaattctctatctcagatttctgcatttggtgcaagacttaagtttggattcactttttcttgggtacagaatatacagtgggcagtacacaaaatatcataatgtatatcgttccattctcaaatgccagacacaaatactatagtgagtcatagcaaagaaacaaaaatgaagataattttaaacttcaatagaattttacaggagctcaaagataagtgtcactttttgcctccacacacagttttggaaataggaatgacatttaataaccagagagttatgcaaagcttagtcaaccatctgattaaatcctttatagatttcattaacttaagtagtagtagtagtaatagtagtagtagtagtagtagtagtagtagccatagtagcagtagtagcagctatggtaatagtagtttcatctcttcttagtcatctggtttttataatactggccagcagtataaagcatgctatgcagcatttcatagcattttcaacataacttaatataaatgatactcgtgggtcccatggtcataggactccaaagacctcctgtctcacaataattcaatcatatttgagcaataaggtagttatatccaatgagtacaaagaatatcttctattattcatgctccactcaattcttgagacagcttttctaactcttaatatttctaaattttactcattgatatgaataaaatacatcaacacatatccgaaacaacattgtgagcaatgtcagctccaactgtgaataaatgttccatatgaatatgtggaaaaaattagattccacttctgacttttcttgttcctgaacaaaactacctgagggaagacatgcacgaagtggcaatgacaagatgcttagcttactgtgacatcatttataatttgaaaagcatacagtcaaacctccctctgggcccaaacagtaaatatataaaaagtgttctttatgcttattttctccttcattcattcagggtcaagtctggatgggtctcggtgatacataggaatcagtgtgtttttgatgcttagacaattatagaacttggtaaaagtcttcgaggaatgagtggatctaacaacactacaaacaaagcatccaacaaccagaatcagtttggcagatgaacttgtaacaccgtggttattcttgtggcctcttccaagcaaacaagcttgtccatagtctccaatgccttacctactccttctctgaggtatggctgatgaaacctttcctgctgttctgacaagtaaaccataaactaaccattgatcattgcggccagggcgacctgtattcaaatgattggctatgggaaccagattttccaagaacttcaatgaaaaacgacagaaaatatttgtaactagtgaaaggccttgcaaagtcaggttaggaggcacctaaagcatagagtagctacaaagtaatatccaattgttcagatttcaataagatcaaggcaacaaccaaactagttagaagcaaaagtcaaactatagcatctctctctccccaaaccatgcaaatggcagaacacgtgatctcatttctctgaagacctaggtgactatgcttctttgctgccaccatgggccctaagctgtttgtcagcaccctacctataagatgacagtgtacctcctgtgcatgagctagcctgggaactttctttcatcacccaaacagcaaatatagaaatttatggtaatcttaaagaaataaattggcagttctttttttggccaactgtgaaatattgccactgtgaagatcgttagtgcaattgtataaaatgccatttttttttaatctctgaatttccaaaggccattgggccaaagatctctagaccataagggaagatgtgtatgctataatataagttctgttagtacataacggtgcaacttagacaaagtattcttccttaggatcaaaattctcctctaaaataaaaggacaggaatatatcattaaatgcctctctgtatacaagcgtctgtctgtgggtcagtgctgaggcagccattcctggattgtagttttcaacccttggtaatggtctaaggtcagctagtaggcctgctcatatagaacttcattaggacgcactaacatagaattcattgaaatctggagaatggtaaatattcagaaagacacattttttaaagttataaaaagtccattaattttaaccacatattttatcacatagtcatatccccatcagataattacagcatttacccagtgtataaactatcttattttacctctactttgttttaatgttctgttttaggctcagtgtatatttcatacttaagtcacagttgagagcagccatacttttactagctaagtagccacgagtagacaaggaagaataatcagaagaccataaaccttttcatagaggagggtgatcaaagactttctggtgataacaatcctctgagtgaagaactagtgaattaagactgctgtcgttagttagttagttagttagttagttagacaactatttatttgggaaaacattcagatggcctttgaaatcagcagatcctaaaggagacactgggaaggtagatggagggaaagatgctcatgttcttagcctcagtagaagggctggattgggaacaagatctatgttttaaaaactttgaatgtgtgaaatcactgaaagtcccaaaattcttccactagtagaatgaataaatgaaaccatgatgaaataaaccatgtctgcttcaggttgggagattatgctacactgtaaattttcagaaatccagaattagatgacaaggtaaagatgctcaactattaagggtttttttttttttttttttttttggtcttgttttgtttcggtttttttgtttgttttcatttcattagaaaaggggaaacaaatataggagctgatggctaacatttaaaactagatcaagtgagcctcaaacccccctactctctggagagagaaagaaaatatcaggaagtgaaaattaattttcataggattgttgtctcctgcattaaatatagttttccattcacgtcatatctatggaaacaaaatcctcagattcatgaagggaaatatatcttaagcaatctaagagtgctctttaaagagtcagaggtggaagaaataaaagatactgctctgtatattctc

SEQ ID NO: 80 - DNA, 3440 bp, Mus musculus
gaattatatgctgtgggctatattctattttattttactggtagagaggggcagttagataaagaggggcagagctagaagactgcccagaaggattctatgaaggttgaatttttctttacacgacacaataactttcccagcctgttttatcatgtgaacagagacagacgtagtcactaaaatctaagcaaaccagtaaagtggtgcagtaacttcagcttgcaagaatatggaaaggcacagtcacagcatgcgagggttgctgggtgtggtctggaagccaccctgtccgggcttctgtcctgggtatgcaggaatctccgagcttatgtttgacggtacttctgtctgtgcttccgaggaaacagatgtgcagagcattggcatggtggcaggagcagtgacaggcatagtggcaggagccctgctcattttcctcctgatatggctgctaatacgaaggaaaagcaaagacagatacgaggaagaagacagacctaatgaaatccggtaagcttccctatttgtgcaaactccctttacaggccaattccatagtaaccagtcaatatcattccgtaggtcccctgcattattaatctcttcaaagggttatcctagcaagtaggaaattacagtctggggacaggagatgtgattcacttattgtgaaactatctttgtcctggcttgctttttgttgctatggcaaacaacatgaccaaaagcagcctggaaagaaaagggtttctttccccctacagcttacagtccgttaccaagggaaggcaggaaaggaaaagaattcaaggcaggaaaggaattcaaggcaggaaaggaattcaaggcaggaaaggaattcaaggcaggaaaggaattcaaggcaggaagctgggggtgccaactgaagcagaggccatggaggggtgctgcttactggtttgctcctcacagcttgctcagcctgctttctaatagaacccagcatcgccttcccaggagtggcaccacccacaatgagcagtactctcagacagccatcattagtccagaaaaaaaagcaccacaggcttgccaaccagccattctgatggagacatttcttcagctgaggctccctctccccgatgactctagcttgtgtcatgctaacaaccaaccagcttaagtctcagctttacctctgattcacttccacttagcaagggtagatgataaaaagggtataacccacaggacatgaaagggtttaagtacgcaaacccccaaatcaaagcaattctatcaaagcaatcaaagtctcctgttgagctgtatcctggtgcaactggctcaacctctctggcagtcactcaacaaacattttcctaaactgagcattaagtcttaggaaaccagaaactgctcagttccttaactgactgccttggaggtttatggcttgaggagtttattggaaaaaaaaaaaaaaatctcaggaggaagtaactttaacgagcgtcaacccagccccggcagtactaaagtttatctttgctatctgttcacttttccgctttcagagaagacgccgaagcgccccgagcccgccttgtgaagcctagctcctcttcctcaggctcccggagctcacgctctggctcctcctccacccgctccaccgggaacagtgcctccagaagccagcggacgctgtcgagtgaagcagcgccgcagcagcccgggctagccccgcaggcatacagcctcataggaccggaagtgagaggttctgaaccaaagaaagtccaccatacgaccctgaccaaagcagaaaccacactcagcacaacgcccagccagagcaaagccttccaaactgtctgacttagagtggacttgacttgcgcttgccccaaagtcaggatcttagcctagtcactggagctcgtccaccagccacgcaagcccctcagccagatacgatctcacttaagtagctgcagaaatggcacggaccagttctgatgagtaccctccttatataggataccaaacaaacacaaggacggaggctgaccatctatctctaaaggcacctcactgtgccttcagacagagtggaggggaggaggggcccaagcttatttggtgaaaataaagggaaaggtgaggctgcacacacctgaaacatcttacctaggatgttgcaagtcaccacagtcaagaagaagcgggaatctcgtagatcaattttctattcatttctgcaaatttattggattagtgtgattattcagatagtcaaaacagaagcccacgccttataatatacctatctgcaacatgtactgggagaactgcgtttaagaaattcacattaaaaaaaaaaaaaaaagaaggaaacacattttttttctactttgacttgacttcttgtgtcataaggtttgaacgttggttggggaggatttgcaatgtgggagacagagaaaagggacttttctcttacctcatcaacagccaatcttcctatttccgtcgaaccctaaaataataactaaggagggagtccaaccaagatgggacatgattctctgaagagctttcctttttgatattcagaggcttgacaacagatatcaagacgattatcccggggcagttgtggctctttattccaatttgactgactcccctaaagacttctctgctggatgtttctaggagaaacaaatactcactacatgtcacttaatgaatgtccttagggacagtcctctagagaaagtctctcagggatgttgaaagatccccttgcataccacttcctgctcctctttctgggaacaagagcaaccagaatttcaagactgcttggaatagagagggagagtagacctttctctcagtaggtcaaaggacatttgatactggcccaaaacttggcgattctttcattctagaaggatgcaaatgtgggacttttgatgattctaggccttaaattttcagcaatcatttcctaaaggcactgaaacccaaacccctcccatggccctctccccgctgagaggttgaacggtatcctcgctgtctttcttctcagcggtagactccaagagacttggaaggagtaaactgccattagggagtaggtggtgagcaaaacaaggggtggtgggcggtgggagtgggttcagctcaaggctgttaacatttttggcgttggcgcttgggaaggaattagcagaaaggattcactaccagcaaaagtatcaaacaactcacacaaggagaagaaaggtgtctgagaaatgtttaaaaaaaaaaaaaaaaaaaaaggcagcctttccaggacaagtaacttgccttttagaaggttttgaagattagggcacttaaggcacagctgctaaacctgaatgagcccttcaaagaacaaagcaaagtcagct

SEQ ID NO: 81 - DNA, 2260 bp, Mus musculus
gatttgtcagcctggcaccactgagtcatctggctggtctcttccaaatgcaaattttttattctgcgcggtttttgcatgtaatattaactcggaaagagctgctgtcttcaccaccccttgctcacctgttgctcctcatccacttttctcctggaaggtttccaatgactctcacaatccttcacgcacaataaactagactgcaaggctgacttcgtctctcttagcttgccagagtctctgccctcttactccccctactggctagacacaggtgttgtggagccaaactgctgccttaggagtagcagggccatagggagaagctgagtacttggtggcttggcatcatcgcaagtgcttaaactttggctgctgtggaagaaagaggtagaattctattgtgttgaattggctatcattctgagttctgtttttagggtttattttattatttttaaaattgttttatgtgtattggtgttttgcatgcatgcatgtccagggtgtcagatcccctggaactggagttacaaacagatgtgatctgtcatgtggttgctgggaattgaacctgggtcatttggaagagcagccagtgctcttaactattgagccgtttctccagcccctagggtttattttaaatcttatctactctaaaatgctcactgtatacaccgtgaacaatttcccacagtcttaaaaacatcattttcacgttgtgtataatattccatcatctaaaagctagcagaagtttgtttttttttttttccttcatgtttgaacccatatttattgagtcctgactaaacccagggatagataatggagatgcaggatgagcaacgtccattgctctagcttgctttctattgctgtggtaaaggccggtgaccaaaagcaatgtgggaagcgaagctcattggtttgacctacaggttagagttcatctcgggaatccaaggcaggaccctggacgcaggaactgaagcagagccctggaggaaccctgcctcctagcatgctcttcagggctcgctcaacctgcttttccatacagttcagaaccacctacccccaaggccgggagcaccaatcacggtgcactggaaaccttccgtgttagtcactgagatggacccccaaggccttgcctaacggccaatctgacggaagcaagttctcaattgagggtccctcttcccagatgtccccagttgtgtcaaggtgacaaaaaaaaaacctagccagcacaccctcggaggttacactaacaaagacaactggcggtgcagcccctcccccatcttcagagctagcatgttccaaatgcgtggtagagattggtgaatgtgacccgaaccggtaggaacagggtttccaaacagcgaggcatcgggtgggaggatgggggatgagaaataaagacgagaaataaaaaagacaaaagcaatagctgggatcaggaggtcttgtatgagctgatgtttataaagcaagcttattaagaattacagcatcccaaatactatttacagggagaaaacagccggaaaacaggtcagcagagagctgcgtcagatgatgttggcaaagagaacacagggtacctgagacacagctgcctaagtggataaccacagcccaggtggaagcgtccagtatccagacgctccaacttaggctccctcaaggccttggctccagccctcctcagccttgccaagtcccctccaggacaaggacacagaactaaagtcgctttgtttctcaggacctctgagaaagacttgggtctctggctccctacactaatgattcactaaagctgattccctatgggcttccagagctagactgcatttcccatcctcctttgcagctgtgtgtagcctctgaaccctggccagtgtcataggagcagatactttgtgtccaacatcggagactctaatctactgctactgattgacagatactgagatcagcatgtggtaaaaatgagatttccgggataaataagaggagaacagacacaacaactgaagcatagaaaagacatatttgtgccttaaagaaaacgcttgatgtctggagtggtgggccagctgttaagagcatttgtagagattctgagttctttcccagcgaccgcatcatatggctgtacctcctctgggtctgaccctctcctctggcctccaacagctcctgcacttacatggcttgcaaataaaaatataagtctttt

SEQ ID NO: 82 - DNA, 2409 bp, Mus musculus
gatcgcttgctgaagattctctctgcgtttgctgtcgctgcagcagcggacgacctccttagggccaggcgtcccagctaggcaagtccagttgaccactcggtgtgcttaactgagacccaaggtacgacttcttggcgcggttagcgccgctttcctgttcgggaggtcccgctccaggctcttcggaccctcctggcgtcctcgtttgcgtcgggaagggcggcagcggcgcccgggcatggcttcggctggcagcggcatggaagaggtgcgagtgtcggtgctgaccccgctcaagctggtcgggctggtgtgcatcttcttggcgctgtgtctggatctgggagctgttctgagcccggcctgggtcaccgcggaccaccagtactacctgtccctgtgggagtcctgccggaaacccgccaacctggatatctggcattgcgaatccactctcggcagcggtgagcgcccccaccccacctccggtgccgcgccccttgctcccgcgtggccatcctgggctcctccgctgccaccgcctctctgggagccacctcccccactttccttcgctcccctccctgcctccttgccctaccttctcggcccttggaccccaggaccctcttgcatgtgcccctctctcgaaggggtccgggtaggcaagactccagagacctcctacgccctctactcctcccttgctcatccctccagttttggagtaacacgtctgctattttgggcaattgttatcattgagggcgagaaccatgtggctgtgtaaaagacgcaatgccttccacacccccgttagaaaagaaatgggtaaaacgctccaaatctgtgtgggttctctgttccaaccctctaagagaaatttgcccaagttttcctgaaggcccacatttccccctattctatttcactttacctggtgtattggctaggaaccctgactaagacacctggcttttcccgagtgaattttcgtgtgtgtgtgtgtgtgtgtgtgtgtgtgtgtgtgtgtgtgtgtgtgtgtatttcccctttaaattttggggagggataccgagagtcaggagagactgatgaattttctttccttttttggcgacaccattgttgcttctgagtttcctttctttcactcccacagtaagaaactcccctttcttccactccgttttctctgagctagttactcacagttgcctggaaagttctgcttcattcagcaagcagtgaaaattgtgtgcggatgggaaacggggtagagtaggcggtagccattgtggctactagctcaaagggactttgtggctttattctcttcctgatcctctagtttttgtttttgttttgttttgtttttaaccccatttccagagtcccattcctaagaatttgccaacttccaatttcttgctgaaaactattgctacttgaattctgtttcttcagctgctgctgtgtgcacagattaaggaatgtaaaagggaggctctgctgggtgctttttttttttttttttctttttaatgctggcgcgcgctaacacacacacacacacacacacacacacacacacacacacacacacacgcacaagctcacgctcacactcacacactgacctgagaaactcattaaatcccttcttgatagtttcaagtcttttctgaaacaatttttttaagctttgctggaaacgtttcaagttctaataaagttgaaatagcacaaagaccacacacacacacacacacacacacacacacacacaaatccgacttttctttgtcttacgttttttgttataggagaaattagttcacttagttaaatttcttccagaaatttaattttgtgcttacaaaggctttttctttgctgttacctcagaatacctattgaaggctttctttgttgattgattcttagtgaaggggactggttggcagcaggaggtcaacactcaggctttttaattctttcaggattagttgtttacaactgaagataaaataaacccacaaaatgcctttctttggtaaccaggggctccaaataaactttggaaaaaatatcttttctttctcccttcaatagaaatggaaatttatgtaggaatgccagcttcagcagatctccttagcaacgtgaatcttttgcccccttcactctgtctcctgaaataatagccctctgattgcataaagacttttcagataggttggagaaaccagcttcagctcccatttgctttttaggctattatccttttctcttggcttggaatgtggggaatggacgaaaagcagcttcagtttgtttgctaatctttccttaattgcctccataccgattgattttagctacaaagaaatttgtaactggacc

SEQ ID NO: 83 - DNA, 5119 bp, Mus musculus
agtgggagctgaggcatggggcacagggttttataaagagagcatgatctaaggtaagaaaatccaggataggggctttgaactgtgtagcaagtacttgtgagtagggactgagggagcctggcatgggttttgatacacagccacaagtccgcgtcactggaaccctgtgtcccttctgccagaggtaagggaagtgactccttttggcagaggggaaccagtttcacaagttcctgaggaatgctggcttttatctaaccactagaaaccctcttatcgttcaggctgagctggacctagactcaattttggacctcagtgtgcctgcccttttcttggggtgggcaggtgggtgagaggtgatagggtgattttttccccctccttataaactccaccaatgttacattctggtcactaaaatgtatgtggatttctccttccaacaaacattttctagggatgcagtgttgttgtgtcttaacaatttagcttggttctaacattgtctactggagatggcatcagaaccaacaaattctggagtgtctcaggattgccccgcccccacctccgcttcagaccgactgcagatagtaagttgttgcctagagtcctgattgactaccccaaatccgaagttcccatccctcctccccagcattcattaattggctagagcaactcacaaaacagaaaaacccttccgtttgcttttactgggcataatgaagagccagatgggtgcaaaatgctggggtgtgggggaggggcgggggagaggaatccacgtgttcagctgtgtggagaccctccaagttctgtcctgaggactttgatggaggtggtatctcatatgtaaacacaatcaattgttgatcattgtcaatcaactcagtctttgacttccctccttctctagaggctgggggttggtgacttggggtggtcagttttccttaccaactctgactgcattagggctcacctagagacacacctgtgcacaagtctgtcaaggcttttccaaagtcccagcccgaagtccatgacggtcaccccttgtctcagcctgagcacagagagaaaaaggaagcagcaagcagagtaccagaagcaatgtgactttgcaatgtgactatgcatctcgcgctctcttgccgccatactttctgggctatgatggaccgaatgccctcaaactgaccacaggataaacccttccttccttaaattattttggttccagcaatgagaaatggatccgtctctatcctgaagctagttgggggcctccagcacccagtggttttcattagcattccacactctggggcctttatgggctttggagttgtgtgccaggaaccaaagttggaagccaattatctgttatatttattgttcgttgatggtgctgggggattgaatcgatatttaagagagaagtgttgcatgctaggcaagccctctgccactgaactacataccacacttctctcttaaatatcgatccctcctccctccttctccccttcctcctcccccttcctccccccttcaccccactcccaaaacagggtctcactatacagctcgggctatcctgaactcacactctattgaccaggtttgatgtgaactcttttttttttttttttttttttttttaatttatatgagtacactgtagctgtcttcagacccaccagaagagggcatcaaatctcattacagatggttgtgaatcaccatgtggttgctgggaattgaactcaggacctctggaagagcagtcattgcgcttaaccactgagccatatctccagccacctgacgtgaactcttcagcgacaggctagcctctgcctcttgagtgctgggattaaaggcatgtactactctgcctgggttctctctcttcttagattttatgtatatgagtgttttgcctattgtgtgtctgtgtaagcctggttcccaaagaggtcagagaaggggatcagatcatctgacactggagttacagatagttgtgagctgccacgtgggtgttagaaatcaaagcgtatcctctgggagagcagccagtgctcttaactgctgagccatctctctagcccctcaaatatctggttcttcttatattatcatgcaccagagaggaatgaaggaccacagctctggaaggacctttcttgaacacatttaaagataacagagatctgggaatgatggtttaggcaggacacatggatagctagtcaggaagagcatccaagcctcctgggacttagttttgccctgtgtgtatcacacttcttgggtcgattggtgctaaggaccattggcttgcagctcagggtattattgtccttaagaggcatgcaggctgggtgtgatcccactgctttggttacacagcaaatataaagcggcttgtcctccaggctcctgctcctacccagtgtgcagcatgtatctccgtgctcctcgtcctgttcactttagaatccgattttgtctttatgctcagagcccatgggaaagtatatagagatcttggagcaccaggagtggcttgggaaagggagtcaggccaattggccgtaatattaaccgatttcaacacacactaattactgtaggtattcatctaaggacaggtgtgatgttaatagcaatttcctggaatgattgcggggggaggaggaggaggaggaggaggaggaggaggaagaggaggaggaggaagaaactgggtgtgctggtatatacccatagtcctatattagggaggtgaaggcagaagttcaggaaatcaaagtcaactttggttccacagcaaataggaagccaacttgggttgcataaaatactgtcacaaccctcaacccttcctttccccaaaattaattaaagagagagagagatcaaaattgagttaaagaatatatgaactgatattcacttcttttctttcttttctttttttttggtttttcgagacagggtttctctgtgtagccctggctgtcctggaactcactctgtagaccaggctgacctcgaactcagaaatccgcctgcctcttttacttttacttatggattatactttttttttaattcccctcagagatgtttcattttaccacgttgaaggtatgggccaccttttagcccctgtccagctcactacacatggacaatttagagttctttggagcactgtatggcctttgaaatgccatccattacggggactggcctccttgtttttccctgtcagcagattctgtggagagcatcttgctggtagaccccattttattgtctaatgatgagattcaatgaagcagtgaagggtaaggcttttaaaatatccctagtggggctttgatatagagcataaaggtctcctctctggacccgctccactccttttctcctgctttattaattcaaccgtaaattgcacacttttaatgaagtgttacctttctgctaacttccccagcttcagttcggtgcagctcctgatggtacagggaccagtttacagctggctccaagcatcagctgacaagaggatccaacctagcattgtcacggatcttaaatgaagccaacacgttagcaaaccaggtggtttggagttgggccgtatcagatgcccagaggaaggacacaaatcaccatgcctctgtaaccagcatgccacaggacctgaggagagtacagctagcattattttaaagatacagacaacatcgtaagcctgtgggagacacatgcatggggaagggggttcggggagggggttaattccctcatccattatcaataatcatttgcattgctatgtgattagatctatttgagggaaaaacaaaagcaaaaaccaaaacaaaaccttgttggtcaggcatggtggtgtacacctttaagcccagcactcagaaggcaaaagcagaggtaggtggatgtcgatgcattcaagtccagcctgggctatataatcacatgctgtctagaaacaaaacaagcaggcatgtgtttggagaagggtggtctatggccgtttgttgccactgaactctactgagaacccagacctgccggcatttttttcacctctattgccatctagaggagacaattggaaggacatgaagtaagtccccagatggaattaagtgaaaaccaatactggaaagaaacatttgtacaaaactctaagaatcactacactttgttggctccaactttatgtttttctcctctctttccatctggctcagttacaggcaggatttgaatatccacttatgggcttttatatcagcacttccggcatttcgagggctccggtggacacctcttatagacataaaatcatgaaactttctgatgaggtggtttgtttgtttgtttgtttacttggattttggtgaatggagaagaggatggagcctttcaacacagagaggcagtttcctgacgtccatagcctcagaacctattcattttgtggggtgtttataggtagcacgttggtcaaatatgttttgctagggagagcagtactgagccgttttctttacaacctttaaattactggtgtgcactgtggacttgaggagatcaaacacggggcaagcagtgaccttggagcctcctgcctttcacagaaccgatgggaaatatcctgtgtacacttcaaggactgttcccacaggcaagagaagctggcctgctgcatgcacaccatgtgcaaacagaccagcccttcctcagctctcctgctcctctctgtctaaacattgttgaagctttgttttggggttgagtggcttaaagactgtaaccatggtcactaacaacagggatacatctttgtgagcgtatcgttgagtgtgctttcgtaagcctcaatggtatgagctaatttactctatgacatggcctcttgtgcaaccagcaactgtaaatgcagcatcaggaggctgctgctggcctaacatgacaaacttttaagtaaactccttttgatctggtctgtgttgtgcctctgctcatgcatgaggggcccagaccagggtgtttgttaggc

SEQ ID NO: 84 - DNA, 5497 bp, Mus musculus
gtcctagacagacctcattctagactctgctctgccacagatcgtcggtgtctttgtatgcttaattaaaaaaaaatggggattataaataaagtaatgctccattttccctcagagagatgcggtgaacatcagggagaccagacttcaagcgccaaccacagttgggcaaggtggaccaaagggctctgttctgatccaaagctggatgaaggtacggagttctagggtggcacactcaggacagccgtagctacagatgacccagtttgcttaaaaagacaacagggaaggaagggtttgggacatttttattataaatgataaaccatttgaggagtgagctgtgtttgcttgtgattgaacacagtaccacgtacacataaaaatcacccagcacagtatgcacagtttcaatttttttatgtagttaggaatcagttacaaataagttcagggtctggggagtcagtactgtgtaagcgtgagggtctgagtccagctcctttcacccatgtcaaaaagccagggtggggaacatgtgccacagactccggcattgggaggcagacacaggcgcgcttagaagcctgatagccagccagcctagctgaatccacaaaccccgggtgcagtgagagaccctgtctcaaaatattaaatgtgaagcatgctatggtgtttgtcaacttgacacaaacctgaacagccctgggagaagggagacggagctgaggagtccctctcaccactgtaaccccaggcatgtctgtgggggattgcacccaatccattgtgagggtgctgtccccaggcaggtggtccgaggctgcagcagaaagctagctgagtgatttataaagagcaagccagtgggcagagttcctccatggcccgtgcttcagtgtctgcctagagttaatatcttgacttttttcatgatgatggaccgttccctgcaagccaaataaatccctttcctctccaagttgcttttagtcagcgttttatttattctttttttgtctttttttttttttttttttttgagcctggatctcactgcatagctctggctggcctggaattaaaggtgtccactaccatccctggcagggtagagtagtttttatcctagcagcacacgaaaaagacagagtggtagaaggccactcaatgttcacctctggcctatgtgtatgtacacacacacacacacacacacacacacacaggcacgcacacacgcataaacacatgcacaaacacatgctcacacatgcacaaatgcacacacacatgcaggcatgcatgtgcacacacaaacatatgcacacacatctatacacacaaccttatacaagcaaaacataaatgtaatttaaatttaaaaagagtggaagaatcctttcgagcctctgtctccttgtttgcagaacagcaaaaagccagtgcgtgggggccgtgggggccgtggaggctgtggggaccgtgggggctgtggagctggaaccagataatccattccacactgtgtagaagggagcaacctatcagtcagtggtgcgtctgtgagtctgtctgtctgtcctcagggctccgttctctcctctcacttctcattttatcagaaggtatcctgatgtcaacctctgccttccacatgtgcccatgcacagcatgaatgtacacgtgtgcacacatacatgccatttctttatgtgcatcgcagttaaccattcatctgtccctgaatctatactctacctgttcattcatccatccacccattcattcattcattcatccatccacccattcatgcatgcattcattcatccacccactcattcatctgcccattcattcattcattcattcattcatctatccacccatccagttatccatctctctacgcatccacttatccacccacccatctgcctatactactacctatttatccatctctttatccattcatttattcatctgtatgtactcaggaatgtcatatgccaatataaataattacattacgcaggcaaaacacatggcactaggttgtcgaatttacaaaagctcacaaatgatagcttgttctcctaagatctgattgccgcacccaaatgccacaccttgaattcttccttgggaagatgtcaaacatccaggttagatttattatccagggctttcggggaaggggaatggtgacaagagtctgggagagaaaacaagagtccacattggacagtgagcggaggtagggagcctggtgggggaggggagggccacctgggaccaccctctccagacagtcatattgttagaagtgtcttcagctgatctcactgctccatgccgtgtgtccaggagagaagagaggaggctacgggcacaggctgggcttagggatgtggtgctggcttgctttcctccacggggactgggcccctctatgtcaggatggtgcgctgccggaagggaatgttgactcggctctgtagccagttgatgtagtcttcctggggcatatgaataatgtgttctctcacaaactgtggggtaaacacagtgttaatctcagagtctggtttgagagccagactagactgccactcccaacctctccttgacatcccagaaacctttgtgagatccaggattcccccctcccctgacccccccatgactcagacactcatctttaggttggtgcaaaagtaactgagagtttctttgcatcactgttagaatacataatacagactgatggctacgtgatacaatgtttttaatgccacggtccttgatttacatgtttggtagtgacttgtgccctgatgtttattttatactgtggaaatctatgttagtcggaggacagatatgagtttctttttggaaaaaaaaattatttttcattttatatgtgtgtctgtgtgtgcctgtggaggccgggaaagggcatcggataccctgaaaatggagcgacaggtggttgtgaatgagcatatggggagcagccggtgatcttaactgtggagccatctccatagccctttgatgttcttatttgaattcaacagagacagtgggtttgctccaggggctaatgaatgtccagcgcagggcggttcagggagacaagggcttgttgagagccaccatggaaactgatccttttcacaagactcaagaaaagtgttgtttgaactgtcagtttcgcttactatgcgtagaaacagctatttctcgagtgagttgtgacacgggccaaaacatggacagggtaaggcaagcgatgacagccagctctgtagctaggactgaaagaggctctaaggcagaaaccagacttgtaccaatacccatcatggctgctgtttgttgggctgcttttctgatccattacaggcgggggggggggggggggggcatccctgggggatctggtgccctcttctggttttgacgggcatcaagtacacttgtggtgcttctatgtgcacacaggcaaagtgagtatacatgtacaacaaaaataaatcgagagagagagagagagagagagagagagagagagagaaaaccaaaaccactcaaatctgctgtggtctctcttcttggttgtcaagttggctacctctgaaattaactaaaccccaagctgctggggtttacccgtgtgggggaagttttcttaattaaatcgtttgaagtgggggaaaaatccacttttaatctggatctttagatgtgggaagttaataatacctttgatttgggtcacccacaccttcctgccggcagcagatacagaggacacggaagaaggaagcccctctctctgccatcttgccctcacttcggctggcaagtccattcctccactggcaccagagcctgcttctttgaagagcagctcggacgtccagccttgtgagctgaataaggactgggctctcgtaccttccgtcggtggacagccgttgctgggattagcaggactacagaacataaagcatcctgaagggtctcctacatattcactctccatgttgttggggagaaccctgactaatgcatttgctttttgccaacagaccagtgtttctaaagttaaatgaagtgggctgagtttggagctgtggaatctggggctatgaactttggagctatggagcgtggggctgtggaggcgtggactgtgttcgtccagcgtattcctctgaccttcttccggcttatgtctgcttcttccatcacctgaaccactctttggctggggaacacttctgtaaccggctttgtgaagatgacattttccaagaattcattggatatgaaggcacaagtttttacattattggaaaaccaaacatgtctcactgggggaaaaaaatgtgttgatcagaatggtttctgttgtggctcaaaggcatgtgtctgagcctcgttggagtgatgcagaactcgccatctaaaacctcagttattccgcaccgacctgaacctcaggccagactggttgtttgggggtaaagggccccactccagtttctggcttcgatcttaagctgattttaagctcatcttgttgccattcacccaggaaaatttgaggagagcaagaaaacccagctagatacatttttttctcatttgcttcttaatctcttaacattccatcagtgtatattcattatatatataaagagatgggtttataatggctcaagaggagaatgctcactgaccatgcctctcgccaattacccctcctgtccccaccccaattagtcccctaaaattttcatgtcatgtgtgtgtgtgtttgtgtacagtctaggttctacatagaaaaattctagtagtctggccttcaaagcttactgtaacctgctgagtgacgtccacatctctgtaaatggcatgagtagcttttctaaagccatttgtccttaaagtcttcgttctggctcagcagctcttttaagacttatttatttttatcttgtgcgggtgagcagatctgactttgcctcccaggagaaggcttacgacacacaggcccagcgctttgcctgggcccttgctgttcggtggtctgtgatgctctctcctcggcaggagcatgctaagtgtcagtccacgtcctgggaggagctttcccctctgtacgacttggagacaaacacctcttctgtgtacctcaattactgaatccactgccctcaaattaattctgtttagtctgtcagaggtgtccctgaggctgtattagtgaattgagtagagtccggacatctgaactggcccacggggcctcctcctccacccctcttgaccttaccctgtgcacagcccccctaccctggtcatcctgtaaaaggccaatccatacttaagcctgtctactcttagagacttacgtgtgatttgcttcttttttgggaggtaccaaagcctctattaaaatgcacctatt

SEQ ID NO: 85 - DNA, 3758 bp, Mus musculus
ggtcgtgctttggagttcctaagtcgtgccgtgctgtgagcgagcgcaaaggtagtgacgcgttttacggggagtatggcggatacgggcttgcgccgcgtggtacccagcgacctttatccccttgtgctcggctttctgcgagacaaccaactctcggaggtggccagtaaatttgcaaaagcgacaggcgctacgcagcaagacgccaatgcctcttccctcttggacatctatagcttctggctcaagtccaccaaagccccaacggtgaaattacagtcaaatagaccagtgaccaagaaggttaagaaagagacttcttccagtgacagcagtgaggatagcagtgaggaagaggacaaagcccaaggactttccacacagaaggctgctgcacctgccaagcgagccggtgtgcctcagcgtgctgggaaggcagcagccaaagcttcagagagcagcagtagtgaagagtccagtgatgacgaggaggaagaggacaaaacgaaaaagcctgtccagcagaaagcagttaagccccaagccaaggcagccagacctcctccgaagaaagcagagagctgtgagtccgagtctgactcaagctcagaggatgaagcaccacagactcagaagccaaagacagctgtggcagctaaagctccgactaaagccgcagccaaacaagctacaccagcgaaagcacagcctaaagtagccaatgacaaagcagccagaagccacagccgccgccgctgccacagcagcagcagcagcagcaacagcagtgatggctcgcaggaagagaaggcagccgcacctcccaagaaaactgcacctaaaaagcaagtcgtggccaaggcaccagtgaaagtagctgccgcccctacccagaagagttctagcagtgaagattcgtccagtgaagagggagaggaacggaaaaaacccatgaagaaaaaagcaggtccctacagttcacttccaccgccttctgttcctttaccaaagaagtcctcctcgggaacccaggctccaaagaaagctgctgcacagacaaggcctgcagacagcagtgatgagtcagattcaagttctgaggaagagaaaaaacctccagctaagacggtggtctccaagacacctgccaaaccagctccggtgaagaagaaagcagagagctcttcggacagctcagattctgacagttctgaggatgaagctcctgccaagccagccagtaccaccaagagtcccttaagcaagccagctgtcactcccaagccatctgcagcaaaggccgtggcaactcctaagcagcctgcaggaggtggccagaaagctcagagcaggaaggccaacagcagctccagtgaggaggaggccaccaagaaaagtgtgacagcccccaaggccaaggtgaccgcgaaagctgcaccggccaaacaggctcctcaggctgctggggacagcagctctgactcagacagttccagcagtgaagaggaagaagagacacctaagcctccagctaagaagaagacagccgttcccaaaccagcccctggaaagagagcggagagcagctgcagcagctcctcagaagactccagcgaagaagagaaaaagaagcccaagggcaaggctactcctaaatcacaggcaagcaaggccggtgtcactccagcttctcagaatagaaaagcaggcaaggaaagtgaggaggaggaggaggaggaggaggaagaagaagaagaagaaacagaagagaagaaaaaggcagcctggaccaagccaggttcaggcaagaaacggaagcagaatgagacagcggttgaagcagcaactcctcaagcgaagaaagttaagctccagatacccaatgcgtttccaaaaaggaagaagggagaaaaaagggcatcttcccctttcccaagggtcagggagaaggagattgaggtgggctctcgagtagcagacaattcctttgatgccaagcgaggtgcagctggagactggggcgagcgcgccaatcaggttctgaagttcaccaaaggcaagtccttccggcttgaaaaaatgaagaagaagcagcagcagcgaggcagaggctccatctccgtccaggtcaattccgtcaagtttgacagtgagtgacctgtggtcatctttggcagaggaagggtggtgttgggaggttggcactcacctccaatggatccagaaactcagtgttattaggagagaattgtggcaaggacagtgtggagcaggtcctgaggcattccagtctgcagtcatctcatgtccctacttctggacaggtttgtttttgagcattgattgtcaaggataatcaaggattttatttatttatttttaaagaaatttatttgcttgtcaattgccttcctgttctgtgggtcttcatactgagaaatctgtatattttatattaaatcatgtcatacagatttttgttgtgattttccgagatgagttccacagattacaaccttagctattgcctaaagcaaagcaaaatgtcaggtggtagtaagtttccctactggagaattctatttatgtgagtgcacagacccacatttgatccctcctcccttcaagtggtaccgatgtcagtcagtcttgtgatatttgtctgctaagcatgccctgtgctcatcttcctcaattgggcctgacacagaagcttccagaagcctcgtggatctaccaacttcaggggatacaattgcagttcttggtacagtatcctactaagtgacaggcaggattctccagtgtgtgagtgccatgcaactgtcttcgttttgttctcagtagctattactgctacatgtttacagtactttttagttttaatttcaaagtaagcttttctgacattgagaggcatttgcaacaacttgactgttacttgactgttggatattaagttcctgaatgtatttgattctttttaaacatcaagagcagaatggtaaattcctgcatggttgtgtcatggtcaaggaagtggaactgactaacctctgagtcttggtgtgaaataggtatagtggatacatcctgtgaacccgtggtggtggtggtggtggtggtggtagtggtggtggtggtaaggaggaggaggaggaggaggaggaggaggaggaggaggagaggagggagaaggggagggggaaggggaggggcaggagacagaacagtgaggttgggaggggtctgagcaggactgttttgtcttgaagttggtacatggaagtaattatgtcctgtttaaattggtccactgaaatgattattagtatcttaactatgatgatactggtatagacgagccagggggctgggaggcatagctgggtgacagtgtgctcccttggcattcatagaccaagtgtgatctccatcacggcaggaagtgaatgagcagagaaattcctgggcaaagggagtagatgataaagccataggatgtgaccactggcagagctcagatagagtgagggaaggggtaggggagagcaccctagttggccggtgagaacagacaccaggtttcatgtatgaaatatgaaggcaccacatgtcgcctcccttgtttggtttccatggtcacctggtaacctgctaaaagctgtctgtctgtggcaggtccttgaggaagtctgcatggtcaaatctctgtgtcttaatacaaaaaaataaaataaaataaatggttcatg

SEQ ID NO: 86 - DNA, 7820 bp, Mus musculus
aaacttccagtttattgtgtaccaagagttgatccacaacctccatgcttcagaagtgaacaccatgttagggttgaacatgggcaccatgagcccctgtgagtcctggataagattctcaaaccaagatcagaaatcctgtgatgacatttcatcgtacagtaagctgtgaaggttttcatgcttacccgactctcagtggacattctggtactcttcctgcattgagtctcctgctgtgagctctgtggcatagcctgctgaggaatggaatggagatgcctatagaggtcccaatgtcatcgtcgtaagcaggtgtgaaaggagagatctcttcctcaccacccggctacctcaactcttttctggtagcagtgcctatgtagctgcatctaggttctcagaagcacagacatgtaaacaggtggttgggttgggctttaggacatactgtcacaggagagcttccagggtctctgagctggttttcttcacaggcaaacatcctgagggacctttaagtaggggagttctttattctgatttgcctgcagaagtaggaagacttgctatatcagtcctcagtaggactagaacaatgctgtgtaataaaacaaggtgaacctttaacttgcctaccatactgggactcctcacttcaccagtgcaaatgtccaaactgttcgtgttgctcatttaaactcttgacattcccgctcccatctttactcattccaaaatagctgatagcaaattcttttcattcatttggtggcaaaacgtgtagtactaggaaactagggaggtgctttgacagctctgtctcaaaggcactgactgctcaggcaactcaaaggaaacggccggctggaagaaaggctcctgaggatggcgcactggttttcagcaacattcatagagactcgggaggcagatgtggcctcaacctggtgaacatatgttttgatttctttttttaggattgatgtggtgatggtgtggctttccaaaatgggcaaatattcaagtcctagctcatcagtttcttgtgccaggaatggaggaagggaagtagatctacttccatatgtgctattctaggcatcacttcaaagttcttgcggttttcatttgttttgttttgttttaaaactgggcagagaggttgtaccaggagtgatgacagacctggaatggatgagggaagtgctgatgacattggaatgcccaggatgcatggcccttactgccagggtgggttccttcacatacctaggatgaaggggtctcatgctgcctgccgaggggaatgaaggctatgttattgacatgtgacagcaggtgctctcaggtgccatggattgatgcagggtgctcagctctggactgaggtacccacttccaatttgtaaaacagtattgatacatagggctacactcattactgttcaagcgttctatgttaagagttgtttaatttctaaagatttaaagcaaaatgcaaaaaaaaaaaaaaaatggtgctaaacttcacccctgagcactcagtgagactggtcatgcaagcatctacagtgccatgctcctcaagcctgtttttcttgtagaaatgttgccctatcttgtctttcccaatgtatagtgtgtgttttgttttattgagggtggggtagaatacttgccatttaagaaaatgacagaaagacccagaaaggtggggttggggaatcggtaaacaagaatccagctagcaaggcccagcatcacactgaagtgggctcagtggtttcagagtgaagtcgccttactcctgcacattccctcgtgctcccaatgcagttctgcagtgcaaatgctcaagttcctcctgccttgtcaaggagacctggaaatcagcaaggaaaattatttgccccaaaagacatgggctctattggtgtcagtcctgacttgagcataggcattcacaagttgaagtacagtcttggtcacctcatgggaacatgtggcagatagctctcaggaaaaagcaattgtggattgtccacttgggggctttgcatagggaggtcaagctctgaattagaactgagctgccttccatacgttgaccaaagcagtgataagggtggccagttagtggtagtggaaagggaccgtttcctgccctgggtttcctttagctataggctgcaaggtccccactgctctcagagagccagctaaactgctggcttggtttggaatttgtttcatccctagctgtgagtgccttttggtctggaaagttggcttgtctcatcatacccacagctaggacatatactctgtaattatgaattgtccttgttttcctgagctaaaagcgaatgtctttgatcattagagtttgttagtgttgggttgtttccactgtgaggttcttaaaatgtttttgcttcctaatgttaaaataactcatgttagaaaccctgtacacatgaaaaagggtttgtagttgagacattacgtatattttactgtttataataaatcatctatacaaaagtcttgggtgttaattttaatattttgagcaaaatctgttttccatgctatgttaacatctacaatttcactaatagtgttactttccattgatttctgaagcctagaaaactgtttttgtgtgttttttttgttttgttttgttttgtttgtttccccgaagagattgtatggccttcactgcaaagacttcagaccaattacttgtattacacttggttgcctcgtggctatataacttctgagtacacgtcatcaagagtcctgaatgaagtattgtagagaataaatcataatggacaaaaactgtcttctgcctctgtgtgaccacctgacttgagttactggaaacagattttccattattttgtttgatgtcctcataagagatttgtctgcctctgcctcacaactgatgggaataaagagatgggaaataaacccatcccagtgagagtacctgttaaaagattcctatgagctaggtaggatagagccatccttcaatcccaacatgggagggctacagtgagagactgtttcttaaaaagcagaatatcaaaaactataggtgagatggctcagcccatgaaggatgttgccaccaaatgaccttttcaccttgcaacacaatatagttgaaggagaaccacgctgtcctctgcctctatatatgtggtctggcacagacacacaaaataagtggtgtgataaaaccttaaagattcctatcatttgagattagaggtgcttaaatatgtggtatgaagttgtcctttattctctgaggttaacggtgctaattcttggtgaaagtaggggtgattagatacttttaaagctctttccaaacctagacatggtagctcaggtctgtaacaccatgatttgggggacaggaagatggacaagagttcaaagccaggatgaactgcaaaatgaaatcttatgccccatccccatccctgctcccccccaccccccaaaaaaacgttgattagtggcacatgcctgtaatctccggcagaatgactgctgtgaatttggctatagagtaaagcaatagtcatctacactggagaaatggctcaatggttaagagcatttcttactgaggatctggatttggttttcagcacccacataaccatctgtaattctagttccaggggatctgacacactcttgtagctttcttagagactgcacacaatatactgatatacatgcaggcaaacaccaggacaggtgtctcatgcctgtaaaaaccaccacttagaagatgcacagacaggcagaactttgaaaactcaaggccagcctggtttacaaaattgttggagtgtcagctagggctacagagtgagaacctatctcaaaaacacaattccactccagactcctggcatgttaaatggaattcaaactccaggtttatgattgtatagtaagggttcttaactgtggagagccatgtctttagccctagcctgttggaagttctttagccaaggtccagtacacaatgccagggctggatggctctctagccacctggattgtcataatgttgtatataaagtgggattgtgggaaaatggcaaaccctttatcacagtagtcctcaaccttcctaatgctgtgaccctgtagtacagttcctcccaactataagattattttcagtgctacttcataactaattttgctgttgtgtctgtagtggctattcctgattgtcaacttgactatctctggagtgaattacaaggctcacctgtgattcagatcttgaggctggaagacacaagtttctgacctggatcttggcatggagctcttgcggcacagtggccatgaaaagcttaggcccaggcaaagtaggaggcatggaggtctctaagttcagcttgggacaaagcaagtcccagatccaggtgtggtggtacacacctttaatctgggccacacctgctggagacctacataaggacattggaagaaggaagattagctctccgcctgcttgccttgtgggactgagcaactgctagatccttggacttccattcacagctgctgctgaccattgttggggagctggacaacagactaagtcaacaaattcctttactatacagactacccataagttctgtggctctatagagaaccctgactaatacagagtcttaatgttaggagatagaatccttatgtaattatgtttcccaaacttatggggtcaagagtcataacttgaggactggtgctttacaacctgggcatgtacagggagacagtgtttatgtttcaagtcaagataagctgtcagaagttgcagacaatgaaactctggcacgtccagtttggcaaaaactagtttattagggttactgactagagtatggccaactcacagctacactactgaaaactgccaacacttgtggggtggtgagctgtgacaggcagcctggtccctggtcgagcagtgttcagtagtgtaacaagggcactggtggccatctagaagaccatcaagctcactccctgatgttgaacaccaaggaaagacagaggaccaagccctggagaatgggaaagtgacacaattatccctagggataaaagactacagcttggaaaccctgatggactctggtttgataattttctagagcccctggggtctcctcttcccactatgggtgtcctgttcagatgcctgtccccgtgcttttctgccatttctccccatgtcttctgtgaacaagagacagcaatctacgggagcctgctttttctttccttgtccacctcttaccctcaaactgtctcccagatggaatttgggtcctcgtgcgtataaggacaagcactgtggtaactaaaccatctctccagaactcactctctagaccaggctggcctcgaactcagaaatccacctgcttctgcctcccaagtgctgggactaaaggcgtgcgccaccacacctggctactccctacctcttaaacagctctgacttctagtacttgaagctttaggagattaatttaaaccatatccaaacttcagactcttgaccttctcttggcatcttctctgactttctgttagatcatttgtcgatattgctctagctactgttggtgagctcatttggaggacagaaggacaggaggacagacttttacctaactcatcattttaaccatatggcctaacagatggcttatactggtttcctaaataaaaatgtcatatacaggccaatctgtgaaatgtaactttatgtttttcttactctctctctctctctcttttttttttttttttttgttttttagcccaggctgtcctggaactcattttgtagaccatgctggcctaaaactcagaaatccacctgcctctgcctcccaagtgctgggattaaaggcatgcgccaccacgcctggctattcttcttttttctctctatgcctggtgacttctctcctcatccctccctcctccatctttttccctatgtgtgtgtgtgtgtgtgtgtgtgtgtgtgtgtgtttgtagactgaatctcaagcccatttctactacctagatgtagtatgacataaactattgtcctgaatctctctgcaggagttctgataagcagagcatatcggttataaaggttttggggtttttttttttgttttttgttttgctttgctttaagatttatttatgtgtatgggtattttgtctacatgtatgtctacacactacaaccccatgggactatagttatagaccctgtgagacaccatgtggaagctaggaattgaatccatgacctgtgtaagagcagctaatgctgggagatctctccagtccctgttgtgacttctcacatgctgttcaggaaagcatcatgaaatggttaaaaagccccatcaatactatataaccatttattttaatcaatgcattccttctacaaatacagatacacagcagttttgtaaaactcactttatttacaaatccaaagactacctattcttgggccagtgagatcatgcagcagataaaggcccttgatattcaatactgatgacttgatttctatccccagagcccatgtcaaagtggaaacagaggacaaattccacagaatcaccatctaatctttttgtgcaccacagtatatttggccccacataataaaaatacatatttttgtcttgtaataaatacttctactagttttttaaaatttactttctgtgtatgtgaagattgtgtatggtgtgtgtgtgtgtgtgtgtgtgtccttcaagagagaccagaaagtgctttagatcccgtgtagctggagtcacaggtgtttgtgagccatctagaatgggtgctggaaaacgaacccacgccctctgaaagcatcaagtgttaaccacagagcagtctctccagctccttcaatccattttttattaagttagcagaatttactagtattcactactaagccaagcactatagagtttccaatagcatcacttcttcatttagcttcctacttgctattcaatgtccaccaacaagatgagttctcaatattaagttcacctgctcagaattgtcttttcaacaggatggtctataacctaagttagcatggattcagggaatttgctaaatagccacgcctctctgtgaacatttttaaagacaaggcctcactatgtaacctgggcttatcctgaaactatcattttgtagaccaggctagccttgaactcaaaaaagatcggcctacctctgcctgcctcaagcatgctggaattaaaaccgatctccttcaactcttcatcctcgcgcccagtggtttacttcatgaccaccacacccgggttatttttttgctttttggttttttaacataatcaaatcattgaaagatatttcagtatgtttctgtagtcacctacccagcttttcatcacaggccattccttggatcaggcacttagttcactcctacacctcactttcttctgaaatggcttacttgactctgtggcctcatggcaagcgggtgttgccggaaacaaacaaacaaacaaacaaaaaaacccacaatctccaagcgggcactacagaaccccacctccaacgaccggaagccgctaggacagcaccccgaccgcccccctcgcgggcagcctcgcgagctccccgcagtgtagaccctgtccgacctgcccttctccgccctc

SEQ ID NO: 87 - DNA, 95447 bp, Mus musculus
ggagcccgggaggtctgaggagggcggagagtcgcctgctccgctcggtttaggcacccgcgctccgcacgcggagctggggagctgggaagtaggtattgttctgcttctcaatgacaaatggctggcttggaagcgtaactctccccgccctttggatctctgctccgttctcttttggcactttgggatccgaggtaacaccatgctgggatgagcggcccgggagggacaggtaagagagacgcggttggccgcccccgccctgcctctgctcatttctctgtccagctgtgcttcgggctgatgacttcttttctgtcacttctggtgcgggacattgaaaatggagaagaagctctcacaccattttcagtaatttgatttctacaggacattaccctttttagaaagctgggttttgtaaaagaattgtgcacacacttgtgccttcgcacaggcacgcacacgtttgtcattccgtttcgaaatccagtagttgaaagcagctttgactgtctgcaccgctctccctggtaatgaaaagctttggtaatttcttccagcgaataaaccacagggtttgtccctagggaggaaaaaggtaattttgtgtttgtgttggaacttgtgaaactgtttggaaagggatgctaaaaataattgaataaataaaaagacgtccgcattctttcctgtatactccaactttgaagaacttcgttgttatttggggcacacttcattttacattgtaaaacttgttttatttcaccatgtcagtagtgaaagatgagggctagtcagtgaattccttcaatctggaaaatcagaaggccagtttgggactacatgcctttagaaggaatatattcaaagcactcttattcgggtgtttcagataagactactaaaattccttatgacctcctttcaagacaactgttgcagctgtccacgtgggagaagataattctatggactcagagcaaacctttagttccaatcaaccttgaaagatggtccaaggtgggcaagggctccctgccagtgttactgtatccacatttaaattgcactaggcctgcttttgtgaaaacatacatttaacaaacaaacaaacaaatccaacaacaacaacaacaaaaccctcttgctttctttagagcaaaagtgaggcacatgaacttccaaacacaatagttagttgtgcataaactccaaccccaaagataagtgagtcttacagctctttattctccttcaggcgtaccatatagacctccatcctattgactgtgggtatcaagatgaggtcacactgttgaaagggtaaacagagaaaagaaaagaaattaacaccccctagtttatgtaactgtggggtgggggaaatggcaagtacagcaatctgaaacaggatgtggggaatttttgaccttcctgtaacaaaaactgaatattctcatgcgtggtggctacataactgataaggatgttatttattttcattaagtggtggaaaaatgcttagaatttgactaaaatctgttatgagattgataattcatctattggatggccatacctttagaatcaatttttaaagaatgtttttaaaagttcacatattaaagccttcatcccatgtttgacttaagtatctgattaaagtggaaatctccacccccgcccagcccccatgactcatatttatttatttatttatttatttttagtaccccagcagcatcattgggggaccccagaaatgtatcagcgaggatacccgtaacaggtcatcagtgcttaaacaagggcagtttattacctggggaatgatgtgctgggggcgatcaccacacattgttaatagatatggcctggagtagctctgccgggtccttacacactcacccccccagcttcactcagaaacaatgatattcaacatgtgctatgtataataagagagcttgtgggaactctgcaagaaagggctgagatgatacaacctgtgtgttctacattctcagacgagttatttttattaagagagcaattgtagttttcttctaacaactaaactatacttactaatctagaaagtacatatcagtgccacacaatagatctgtgacgtcagcacctagagtgtctcagccaataagaaccaccgatattgggctatttctcctcagtaaattagttgttgtatagttttttttttaattctaaaaagcaagataccattttgcaatttttgtttacgttttacctgacaaggatctgcttccatatcactgaatagtctccccgaaactctcacatgttttgacctgtttcccccagtttctgtgcgaacatggggatttattaactatgctgaagttctttgaaattattgggatgtttatacacacctccaaatttcaacattccgatttttatttttctttataaactacccatttacgtctacttcctccagatttatttgttatttcaggtgctgagcatcttacctgcatgtgtatgtatgtaccatgtgcttgtgtggtgccagaaaaggccctcagatcccctgtggttggagtaacagacagttgtgagccaccatttgggtgctaggaatcgagccttcatcctctcacagagcagcaaatgttcttaaccactgagctaattctccagccccgtgtctacttttcattgaggagcgtccttatagggttttgaatctatctttgtcttagactttagtataaacttgatagcttgtttaaagataaacacagtgattcacatcaaaaggctgggaggtctgagatcatggtgctgatggataaaaaggtacccgctttactcgagccaggctatgtgtgagaatggtggtcccgatgcccagtgggacacggagggttttgccagcttcatttggccatgctcagtatgagttaactgaggacagggaagcgtgattgggctatgacatggtaaggatgtagcaatggtaacaggaaaaggacaggtgagcagacagtgtagcactcagaggcccattcatggaacagggggatatggctagcagtgagttaagatactgctgtgccagacacgtgtgctgctcttgtcccaaaggtgccccgagagatgccttgggaagtgttcctttcccgaggtcaccattggagaattattctgaagctccttgttccattttcctgtgaggttctctgccttttgtcccattccagtgtctctctcggacttgtgaaaaaaatctgaattgttgtaccatatccctcccttctcaaacatctttcatggtttcccgtatcttccaaactaagcataaactcttcatctctcaacgcctaaaccttcactctggtcccctcgcacatcatcgtttgccttcaccataatgaatgaagagatgcctgtcttcttcagtgcatgcccaggaatgctgcttgcctcaaaggacagggttaggaatttgagttgatgtgcttatttgcttcatgtttaataaatatataatatgcatacatatatgtatacgcacattacataacattgtgtgtgtgtgtgtgtgtgtgtgtgtgtgtatgtaataatctgtgaaagacctttacgaagacatttggtgttatacattgttatgatatcttatgttttaagtgcatataatcttttagagccttaagaattccttttcagctacagaagaaactcatcttctttatttactttttttctctcatcatttctcaaattattttcctttgctctaaatattgtcttgtttactcatacaaaaatactatttctggcatattaggaaaatattgtgactagttattttaagaataatatacacagaggtgaaaactattagctgcataaaaagaacattggataatattctgtaaggaagtcataacttaagagtaaagctttttacagtaggcttgaattaccacattatggtggtccctcagcctgggcaatggaataggtcgaacttgttagcaataccatttcttagcccttattgtacacctcctgagttgggaacaggacagcctgggcctggcagagagaaagactgagcctgtgtttgctaagctccatgtgagattctgtttgggggtgattctgggaaccaagcttagggaagatactcaggtgagcaggccagtttattccctgggctttgacaggcaggcctgacctctcaaaggactctaagaaaattccaccccttttacagtgtcactcctactgtgtagggagcgggggatccttgactgaatgtagactatccacatggggcatgagcatgtcggtatgagcatgtcaagaaccaacgcctcagattcatggggatggcaaagcatttcccatactggtcaggcttgagattggcaaagccttccccgggtccagagtgggaatgttgatagtgtgtgtaagtatgtgagtgtttaaaaactcagagtgtgcaaaaactagcaactgtagcttcttctccctttcggatgttaacagcctgaggctgctggcctacagagaactactgagactagctaactcttcccactgggctatatataataaacctgcagaggttccaggtggctgtgtcattgctaccacatggacgcttggccccaagcttttctatgcgtgtgtttatgcttccttcattcccttcctgcccctagtcaggccaaggtgccaagtcctgcaggttacagtactaataatacctttgtgtttccatccagctgattgaaaacacaactcatctacacacacgcacagatacacacacacataccatccctcccccaacccctgccgagtttgtaaagcaaccaaagtccagtgtctaatacttaaagattgtgtggcctaggcttataccttttgtttcctgacagcagattcctgttacacacagaagtaagcttaatggtgttgtgtttgctgataggaaattcctgttgggtagaacttagcatgtacccttcttcaatattaatctgacatggtgctaaagattaacacggacactaccgagggatccaggtgtgaaggtcagcttttaccacagaggcggctacttatcatatactttttgagatttttcttaaaaaggaaaaagcaaacaaaaacttagcccagcagaggtgaaatatgcctttaattccagcactcagcgggtagaggcagacagatctctgagtttcaggacagccagggctacacagagaaatcctgtctcaaaaaacccccaaaccctcaaaaacaacaataggaaccccaagtcctcaaaacttaaagtattgcatgtatgccctccaatttaaatgtagaagcattcttaacttctgcttatttagtgcaccatcataagtaggtttcaaaattacaggatgtaatctgtttatggttagagtcaattttattctttaaagatgaaaatggaggaagatttacttaaaaataaatcttcatgagaaagatggacttaaaaataaaactcaattataatacctcaaagttaaccagcattaagattctcaacatattttgtaatacattttatatagtgtatctacttttgtgtggtttttttttttcaggctcgtttccaaaatacatttcaaaatatataaagccccagtgaataattcatgatgtagacttttagaagaggacagtttgaaacgagactcctgtaatgacaacagaatatttcagggtgatactgaaacactgcagtcccaccaatgagcccagactggaaataggctcacatctaaataaacctggttttgtagtgtaatagtcacatgaaattttcgcagtcacagtaagtcgcattaagattgacttaaatactttgctgtcagattcataattaaagacataccggagattattaaaagttcacctaggtacatgggagctgacggagtaaccggatgtgagcagctactcacttgcttttgtaacatcgagtcaagtcagtctctgaatctcattcttcttgactttaaaatgaaatcttttgttggatatttaatgttattttcacctttacgtatggagtttttgagtttctgagccttgccatcttgaaaaataagatttatttttatttgtgttgtgtgtgtgtgtgtgtgtgtgtgcctgtctgcatgagtttatgtacgtcatgtgctcgcaggctcctgtggaggatagagaagggtgttggagccctggaactggagttacaagggttttgagtgacagcactggaaatcaaacccagtcctctgcaaaagcagtcggtgctcttaaccactgagtcatctctccagcctcaagccctgctgcctttcaattgctttccttgaatggcacacacgctagtctttagcaagtaagaagtattcctactgtttattggtctattgtacacgaataacttacatacattcttatgaatgtctaataacaacccgacagggtaggtgtgactattgtcatgtatcttttatggagaaactgaggctactaagaaatcttgctggggctgagtgagggagtatgaattggaacggttcatcatttgaaactgaggttttaaaaagaagtccgttctgtgcatcttgctgcccctccctctttttaacagaaggatagcttgctttgatcctgggtttcgaagcagattcttgatttggaagcggagtatttatttctcttttgtgtgagggatcattttgtgtactgtgggatatttaacagcttcccttgctggtggcttccataacaaaaagtgtctccaggtaattgcctaacctggccctatttacaccatcggtcgtctaaagctgaatggaactgccttctcgggcaaaggtggcatgactttaggacagcttaaggatcaagatgcaatcgaccatatagatctctgcaaaggatctgctcatccattcagtccttgtcctaactgatcagccctcgttctcggaatgtttgttttgtttgaagaggattattgccaagatgcatagtagaactcctagagcctgactggcagtggttcatgtatttaaacagagtccttgggtacctgctctgtgacaggcattgttaggtcacggtcagaacagtgaatgagatagctatagaagggatgctgatagtaacagaaaatgttagctcattgatctttatcttcctgagaataatttcaagactgtcttggtaaccacagtccagggtgttgaccacagtttacacacacacacatacacacacacacacacacacacacacaccacataaaacaggagttcgccctcggcgtgggtgcgtaaagacagcccggcaggagatttgtattctcccagtttaacatgatcctttggttccagagttcaaagggaacactgctctgagtcccggcttccttgcagaacttgcttatttatttattggttggtattttaatgctctgttctgctcggaaacctgccctggcctctgtttgtctcctggcagccactctctgaggtttgtgctaatgagagaaccccatggggttcatggctgatccctttgctagactgtgtactcctgcaggccaagaatcctgtggagatggtgcgggacattagcttcggtgcccggaacaggacctagccagcctgtgggagttttcagtactggtttactaaataactagaaggaccgaggtgtctcaacagcagaaagggttgtattaagccagtgttgctagtttcagtcttacacttcttgaagaccatagtagtcacaattcccttatatatttttggggtggggggtggggttgggtttttttgtttgtttgttttggttttggttttttggtttttttgagacagggtttctctgtagagccttggctgtcttggaactcactctgtagaccaggctggcctctaactcagaaatctgcctgcctctgcctcccaagtgctgggattaaaggtgtgcgccaccactgcccggcattcacttatatttataaacctctggtttggagttagaagagttttcctctttgtcacaccagattcttggtaggagtgggatggtgaagcctatacaaccatgtgtgtgcattcacagaggtgatgagaacaagaagactcagacacagatctggaggcaccaccgggtaccttagctcccagggtactggtgctataactcccagagaagaaaatgtactgcgtgcctggtgagatgcaggagcgagtgcatgttgtatgaagatgtccatcccggatggaattaattgtttgctttctgtgatgtcttaagtggtctgaaaatctaggctgttcagaagaccgtcctccctgagtgaaacagaacaacggggtttaaatacttcagctgcacttaaaacttggctctgcttgttttatttcctttgttacgtgctcctgttatgttacaggattaatggcggcttcacggttccgtgctgtggatcgtaatgcaacctctcatgactctggcatgcagaatcaaagctgtagggagacacggggacacgccgccgccgccgctgacgactcccgtctagagccggtgggattaagacagctcaaggggattgtgctgcattgcacagagggaggggctgtttcacttattcatcctttacttcaggccacagatactcagggaaggtctcgactggatcctgttctagggtaaagctgtatccacgaatagaacagacggaaagttttactctgatggaggagagaagcatacaaaagctaaaatactactactactactaaattatctgtagaaaatgacatgaaagttcaatgaaaagtaaagcacaaaacaggctgaatgtgaagtagatcttgtgcagacatatgctattatgcaattaacatggggaccattactgttttacactgaagaaatagccaggtctaattcttgtaatggaaccaggctgttgaggatggcccaggggttggagggtgctgtttattattttcaagcaacagctaacttaattgcatgattgattggatgtgggatatgacggggaaaaatgtactcacggaagagtgcgccggcttgggatctgagcatcttggaaggtgggggcagccactgactgacaagagagcttggtggtggaagctggtctgagcatagtctgactaactagcttagtctgtcatgtgtgtgtctggaggtgggctgcttccttggtggctcagtgtaggactatgagaagtgtatgcttgagaaatgtatctggggaccttgtggaagctcttatatgatgtctttgctttttttctaatagaaaaagaaataagatcaggaacagaaagaaaattgggggatgggagatattaaatatcagaggaggagggaaagtatcggaaacaattgtgcgtggaggtgtgagttaccagactggattcactgattgtggtctgtgctgacttgtggcttgtggctgtgaatttcacatgactaatgtggggtggtgtgtttctctcaagtcctttcaggccaaaggcactgaggcaggagggatacaaagtttgctgcaactgctttgaatataggcagaacatgggttttttctgagaaggaagaaaagcattatcaggtgtaacaaatatacaagagagggggaggtcataaaatttaagcctatcaagaagagaagtaaaacctggtgagaatgatgggcagtagagaggtagttggtctgttagtggaggatggatcactaggtattggagtcttgtttaaagtagcatttattttaatataaattgtatttacgtatgttggatcttatttcaagtacctgtgaaaaatcaactgaccacatctaatgtttctgaaattcacaaattcaagtatttaaataaatattccaacacagataatggtaagtattgaacattaatatggacttatgtttatattattaatatagtaatatcttattaaccctgaaaagccaaatctcaacaacacacaattccgtttcacagcatagtgttgtagaggtagctaggattatcaaaatcaaagcatagtttaaaatagctacttttagtgttccaatatatgcttattcagttttcaaaatcgattaaggtaaccaggaagtcatttatcagtatagatgagattgtaaataatgcagggatatgcttatatgccttcaacatttgcctgtttctctctaagctgactgaccctaagtatctacccaaggagactcacctaagatgtgatcctttctagaaagtaagagagttactgaagaagagaagtattgaagctttctgtgtctggatgggtcatctaaatccattcacccatttatccattcatccatcatccatctacccactcatctcactaataaacatatctgttaatatgtgctaatgggtcctaacatatgatggcccaactataacttttttgtctgtgagttgatagtaaaacaatacatatttttacagtaatgtgcttcagatttggaacttcagtttttttcctagacagatgcatggtatgactctctctccagatgacaggcagcagcaatgagcagccacttctcctggtgagccacacaatcacattgatagggaactggtcgcagggtactgccatgatgccagcattctgttcatacagatattcagtaagttacagagatagtccacactgtgttgagaaatagatgtgttagatgattttgcccaactctagcctcatggaagtgttttgagcacattgaaggtgggctaagctttgactctcagtagctgggtgtatcattctgatggctattcctggcggtcaccatgactacatctggaatacactacaacccagaaatggaggacacacctgtgatccagatcttgaggctggaagacacaggcttctgacttggatcttgacatgggatgatacacacttttgaccaaggtcttggcatagtggccaggaaaagcttaggcccaggcatggtagtttactcctttaatcacaggagacagaggcaagcagatctcttgagttcaaggccagcctgggacagagcaagttctaaatccatgtgtgatagtacatacctttaatctgggctctaccttccctggaggcctacataaggacaatggaaaaaggaagtcctcctctctttcgcctcctccttcatctgcttgcactaacctgtccgcacatctgttggaacctacttcgtcaggattccagcttatacagaagaccagctgaaacacccagccttgtgggactgaacaactgttaaattcttggagttcccattcacagctgcccagtgttgggttaattggactgcagactctaagtccttccaattattaattttcttaatatatagacacattccataggtattgtgattctagagaagcctgactaatatttgacttataacattttaaacttgttattgctagtctggtctacaaagtgagttccaggacagccagagtcacacacagaaaccctgtcttggaaaagacagagagagagagagagagagagagagagacagagacagagacagagacagagacagagacagagacagagacagacagagacagagagatataacatattgacttggattggcttgtttaaaattcagcatgtcatacacacagataaaatatatatacatttatgatatacatgcatttatacacattttcatgtataaatgtggcataaacatatgtatacatggataatatatatgtacacataaatatacttaatttaaaaaccttattttcacattagagaattgaagaaacgttctttttaatccgtttgttaacaataaaaattgctactttttctagtgtaaaaccatacatcttcatagatacttcacttcatattattctgtcgcgtccgctctcgaccagcaagaacgacacgaccaccagtccttctaacagcagtttactcagcaaacttcagtcttcatctctctacttcatctttttcctcatctatctcccctgaacccagggcctctcactcttatatactctcagtcctcatccactcacagcaggccacatcacctcaccaggcatgcagcttcagccaatcagggcggcaggggcatgtctccaccaaatatggacttgtttaaactgccagcatcatggtgcacctgtgcagctctcacgatggtcgtggcttattttcgggtgtatgaggaagtcaggtgcaagtcataagacttagctgcagtcccgggcgccatcttgggactgctgccacactcgctcctcacattattcctctgcccttcttaaaaataagcgtgctgtgtttgggaagcctaatttgacccttcattagaaaggatatctgaatgtggactcatttttatgatgatgtccatgtgtgtatgggatggggatggggtggggcgggatagtggggcatgtggaggggcttccttcagtctgcatgagaggctgcttctgtgagaacctgaacattttctgtctctttcctaagcatcgcccatgctgtctggcatgtggtgagctttcaggatgtgtctgctgattgacttgggtaaaccaagtttaggttctcatttttaataaggtataagggcaatgcacgtgatttgagttgaccttttcctatttagggcctttttaaaaaatggccaaactatcataaagatttctctctcaaaggtatagtgaaagtataagttagctttttaataacctttcctaacatctccataatgatggtcactcttatcaaaagtaattactttatggcagtgttttgagtaaggcagtaccctggtctggtttcatgcatatacccaaaatataggatgtgcatgcctactgggatttaaagtttaatacaaagaaatattgcatagccttcaaaagtccaaggttatttcattcaagagatctgacttactcaccgagtgcagaaaatggataaggtagccacactcttcaagagacttagctttctagtgaaataagttgactcttgccattacaaaaccctacattagatatagccaggtacgttttatgcttatcttctttctgaaagaagctacaaatcgaaggacagaaactgcttctgtgggtaacaagataatcattgttaagggagcctcaccagtgaaatacctgggtacccgaaatagcaaagaatgtgaagcgatcttattgccgttcctgtggcatggaagactgtctcccgggacccaagcctcttgtagagagtgttagggaatggggtcagaggtgacatagattggagcaagctcaagtcttcctaggatgtcctttacttctgccatagccatctgtgatgtatagatggcgagacattcccgagataaatcttcgatgaaagaattcctatctcatatttagaaactgtttgctgtaagtttctcaatacttgttattgaccctgatagataaacaacatttggagcacagaaaacctttatgatttcattagtgtttttttccccttccttccttccttccttccttccttccttccttccttccttccttccttccttcctaagctaaattgaaatttatttttattattttacaattatgtgtatgggtttgtgcatataagtgcagagcccttgggaagccatggtttgggatcctctggagctggagtgtgtggagttacaagtggttctatgtgtgctgtggcaacaggaactctcttaactcctgagtcagcttagcagcccctgggttgtttttgtttgtttatttgtttgttttttaaactttgctcattgacagaaagttgagtccctaacatctagttgtctgtattcatccattttgatgatgactgtgtttactgaacaaatgttctgggaagttgaatcctctcttcctcctcctcctcctcctcctcctcctcctcctcctcctcctcctcctcctcctcctcctcctcttcttcttcttcttcttcttcttcttcttcttcttcttcctcttcttcttcttcatctcctcctcttcctttcatatattatatccccactgcagtttcctttcccacgatacctcccagttgttgtctagccccatcttcccttgatcctctccccttccatttctgttaagaaaaaaaagagcaaacctcccaggaatagcaactgaacacagcataacaagttacaataagactaagcacaaaccctcatatcagtgctggatgaggtaacccaggtccctagagcaaaaaaaagagtcagggacatccctactccttctgtcccacaaaaactccaagctacacaaccaaagcatgcagaagacctagcaccgtcccatgctggcaccatgatggttgcttcagcctcggtgacccctgatgagctctgcttagttgattctgtgtgctgtgttcttatggtgtcctcagcccctgtggctcctacaatccttcattcccccactgcaggagttcccctggctccacctagtatttgagtgtgggtctctctgcatcttttctctgcatgctttcatcagttgcttgatgacacctctctgatgacaattgggctagtgggttgtgaagaaggctataattgtgttaaggtgacgatccatcaccttaatctcttccttgccaagcttttgggaatgttggttgaaatgagtactaatagtattagatctatagaaagacttaatccttaaaatctcctaacctggtggtggtggtgtgtttctagacttttggttcatttcagcctgtgcccatgaggttctgtttgtatcaactgtcaaactagtggccttgatctttatgttaaaatgaaatgggcttcccaacaatgtgtaatacatagacatacttgtttctgaactccaacccatacctgcggggtctaaaaccaaagaggtgaacttcaggtgattcaggtgcatcctgagaaagacaatcctgaactgactccctgcaagcctgtgtttgtcttccagacaggtgacctcatgtgtgtatttgaagttgtttgttggctggggacaccctctaaaacttttaagtgctaactgggcccaggagaattcattagcctgtatttaccattggtaatctttcctgcttccaacttgccaacttaagcattcatcaagggacacagagttttgagaacttagcctgtttttacgtgatttgtgtatagtaagtgactttaataagcactaaatgtagctatgctttaccagtaacttttttgttttttaattttctagaaaaagtgtcacaaggagatcagctcagggcaggagagtatctaaatcttaaacgttctttggttccagttgatcttctttggacttcaagcactcacttcttcatatcatttaaaagcatcttccttatcgatggcggagaatcgggccaactctaccctgcgaactttgggttgttaacagaaaacaatgataagccagcttttggggattatggttaaatcttggaattaggaatgatgatcttgaaaagcatcttaaaagcgttccacattaagttgttctttgcagcttctgtctcctgggtgccagacttgctcctgggaacagctgagagaatggagaaggaggagggcgttgctatcctttgctagtgagctgcttagaaagtgctctagttaactgaggaacaaggtcactaaaagatgagtgggaccagtgattgagcccgagttaagagtttaaaaacttaaacacagatgaatatctgggttatattattatctatgcatataagttctcaactaatacagcaatagttgacctttacttagcgtttgtaaagggtcacacattattctgaggcactgaagtattcatttgatgttaacaacaaccctttgagtgaagttagctgataagagaggtaccaggaatggacattgatcccaggaccgagaaggtatgggttgcttctgtcagtggtggactgatgcaaccgtaaacccaaatcaacgacccgtgcttcctcaaccttatgtctttcatccccgcttctaagagaaagacagtggtgccgaattagtacttttcaatattaccacatttctctaagagttcaatgatcaatagatatctgttgattgtatagctttgggcaagacacacagagagcaatgcctaagttctccactgaaagggaagctaccgagacacactgccaagtacagtgactgagccgtgcatcgggttgtggtgggagcagagtaggggatgccctgacatgctgcctatgtgaactcttcccggccttcctcattccacagtcaacctgaaaacaggccagcgagtcagcaggggcgagtacggcgagtgtgtattgtggttggccaaccctcagtaagagggaacagtgtgtgcagaagtacagaggttattctaggctctcaacctacgataagccatcagggtgctaataaaattacacaggcatgggctccactgtagattccccgggacctgaatctcctgggaagagacctggcagcctgattagccaggcaggccctggagcattcttatcagggaagcttgcgaaaccgaacaaggagaatgtaatcggtttgcaaatattgttggaatgagtttgagagagaatgtttcggggttaagtttgggtggtatagctgtcacgtcttgtcagattcgttggttaggacattggtgtgactgttcagtgttggttacttccaggtatcccaggtacattgaacggagcatttacttagactcaagatcacttaaagtttgtacctcagttcaacatacagggttcgtagccttttgcgtggggatagcctatgagatggcagccagtgcgagtaagggtgagaaggaatcgtttccatctacagggtgtcccatgatctaagtggcatccattttctcttgaacacactgaagccgagacattactttgctgacaaaggctaaaggtaatatgggaatggacgtggacacagcagggggattttagtgtgtcaagtcgtggtgaggatgatcaatcgtgaaatataaacgcagcttcatgaaagtatatggtagaaggcagtcagagggcagtgggggtagggcaaaagaagaaagagagagaggttggtgagatgctgagttaaagttagataggagacataaattctgatgtcctattgttcagtgagggaagcatggctaccataccgtattgactgcttcaaaatggctagaaagaattctgaatattctcatcacaaagaaatggtaagtgcgtgaggtgatagatatgctaattagcttaattcaatgattgtacagtgtatatacatattaaaatatcacaccatgctctgtaaaactgtatgcccatcatatgtcaaataaagtaaaaagtattttaaatggtgagcagggtgcctattaactacaacttcagctaaaatggatgaactatgaagtgcactgctggagtcaaggggccataataaaaaaaacttctgacaaaaatgtgtgcctgcccagtattctgttgcttttccttttgggagaaggtaattatgaatgcttcaaaatgccgattctctgtgttctaaaaaagaaattaaagcaaggagcttgtcggcaccctgacgcaaagagtatcattgagtagaaagttgctcagtcaggctctagttgttttgacttctcgatcacagctagttaagccatgtcttgcaactccgtgtgtggctgtgtagattcatatacgggttgcaaacatcagctgaggaatgacgacacttgtcaacatgaatgatcaaacatttatcagatgtgtgataaacctgaggcatttctggcagggctggccttcattttcctcagggtttcagggcaaacctttgttctgaagacacgacaggtgcacctggcactgagcatgtcctggagtcatccaggacccctgaatgcgatgatgtcaaacactgtggttcagatttgggactgctgtatgttgtgtagtgtctttagtgtttaaataggaactttcagctcatatagaaacacaaggcttaattatggaaaacagagagttatattttcctttcacatgtaagtatcaaatcaatagatctttggatcatattgtgatcgaatatcccatttttaaaattgctgtttaaattgcttggttgtgtttcaaaacaacgaaaagggctggagagatggctcagtggttcagagcaccagctgctcttccagaggccctgagttcaattcccagcaaccatgtggtggctcatgaccatctatgaagggaatcttctggcatgactcctacacttaaaaataaataaataaataaataaataaataaataaataaataaataaacttaaaaaaaaaacaaagaaaaaatcattagattctagcttgggattaagacagaatttctatttttatgaatagtccatttttattaatttgttctctcataaattgcatcccagctgcagtttcctctccccctccaccctcacatcttccctatctcccccgcccccactccttttccattttcctttggcaaagggcagatcccccatggataacaaccaaacatggaatgtcaggttataataagatcaggcccctcacctcgtgttaaggctgagtgaggaaaccctgctcccaaaagcaggcaatagagtcagagacagtcctccgctccctctgtccgaaaggacaggatttctaacaatttctctttctctttattttatttcttttactttcaagagtgtacttacatcacttcccccattttctctctcaaaatgctcaagtatatccctccttgctctttttaaaattcatggcctcatttttttaaaaaattaatttccaagaatgtctaaagggttcttaatgggattttgtattatgcacttatgaaaagaggtgttctttgcattaacaattatgagatataagtgaaaaatatcaaagatgctctatatcctgcagtatcaaatattcaccccaatttaatttcttacataaaaataagcaagcacactcatcttatttagtatgcaaattgcctgttttaaaatgaatttcttagcatctattatccataaatgtttgatttgcatacctgttttatgtactagtgtacctggggtttcataaaaagtttcctgaagggagaaaggtttgtgaatggaagtttaagaaggcctgctttacattaagtgacctccagaatgtagccattactccttggtttaggcatcacttaatgaaacgttcatgaatgtttatacttacaataccactatgagactctgttctgagcattgatgtttctctacttggctgaaagtttcaaaggctctgtcttggctatggtgggaaagtgctgggtacgcctatgccctttggccctgctggcatctttagcatctaagagtccagtgtgtgcatccatcagactaggaatgtggctctctccactcccacagataatttcagttcagtgtggagctagtgactgccagagtatgtatttcaacacattgttgaatgttgaaaccaacactataatgatgaaagagggagaaagaacaggaacggtccatctgtggagctaggagcaagggcatggagtgtttgtagagcctttgtttgcagcaacgtgtgcatctatgtcaggttgagtctcagagttggcattgaaccagaagaaacttgatagattcctggtcactctgtccatatcagttacttttacatcactgtggccaaaagacctgtcaaaaacaacccatagggagctggtgagatggctcagcggagtaagagcacccgactgctcttctgaaggtcctgagttcaagtcccagcaaccacatgaaatttaaaaaaaaaaacaaaaacccacaggaggaatgatgaattctcacggtctcaatgagggcagagacatagtgccgctgaaactggggccagggtagaaacttccaaatacactcctggtgacctcaacctcctataggctccataatcccccccaagtagcaccacaaattgtggatacaggctcaaaggatattggagatatttcatattcagacgacaaatctggccggtgcaggaagacttcagttttaaactgggaattcagaacatccctactggtctgctaattagttccaaacactttgttcttctccttagtcccctgaaagcccattctcttcatcatgctcaagttctcagatccaattatcacgtatttttaaaaaactaatattggttgacattgactctacagtctatagcttccactcacatgtgctttagtgctctctctctctctctctctcacacacacacacacacacacacacacacacactcacacacacacacacacacacacaaaatcagagagctagcttacataacttgacaaggcacctcaggatcttggggaaaaaaagccaaatccacaacaatagatagaaaaaaaaagtgattaagaccaaggtaggaattaatgaaatggaaatgaagaaaataatataagaaatcaatgaatcaaataattggttctttgaaacataaattagaccagtaattgtagccaaacaagagagagagagagagagagagagagagagagagaggagacaaattaagagaattgaagggaagaaggtgtgtgttgccgatagacactaagaaattcaggaaaactttaggacataaactaaagacatattccactaaagtggaaaagtctgaaagaaatgaatgaatgtctcaaaatatatagcctaccaggttaaaacaagatgaaacaggcaacttacatagacttgtaaccaggaatgaaatccagttttcgcttttattgtaagacaagggtttgctaagttattcagggtgaccttgaatttgtaatcctcctgccttagctctctcagtatctgcggtccggtcccaggcctgtgcccccaggtccagttcccatctgtcagttttgagaagttagtgctggtgagatggagttattctgtttctgagctgctgggcagtcaagagcggagtggcagggggaggcagtgttgagcaatgggtcagccccaagtccatagccaagaaaattccttgagaaagagaaggggtacaatacacgagaggatgcagagcctctaagggaggtttaaggatattagaaaggcacagagaaaagctggcactgatatacattggcagcgaaatgttttccagtcagtatgccattatttctctgaaactgggtgacttaggggaagatatggttcttgcctggctgcctgccatgcaaacctttctgcttgaaccaagtgtttatttttgttagggcgagggtgttagtcggacgtaccatgaattaccagaagttaacacccacccccaccccccaccccgcatttgttccaggtttctttaatcttatgtttacattgtcaagaaattgctttgaaatttaaagggtcaagtggtatttagatggttgcacaagggtgtggacaccagacagacaggctgtgttctatcttagtaagaggttaattgcaaacgcaaacttcccaccagaaagtgcagagtggtggtagcaagtcccaccaaggtcagctttctaaagataagtatgagacttgccacgcccccttccccacccccgccccttgcttgtacacgaaagctcttagtgttgtgttagttattttgctctgcaatgttgattaatttgtgaagccttgtctcacttccttattctacggcggagttctggcttctctatgaacgttactcagggtacacttcattgcatgttgaagcttaaaagaaaaaaaaaaaaaaacccaaacaaacaaaccaaaaaacctaagcttccctccccccaccacctacctcccaccgtgggtttctcttctataacagccctggctgttctagaactcattttgtagaccaggctggcttcaaactcacagagatccacctgcctctgtcttttaaatgctgggattaaaagtgtgagccaccacacccggctaagctgctcttatgacaggtaaaaaccaggctttcctaacccatttcaggtacagacatttaaatgccgtgttggaaatagtattattttggctagtcgcttttcatagtcttctcttgcgtaggtgatttagataggatcccaaggacagatccaatgtagcaaaaacattcctcctaccgtgtgtacaaaactgataagtctgcttttcttatggggtagatattataacagcactcaaggttccgaggcaaagacatgccctttgaggctgtgttcctattgttaacagtggctttgagccaggccttagattgtaggcttgttgtcttagctatgcagggggctgaggcaggagtatagcaagggttaagccctgccgggggctacagatgaatttaaagccggcctggcaacttgtttagactctgttgcaaaatgaaatcacaaagaaacagatagggctatagcacagcggtgagatgcgtgcttaggatgtgtgcagggtgtgcatagcccgaggctatggtcccccaggactgcaaaggaaacgaaggagtgtgtgcatgcttgtactctcgtgtattctcatggctttgtttcaggtgaaggtttaaagagatctaatggatttacagtcacttatttgtgactcagtgtgttctctgtaaatgggagaacaacccaatgtcacatagctgtcctatcttggagtgtgtagggcccaatgcatagtgaacaaaggtactgccaagagtgggttgttcaaatactgatctcaagcatgaggggagtcagaacagagctgcccatgttggtgggtgatgactgagggtttcataatcataaaagctgagtctaattctaatgtccttaggggagaatgatgaacttctgattagtatagaacttcagaaaaatgaattagtactcattataaggtcagaatgatgcttacgaaggaaaccatcttaaataatctttttttttgaaaaattatttatttctatttcatttgcatttagttcaccttttccatgctcatatgtctgtgtgaggatgtcggatcctctggaactggagctacaggcagctgtgagctgccttgtgggtactggcatttgaaccgaggaagagcagtcagtgctcattgagagcccctgagccatctctccagccccttaaataaccttcttaataccaatattgccataattatgctttgacaccaggagtgcatttaaatatgtacatgcctagcaggtcacttagaccttcagctcttggagagtcggggctaggtctttaccgtgtctgcatttctagcttagtgcagtatcagcatgtatctatagatgcccacctcagagttcattctgtcacgatgactaagacaacacattacagatttcctaagtgagaaacttaggtggtcgataccaacatgtaaataataacactgataaatcaagacagaaaccaaggcccctggatttcttttgcagcataatccatggcatgctcattacctagtgtgtgaatttggggggactttccccaaccgtaggtcctcgtgtcaggtcctctaaatacacaggcaaatgaggtacaaagtcaatgagcccttgtttcaggaagatgtgatttgaatcagctgcttctactcatgctacagaattgatggcatttaaaaatatgtttattttatttttacgtatgtatatgtgtgtgtacgcatacatggaagcaaagggacttgcacacattaaagcaaaagtggttgccttgtagggactgtcttttgttgcttagctcaccagatccctggctccggaggaggaaggtgcatgctttaataagaactcggtttaaaaggtgtaacagcgatgagctgtgcattcccaattacacgtaggagaactaggccccatactcgtctggtatagactaagaaggttgtgtgcacgttatgagttttcagaggcttacagggagtgtgtttttgtttgctagatcgcctgagccagccgggtctccctgcgtcttgggcatgactgagctgctgcagtgggccagacatcactggcgtcggctgagccatgggagagcccagggtgaagatgagaggccatacaactacgcctccctgctggcctgtgggggcaagtcctcgaggacccccagacctgcaggaaagcaccgcgtcgttattccccaccttcagtgcttcaaagatgagtacgaaaggttttctggaacctacgtgaataaccggatacggacgaccaagtacacactcctgaactttgtgccaagaaacttatttgaacagtttcacaggtactgtggtcctttttaatgttcttcattcttctacttgatactcccaccaaatcctcactttcttttttttttttttttttaagattttttatttattttatatatgtgagtacactgtaactgtcttcagacacatcagaagagggcatcagaccccattacagatggctgtgagccaccatgtggttgttgagaattgaattcaggacctctggaagagcagtcagtgctcctaacctctgagccatctctctagcccaaatcctcacttttttcttatgctatctaagcttaatgcatataagcatccaaggcaggtgagattcaagtccaggctggagagagggtgccttagggtcacacagttctgtacagctgaaaggacgtcttctgtttgtgaaagatgctgttatctgtatcgttctcacataggaaccccatctgtggctcagccaatgccacacctgtaataagcagcagagcggatgctgtgaccctgggcctcctcccttgtactttggtgtcctttctactaaaccatgttgtattttaattgcagatttttcttatttgataacaagagaaagaacaggactcttaagcaaatgtaataggatgtaattatgtaaagcagtggtgtaattcagtttagcaggcatttcctggagcttacttgagatctcagacagtgaagaaaactcgggtataacttgctactctcctcacggattctgtaggttatccgatatgtgtataaacaatgggagggcacacagtgggctgacagttcctataaagtgctatccgtcagggcggaagcctccaagagaaatcataccatgagatggaactacagaagatgttcatgctaattatggagggtgggatcacgtctgcccaggaatgggcaaagtatatttcatgtggaagaaggcatggtagtgagaacacaaagacatcagcatagaagactcacgtgaagcctgggaggtttcctctccatgacacctagtgtctgtgttgtggaaccatgggaaataccgttggacagatgggtctaacccacctgaggagtactgctgtcaggatagagacctgagatgcaataccgcaggtgtggttctatggaggagaaaaacacacttggaggcattgaggtgggacttagagacaaactggagacaaagtgagcctttcggaagctggtgagttgttatggagacccatacttatgacagtgtgggagtgaagggaaggacaggcaagtacagatgctacacactgctttggagaggtaagtggaagagaagaacattagatgagcacggtgatcgtgatgattataaaactttccaggaaaagggaatcgagggccaaaacccagctgggctgcacagttccttgctttggaaatgctgagctgctgtgtgagtccagggattctcatctctacttcataggttctgtgtacacttcctgaatggtggctctttttaaagtgctggtgtgggtttgtgagattaacaaccttaagggctacaggtgtttacttcacttaattccaacacatacattgctctcttgagctgtggacctggatgtgatctatgtagaaataatcggagccaccgctctaataaaaacagttaagaaaaaaaaaaaagttcccaacaaaatgaattggacatgatggaggaggcatttgggtagatttttcttttaaggagtttcacagccgagggcaaaaggaaaattcctgataactgtgcagggctgagctctattgtttgtggggtttttttgctttttgtgggttttgttttgttttttttaatatataaaatagggaaggtttggggatggaagagtttcctgagcacagtggttctgaattgtgtggaaagaaacaaagtccggaggagagaaaaaatcccaggtatccctgctcactttgagccttgttcgaatcttatgtgttgattcagaatgtctgtttttctttttagcttttaaagagaaatggtacttcctttttcatcatgcattatataactcaaggctgtcctattcaaatgttctcaattatatacttaattaaaaaaaatcttatatttattcaaatatggttcaagctaaatgtcctggatggatatcaatacttcgtatttgctagattttgttaatgccctgttctgtgacctgtaaaaccagctaatactgacttttccaaaagcacagaaaaacaatgtcttgccacttttattttagctgttgtgtgttccatgaaaacctccctgtgtgtgcttggcttgcagggctgccaatttatatttcctgttcctcgtggtcctgaactgggtgcctttggtagaagccttccaaaaggaaatcaccatgctgcctctggtggtggtcctcacaattattgcaattaaagatggcttggaagactaccggaaatacaaaatcgacaagcagatcaacaacttaataaccaaagtttacagtaggtgagtggatggggtgttcccgaggagagtgctgtatgagcatggtagtcttcctaccattaggtatgatcaggaccctttgtgtactgatgggatgttgttaattgtttctgttttgttcttacctctcctggtactagggattgaatttaggactttataatcttttacatattagtcaagaggtctaccactaagctacagccatagttgttattactgattttaatgaacatttcttaaaatccttcagtgaacttaattgaagtcacagaagggaacctaaagccactgtcaatcaaggacttgacaaaaacaaaagcaaacccttttgactcactcatagaggaactgaaaggatttgccctggattgagggctgggtgcagtgacacccactataatctcagcaagatagttgccagcctggatataagacccaggaagagaatcaaaagaagggaaaataacttgaatagatacaaaacgttgtatggtatatgagaactcaagcgctatctataaagaaaagggaaaacagaataggattcttttgtgcataaaacccgaggcatcctattgcagcaatacccaaggcatccataggagagggtttatgcaggagcctatctgctctgttgcatactgtcattcacagtatgtaaagagaaagccctgagtgaactcaggtaaggtgagctttgaactgggatgttcatgatacacagttcctgagtgcttcttttgaaagttaacacttagaaaacagcatggctctctgcaacttgtcctcactcttagaatcttagagaaaaagtgtatgggatacctatttgaagatgtggcatttaagctaaagcctgcaggattatgaattctgttcatacttagacgtcttcagtagctttcacaacatttgttcagcgatctcttgagaaacaaggacaataatttatttctcatcattgtaagatgttgtgagattaacttgaatagtgaaaaataatttttatgctatttatgaaggaaaacaaaccaacacacacacacacacacacacacacacacacactcacacacaaaccctgataccaaatattaaggtatttttagagtaagagcttctaatttgcagttgaaagccacagtgcatgtgtccaccagttccatgcatcatgcagtaacccttgagtacataggaaatgccagggatagagaggttgcatgctagactctgctgacctttggaccctcgctggaagaaatcaaatatcacaatcatcacatcgtgacaaaatctggacttagactagacttagactcagaaaaaaggaaggacagtttgtgtgtaatatggtacgtgtatatgcactttgcatacagatcgttatatgtgtaaagacttgtggccttttatcactaatatacaggcaataatgtgtctttgatttctgtatttttttaaaaagttatcatcttgatttccccccacttactgtctctgtagccttgggcagattacataagatagctaatgtccaatttatttcatagtgattataatgataaaacagcaagcaccatgatgagtgtattataagagctaagcacaggttagccaccagcattataatggcaggttaatggcagttagtaagagaatttcttggcacatgggcaagtcatttacttagcatatgagactttgtaatagcactgctctgtttcctagatgttaactgcccagtgggagacctggtagagcctctctggggtacttttagataattttcatgtacatttattgatgaaataccctattccactctattaatatccattttattactcatgacttcattttataagagactaggttactttatatcattttaccaatattctgggcaatttatttttgcttagagctatggaagaaataatgtttattatgttttctcccccaaattgtccttggaacaataaagataaaaagaaataaaaataggctatgaagccataccatgttgatttacatatgctaatttaaatgcccatggaatattaaaaaggttatggaagaaaatattcctcagaaaatttaggatgaaagtatgcagctattaaatggagcaaatgtttggaagaagagggttgacaattctatgcagaaaatttgtttcatattcataatatctggcttgtcacaaagtagttaatttttatgggtaaataccatataaacataacaaacaatactgtagaaattgagcatttgagccctgtaataccccaagtaagttagaatgaactaatactgaaacatgacttttttttaatattttttattaggtattttcctcatttacatttccaatgttattccaaaagtctcccataccctcccccccccactcccctacccacccactcccacttcttggccctggcattcccctgtactgaggcatatatattttgcatgtccaatgggcctctctttccagtgatggccgactaggccatcttttgatacatatgcagctagagtcaagagctccggggtactggttagttcataatgttgtttcacctgtagggttgcagatccctttagctccttgggtactttctctagctcctccattgggggtcctgtgatccatccaatagctgactgtgagcatccacttatgtgtttgctaggccccagcatagtctcacaagagacagctatatcaggctcctttcagcaaaatcttgctagtgtatgcaatggtgtgagcgtttggaggctgattatgggatggatccctggatatggcagtctctacatggtccatcctttcatctcagctccaaactttgtctctgtaactccttccatgggtgttttgttcccaatcctaagaaggggcaaagtgtccacactttggtctttgttcttcttcagtttcatgtgtttcgcaaattgtatcttatatcttgggtattctaagtttctgggctaatatccacttatcagtgagtacatatcatttgagttcttttgtgattgggttacctcactcaggatgatgccctccaggtccaaccatttggctaggaatttcataaattcattctttttaatagctgagtaatactccattgtgtaaatgtaccacattttttgtatccattcctctgttgtggggcatctggattctttccagcttctggctattataaataaggctgctatgaacatagtggagcatgtttctttcttactagttggaacatcttctggatatatgcccaggagaggtattgcgggatcctccggtagtaccatgtccaattttctgagaaactgccagacagatttccatagtggttgtacaagcttgcaatcccaccaacaatggaggagtgttcctctttctccacatcctcaccagcatctgctgtcacctgaatttttgatcttagccattctgactggtgtgagatggaatctcagggttcaaacatgactttctttagattgcccttaagatagaagctgttcataaagttttcatgacactagagacatcataagacagagttatcaagcaaacttgggtattttctctgtgattgatatggacagccttcacttttggtcatgtttgtgttactataataaactgcctgatagagtcttctttaaaagatggagggttcttttgacttacaattggaaagtgtctggccatggcctgctcttctcattgctccaaagaatcctgaaagttacttataaactaatctaagttgtatatgttaaaagattaagtggaaatgctaccctaaattacttaaatagcttctgctatgcaaactacatcagcaacataaagaactgcttagtttgaagggataaatcagtgtaaataagcatacagctttacagatgcctagtgcataatgtcaaatctaagagaaatcttctattaccttaaggaattgttagtctacagagaaaggcaaatcaatactttattttgttttttctaaaattctttctagtgtgtatgcatactactgaatttttccatggagagacataacaggaaattttcacaaaaggtagatgttctacttggaaaatttaatcctatatgccatacacacctagtaaagggaattaattctacagaaaatagtcactacagttcacaaaaaggtgtgtccctttgcatttctgtagcagagtaaaggactactgagcatcagcctagttagtggttgtaatagacaagacatcaatggaaagttactgaaataattcaaaggaggagaaggctcagaattaggctgtagcaggagagatgaataaaagattaaatgaagacttatataggtaccagagaaagtcttttgctgactcaatacatataaacaacttcatggttcctagtttgcatgatggggtgatagatgcctttccttgtgtcccagattttgggagcaactagttacagctgaggaaggggagcaagttcattttaagaagttttatgtggcatgaattgggtaactgaggtgcttagcaagcataaaaattgttatccaaataccacgagtgaagacaaggatgcagaagcccttggtacataaaaggcaactggcaacaggcaaagaagatacaagagtccttaagtggaagaaactttaagaagacagagagtgaaagcacagggaaagggaagtgatgtcataaaaaccaaaggagaaaaatatttcaaagatggagtaatgccagcccacacttacaaaggaaacttgtctaataaggaccaacacgcccatggcatttgctcatcaggggactgatggccttctaggaagggtgatcacataaaatctgttgagagaaagaatgaaggagtaactaacatcaccaacatagtcatatttaaaggtcagaaaagatccagaaaagatgagggcattcgtcgtatccattatttgtttaaaccgttttattatatgggtaaatggtccccctaaagctcagggatgggtggactacttcccaggtcatgatactattggaaggtgatgagtcctccagggaagaaggtatatcattttggggagtgtgcttgaagacgttgttgggcctctagcccttggtctcctttctaggcttgtaaggtgagtagttttctctgtcttgcgaacttgacaggaaaagctgcgtcagcaaaagcaatgaggagagcaggccatctttataacaataatggaaaataagtagctttgcttttacgtgtttgtttgtttgtgtatttttgagaccttagtctcttgaatgttgtggttgcaaatgtgtgccaccatgcccagtgtgcatgtatacaaacactaactaaaaatgtcaacatataataaaatattataaaaaagatagaatgcagctgaattctgaggagttctgacacaaccaggatcacaggaaggacaggctccactcagatatagccagggcaggtagccctagagataaccagatggcaggaagcaagcgtaagaacataagcaacagaaaccaaggttacttggcatcatcagaacccaattctcccaccatagcaagtccttgataccccaacacactagtaaagcaagaatcagatcaaaactcacttctcatgatgatgatagaggactttaagaaggacatgaataactccctcaaagaaatacaggtgaacacaggtaaacaggtagaaacccttaaaggggaaacaacaaaaaaaaatcccttaaagaattataggaaaacacaatcaaacaggtgaaggaaatgaacaaaaccatccaagatctaaaaatggaactagaaacaataaagaaatcacaaagggagataaacctggagttagaaaacctaggaaagagaccaggagtcatagatgcaagcatcaccaacagaatacaagggatagaagagagaatctcagatgcagagtatatcatagaaaacattgacacaacagtcaaagaaaatgcaaaaaccaaaaagctcctaacccaaaatatccaggaaatccagaacacaatgagaagaccaaacctaaggataataggtatagaaaacagtgaagatttccaacttaaagggtcagtaaatatcttcaacaaaattatagaagaaagcttccctaacctaaaaaagagatgaccataaacatacaagaaacctacagaactcaaaaagactgggccagaaaagaaattcctcccatcacaataatcaaaacaccaaatgcactaaacaaagaaaaaatattaaaagcagtaaggaaaaaaggtcaagtaacatataaagacagacctatcagaattacaccagacctctcaccagagactatcaaagctagaagatcctgggcagatgtcatacagacctcaagagaacacaaatgctagcccaggctattatacccagcaaaactctctattaccacagacagagaaaacaagatattccatgacaaaaccaaatttatacaacatctttccacaaatccagccctacaaaggataatagatggaaaacaccaacacaaggagggaaacaacatctaggaaaagcaagaaagtaatctttccacaaacacaaaagaagatagccacacaaacataattccacctctaacaacaaaaataacaggaagtaacaatcacttttccttaatatctcttagcatcaatggactcaattccccaataaaaagacatagactaacagactatttacgtaaacaggacccagcatttttctgcatacaggaaacactccattaatactcataaatagaagcagtcattaatagtctctcaaccaaaaaaacgcccaggaccagaggggtttagtggagaactctatcagaccttcaaaggggatctaataccaacactcttcaaactattccacaaaatagaaacagaaggaacactacccaattaattctatgaagccacagttacactgagtattttcccttggagatggaacagtttctgtctaatcaagaacctgttacattttcctttcatagaggacttcataagagattttttttctcctgtcatgtttaatgtttcaaacagattttaaaaactggttgagtgcatattacttttagcttcagaagatattatgtatatttaagaggcatttaactattataaattattttaatgacttaaaatgttaatactaggctgtatattttaaaataaattttataaacatacaaaaaatgagaaacagtatttttaaaagggatgtaatgtatagttcttcatgcaggtgtcagatgatccggagtgaggagtaatctcacctgcaatgttggggaagatggtgggggtgcacaggagactggcagagatgcccacatcccttatacacctgacatgcaccagcctttttcttatgcctgttctcctgtgcactttagctattctttacatacttacaatactgaatacaatgtaaaagtgatatcaagagtcactaaatggtttccttcaggagatgatagcaggaagagaaacctcaacatgttttgtacatgtttttcttttcaaatattttcgaattgcagttgctgaaatcctcagatctggagcctcagatatggaaggctgcttgtatttctattgagtgagaattagaggtgataatgtggtagaaaagaattgtttttaaatgttgtgtgtgagttgtccttaattatccagtatagtgtgtgaaatctgataatgtgtcttgtggcacctttgggtccttgttacctcatcacagaaccacacacaagaactgttctacataccaatatattcacgtaatgttaattgtaattctgtcttcgacttgcattcaaacagcttaagagctcaaaaaatcccacagtgggaagagaacaagcttactttttttttttttgatttatttatttattatatggaagtacattgtagctgtcttcagacactccagaagagggagtcagatctcgttacagatggttgtgagccaccatgtggttgctgggatttgaactctggaccttcagaagagcagtcgggtgctcttacccactgagccatctcaccagcccgagaacaagctgactttaagtgtcagctttatatttaagtgtcttaataactagtttattgtgtttttgcaacttaataacttaagttttccaaatgaagtctttgtgaaattttggttttaccaattctgtagtgtctcctttagcatttaatacataaaaaatttcataaattatacaccaagattttaagaaataattagtttcttcttactactttaaaaaaagatttattcatttatttatttattttatagataagtatataaatagctgtcttcagacacaccagaaagagggcatcagatcccattacagatgattgtgagccatcatgtggttggtgggaattaaaccgaggacctctggaagagcagccagtgatcttaactgctgagctatctctccaggcctctttttttttttttttttaaatatatctttttttctgttcaattttaggaaagaaaaaaagtacattgactgttgctggaaaaatgtcaccgtcggggacttcatccgcctgtcctgcaatgagatcatccctgcagacatggtcttactcttttccacagacccagatggcatctgccacattgagacttccggccttgatggagagagcaatttaaagcagaggcaggtggtgcgtggctacacagagcaggtgagcagtgtctgtctcctcagatggagagttctggacgctccttcttcctcaggaaaggtctgggctcgtggttgttttgttttgttttgagacaaagagtttctttgtgtagccctggctgtcttggaactcgctctgtagaccaggctggcctcgaactcagagatctacctgtttctgcctcccacgtgctggaattgaaggcatgtgccaccacacctggccataaagagatttttaatttaatttttaccactgattaaatagaactgcagaaggctcaatctgttttcagctctcagtagacatgtgttatgttttatagataataggatggacatgacttgggagttcacactctctgtcccccctcccccccccccccccccagcacacacacacacactatcaggttgtttggaacaacattagagaagcctggctgagttcatagaaacaatcacaggataatttcattttcttcctcttagggtcttatattttgtgttttcattaatgttcctaaaatgtctaattacctatgtttcaaagctttaaaaaaataaataaataaaactttcatggtttctcatgccaccgtcctctaggctgttcatcctgatgtggtaagggaaatgagactgacagaaatttgagttaagtaaatctcccctctgccactggttcctttgtgtcttttatgcacaaagtgatgttcttgtgtagttattcaggtacacgatgactgagtttcctcataataatgtggaaattgtgtctctttcttgtcatcgttgtttgactcgggccaaacacaatgcctatagctaaatatcactttccttcttctgtctggagacactttaggtaaaacattttaaaatttaactgtcgttcctttaaacctgaaaacctgaaggaccaggaagttggaatttcttcatcttatatgcataaataaaactatatcagtctcctgatccgttagcatttcgtctcgggtcggagccctttttccatctatggatcttcatgcagactgctccatgttcagctgcctctgagcttgatgtctttgtcactttcctaagcagtcccacccctaggattttgacaacatcttgcataacttagcattctgtcctggcactaagtgcacgttcggctgctgtccgttggctatgaggcatactttgggttcagttccagatgagcatagtcactccctcatagtctgcaggttgtattgagaacttgggcaaactatttggccctctgtgtatctgcagctgttcctaagctggtttgtagcaccagcctcagtggaccatgaaaaagaaattatttaatagtgttaaagtacatagcatagattctagtacttcaaaggaattcaatagggattattaacaaatcaaatcatgttatcatataattcgtggttttctgtgttcactacagtgatatagaaatattactcaaaaagctagaactattttttctctgtttcttatcacacttccctgagaagatgttctgtagcccaggccatcctgaacttcattacataatagttccagctggctctaaactcacagcaaacttactaagtgctggaattgcatagatgagctctcatgtctgagctggtgacttgttcttcatgaagccacgtccttcatgcacagtgttttgtctttgtttttgcatgcattggtgttttgcctgcatgtgtgtctctgggagggtgttggatcttctggagctagagttacagacagctgtgagttaccatgtgggtgctgggaattgaacttttggtcctctggaagatcgcccagtgttcctaaccattgagccatcttgccagccctagacaatggtttttttggtttttgatttttgggttttggttttgggtttttgggtttttgtttttgtttttgttttgttttgttttgttttattttgtttttcgagatagggtttctctgtatagccctggctgtcctggaactcaatttgtagaccaggctgtcctcgaactcagaaatccgcctgcctctgcctcccaagtgctgggattgaaggcgtgcaccaccaccgcctggctagacaatgctttgaaaggcactttgcctacatcaccactggtttcctaacagaactatgaaagtatcagtttgctccacgagagaattttgatagatggtgatgtcctgcttatttaggaattttatttatgaactttggctgagatcaaatgcttatgtagtccaaggtatttctacatgctctgaatctgggtcataggcaaaaccaacaaaatacttccacgacctatggcactactgtttgctccatgagtggaagctctgaggtggaatgtgcatttcaacatgaaacttgcatcacgtgattcatgtgaaaaaaacaaaacaaaacaaacaaacaaagctctccttctgtttctgtggatgctgtatcagcatctaaggtcctgctgacccttgttatggattccctcttcatcctaagagagtcacagcatacactctgaggctatatagatgtgtgtgtgtgtgtgtgtgtgtgtgtgtgtgtgtgtgtgtgtgtgtgtttgccttaattactgtgtgtattaagaattggtcaaagtgatacaatgtctaaatagcaaatttaatcttaatttttttccttctgtgatttttttttaaatatttttaggactctgaggttgatccggagaagttctccagcaggatagaatgtgaaagtccaaacaatgacctcagccgattccgaggcttcctgtgagtgacgtgggaccgagttctgtgggcccgaaaggaggtgtccttagttcagtaacgttttgtgaattcataccccgtgtaactcagtagaggctgcaagtttgaccctctataatttggtatacctaagtcatttaataaatgctcatctgcatgtattataaaataatctaaaagatgaaaccctctgaaagtatccctagaatcacttcctatggtataagaatgccttacaggcctgtgtagcttagaccagccttgagtttactatgaagcccaggcttgcctataatgagttcttctgtcccaccttgagatgacagatacaatctctgtgcgcgtctgcatgagctccacgttaagctcagaacatgttaaagtctggaaggagggatttgtgcagggccagtagtggatggtctgtcccctttgtgggaatcagagtagcgggctgcaattctggttggaaggagttaggagttagtcttagagtgtgggaagccatagaagtattcagtctcagcgcttagaataccatcctcgacctttccgaatgacacttataatttggggtctttccctgtcccaaacttggtttctgatacttagatattttatgactctgagccaacttatactcattaactttatttttacaaggaaaaaataaacaggaagagaaaaatgtctaccttatttccctcttttaaagatcagaattgtcctgataccattaccgggtcatttcaagcgtaccaagagactggaagaaaaactaatgtttctcatgaactaaggatgaaattgtggcctctagagaggaaaactgaccctagataatatctttagtagtgatgtttttatgttttaactcctgctacaaggattctgcacaaatgttacatcagttgagaactggctggtgcacacccacatatgccacttgtaaacatgaattcttagtcttaactttcccatctataaaaccagcattgaaaacccagcactttggaggctgtgactagaggattggcacaggttcaaagccagcctacgtttgatagtgagtgtgtggcctaaagagactacagctccgactctcagccaaacctccaaagtagaatgaacaagctcagggagggcggtgagttagcttaggttcagggatgcctcttgaagtgacatctctctgcatagaagtttaggtcccagctagaataaagtctgtaaaactgggagaaaaatggccaacctctttcctttttctttttcctttttaaaattttaaaattttttttatttcttgaaatttttatataaatagaaattaatgaatgaagccattcatttttatgattgtaaaattattcttcataaacataagatgttgaggaatggcaatagctgttttttaattgttctctttgcatggggggagaggcaatcgagaatccattcccctttgtttgctctttcttctctatatcaaacttctgtgggcttttactttatattctttgcagttccagagagtcacggtgctagatttattgatgaatttcacttaagtaagaaattacatctgcttatagactaatgattattgcttagaaagccatcaaaatttaatgataaaattgagacggcctttttcacaatgtgtgaaaggtcatttttgcttgtttttgtaactattttgctgattttgccccacactcttatcatggtttcgtcaagtaatcacttcttcaataattttgaaatgggttattacgcaagtttccaagtgtgtaaaagtgcaagggaaagtgtacggaacactcaggctctccctcagccgtgccatctcacagtgctgcccactctgagccacctctcccacctcctcctgggccccgtgacacatcacaccggagaagaagcaaaactcttccttaatctcatctaataccaggaatttgttcaaatttttccacctgattgaaaacaatatcttatgataattgccttaatcaaaacaggaccaaagtaagtctgacacattacatttagctaagcagtttccaatttttctatcccaagaaatggggttatttcccttattccagcatgagcggattgtcttttctttgtgttgagcccagtcctctcctttctgtctcctctctttgagtgagctagacctctcttgctggaagcaccacatttgcctttggccagctgccaccttctggcgagctttgccttgtttctctggctcttttactttgtcagctgtccttaggcagaatctgttgaacaattcaaattctgtctctaaaaatagcaagatgtatacatatatacacacatacaagcaaaatactgcctgtgaatctggaggtgtcacagaacctcggaagtcacagacttcaggttgtagttctctgataaaagaccctgatatatcggtctcgagtgaggctatgccagtgcctggcaaatacagaagtggatgctcacagtcatctataggatggaacatagggcccccagtggaggagctagagaaagcactcaaggagctgaaggggtctacaaccctataggtggagcaacaatatgaactagccagtatccccagagctcgtgcctctagctgcatatgtagcagaagatggcctaatcggccatcagtggaaagagaggcccattggtcgtgcaaactttatatgcctcagtataggggaacgacagggccaagaagtggggagtgggtgagtaggggagcagggcggggcagggtatagggaacttttttttttttttttttttttttttttttttggtttttcgagacagggtttctctgtatagccctggctgtctggaactcactctgtagaccaggctggcctcgaactcagaaatgtgcctgcctctgcctcctgagtgctgggattaaaggcctgcgccaccacgcccggctgtatagggaacttttgagatagcatttgaactgtaaataaagaaaatatctaataaaaatatcccccccaaaaaagaatctggggccctcacctcctttcctgtaagccaggaggcctctgatgtcccctgccctgttctcagatgatgggtgtaggccttcacctctgattatgcagtttcccattagtctttcacggaatggcctgagccaccaccgattgtcagtgcccggcaggattcttagtttcagccaaatcgaaaggactacttttctaaatcaagactgcctccctcatcaactaagttctccgaataagttctccaaatacagtgtgttctagcatctttatttagagtattttttgagttcttatagtaatggaatgtgaccaacagtaacttctagaaataacaggaatttgcaacttgtggcagctttcccctagcacatcagataattacaacagcagaagcacgtgggccagagacttgacaccttccctatgagctgtcaaacataccacacagggtatagaacattccagactcttattttacctccccacttttgctgtttaaaaataaatctatatgctgcctttcttgcagggaacatgccaataaagaacgtgtgggcctcagcaaagagaatttattgctccgcgggtgcaccatcagaaacacagaggctgtggtgggcattgtggtctatgcaggttcgttctgctcctccctttattctgacctcttcgcggcctcctatgtgttaacattcttcatttcctcaagacggagtctccggaaggtaaactgtgacttgaggaacgtaacctcacagatcctggttctgcaaagcgaaccacatgaacagactaaactcacgagatgttatgcagccaggttcgatcagatggttagccagagagatgtttaacagggatgcttgctacccgcatgtgcagtgtgcgttttcagacatactgtgctttctatgcaggtcatgaaaccaaagcaatgctgaacaacagtgggccacggtataagcgcagtaagttagagagaagagcaaacaccgacgtcctctggtgtgtcctgcttctgattgtcatgtgcttaactggtgcactgggtgggtaaaattcactgatctaatatcttgtcggtattattttcctctatttttttccaaaataatatccatgtttggtttttgtaagagagttctgtttgttcatttttttcctaaatgttttcttctcttatcctttagcttgacaaacactgatgttgagtgtatccacttatgttttgccacagtactggagggacctggcgacagggggctggggggggggagagacagagacagacagagacagacagagagggagacagagagacagagagagacaagagagagacagatttagagggagaaagatttagagggtgagagagagatttagagagagaaaagagagatggagagagagatttagagagagaaagataagagagagactatcaaggacaagagactgagtagcctttgaatttgagcctgttttaaaggacaattagtgttcaaagcaaacattctcatctgtttttcttgaggggtgtggttctctacatgctctctctgtagcatccttgaggggtgtggttctctacttacacactctcagtagcatccatttggtgtctgtgtgctttgtaaaggtcacggcatatggctgagcaggtatgagaacatgctcttttttaacatccctgagccggatggacgtgtcatctcacccgtgctgactggattctatgtgttctggaccatgatcatcttgctgcaggtaatttctgccacacttagcagagattgttttcctttgcctgttatctagctgtagtcaccggatcgcactgactctgaccttttgatattgtttgcactccattaggtcctgatccccatttctctctatgtgtccattgagatcgtgaagcttgggcagatctatttcatccagagcgatgtagatttctacaacgagaaaatggattctaccattcagtgccgagccctgaacatcactgaggaccttgggcagattcaatacctcttttctgataagacaggaaccctcactgagaataagatggtgtttcggaggtgcagtgtagcagggtttgactactgtcatgaagaaaacggtgagtgtgggactcctacacgaacggcctggaacttttccccaactacttaaatccttaataagtttttcagatttgagtattggatcattaactcagcccaatgggctttgtgctatattattggtcctttagaatagcggtactcaacccatggttgacaacccctttcacagggagcatctaagacgatcagaaaacacagatatttacattatgattcataacagtagcaaaatttagttgtgatgtcggaacaaaaataatattatacttggtggggggtcaccacaacatgaggaactattttaaagggttgcagtgttaggaaggttgaggatcccagcggtactaatttagagattagtagatgctgagttacctactactttatggtacaatcactggatgctgaagggtacaaagtggcgaagtactatggatgctcaacactgccttcctcagtgcagctgtatactcggagctgtgggggacaaatggatttgggataaggctggattcttcccaaaatgtaggttaagacataatattttcactgaaatgaaagctattaacagtatctgggtttctgtggccagtgtttcagggttttctagcagaagaattgccttggaaagaattctgtaaagactactactataaggataaccccttcccacatacaaataatttaaacgcatcggcaatcctactatgtgtttaaaacttgcccacttggaagtgtgacccatgtcctggcatcatcagtcacagcagagcacctgggctgattagaaattatgaagctgtgattaaaatctcatttaacagaatactcgcattagattagcatgcatatcaaaatttaggggccaatttttttgagacatgttccttttttctttttctgagtaacagccctggctggctgtcctggagttcactctataaaccaggctggttttgaactcataggaatctatgcttctgcctcccaagtgctgtgattaaaggcatttgccaccatggctgtccaaaaagccacttctaaaaaagaaaacggagacgaaatgaaaataaaaatgccactcttattttgagagagagtatttgagagagagagagagagggagagagagaagctattgaaaaatgttcacattaggatagttatagattgcagaacagttacaatgacatcatagagggttcaatgtttcctcatactgtttttttcctgttaacatgagtaataacatgcctttggtaactgatgaattgatgatgtatcaatacatcatcattacctgaacttcatgttctgagagtacctttggttttgtcttacgtctctggctgtctcaggatgacatctggaatgccagtaagtgccatcacagaggcatctgtattcttcacagtttctcggacctttctttggatgaacttctcagttttgacaggcactgttctaggatctcttcctttgggatggtcgagcacgtgcctcctttagaatgcacggtttgtaagtttgttgatccacggaggcattggggagcaccatctaagaataaggactgtacagccaagctccttaagcctgaatcccatttctgctacctgaaaactctgtgtgcttcagcaagatacataatgtctctgagcatcagggagaggaaacagccattatagtatctgctacactgagataatctgtgcaaagatgcacagagcagggcacagataaagtctttctatttgagttgctgttattgttacttttgattattgttttgaaaagaagaaccaggtctgccacttaagtagctcatgatccattgtgggaatccatgtgtaattataaaaatatagcatgttaattgaatattaatgttgatattcctaagatcgggggatggcccatttggtaaaaatgcctgtattaggacctgagttcaaatccccagcacccaccaaaaagaccccatgtgatggcatgcatctgtaaactcactgctagaggcacaaagatggcttccctggacgcatggtgctcattggccaacgaacctatccaaaccaatcaggttcagggagatatactgtctcaaaaattaaagcagtttcctctggctttcactagtgaatgcacatgtgtatgtgcacacatacatttatgtattttcctatacacacatacatgaatatgtacatacacatacatgcacacacgtggaaatacttgttccaaatttggtttgactttcaggcagccagatagttttggatatgcattttgcacctatgtaatttggtattttagagacaggatatcagacattcttggaatgcaggaaatgtgtggaggattagttcagagcagaggtttgggtatcagttatattggatgctgcggttggaggaaggttggctgagtgtgctgtttacaagtaggtgaaacgtaggatgccaaggatgttgtggatggtttgaaggaagatgtgtggatgatgtgcagaaggaggctcctttgactgttttatgtttgtcctggtgtcagcctatggaatttacattgtaaattatgacaagctaatttttctttagtctcagacctacttctttcagatatcaaaccaatgcaagtagtaggccatgcacaagattcagaatatctgagaagggaatagcaaaagaacacattagagattaaataagcaaaagaaacgagaaagataatttgtttagcccatgacctacctttagctacagagaacaatagcagactgtttcctcagtgactcagaaaacaagagttcccggccctttgcaagactttcacagaactagaaggaagctactctatgggagttaaaggtccttatcatcactttagtatgctatgttttgagacatgttatcaaccttggcttttcacagacatctttgatacagtgttctctggacctggaagcttagcttgagtcactctttttctgactcacattgtaattctcttgacctatatgtcggtagaactttccatgatatgagtaaaggctgagtcagtctgctccatcccattatgaaagctctacttattgagcaagcttgccctacagtgatgtctgagctccttgatgtcctactagttcatacaaccatgtgatcttcattccctctgtgatggctcaaagaaattttatgaacccatttatgtgggttttgaggcattttggttgtttcaaatgtggcataataggccagagaagtggctcagtggttaagaggactgactgctcttccagaggtcctgagttcaattcccagcaaccacatggtggctcacatccatctgcaatgggattggatgcctccttctgatgtgtctgaagatagtgacagtgtactcagatacattaaataaataaaccttttttaaaaaaagaaaaaaatgacatttcattatccataaatttctggagccattcaaagttttatcatcctcagcactagtccctcactggattgggttattctttgttgagaggaacagtcaagtacacagtaaaatgttgacaaacatatctaatgcccacctactgaatgcctgtagccattgccaaaagttccacagttccagccatactacaaaaagaaaacaaacagacaaacaaacaaaaaccaattattgaacgtcttagaactgtgtagagttcaggacttatggtgtaggggtatgactactggctttagaagcaggaagattaaatttcaattcctgttctctctccagccagctgtttaatcataattagatattcagtctctctgaatatctgaattagaggtcttcatttcagagaggccaggatatttctgcatttgtaaaccaatacattggatacagtatataaatagaattaagacaaaaaatggtatcaccatctagatcaatgcagagaaaacctaagatataaaattatatcatttggaaaaaatgaaaagcataaaacatgatgtcctcagaattagaggtcttcacaaagaatgcatgtttattggaagccagttaaatcacgcctataatcttagcacttcagaagtagagataggaggatcaagagttcaaggctatccttggctgcatgctgaatattttgagtttcatgagactgtcttaacaaacaaataacataaaagcaagcaaacaaacaaacaacaataataaacaagctaccatattgctttttaggcttttccttctgaactggccagttttgcgtcaacttgacacaggctggagttatcacagagaaaggagcttcagttggggaaatgcctccatgagatccagctgtaaggcattttctcaattagtgatcacagggttaggtccccttgtgggtggtgccatctctgggctggtagttttggttctataagagagcaggctgagcaagccaggggaagcaagccagtaaggaacatccctccatggcctctgcatcagctcctgcttcctgacctgcttgagttccagtcctgacttcctttggtgatcaacagcagtatggaagtgtaagctgaataaaccctttcctccccaacttgcttcttggtcatgatgtttgtgcaggaatagaaaccctgactaagacaccttcccttaaaaatatggcaaagttattacaataaataaaatgtgaaaatacgttataaaacaattcactccaatctatatcttatccagtagctctttggttaaacagacacaaccaccaacccaacaagcatcttctcattgcctcttcctctgatgcatgctttgataataggtaagaacacacacatacacacacacacacacacacacacacacacacacacacacatacacagttactctcatagaaattctattggagaaagtcatcacaaatgcataaatagataagcagtgatcaggacctggcagagaattagaataaaatgatgtgacatttgaagattggatgactaatttggactatatggctaagtatgacctcttaaagtggacatgagagtctagatctgaatgatgaaggtgaagaatctccagtccaagggatcaactgctctacagtcctttatgctgtcctgagccttcaaactttcaaagtaagtaggttctcaacttttcaaatgctgtgactctttagtatagttcctcatgtggttgtgaccctgaccataaaattatttacattgttatttcataactgtaagttttctatcattatgaattgtagtgtaaacatctgtgttttccagtggtcttttgggggttgtgacccacaggtttcgaaccattgatgtagaagaaagatggagctttagatccgagtgggttatttaagatagaatgaagatcctgagtttattctgagggaatcctgaagccaccaggaagtgatctcattgctttaacttctaagaaggtcactctagctgccatttgaggaatagatttgaaagggggaaagagactagttttgaggtcctgaattggttcagttgagagatgatggtaacttgactaaggtcatggaaataggtctggacactcggggcatgtatttgatgtgtaatggacatgtgctggtgagcctctggatgggagaaagcagtgagggatccagagtcttaggtttttggtaaccatttagacagtacagtattgttatccaaagatgaggaagcccagagacaaggttgaagaggaatcggaaacagcccaactgtagccatgtggaatttgaggttactgttatttacttatgtattcctcaagtatttcttgagtacctatgagctactacattagactctcagaacatattaatgaaacacgaatttctctgaccatttaaagtgtatattttatagggtgataaaaataaaagtaaaaacaaaaggtatatagtgcgtagtaatggcaacagtggcaaataatgaggccctacctgagaagtcttcactgataaggtggagagacctgagggaggtcaagatgtgagccataccactgtccattttgtacaagagccttgtggctagctaatggcaagagttttgtggagagttgcatggatgagtcttgattctaataagaggttagagttgaagatacaggttgttctagttgttagggttactgttgctgtgatgaaatatcatgatcaataaaacttgaggaggatgcaaaacaaacaaacttgcatcagcttacacatccacatcacagttcgtcatcaaagaagtcaggacaggaactccactggctcagggacctggaggcgggagcagaggtcatggaggagtgctgcttattggcttacttggcctgctttcttgtagaactcaaggccaccagcctagggatggaaccacccataatgggctaggccctctcctaatcaatcactaactaagaaaatgccttgaaggcttgcctacagctggatcttatagaggaattttctcaactgaggtttctttctctctagagactcctgcttgtgtgaggttgacatgaaaccagtacacaggttcataggctgtgcataaagacattttgtttcaaagatcaaactgtatgagaacaccagagagaggagtttagatagagaggagaaggcagtcctgaagcttgcaaataactgagggttgagaagaaaggtcactggagatggaatataatgtagtgttagagtacttgactagatgcttgaatctctaagttcaatacctaatgtaacaaaaagacaataacataatacatacatacatacatacatacatacatacatacatacatacatgtagcttagtctgtaaaaacccttgcctggcaagcatgaggacctcagtttaatccctagaacacacatctcatcacagaggaagtggggacagacagatcctagagcttgctggtcaagcattctaccttccacagtgaattctagaccagttatgggtccctgtctcaaaacacaaaagaaaaaacaaaacaatgaatcctgagaaataacacccaaggttctctgattgttacatacatacatacacatacatatgtgtgagggcacacacacacacacacataatcatactgctttgcaagatggagcttgatggtgaccttgagaagaggtcaatggagcgttaagacaggaagtgctgaacttggttgaggagtgactggtgtactgagactcagatgtgaagaagtgcttgaggacccagaggacaggatccggatcccaagtggagggctcagcacttaaaacaaggaaggctgagttgtgcattgccgtagggtaacagactaagagcatggatagaggtgcagacaaggctagacctagagatggaaaaggaaggcacttcctaatccactgtgtcctctttcctccataaggacggggtaagtttattgaccatggattctcatggggagaatttggaggccagggcagaaaggaggtgctgtgctcggcttaggagctaccatattcagcctgcaatattcagatggtgaattttatcctacagccaagaggctcgagtcctatcaggaagctgtctctgaagaggaggaatgcacagacactctcggcggctccctcagcaacatggcgagacccagagcccagggctgcaggacagttcccagtgggcctctgggaaagccctcggctcagctctccgggagcacctctgctgtaggaaatggagaaggatctggggaagtgcctcattccagacaggccgccttcagtagtcccatggtaagcgtgacgtcatcgccacaccctgggcagagccactccctggtatcatagcccagataacactgcttttctttgtctgcaaaataggtgatattgctacagttcagcatgatggtaacacgtaagttaaaaagaaaaatacaaaattgaggtttgtgcatttgagatttgagataattcagtgttgagaagttgggtgtcatttctgaaaaataaaatatttcgggttagaactgattttgtcagagcctgaagaaggctatcttgacataaggataacagctaactctaagaaccaccaagacttaaccagaattttcttggtgacatgtatgtttctctaattaatcggtcttttggtgtctttttgttactttctaatcttcctctgcattccacccaacctagttctccttcctcatctctagctccacgaagggcacttttcagtattttcattccagagttcaacaagtggtttgagtcccagtgacaactcttaggaactgactagttatccccatgaacaaacccatattcctgcagaagaggtggatcacatagaacatgggagacagaaaagatgattgtgtaaacaaattagagatcaatacttgcaccgaatttaaaattacctctctaaaatgtttactgccttctcagcctttcatatttcgtgaatgcctgtgtttaaccaagatggagatttcccactgtgagatcagtaataacgcaggcagacagcacactatgagtagagaggctgccagaaatgttgctgcattatggtcgttgcctgactttcatggtagatacattgcataagcagaccccaggtgtctatgtctcttgacttgagaaagcctacagggcatctccaggctctttgcaaacttgctgtgaaatgtgcaactgcagtaatggcatggccaccgccaactcagttctgtggcactcaggagacaacacccctgacagtacaacttcttatttagcaatccgttttgaaacatctcagcttccctcttcatgcacagacctttttttctatagtcaattttaaccatatgccaggaagaaatatatatgtatgcatgtatatactcgtttctctatgatactgtctttactagtcacttgtacattttctgcacatttgaaagtaagaaagtgttaactgacatctagttggtggtagcccagtgctggcttgcccctcctctgtttcctgaataggcctcactctcctgtgggaacaaatagatacttctggaagcctttgtggctttttctatgctatctcctctgagacatcttctcgcctctatcaaatctgatgaaccactaagggagggctgtagttctctgattctttgttgtcagcctccaggttttctgagcgcttttctgttgtccgattgtctgcataacactggccttatttctgtacctgacattgtaccattacaaccttgagagcaaagactttttaacctttgaagcctagcacacagcacagtgcatgccacattcattttcaaaacagtattttggaaggttgttgattgagtctgatcaccagacctactcttcccatacagtttgtttgtttccacttgcccccttctccagtgcctcatgtacatggacatcctgggcttgtttttgttctgtgtcttgcaaagccacactattataaataggataaagtggtcatcccatgaaatgtgactttcactcttgagtcttaagtcttacaagctgagcttaagattttaagaaagctacgtaaatccttgacctgtgaagcctgggttaagagtgcctgtgtgaatgccaagggtcttgaaaaaggccgtgagatgtgattcataggagggaagtgggcgaccacacaggatttccacagcaaatcctcagaactgctggatcgccaagctggcagacaggaaaaagtcatcagtgtgtgtgtggcctttgtacttttccttcaggtgtgtggcatttaggatttagaggagtccgggaaaaggcttttgttccataaaaaccaaagtaacataagtagagcagcaaattcttggagctgcagtatgagcagggtatgaagtaaaaccttagtcagggagagagtgagaggagactgggcagccttacaattgccggtcatctccatccgcccagatagagtatcttttttcgttattcagccatggatgtttagaggtttgtgtaggttcctgttactttcaatttggaaacacgatatttacgttccgttgaagccgtacaaaagcttccgcaaacagcggggagagcaaagggagcctagccagattttccatttaacttggatctaaataggggagaaaaataacaggagagaaagaaagtctgaagtagaattccttccgtcaagtaggacgtttgaatcctgctgacgaacatgaacttgaaaactatccagagtcttcgaacaagttgataacaaagttgtgacgtccaccttgaaactggcaaggctttgcaggcaatgtagaacagtggttcgcatccagaggtggtgacctctttagggaactatggaatgctcccttcacaggggtctcatatcagatatcctacatatcagatatttacattatgattcataattgtagcaaaattatatttattaggtagcaataaaaataatttcatagttgggggtcaccacaatatgagaaactattaaaggctcacagcattagcaaggctgagaaccactggtgttgtctgtgttgtgctgtggattctgtaatctcattatgagtggaaatgttctctgagtcttgaccagatgcctggttgagatccagtgggtgcatgtgtttcttttccaagggcagtgactctgtcttgtttgtttctctaccctttctgtatagaatataaggccagcaagtatttggtagtagtgtacaataaacttgggttccttatatgccaaatactgggttagggatttaaagatccgtagaatgtggtccttgccttaaagagacttctggcctctgcagaggacactgtttaaacacagctgtttcagataaacaggcacggttttatgtaagatggcaacggttgtctagcacagcaagggaacgaatattcacttatatgccgaggccacagcaaagacggctctggtcttgggaaataattatggatatagttatttagatcaaaattgtacatggctgttttgcgtcctctcctcaactcaagagctctcttagtcacgagggattaagttattttgtcagagtcagtggagtactctcttttgggagcgtcattttgatgtgaatgcctccttacatcttcctgagcgctcttcttttgtttatatccttttatggtggtttcagtgtctcttctgcactgccaagtatctagaaagacccagtttcattttgacagttcttatctgcagagtcctgctgacaggagtatctctttcatgacggaatacacatgcatgtctttacctagctttagtattgcttctattgtcacgctcacagaacaggatttcagctttatagtcctctacttgccgaatttagatagaatttaagaatacattgtgatggctcatagcaggtgaattttaaacctgtcgtggaccctggtgatctgaaaggagagtgcatgtcacttgaaaggaaggaaagaagaaagacttgcaggcaaaggaacgcgtcgcccctggctggctgtcaggggagtcgagctgagacaggagtgtagaacgtgtaattgcaagcattgtgcttctctcattaaacctgtgatcactctcaccaaatgccggagcagaaacactagctacggtacccctgtcttctccttgctatttaaataaaattcctgataagagcaacttagagtttgagtggatacaggccgtcgaggcagggagggcctggacggaagcctgaggcagcaggtcactttgtacccagtcaggaggcagaactgatgccctgctgttcctcctcctttattctgtctaggaacaggtctgatgggatgtgcacccacatttataattggtctttcctctttaattaaaccttcctggacacaccctcacagacacacccatttccttagacacaccctcacagacacacccatttccttaggacacaccctcacagacacacccatttccttaggtaattctaaatccagtccagttgagaaggaacaccatccctgtcaaggtcacgtgagtacagtgtcacatgaccctgttgcactttcttctgtcaagtgcgtctcctggcctctctgaggtcagtgtgctttgcttattgcatccaagacttcctgtaacacagtggtgcttctttagggctgtgattcaaagctgtactctccgagacagactaaaagatacagtgagaaaatgaggtttctatgacgacatgtttgtggtactcttgggtgagtttgagaggcactctgcccggtgaaatggggttcctgcactgcaccccactctgatggcaggacttcttagagaacacccataccaggaagaggaaggcacagttgccaaacatatttgctgatgagaaagctggctgtaaataccctggctgtggaatgttgattagtctcctagcctgcttatcatttttttttcttatagaaagttgtttttataatacaaatgaactgagcaaaaaaatatttcgttcaattctctgatatcacttttgaaataactggtattcatcagatgttgagtaaagtacagccatggtagaattctaagcacaataaaatacatacttaagtgttgtgtatgtcaaagtgagaatcctttcaactagattttcatagaaggtggtgtttctatctcctatttaactggatagtcaaaatattctccatttaaaacatataaatatagatttcccttttatttttatgtgcttcattttattgttttctttctcaagatatcatatgcagtaaacttcacaaattaaatttttggggctgatgagatggctcagtgggttaaggcacttgctgccaagcctgactgcctggattggatctctggacccacatggtagaaggagaaaaccagggctggtgagactgttcttccgaaggtcctgagttcaaatcccagcaaccacatggtggctcacaaccatccataacgagatctgactccctcttctggtgtgtctgaagatagccacagtgtacttgcatataataaataaataaatctttttaaaaatagaatataccatctgggaagaatataccatctgggaagaatataccatctgggcagaggttgaagcagaaggattggggccaacctgtgttatagagtaagatcctggaagctggagaggcagctcagtagttacgaaccctggctgctcttccagaagtcctcagttcaattcccagcaaccatatggtggctcacaaccaattttaaaaaagaaaaaaaatgaaaaaaaaaggaaagaaaaaaaaaaaagaaagaaggagaaaactaacctccttaaatcagtttctgatctccatgtgtgcctcggagcatgcacacacatatatacacacattcacacacatggaaataagtaaatgcaggaaaacatgaacatttagtttaccatctcacgcttcacttagctccgtattgtagaggtaattgatgttagtagcaatactttaccatattgtctcctcaggaaacagacgtggtaccagataccagacttttagacaaatttagccagcttacccctcagctgctcactggactggatggcaccgctcagagttcaccgctggagactttgtacatcatggacttctttattgcactggcaatttgcaacacggtggtggtttctgcaccgaaccaacctcggcaaaaggtaaatttaaacgagggttttccctgccagggaaaatatggggtttacaggcatctatctgtactgggtttgtgatgataataaataagaacgcagcaggaatagcaggtgtgtaccatttccttgggacttgttcttggctctgcacttagcatagtttttggtcctaatgtgtttagtgctctcaaagcctcaagagctaggcactcttgctctgttcctcttgcatttttaaaattactaattaattaattaggactgtgttaattaattaattagttactttacatcctgactgcagttcccctccccagtctcctccagtctccctgcgactctcatccactcctctcgatttctcctcagaagaagggaggtctcccatagatatcaaccatccttagcatatcaagtctcagtaagagtagatccatcgtctattgagtctagaagaggccactcactaaaggaaaagagtcccagaggcaggcagtggagtcagagacagcccctgctcccactgtcaggagtcccccatgaagaccaagttgaacatctcttacatatgttcagaaggcctaggtaagtcttatgcatgctctcttgttggcagttcagtctctcggagcccctatgggtccaggtccgttgattctgtaggttttcttgtgatgtccttgagctctctggctcctccaatccttcttccccttctgcaggattcccccagttcagcctaacatttgctgtggatctctgaatctgtttccatcagttgggtttctgcctgtttctgtcagttgctgaggctggagagctgttacaaagctaggctcataaccaagaatgttctgctgcattgtaaagatgccttggaaggatttcaccagtgttgtgaaaccagtgtgtgggggtggggctcagggtagggggtgatcctaggcagtaggactctgggcttactctgaacttgtacgttgccttccttgccccactaagttggagctgcctatgaggcttctgagacttacaacatcatatgcatgacaccaaaccaaacgggaagcactagttcaattgccatgacaatgacacacttccttcatgtgccagctaggttctcttttagctcaatctatctgtaacccattatgagtataatgtgccaggattcagaagttctttagtgtagctgtgcctaagagctcgtggaaaatttatttccagttaagaagaaaaaccactggtgatctatcatggtgtatcttgcctttcccacacatccacttaaaattcaatttacagcaaaatccaattaaatgttaatttcccaaccagtcattttcttttggcaacttcagaggtgggaactttaacataaaagtaattcactttcaattaagctgcacctgatcctagaccgtatttaacacagtgttaaatatgagaagatactcataaaaaaaaagatgattatgtaattcgagaataaatgaggatttgaagaaaatgtaccacacgatgttttacacccgttttcaaagttggcaatttttggcattttctctctataaagtattgttgatttattcctagggattccttaccacttagaataaactctttatgggcataaagagccctgctgctcccagaatcttagggtaatgagaaagggagcataggaaaggtacaaagtcttcgaggtgacaaggtgctttgctttctgtctgagtctctgatagtgtcaaagactgaccagcgacagctctccaaaaacatcatagtggcagctactagagaaaatgtttagattctcctcatactcttgtatgaataaattttagaatccattgggtggtctttcatgataggcaggaagttgtaagcttaatccctgatattaaaagtgtaaaaggagacgaggtacaaatgagaacagattgtatactaacaactagttaagatcacgtgatgatgagggtaagttcctcttaactgactttcatgcactggcctgttttgttataactgtcaagttaactttttatggactgtaaaaaggggaaagaaaaatgtattttgttagctttttagtcgcttccctccagtggccttgggatgtgtggtcttatttttgtttcatttttattttttactatttctgaacttttcctgtaatatactcctcaagctctggtctttttaaataatctatccatgctctataaacttatttttaaaatatatttcaagaagatgttttgttttaatattgaatatttaacttgaactttcattttaatggtgattaattgcttcataattgattctttgagacagggtctcattatgtaatccagtctgtctttgaatttgggggcccttctacttctctctttcaagacctgagattatatgcagcaccactatgcctgatccaatgtgcttataattgttattgtatgtgtgtaaaagtaactttctttctttgttcctttcttttgttttattttcttttttgagacagggtttctctgtatagttcttactgtcctggaactcactctgtagaccaggctagctttgaactcagacatcaaccccctcccaggtgctgggatgaaagcacgcaccaccacactcagctttagaaacaattctatgatgaaatccaatattagcattttgttccttaatagttatagaaatgtacaatgtcatcacgtgtagcgtcgttttccctggtgacttttatttgccttcctgtttgctatggaatttgtagagagactacagattggcagttaagacggcagttacactttcagaattgtaatgacctcattttgtacgtgttaatgagaacttgttccactgtcattcctagattggactctcctcactgggtggaatgcccatcaagtccttggaagagattaaaaacatcttccagaaattgtccgtccggagatcaagttcaccgtcccttgccagtgggaaggattcatcctctgggactccctgtgcctttgtgagcagaatctctttctttagtcgaccaaaactgtcacctcctatggaggacgagtcttcccaaatggatgaaatcccccaggccagtaactcagcttgctgtacagaaacagaggcacaaaacagggccgtaggactcagtgtcagttccgctgaagccctaagtggaccaccgccctcggcttccaacctgtgctatgaggcggagagtccagatgaagcagctttggtgtatgccgccagagcttaccgttgcactttacagtctcggaccccagagcaggtcatggtggactttgctgctttgggctcattaacattttaactcctacacattctgccctttgactctgtaaggaaaagaatgtcggtcgtggtcaggcatcctctttccaaacaagtcgtggtgtatacaaaaggcgctgattctgttatcatggagctgctgtctgtggctgcctcaggtatgtttacaacgttgccatggtgatggtcagatggactggagagtcccagctactcccacacttgaaaaatgaggttcgggggttgctgagaccttggcttgcttacatctgaaacccatcactagctgagcctctgcagagttaacctgtttgttcttctgggaaaatgggcatcacaatacctttttttccccttttttacttattagatattttctttatttacatttcaaatgttatcccctttcctattttcctctacgaaaattccctatcctcttccccctccccctgctccccaaaatgcctataccccagtaggcatttccctatactggggtatagaaccttcacaagaccaagggcctcttctcccattaggatccgactaggccatcctctgctacatatgcagctagagccatgagtcccaccatgtgttttctttgattggtggtttagccccagggagctctgggggggtactggttggttcatattgttgttccttctatagggctgcaaacccaccccttgtgctctttaggtactttctcgagctccttcattggggaccctgtgctccgtccaatggatggctgtgagcatccacttctgtatttgccaggcactggcagagcctctcaggagacagctatatcaggctcctgtcagcaaaatcttgttggcatctgcaatagtgtctgggtttggtggctgtttatgggatggattccctggtggggcaatatctggatggtcattcctttagtctctgctccaaaatttttctctgtaactccttccatgggtattttgttccctgttctaagaatgaacgaagtatccacactttggtcttccttcttcgtgagtttcatgagttttgcaaattgtatcttggctatcctgagtttctgggctaatatccacttatcactgagtgcatatcatgtgtgttcttttgtgatgggttacctcactcaggatgatatcctcctgatccatccatttgcctaagaattttacctttttatgggttcccaagaggcttaatgtcagtctgtgtgaaattctggaagcatctatgcctaacaagagaggagtgccctggagaagctagatagcgctgacccctcacagcagcatctgtatcaaagctttagcgcttgctccgcacaggaggaaagaatccaagagaagaattatgcagctgtattctctcctaggcacacagctgagactcaaagctaaaatgccttttgtgtcttatggattaaactgtcatttttagaaagggaaaagcctaattggacaggctggcaggggtaatgattttctgttcctggtttcagatggaacaaatccagaacaacagatgataataagggagagaacgcagaggcacctggacgagtatgccaaacgagggctgcgcactctatgtgtagcaaagaaggtgagactgccgggtgcaccctggtcttactgcttctcctggttactcatcgctactgaaaatgagtgtgaaccagacctcaaccccaaatcaggtactagggaagtttccccgactagggtccctttttgtagcctctccattctgcgcataactgagtggcttgaatgtaaacagttgtttctctagaagtaaaaaccccaacatcttattatcttccccgccgcctcaccccacccccagaaccttgtggataacatcctccctgttcatcagcattaaatgagatttgaaaaaaatgtgggctaagagcagccttcacttttcccttgtgaagtctcggtagtttcgtttgctctgtttccttagtgcccataacggatctttcaatccaagtaagcttgcttttattccagttttgattattgtttatggaaaacagtcttggtgtatgatatgtcctttctaaatgaaaagttaaatacaagcagagcccagaagctctttgggggctgttattgccaacgcctctccctgaccacccacgttatatgcttaattattgtggaaggcaaatcggggctggctctgttgtggacttccaagagagccagccaaccaggaaggatcaaatgtctctatgatacaattgtaggaagcgtgggggattcaaggtcgaaccaactctggcttttcacttgaatgtgttccaatagatattatattttcccaaatcaaattacctttcaagtaaaaatgagtgtataagagaaaaattgccttgctctctcctcttgaccctggttttaagacctgaaatacaaatttatctgttatgacaattaaaaagaggaagacattggctccttctccaggaattgcatctaagtgttgttagaacgaaggcctttctgtgttttatatatggcacctttcttgttaccttttctgaaacttaaccttaggagctaattttcagaagacatctgaagtgctgttggttgtggccagagttaaccagtaacaggaggcctgttccaatagataaccctattttaataggtaacccgctttcaccaaagataatgcttaaaatttcccagagatacgatgctgtaatgtccttctatcatcagggtcacatacacatatatggtcagagtttggggatctgtgtccatatggtgaaggaatatgggtcagataggatgatgcccgtagggcggaatttagaaacaaaggtgttgcatggaattttgcccagagttagtcctggtagggtattacatggttacataagcagccttctagcctcttttcttcctctcataggtcatgagtgacacggaatatgcagagtggctgaggaatcactttctagctgaaaccagcattgacaacagggaggaactgctagttgaatctgccatgagactagaaaacaaactcacgttacttggtaggtaaatggtgctgcattgcctgtgcagacaatttgtctctaaagccattatttttgtctcttttagcaactttggtcttttttttttaattaccttatttttatttatttatttttttttttgtttcttttggtttgagatagggtttctatgggtagtcttgactattctggaactagctatgtagaccaggctggccatgaactcacagagatccacctgcctctgcctctgagtgctgggattcaaggcaagcactgccaccacccagctagccacatcgatctattaagcatatttggttctccctattttgtccattctgatctcttcccacgttcaagtgcattcagacccgagttccacttcagtgagctagagttcctttgtggtgggaacagagttggcattcttagaaaaatgcaaaagctaaacaccccactcctaacacaaagtcagaccctgtcacaccctgcctggtccaagagaaggattttgcaactgtcctgcaaagaattgggtaaagtcttgaatacgtgttgtcgtcttaaatctttataacaaacacgcatcttatttagaagagacagatcatggagtcatgccatgtcttgttcacactcaaaggcttagacatccactgacaaacaagaaactcaagtgtcccgaagtataggctccacgtcctttattctgcaccggcatgtgatcttctctttcctgactccaacctaaactgcacaaacacaaccaacacctcttgcggtcagcttgacccttaccttggaatcactcaaagaactcaaaactgtcctgatggcagaaccatgtccccaggaatcgcaggactgttggtctagtgcgtgaccttgacattggagttcttcctgaaagcctcctgaggaatttggaggagctgtcaagttcagaagaagtgccttggcatacggagatgtggattctgactgaagcatcactaactacaccaagagcacagcctctgagttccgttcctttctttacggggagaacagtctcatttactatctgtcaagtacaatagccatgctcccttttaaatactaatcatttccttatgacggtgtaaacagcttacacgcatgcctcttcacctgcatttccataggaaaggaggctctccgggcttagtgcctaaattcatttggcagcaaagtcaaacctgatttgaggtaacgctatttttagtattaatacccgaattagcatgacaatctgcaagtttttctatggaagtataaatatgcgtgactaacgggtattacaaaatggaaaatgtattgccgcattaccggtggggaaacttgattccaaagaacatctggctgcatccagactaggatattatggactgacagtatgaaagagcatccctaaaggacactgtatcttatggccaaatgttcttttaagagcctgcccttaaccctgggagtttcatagaacagtaaaattcagtacaaggctgtggacctgaataagtgaaccagcctttgaatttgttgataagaatagaagccaaaaagagaatgtgtgtttgatgaactccgtggttctttatactgtatgtctggtctgcagtttctataggtcaggactgaatggcccatggcgaggattcatttaatgaccaagtgagttctcgctggctccggcttctggcaaaccttgtttttcatttcgattgctttccaggtgctactggcattgaggatcgtctgcaggagggggtccctgagtctatagaagcccttcaccaagctggcatcaagatctggatgctgacaggggacaagcaggagacagctgtcaacatagcttatgcatgcaaactcctggagccagatgacaagctcttcatcctcaatacacagagtcaggtatgcgtggtgagccagatgttcttcttaaactccaagcccatagggcctgaggagacggatggagggaaggaaaaagaacagccgatcgtctgtagtttcttgatgttgtgctgctgagtgacctggctcgtatctcggaggatgccatagagtttctaaaggcctgattcagaggcatcatggatgaatacaagcattaaaataaacttccttttttaatttttcaccccctgactgtatgactagggatttgtcaaaacagacaaaaatgagtatacatgtgaaaccttgagactagagcctacttcccttttaagttgaaggaaggagtaatttttttttaatgataaattttaaaattaggctctcagcacaatcctgccctctagtggtacatttagatagtgctcctaagagcgtccaacatttgtagaaataaaggggatggagttgttaaagcaagggaatgacttgaaatgattttgaaccacctctcccccccaccccctctcgcgcgcgcacacacacacacacacacccgttaagcatcagggtggatggacatttgaataagttacgtgtcacgtgaaatatttaccactcctgaccaagtaagtgtccttggagagttacttgccccgtgcggcctcttccttgcctgtcatagatggtaacacccttgcccagaggtggttatgagcaaagatgaggaaatgtcttctgtcggcatttgtttagtgaagggcttctgcagagttggggacttcctcttgcagatggtcgccaacaccagcagcacctaaaaaaatgctaaatgcctcaatttctattgagatttggtgagcataaaacaaacaaaagcaacaacaacaacaacagaaaagtaattagtgttgttgaaaggctgccgctaaccctgggacctgggttcgattcctggaaccaacttgaccacaaatacatgttattaaacattcaaaccatgtggaagcccttttaaaaaagataaaatagtaaaatcttcctctcaaagaaagcctattgacgggtcaggcatccttccagatggctccaagtctgcatacatcggaaaccaagcacaatgttgcatgcttcatggccctggggctccatgcatttgtcaggggaagtgcatcctgtgtctgtgagaacagacatggtgatctctgtcatcatgagaagtggggcagagcatcgctcaggtcagatgtgtcaatcactctgtgctactaaagggagcttggcttcaaaggggacacttggtaggacctggaggtattttagttggcacatttggggtagaatggatgctattagtttatggttatcaaaggccaatggtaactgccaagtgtcttgtacttcccagaacagcaccacacacaatgatttttttttatagttcaagtatcaatgctgccaagactgaggcagagtgtttcatatctaggaaataatgactatagctataagttggtcagtcagctagtgctcacactggcatgccattaagcttctgatattctgtaccagtttcccttttaaaaaatttaaacaaatctgtgtgtatatatgtggatgtggatgtgtgtgaatgtgtatgtgtgtaagtatgtgtgtatatgtgtgtatgtgtgtaagtatgtgtgtaagtatgtgtgtatgtgtataagtatgtgtatatgtgtgaatgtgtgtgcatgtgtgtatatgtgtgcatgtgtatatatgtgtatgtgtgtctgtgtgtgtatgtgtgtatattgtgtatgtgtgtatatgtatgtgtgtaaatgtgtgtgtatatgtgtaagtatatgtagatgtctgtgtatgtgtgtatatgtgtaagtatgtgtgtatgtgtgtgtatatgtgcatgtgtgtgtatatgtgtgtatgtgtgtaagtatgtgtatatgtcagtgtatgtgtgtgtatgtgtgtgtatgtgtgtatgtgtgtaagtatgtgtgtatgtaagtatgtatatatgtgtgaatgtgtgtgtatgtgtgtatatgtgtgaatgtgtattgtgtaagtatgtgtgtgcatgtgtgtatatgtgtaaatatgtgtgtatgtgtgtgtgtgtgtatgtgtgtgtatgtgtgtgtgtaaatgtgtgtgtatatgtgtaagtacgtgtgtatatgtgtgtatatgtgtatgtgtgtgtgtatgtgtgtatgtgtgtaagtatgtgtatatgtctgtgtatgtgtgtgtatatgtgtaagtatgtgtgtaagtatgtgtgtatgtgtgtatatgtgtgtatatgtgtatgtgtgtatgtgtgtgtatatgtgtgtatgtgtgtaagtatgtgtatatgtctgtgtatgtgtgtgtatatgtgtaagtatgtgtgtatgtgtgtgtatatgtctgtgtatgtgtgtgtatatgtgtaagtatgcgtgtgtatgtatatgtgtgtatgtgtgtaagtatgtgtgtatgtgtgtgtatgtgtgtaatatgtgtgtatgtgtttatgtgtgtatgtgtgtaagtatgtgtgtatgtgtgtaatatgtgtgtatgtgtgtgtatgtgtgtaagtatgtgtgtgtgtgtgtgtgtgtgtgaacacataagtgtgcacgtacatgtaaaggtcagagttcaatttctagtgttggtcctcagggactatttttattttttatttcttgtctgtttgtctgtctgtcttcgtttgtctgtttgtttgaattggggtctcccattgccttggggcttgctgataggactacattggtctgccagcaaggtccaaggatctgccggtttctatctgtgtcttcctcccagttgctgggtttgccagcagggccaccatgctcagctggagccccaccccaccccccaccccggagcttctgggcgctgaactcaggtcctctcactagcaaacactttgccgactgagctgactcctcagctcaactaaacttgctttcagctgatacacgaaaataaaaatgatattagtgtggtgtcatgtaatgtttcaatccatctttacatcctatgacatgtaagtcagatctaatgaattaacctcctcgtttctcattgctcactctctctgtctgtttttgttgttgttttggtttggtttggatttttgttttgctttgagatagggagatagagtttctctgtgtagccctggctgtcctgggactagctctgtagatcaagctggcctcggactcatggagatccatctgcccttgcctccggattaaaggccttcgccactacatccagactcatttctcatttctttatgataaaagcatgtaaaaccctttcttctagattttggttttagaaacatagtaaatattttttattgacttagaggctttattgattagttaaaaattattacgattataaaatttatttgtatatatacacaatttatgttggaagacatttaaaactaccagtttaagaagtaattagtgcagggctggagaaatggctcagcggttaagagcgctgactgctcttccaaaggtcccgagttcaaatcccagcaaccacatggtggctcacaatcatctgtaatgagatcggatgccctggtctggagtgtctgaagacaggtacagtgtacttacatataataaataaataaatcttataaaaataaagtaactagtgcatatctagttgatattagctgctattgctaacttcattcatgtgaattttctgtacagttcaagacaatagggatagtttaatttcgttttgtgaatcttggttcagtaactactctgtaaatacccctttcccagtctcaattcctcaggagtccctaaaaatcaaaaagaactcagatcacaaagcccaagctgccctgtgtggattatgggatatctagagtcatgtgtagaaactttacaaatttctatgaactccactactggcaaaactgtatccacttagaagccttcatcatttccatccataggaaggtttttttctgtagtgttcacactatcaaatcctaacattggttgttcagacagacagacacagctcaggcatatagacacagctcgttcagtttaagttgtgtgcttatagaatttttctcctaaaaataacaactcagcatttataaccttttttagaactaaaagactttccatgcatgagctcattgaacaattgaacaagtacaactcactttatagagaaagacaccaaaatattgtgatttcttgttgagtgttaaataacaaacgttgaagttggtatctcctactttaagatatttctatattacattgtgactgacagattatatatataaacaaccactccctacagtggatggaattacatttatagcgttaccttgaacctgagttagtgaatagtgactgctctcctcagggagattcacagtttacttcgtgttggcctggagtcacactatggtgccaactcatcaacacataacattgtgtctttctctcatgataacttagttaatattaattgtgaattcattcccattaagtgcatgggcagcctcactccaattcctacctgaaaagagtgtacttaacagcaagttctcagtactgtacgttgttgccattgagtatttagaaacactaggaacactgtagttaggagtcatttcttatagccaacaaatcctcagcaaaaaggagaatgatgagaaaaagcagtgccacccatcagaatctcagcatccgggaggcagagtgagttcacggacagcctggcctacagagtgagttccaggacagcctggcctacagagtgagttccaggacagcctggtctacagagtgagttccaggatagccagagctacatagaaaaattctatctcaaaaactatagtagtagtagtagtagtagtagtagtagtagtagtagtagtagtagtaataataataataataataataataataataataataaattaccaatgtgttcagcttctgctggagaacatataacacgtgacccagatatcacttttcctgccagtataggactctaaaatcctgagagtttagattaaaaaataaatggtaacaagtacctgcactcacaaatctagaagtcatgaatagttaagactgtatgtgtgtgtatatgtgcatgaacgtatgtgtgtgtgtgtgcatttgtatatgtatgtgtacatgtgtatatgtgcatcctgctaaatatgaaacatctctgtgtactcatgaagctgcaagtgactcacaactatattaggaagactacctatccagactgtaagctaccatacaatgtcaatgctacaaagaattttatattaatatattatgttccactataaacatcacgtcctatggaatattctgactttcaaagactagtaagtattctgatttctaaattatgccatattaatttcatcaaactcaaaagcatttgtataaatagttttcctagtattagtattagtaatcctagtaaaaaaatcctagtaatagtattttgggtctgtaataagtgtatgtaacttttcctccattactttagaggtacatgggaccaaatttgtgctaaggttagggtagttgggtagctccatcttatagctggatctagacttttgtctattctgaggcactataacaaactctgtgagctgaggactgcatagaagacaagaggtgtatgtagcccgcagtttgaaagctcacaagcatggtgccagctatagcttctgctgggtgtcccatggtggagagcattccgtgggcatatatgtacagatggtgagtggtagaaagttctctgggaggagaggaaccacaagggtaaggcagggccatgctagcttctttccccatcttcctggaactagtctgtttctagtagactaactcattgtgaaagaccagcacccttcatgtggatggtcacgaccccatgaccatccacagggctccacctcttaaaggccctagcactgtgcaaactcactcatgataattatgcataatatgatcattaagtctttaaaagcatcatgcttttgtatctgttccaactttttctttatcccttgtactttattgtgggttaagaaatgcttggtaaatcagcacttaaaaaaaaatcactttaaaaaaatcactcatggatgttcttgtatcagtaaagctatttcaagatgagttcaagtcttccatttctagatctcagatctagacttagtgatcatccgatgtagtacttcctgagtaagtttattgtttgttagtcatcctgagtagactgcactcagcaaatatttgctgttgagtacccgtgtgtgctcttgaggccatgcgttcatgcatgtgtgagtgcagaatctagagtggtcccagaatctagaagaacatgttggatcccaccgaagcctgagttataggtgtctgtgagcttccagaacagccgttctcaatcttcctcaggctgtgaccctttaatacagttcctaatattgtggtgaccccaaccataaaattattttgatttcatctttataactgtaatgttgctactttaatgaattgtaatataaaatgtctgtgttctgatggtgttaagctacccctgtgaaagggtccttagatgccaccagggggtcatgactcagaggttagggacccctgctctagtgagtcctgggagctgaactctgatcttctgcaagggcaggaaatgctctgcgctgatgaactgtctctagccaggaagtgccttttttctttattcactacaaggatggaaaagtgagttagggaactgagggtgtaactcattcagagtacacgcttagcagacgttaggccagaagtacagtctcttctaaaacagcaagaatcaaacccaaacagattagaagggataactaccattaaagcatttcctgtgtcaggtgctacagatgcatacgaagctgacgtgataaatgccaccaagaccatcctgaccagagtacaagctctgtgaggacagatgtcccaagcccagaatattttctcatatacttccttagcaaatgattctgagaggattaacgtgtcaagtaaaaagaagatgcaaacgttagatgcctaaaacatctgtatatttcagttggtcggtccttgaagcaatgttaggatggaggcaacgtgtgccttttgcagatgagggaggtggtgtgtgtgcttaatgccaaacgactagtagttggtggcctgagacctgaggactctcgagatccacttctggggaagagatacagctggtatgatggaattttgcatcccaggtagacattttagctgtaaaactgtgtctgctgtgcttccttcttacctggcctcaagttcacagaagcccacgagagagctgcaaaattgaaaagatatgaagtgggctctttgacagtagcctatggttcactacccaaggcagccgtgatccagcaattgcgaaagaaggagaatgaaaaattgagccagctctccagaggtgccctgaggttaactgtctctacctctttgttcaaggatgcctgtgggatgctgatgagtgcaattttggaagaacttcagaagagagctcaagtgtctccggagctggcatcatcaagaaagaactttcctcagccctctgacgctcagggccagggacgtgcgggacttgttatcactgggaagaccctggagtttgccctgcaggagagtctgcaaaggcagttccttgagctgaccgcgtggtgccaagctgtgatctgctgccgagccaccccccttcaaaaaagtgaggtggtgaaattggttcgaaaccatctccatgtgatgaccctagccattggtgagtggaggtaggaaggtgaggaccctgccctgtgttctcctttgtatgttcccagaggctgatcatttgcctgtccttccttctgtatataatatgtggaatctgtctttccatctgtctgtctgtccatccatccatctatctccttataattctgtattttctttttgagctgcactttttttcctcccctctacttctgtatgtacgactttcctcccctcctgcctctcggatccccactgtgaacctgatgttagggatggagcacagagaacggtatgagaatatcctgtgggttatatcttagaccccacatcaacttagtttcctagagttagctattgaactgtggaactggaagcctcaggtgttctacccttaggaaagttacatttagttctacaaaacgtttatcctttcaatgcatatatctgagtgacatttctttaccaggcttccccttatcaccacaggcaatagctataacacagtatctataactgatacctttcttatagcgcacacagctcgcacaaatgaatgaggaaccaaatgtgagtgtggagaatatcagttaacaaatgctattgaaaaaagtaaggaaaagatttgccattttaaattcagttctctgagcagtaacagctgcttcagccttttaagctggctatgcttgatcaaaatactcttcagaagactgtgccacaggataaagtctaaattaggctttggtttttttttttgtttttgtttttttttgttttttgtttttttgagacttcctttgtcaatgtaattaatctgaatcttttcactttagccccaggcagacttttcagacaagggcaaaaggcagccatgttcttcatcaaactatcacaagaacagtctctagggaacatagtaccatgcttctcttttgagagctcttgagccagggtcccacagttcaaatcattcagcatcaatttcttaatttcttctatattcttactagggtggcctattaggcaccacttaaagcatgcctccgctttggaaatccaaagtccccaaatctacattcttttaaacaaaaatatagtcaggcccatcacagcaataccccagtaccaggcaccaacttctgtctatcatagttagggttttattgctgtaaacagctaccaagatagaagaccaaggcaactcctataaaggacaacatttaattgggactggcttataggttcagatcattgtcatataggtgggaacatgacagagtccaggcaggcattgctcggaaagagctacaaggtctacatcttgatccaattgcagacaggacaagactggctcccatgtggctaggaggagggtctaaaagcccaccaccacagtgacacatttcctccaataaggtcacacttcccaatagtgccactccctaggtcaagcatattcaaaccactacaggatccacatgcctgtaggcaagtgtgtagggacattgtcttaattagtaattggtttggatggcccagcgcatgtgggcagtgctgccctggatactagtcctagtgtgtataagaaagcaggccaagcaaactagggataggaaaccggtgagcagtactcctcaatggtttctgcatcagtttctgcctcccaggttccagccttgagttcctgcccacttccctaggtcataaattatgactcatgagatgaaataagccctttcctcctcaagtggctccttttgttatggtgtttgatcacagccacagactcttaagatacgtaacacgaaggatttgaagaaagtactaagcttggaatttttcctgatggtagggagaggctacatttaattctacttaattagtttctaagtaactctggagcatgggataaagctcatagggccaacttgttcccttgaatatccactagggtttgaatgtttcactcctctcacacgtctcatgttttcttctgcctcgtgaaggtgacggtgccaatgatgttagcatgatacaagtggccgacattgggatcggtgtctcaggtcaagaaggcatgcaggtgagtacacacccaagtgccatgaccataatctgcctacggaggaaaagcttctccatgataaagttgtcataggacaacgaagctatggtgtggggagcaaaggaggctggaccttcagctagtccaccgttggtcgcttgtgactacaatgtggttctagctagtctctgctgtgttcatgagttctcctttttaaaggctcatggacattacaagatttcactttttaggcatatgatggctttgttaaattctcactgggagaaatctactaccattcgaatacatgacatgaagaatgtagaggactggggttgggggaagggaaagggaaggagacatgaaagaacgaggacaaggaagatgtgactgtgcctttctgtgtgtgtgtgtgtgtgtgtgtctgtgtgtgtgtgttatgcatgtatatgtgtatgtacatgtgtatatgtagtctctctttctgcatctgcttggaaggtaagttaacagatttggctttactgcacctgctagacagtgtgtgttctagcatgttcctttgcccagcatagccttccctccctgtcacctctgcaggctgtgatggccagtgactttgccatctcccagttcagacatctcagcaaacttctccttgtgcacgggcactggtgttacacccggctctccaacatgattctctattttttctacaagaatgtggtaagtacctgccgagaatttgccacctgccccaccaatccaaccttctactgctggttgcctcagggatgaagagaagtactacgatgctaacttgccgtgttcgctagtatctggaggacagccggaagctgttctaagtgtctccagagataatctgggaatgtgtacgtttgaactattgacaacaaattgccaggcccgtccatctgctggcacgctctgctcgctctgcgtttacattccattaagtcctgacgggttcatttcaaatccagcttttgaccttccgtaaaaagatagtgacaagcaggattacaaaatggctcaagctgtcaggagaaaatgaaaaggtttgcttctgtggtacttggggaggcaaataagtaaataaatgagtaaataaataaacaagtccacggctccaaaataatggctcctgtaatatatcaaagagagcaagagaggaaaatccaattgcaaggatttttttctacccagctcataaagtctctttatgcttggtagatattttgtgatcgaggtattattattgcttgcttgggataatcagaaattgcttggaaaccctggtgtctaatctttagtgttccatttaaattacacatacctctgttccttctttccttcctctttttcttcctttttttttttctttaattattttttttcaggcagtgtcaagcccaagatggcctggaattcactatgtagtccaggcacatctcaaacttgtagtattcctcctgcctcatcgtactgagtgctgggattacagacacatagcagcatactggacttcagttttctttcttacacattcatgttgactcatttgattcttcgaggtggacaagtaactaactacattatggtctttagactacatttgctcttggtctttcaaagcagagtttttgctgggctggcctcgtttaagatacgatgctggggaaagatgaacctgcagggcagccacttcctcgtgcttcctccaaagagactgtccaatattaccacaagaatcccatgctttgggaccctcagtctcaagataactgaatgttgcctattctgttggcaccattccttgtaactactaagaaataactgggaaggatggtgggaaaaaatacatgtgtggcgttgtgacgagtcttctctgagccaggtgttcaacctttgttctcttcatctgaagtgaaaatatctgcaactctgccacttatatggcaaataaatggctgggtagctttgtgcaaatgtcttattctctttgcgtctcagtggcttagattattcggcacacaatggcaaagtaccacaatgatagcaattgaaaactcccacagtctaagagccagaagtctgaaattagagtgggtgtggttgggctttggtaatgggcctttctggctacatcctctcagggtagagcaaagccaccagaggtgcattttagagaaacgttaatcccatccccacaggctgtacaatgatgacctaagtaagtttagcatctggcctctgctcctatcaccatcgcagtggaggctaagattcgcatgtacatattttgaggattcagaaatactttcatttatcacctataaaatgggagcaacaatagttcctaagttgttatgaagactaaatgaattcttggtaagtcatttagaatcgtgccagcaccacatagtactggtgtgtgtatgtgtataacttaataagatatccataagagacaaaacacaattagagaactacataacaagctgaattcttccatctctggttgtggacaaagccgcggaaggctgaaggtgtggctctcagcagcaaagcatgtaggatgcctgttcagaatgcatacggatgtctctaagatcggaacgtctttctttgtgtccccaggcctatgtgaatctccttttctggtaccagttcttttgtgggttttcaggaacatctatgacagactactgggtgctgatcttcttcaacctcctcttcacatctgtaccccccatcatttatggcgttttggagaaagatgtttcggcagagaccctcctgcagctgcctgaactttaccggagcggtcagcgatcagaggtaagagtttaagcagcactggatcagcagatgcccagcatgctgaaggccagcatgtttccggtcagccaggtctggatagtatcagatactcaggggtatttaacatgcctggttgctttcaatgctctataccagtggttctcaaccttcttagctctgtgtcccttgtaatacagttctttatgttgtaatgatcccccccccaactataactattttgttgctacttcataactgtaattttgttgctgttatgaattataacgtaagtatctaatatacataatatcaggtatgtgacacacacaccccaggttgagaaccactgctctgtacacatggcaaatgttaaatcagtggcctgtggcatcaacataaatctttgaagttcttatgtacttataagaagaaattcagagttggaaaccttgttaatgccagctgacctttgttaaaccccactgctcaacctcttaggctccctaggaaacctctttctgcctcctttatcttcacacagacaccttttgagaccgaagccagtacttttcctactccaaaatgaaggtctgctccttaaatgtagtcagtaatttccccccaaactggcagttagtggatgatagagccaggctgtgaaaccagcccattctggttccgtgttaaatccttcagagtccagagccacacaaaacagtagcgatcagagtggctccttctggggaacttcccagcagctatggggtttccaggtctgggagtcagcctggaaatatggcaatatttacctttcttaaactctttgctatctgaaagccaaacactgctggtctgtggtaattaactcttgctgtctagcagcaggggaggagggaaaggatttattgctagcactcccttctctggccaagcagccagaacccttcactggccaggctggttaactccttctgcaccagagaggaaaaagaaagatgtcactcacacagacatacacaagccggtgaagtggaaaatggctacatcactacatttggatggatggatggatggatggatggatggatgagtaggtgggtgggagggtggtgtatggtgcagagcccccaaagccaaaccatcatcttcatttcttttctctggccttttagagacaaaagttcttcagaaaattacctcagagataaaatgttacataaaatgggacttacagaaggatgttgatattaagttcaaagcagtgtttcattctgtaagctcagtataagttcaaagcaacagtttctcatgaccatgtcttatcatagggaacacctgtggcttcatccttggacccaaatgctttttcttgaacacaaatttgtctgaagtctatatctctttttagtgtaattatgaaagctcattgtgtttcttattatgcagcctttacttattatgaggagtggacacattctatgcttgattctaactttattacatctttttagcagaacaactacatctgaagccatctcttaaaaccttcttcctaagatcaaatcaggacttatattaaatctttagttcatctaaacagcactaattcatgaaagttcatctttatgttcatctgcaagaaatctgttcaatagagtggactaatgtccagggattattatattaatttagtaatgacaggaaaggcatatcagctacaagaagctatcctgagatgaagtctctttgggaccttgcctcatagagctcaccattgcagaccgtacaaatatggtgagccacctccaggaaagccacctgctagccttagcttagcctaggcggctcctgacaggctcctatttccagtccactgatccctaggtcctagccactcagcactggctcctctcctgcttcccggaatctactgctcccttatctctcccctaaaggattatgggtaataggcagggtagcctatcacctagggtggctgtccaaatactcttgtttctgattcgtctttctcaagattaataaggccaacatggttgtaacaagaaatttacacaacaaaagacacttctaagtgcttaatgtaatttaatcccccaaatatccctcaagagaagggctgcctctactttgtaggtggtgcaagacaagcataaggtgctggttttagtaacctggtcttgatgctgagctagtgagggtaacagttggatctgatttccaggccctggcagtgtgcctttgtgctatgctgcagagctctgatgattccgtttagttctttggtttcccactgtggtgtttaggccagaatgtcgaatgttattatgtgagcattgcgaggatcccaacagaggtgagccaggagccttagccacctatgtgtggacaaaggggagcatctccaggtggccacatgttccactattgagaatgaggattgccagaattctcacatttgtaatggacaaggggaagaaaagaaaaggagagaaggaaaggtgagggtaaagaaagaagagaaagtaaaagaaacgagaagaaatgccttgggctaacctaatgaaaaagagagatgtatgaattcacacagctacatactccagggcaatgggggcagcatattttcctctaagcaagtataaatgtctagctttgatgctttgatccagagcttgtcacgcactttctcaggtatttgtcaccaaggctaaaagggtcttcttcctgttgtccaggtctggggcttgtgtcattcccagggacaaagctaaagcacatgggtggggttggcaagatcatctctggaagcactaggcagagcacagtaagattagacatcagaaatctgtgctggtccccaagggctgccttgaagacactggcatagatcagcatgggttgggaattacagaggatttcgaaagagttaactttctgattctcaggtttgaccttgtcaagtgctttaccctgcccacacttcagtttgtttactctctggaaatggtgtagaattaacaaagataacatatacaccatttcctggcacattaagaactcagtattattattttggacgatccggcataaacataatttggatgagagaggttttaaatgatgctttatcttctcaagctttaggctaacttgaagatcatttctgatagctgatgattcggtatcctcacctgacagaaacaactagcaaagaggagacacattcagctgccaggaggacaagatctgcataagcctgtagtagcacgcaatcccctgaaactgagcaatgggctttcctagagccatccatcctgcctttagttcaaggcccaggtgctagactgtgtggttggagccactgaacactgttgtgcaccccaactcccagctaagtcccgtgtcccctgggaatggaagcccttcagtggcaagtgtttacaagagtgacttaaaaacccttttgtataggctgactaattcactcgtggttttgctagaattgagctcattgcatccagtctttgaatcccatgatcatttcttcgtgcacagtgttctcttaagctctcctgtttgataaaatataatctagtgggcagagtccccgcacatactcacagggaaaacgtggttccatttaatttctctttcaggatctgtcctttctttgaacacggcctccagagaagttttatgtcacgtaaggtcttgtcctggctttctaaagctcccttcagactctctccccacaaaagattaaatgtggaagggtacagtcagatgtggaagggtacagtcagaggattcccatccctatggcagtcactctttcccatcagctcaccatccacacagttccatccactcactgcccagtatttccctgtgggcgtgtaccatgttttcattatccattcatcaggtgatgggcatctaggttgggtctattttctaggtatcttgactacagcagcaatgaacttataagtattttcgaagtaggatgtatagtcctttgggtttgcccagaagtgctgaagctggatcaaatacttgtcctaattctggtttcttgagaaacctccagattgagatttccagagtggctgcactaatccaaccaagagtgtataaggatgctcctctgcccacatctgtactgacatttgttgccgtttctattcctgatcatggccatcctgactagaatggatcataatttgattttaatctgcacttccctgatagccaaagggtgttgaatgttcttaaattatttactagccaccgggcttggtggcgcacacctttaatcccagcacttgggaggcagagccaggcggatttctgagttcgaggccagcctggtctacagagtgagttccaggacagccagggctgtctcaaaaaacaaaaaatcaaaaacaaaaaacaaacaaaaaaaattatttactagccattttgtttcttgttctgagaaccttctgcttagttctatagctgtagtttatttcatttcacttttctcattattataaccaagtacttggcatagcctattatgtgaggaaagatttattttacatgacaggattttttttttcccttttctattttgttttgttttgtttgtggctggtgatgttaggagggacgggggagagaagattgaaggtggtgggtagagcaattcaaagactcagcacttgggcagacaaagccagagctgggctggtcaatttctgcctcactcttagatccccaaacctctcaacagtacctgcagctggaaccaagcttggaagacataagctgatcagaggacattttgtgttcacattataacatgagagactgtgttgagggtacagagctgatggtaatgggggtggggtaacagtatatgcaaagatcggtgatgggtttagatacgttttagaataatgctttctgatcagtaggcatgggaagttactacgactagttatccctgctttcaatatttcatagatccacaagggcttaggaaaatagctcagtagcagagtgcatgcttaacatgtgtggcctggagtttagtctgtcccaagcagaagcaacatacatacatatgcatacacaatgcatggtcatacacacacacaaacacacacatgcatgagtacacacttgttgatcatgataaagtacatcttattttattttttagtaaaaatgtaatttcatttttttctccttccttttcttccttctaactgcttccatctcaccctgtctcctctcaaaatcatgacctctttttcttcagctgtcattgttacatttatatgtaaatacaaagacacttgagtgtgcacgcacacacacgttttcatacatcttacccaatgcagaatgcctaagagcaacaaaacagctgacatgctggaaaggattggaagaaaaagaaagctgcagccattgtaaactggtccagccactggtttttcgagacagggtttctctgtgtagccctggctgtcctggaacttactttgtagaccaggctggccttgaactcagaaatccacctgcctctgcctcccgagtgctgggatcaaaggcatgtgccaccacatgtgcccggcttggtccagccactctttagtggatcagaattcctctatggttgttacgtttccagccataccggtacaacagagaagatgtcttcacttgccgccttcattctcctaccatgcatcatggaatagagaacgaaggaatggattattactttgctctgaccctcgttaatttttactcctctccgatttgtgtttcgtcttcaggagtacttgcccctcaccttctggatcaccttgttggatgccttttatcaaagcctggtctgcttcttcgtgccttactttgtaagtcattgtttgctccgtgtgcttgccgctaatgaatcattgatgcttctatgtactttgcttctggtctctggttgactctcagttgactgacttttaaaccctcacaatatgttgcttcatggatttaattaagtacctagttgagttctcttaggtctcttgttaacactaaactgtctactgattttcttttccagtggcttaaataaaatttaaattttggccatataaataaattagccaaaacttaatataagaaatataagagctttattaggtggctaattcaatcagccttacacatagaatattaaatttaaatacagaatatcttcaaaatttaatagaaaccactttttacaaataagttagaaagtaacagaagtaggcgaagagtatggaaaagttggcaccgagcacaacagacatggttgcaaagtgcctgtctgcaccttattccagaaagaaacatgcgtgtgaccatgaagtaagttggcagatcacagccctgcgagtaaaaaatcaatgatgctcgctcaccaggctgtcagtttctgtaccctgttcaaattaaattacttgaattaggctcccttgaatatatggctatattactctccaagaggaatttgtacaaagcaactggaagtgcactcagaaatgggaactaagaaagcagggaattgtatcatttgaggaatggcataagaacgtcaagatgcacaggtgggggagggcggtgttaccgagaagtataagcttaggatgttgtaagtgctgcttcactggtgtattaggtggaatgtacctgatatgtttgtgtgcccataggagctaaaactatgaatagatgcttccagaattgtgcttgagaatgaagaggaatcccacctaaaagttcacaatgtacatagatagcctctctgggagagtccgtctcttttctggaaatggccttttttcctaagtaaccagttagtagaactattgcagcgaatactcaagccacatttgagccatagataaaacggcgttacacccgcaagtgtgtgcagttcctcacgcccacccctgtgctttccttgtagacctaccagggctctgacattgacatcttcacctttgggaatcccctgaacacggcggctctgttcatcattctcctccacctggtgattgaaagcaagagtttggtgagtgcgttccttacacttacgggtttgtcttctgttatcagtgggccctgctgagccctccatggctatgaggtcagcatgggtaagaccaatgagacagtgggaaaagggtctttcagggaaaacctcagggtcaccaggtgccatggtgccgagtccatggaaagggaaaggtacatgtgtctttgtttcagtcaatggtagctacttcatagcagggtgagtccgtggacagtaaatcaccatctgtgctcaaaaggcttcaagaacaagctgatggctttggaataaagtcaactacatcctgtgccgtgaccccattctgtcgtctttactaaatgaggactttatgcctttgggataatataaaatatttttgatttctttggacaaaggttttatatatatatattttttcttattacacttgagatgaacttgaaagctctactagagctcatcagaactcatgcagtaagactcttaacccatgcctaccttcatttcattatccaagggatgatggcttaatgtcattcctcttccagcttctcatatgttttgagttcattatcaatgccagaacctcgctacttgccataactattagtagagatacttttagattcccattatgtcttagttggggttacaatgctgtgaagagacaccatgaccaaggcaactcataaaggaaagcatttcattggggctgccttacagaacttcagtccattgtcatcatggcaggacacatggcagcctgtaggcagacctggtgctggagaagaggtgaaagttctacatcttgatctgcaagcagcaaggaagagactatgtgccacattgagtatagcttgagtgtagacttcaaagcctgcctacccagtggcacaattcctccaacaaggccacacctatttcaagaggccacacctcttaatagtgccattccctgtggcaagcatttaaacacaggagtctagggagccatatctattcacaccagcagaccttgtatttgtgacttttaccagcttcaaaaataatagtttggatcatgtgtatctcagcacttactcttttccgttcaacttttcctgactcaccattagctcgtcttctcttgctcttactcataagcttaaaaataatgtatattatccatttaatgatgggatcatttgattcacgttcatcttcctcatcaaattacaatctctgttgtgaggtcagggctcaggccagttttgtttgtcacgtaaaccagcgtcagagaaaagactgactcagagtgacccttgtgagtgaggaggaagatacctgaccatttggggagtgtatttaccatcaggataaatagatggatttcaaatagaaactcactgagtgaggttatggtttaaaatatatgatgctatgttatccaattattttaacaagttataaagtaggaatgaatatatttttgttatcctatgtttttcttatgcagaatgatcctataaaccccaaatgtgataaaatgttaaaatgcaaatagcaggttggctgacagaaatcccaaatctgtagcatttggtctcctttgaacatctgtttaacttttaaacaattgtcagggatagttttggttctgccaaaagacatgccacaggctttgtgtgttccagaggaattgacacatcatgtataccagttggcatcatcagaacccagttctcctaccacagagagccttggatactctaacacaccagaaaagcaagactctgatttaaaatcacatctcatgatgattatagaggactttaagaaggacataaataacgcctttaaagaaatacaggagaacacacgtaaacaggtagaagcccatgaacaggaaacgtaaaaatcccactcaaagcaacaacagtccattctggatagcctaagcaagtagaactgttctgaaaattatgttgaggacccatgactcaacaaacaggaaattcccagggaggaagcagagggccagggagcagaaactagtgggtatgcgtgtcagggtccacactggtctgaacacaccgcatgcattttcttctgctcttgcctcactgtccccgagtcccagtgtcaggtgatggagtcctatttctctggcttcagtcacaggctttagcatgagatgagtgtgttgccaacactatcatcaatgtggagtgttctctccaagaagagagaaagctaaaatacagaagtatctctgtagaagttacttcttggagaagtgtttctcctgccagaggacgtacaaccagagctcatggagtttgcagtgccttgtctagaagactcagccattttgagctcatgaatcacatgaccttcagactcttgctcaccatcttgtggccacctcctacttcctgggcagttttacccagtgttctgcacattcacttccttacgtcaactcatttacaaccgtgggctgccatgtcatcgtctcacttacaaaagcacataaggagagaagatactggaaagactctggaatagtgttcaaatccaatggagggcatttgaacataaaaagcagagagagagagaggagagaagaaagagagagaaagaaatgaatgggggagggaaaagggagggaaggagggaaaagaagaaagaataaagcaagcataaataaagaataaacccattggtaccagcacagtggggtattcctgtgacagcctgaccatgttttggggaggactgtggaatgactttggaactttgggctagaatatctatttggtgttaagaactctgtgggatgttgtataggaccttggaagataatgttgagaacagtgcagaagatggaggcctggcttgtaaaatttcagagggaagattaaagactgttttttagggccattgctattttgattgtgaagattctgtggttctggttagctggggctgaaaaatcagctgtgattaacaagataccagaactactaaagcaaaaccttttcattactgggactattgatgctggttagctggaactaagaaattagcggtaattaagaagagaccagcatcattgagatgactcaatctcctgggaagtgttttctgagagcacaaagagggctgtgttccagagatagccaaggttgtaccttgtgctgtggctggacttagtaatgcgtaaaagttacccaggtggtactggttttgaaggcatgaagtggtcacacagagcagctgaggcttagcactgtgagaggccatggaaggccattggtgaaggtgcaacctcagttgcaattgatggcccagggcagcaggggtcatgcaaaggagttgaggcttggcccctatgagaggctgttggtgaagcctagttacagaggaaggcagcagtgtttggagatgccagtaccatgaaatgaccactaagaacggcagcagcagtggatggagtacaggcagctggagcctagaagacaacgcgtgtgctacaaaggacagggctagagaagtgacccaagcccttggaggagcccagaagatcgtgagttggattccagacattggacagttggagtttagttattgcttttgattgtgactgtgccctgatatttttccctcttgaaggaagaaaatattttagtggagcccacagttaagagactttaaattttaaaagatattggattttaaaaggattgaacttttaatatgtaaagactgtgggacttttaaagttgtttagatcttggggatgaataagaaactaagggttgaggtttactagtgatgtgttggtgtgtcaagttgacaaggggtcaattgtactggttagttttgtgtcaacttgacacaggctggagttatcacagagaaaggagtttcagttggggaaatgcctccacgaaatccagctgtaaggcattttctcagtgatcaatggggaggtccccttgtgggtggtgccatctctgaactggtaatcttggttctataagagagcaagctgagcaagccaggggaagcaagccaataaggaacatccctccatggcctctgcatcagctcctgcttcctgccctgcttgagttccagtcctgacttccttaggtgatgaacagcagtatggaagtataagctgaataaaccctttcctccccaacttgtttcttggtcatgatgtttgtgcaggaatagaaaccctgactaagacacccattgttctagaggcatgacattgttaatcaaggaattagctaacattttctgaaaagccacattttataaaataggaacaatctttgtgacttctgcaaaggtatgtactttgcggaaacactttgcataattgaaaacaaagtaagagtgaattacaccttgtttgaaaattacagtcctagagaagagattttctggagacagtgttttgcatagaaggaaagcccaccctcccttccccactacacacacacacacacacacacacacacacacacacacacacacaccaacaccgttgagtgtaatgcatgctgcactaagcgccgtggaggaaggcacagcagctcttacaagcttctatcctggaagttctaaacatctgtccccattcattgacccttgcttcattgaaaaggagttgagagctgcaaggcacttgaatgctaactaagggaagagaattcgagtatggctgagcaaaggtagttcctactatatatgtgaatgggtgaaggtttgaagattaccgaattaaggtaacacctttaatcaaatcaatgaatggctgtattaaaacagcagcaacaacaacaacaacaaaacaaatgagggtttatataagaaagaaaaaggaaattcaacacctccaggtacatgaacagtacaaactcaaccagccaacggaattgcccattgacttttgatttaatcttttagctttcaaacgttaacataaaccactctggaatgatgtttttcccttatgcccttgggtcttgggtggcaaggtctgtaaaatgatcccctcggagctcggatgtacttgttccttttttttttttttttttacgtattttcctcaattacatttccaatgctatcccaaaagtccccccccccccccactcccctacccacccattcccattttttggccctggcgttcccctgtactgggacatataaagtttgcctgaccaatgggcctctctttccattgatggccgactagtccatcttttgatacatatgcagctagagtcaagagctctggggtactggttagttcataatgttgttccaccgatagggttgcagatctctttagctccttggatactttctctagctcctccattgggggccctgtgatccatccaatagctgactgtgagcatccacttctgtgtttgctaggccccggcctagtctcacaagggacagctatatcacggtccttgcaacaaaggcttgctagtgtatgccatggtgtcatcgtttggaggctaattatgggatggatccctggatatggcagtctctagatggtccatccttttgtctcagctccaaactttgtctctgaaactccttccatgggtgattgtttccaattctaagaaggagcaaagtgtccacactttggtcttcgttcttcagtttcatgtgttttgcatcttgtaccttatatctcgctatactaagtttctgggctaatatccacttatcagtgagtacatttcatttgagttcttttgtgattgggttacctcactcacgatgatgccctccaggtccatccatttggctaggaatttcataaattcattctttttaatagctgagtagtactccattgtgtacatgtaccacagtttttgtatccattcctctgttgaggggcatctggattctttccagcttctggctattataaataaggctgctatgaacatagtggagcatgtgtccttcttaccggttgggacatcttctggatatatgcccaggagaggtgttgctggatcctccggtagtactatgtccaattttctgaggaaccgccagactgatttccagagtggttgtacaagcttgcaatcctaccaacaattaacagagagggttttgccatgttgcaatacactcccagtaagcattccttcccgggccctttctgtcttgcagacttggatccacatgctggtcacggttgggagcatcttgtcctactttttctttgccttggcttttggagccttatgtgtcacttgcaacccaccctccaacccctacgggatcatgcggaagcacatgctggaccctgtgttctacttggtttgtgtacttacaaccttcgtcgcgctcctgccgaggtatgtcatctgtttgcttctcaagacagtaagtacatggggtcagaggcttcaagtaactgctaagaatggatggaagaccaccctgttcatcagtgaggaagtcagcctacatgctagctaagatattggtttcagctgttgtcccataagcaggcctagattaagtgaatgaagacatatatgtctctgtcatggaaagatccaatttgatggcgagatcacaggaataaagaaactgcttcatggaattatctgaggatttatcgtgccctatcttttgttctgccatcccccgagcccttgccttggcctgtcttacagctataacagaatattcaaaccgggtatcttataaacagacatgtcctagctcagagctctggaggttgggaagtcccacgtcaaggtcctagcatgtctgatgactctcattcaaggatgaaactttagtactgcatccacccgtggcaaaggtgggagagcagaccccttatagacttcataaaggctccctatatattattacagtgcacaacgtctatcgcatgtcaaagcttcctgtgggtcacaggtaatggagctgctaacaggagctccatcttcacttatgcagaagaatcgtctatgctttgagtgtttcctccccctgtccccaaaactcatgtcgaaatgtattaacattgtgacaggagaagaaggaactctttgtgcttatttggcaggcatttcgaggatccttcctatttgctaacgctaaacaaatattaatttccttaatattttaaaattattttgagtttttaaaatcagggttttgcacagtagcccaaactggcctgaaactcactgacaagcttaagttggccttgaactcatggctatccctctaatttaaccttctaagtgttggaattataaaggcttaacaccccgcccagtttaataatatttttaatctccattttatacctgacttaccttcgcctatctcagaagccaagtgatatatatatatttttaactgataagtattctccatgggtcccctgatgcaatgggagtgaacataattctatgatgttctttgtaacctaggtttctttaccgagttcttcagggatccgtgtttccatctccagttctcagagccaagtactttgacagactacctccagaggagagagctgaagctctcaagaggtggagagggacagcaaaggtcaatcacgtggcatctaagcatgccagccaatcagctgctatgtcaggaagaccaacacctgggtcttctgctgtccttgcaatgaagtcagcaacagtgtctactgttgagcagagcacacgtgagactgcgctagaccgtggctgctctgaacctggggcctccaagatgactggatcctcagcaagctaaacatgcaggacaccctgcttagagttgctggcaatccttcaagtttggaaggatgtagaagagcacctctcagaagttaggattacttgtggctttgtacaagggatgtcagcattttgcttggcatggaaaaaccaagaacctctctatcattgtatacctgtgagcacatttgtaaacaaaggatagtgtttgaccagagcagagtttaggaactggaatatttaattcaggagaatgtgttgtttttttgaaactttgatttttgtaaaggaattttaattgtcttctcgatgcaaacattatcaaagaagcttatttgaaatatatttattttacagattagcctcaccatgcatttgaaaaatgctttaggtatttaagtattctccatgggtcccctgatgcaatgggagtgaacataattctatgatgttctttgtaacctaggtttctttaccgagttcttcagggatccgtgaattctccttatgaaaatccaacctgaattctccttatgaaaaaaaaaagtactttaaaaaattgttcattaggaaaacattaatttttgaggacaaattcccaagagccttttatttcccatgagagaaggttttggttcccgactgaaggtgtttgacgtcactctctgtcatttcagctttctgctgaagtagcctttgtagggaagggcaaagaagaaggctagtgttttcaacaatcccaggctgccttctgctctgtttactttgtttactgtttaccctgttactgagtagacgcagagactccctatgtgccgatgttgtcaaccaggaaacggacaaatggccatgaaacacaatcacctgagcctacaggccgtgtgtgagcagctcctgggttctaaaattgatgacactcatgttaaaaatgagacaatcattttgaaagtcttccagagtccgcttgagagttcatagttgtaacagtgctcaagagtttgtctgtgttgtgccctccacagaatgagatatgggttgaaattgatacaggttattctcagtgggaatctccgaggctcttagaaaaatcaacatattgaagggtagagatgtctgtagcaaggtttctgctgtgacaaatcacggatggatgctgtctccatttagtgcctagaaattaacttacactagtcaagtcaatttgctactgtgaaatcatgcactcttgttgaagtctttcaaagcttccatatccacctgacagctgccacctccctgtcatctagaattctcttcatgaacctctatgctaaagatcagtgtctacatcaaagtcttataaactgttactctcagggcctgttacccgctgggtaccatcccagtcactttctgtaccttcctggtatcgttgttaaatggtcttttcacatagactgatttctggaactgtcacaaaaccatgtgtctaaacgaagctgccttctgcttccttgagatttttttttttaaataaattatttaataaatgatgttcactggaaa

SEQ ID NO: 88 - DNA, 6444 bp, Mus musculus
gccatggaatgagccggtgctttaaggtccaaagtaagtaattatattgacatttggttctgaacgaagatcagaggttttactttcaggtaccagtggcctgcacatgaccacatgggttggggttttgttgttgttgtttttttcttctacagtcccttgtacagtcctcacccagctgctggcctctatcctgtagaaggagtatttccaagtggtttgcagccttttctccctcacctgcaggtccaaggggagtacccagagtcccaggaattgtcccctcttctatgagtgaggtgggagcaaaaggaccctgttgaaaagcccaagctggcttcttagtccaagcctagtacctcatggtagccaggcaagcattctaccacacagcccagcttccaagagctgctctgagagttgtctttatggcggggagggctgggagtagggtgggcagaatcctcttactcatgcatgtatttctcctcatttcgtcttctcagctgcaagccagggataattcatatacctacccccaacccaagtctgcagacgttggaaaacacaaatgcataaaatggtgctgctcttacactgtggctgctcttaccacaggactctttgtcctccttggaaaggatctatgttggggagtattggcatcaatgtggccaggggccttttctccagaggagtgtgctcttgagggtagggaggacctgctgagggcacagacctatctagattccagaaaggctatggggtgttatctcaacatgatagcagaagagattcccccaaggacaggaaggaagatgactcaggaggaggatcctaggtctgacactcagccttgccatggccacttgttaggactactggtcaccctacaactgagggagaaaagccttgcaggctattaaaacccgtaaagaactcttatgtagctgaaagagacgtagatgtcaactagccttgtaataatagcaagtatcagaatggtaatgatgaaagaggctgtgatacttctgttagggcaaggcgggagggagctagctatggtttgtaccatgaagacattgaagaactcccttgaatgggagggaacaaactacactgggctcatccaggccttgtccaaagggacagagttagcctcaggtgagaagagcctggggtgtcagtcctatggtgggtctgttccccactgctgtcagtattcacagtgagctgggggtgggggtggggagatgggcttctagactgcagagacagaacaggggcaggaagccactagacgctggttttcagtagactaagcaaacagatccagaggaagaataggcaggactggatacctttggggttctgagaagtatcaggcattgggggccatgaagcaccccatttcttgcctcagatacctgtgccctttacatcaggaggcccagaggctgagcacttctcctaactgcgtttgcgaagactccagctcaaccttctgaagaggagaactgttctctgttgcccactgcgcggaacactgcctccaggggaagggaatccgtccagattatttgatctctggactcctggaagcctgaacctctggagtttggctttcagtaaaccttttctcgcgggcgggggatgttcccccaaggggcgcaccactcagtgagtctgggctcaaaaagaggcctggacagctgtattgggagaagtggagctgactgatagatactcccactgccaacccctctagctgcgaagacccagagtcacagaaactttgcggaaataatccctgtcacaacctgaaaggtcacagaggaccaggggacagtatctacgacagctgggagactcttactatttagaaggatgctctctttgttcttacatttgacgaaagaaaagttcatttctttttctttccctagacgacgcattcaccccttctccccgggagaaagcaggtccctggactttcacccttgcctttcagccagccatgtgcaaaggtgctctggaccgctcaggaccactgccgaccacgccccacgggcctcgggtcacttagacagctcccacaaccgcagccgcctctctcccaagccggattttcttgcgaagcgaagctgtttccgtggggatccacattcggtggcccaagcaaaggtttagattccatttaaaacgactggcgcgacttatctccccttggctccctaggattctcagccaccctctatccctcctagccgggcggaagccaaacccacagcgtttgaagttcagagaattccaatcctcgaagaactggccgcatctgagccgatcgccccagcaggagaaggactgcaagtcggcggggctgcagcggagagatgcaccggggcggactccactaaggtggctgtcacctctctttgctttcgaagggttaccttgcttcacgcgctattagaaatttccttccttcttccgctgctcagtaaataaccttcataatacaacgatagtgaagattaaaacacacttcccaagcaggaagaaaaacaaaaacagtaacaacccaagacaaaacagaacaaaaacccccaaaccgtgtctttctccagcactctcttttcatctgcagtgaaaaattctactcccttcatttgaagtcggccaattgctgatattagaagtgacatttagttggatttctttcttttcttttttttttttttttctctttaagcatcggcataggtagggagaggttcaagtagggacctcaaaactaggatgctaagtagatggaggctgctttaaaaagctatgctggggtctggggaggaatttgggactgggggtgggctgagaagggattttcatgaagctcagatctggagcagacaggaggctgcagccttcagagagtctgaggcccctcctggagatgtaaggaaagcctggctccatccgactgacccaggaaggagactaaatggcaccccttgatctcacaattctgttctgctttcatctctagggaaaatgctgagtaaaaggggatcaaacgttgaacattcccattgaatgcaaagctgggggcggggcagggaagtcagaccagcctccctctgagagggagggcagtgaagtagtggctagttcatggggggggggggggggggctgggagagtgggtgtctcacaggcccagccccagaagatgcagcagcagcagcagccctgagacagattcaggagtctagagaacagagagaccaagcagactctggctggagtgagaaagccaggacaagccagaattggtggatatctcctcagggcaggagaagatccgagaactcactatccccttgaccccatctctgccttggcctctgaaatctttctctagatttctgggctggcagtgttcagcaactgctggctttgggggttaatagggagtggacacatttgcttggataccacccttcttgtcatctgcccttgttccccaggcaagattaacaaacatttgctgcatcaggagagaaatggaaagccagagtcgttttcctaaacctctggcttcctccattatttccataatcctaaatcagccagattgagggaagggtagagagaaactgagaaaagggtaggagacagaggacaatgagggaatcacaggaactttcttagaagctggggctttgccttgggacacaggagtttttatccccaccccccgcttcttcagctaagagggcaggctgctcactagtggaaaatattgcagggggagccagagagggggatggaggagctaaactcggagggtgctcacctctgcccctcaatctggcccacctgccaggctccgcaggagattcttctactccttctcccaaacaccaagtcccagaattccacaggtccagaccttcacctcctcagaggattagcctagtcccttcaccccgcctactgcctgtttttgttttttgtttttgttttttgttttccccatgacatttcaacaactttctctcctacctctagctttggacacagaaaatctcttttgggtagagcccaggagaggaccctgcaagctcaaaccctgctgatactctttgccacacaatctacccacagctgccctaaaaccatcagagaaggccagcaccttctacctgggctccttccgtactaccagagcagggggccggattgccagctccttttcattagaacacgccgtttgtggcagaattcgttgactctgtagaaatacctaaaatacagacagaaaaagaaaggccaatcttagaccctttccctaaccgacatacctgaaatagcccggagataagccaaaccaaaagatgttttcttctatgaagagccaatccaaattcaaatcaggccatctagatagagataattaacaacaacaactcattgaacacttcgaattttagccaggtgatctgggtggggagagatttttcttcttcttctaaaatcgaggaacactgtgttagcacacaaggccggttctcaaaggggaaaacgatatcttttggctgttaggggatgaaaataaagtttggttcttaggagggagacagatggggttggggagatgagggaggaacgggtactttaggctcaagctccccagacaactgaggtggagggtaccttttcagtagctggttaaaaaaaaaaaaaaaaaaaaaaagacaagcggttgtattaatactcagaaaacctgggtttgtaaacagcttccaaagagtagctatggattctttcattagtattagatctagacaccaggttaagaaaacagaagtcaaaacaacaataaaataaaatttcaaaagcatttttcaattaccaagtcctgttgcccctgtggaactcgctgcgcgccttaagcgctcccttttctgtgtgcggaattccatttgcatcctctgtgtctgggtgtctccctttcccagtgtgtgtgtctctctgttttcacactctcctccccattcgagcgaggcccacacctggcgcatcactgccgagccattagctgcgggtctcctttcatcttcactgtggcagacgtttctatttatccacttgcgttcgccgagtggcgtcaccagcggtactgtaatgacgattgcagcaggaggatgacagcttagaaagaagagggcaatggggcttcctcccagaggcggtgcggcacagaggagcgctcgcatcacaaggtgaccctagctccccactgccatctccgcggtcgccgtcgacacggcgctggggctacccggcgcctgccttgtcgccttagctcctcttctcagccaagatcccagggagcctgggattaggagcttacttgggggttttccccctccccccctctggagagtccggggatggagagccgaaaggacatggttatgtttctggatgggggtcagcttggcactctggttggtaagagggtctctaatttgtccgaagccgtgagcagcccgctgcctgaaccgccagagaagatggtgccccacggttgcctgagcccgcgagccggccctccgacttcccgggagcgtggcgggggaggccaggaggaggagccggtcgatggactagcaggcagtgctgcagggctgggcgccgagccacggtctgctggagcggccatgcttggcccgggacccccagtcccctccgcggacagcctctctggccaagggcaacctagtagctcagacaccgaatcggatttctatgaagaaatcgaggtgagctgcaccccagactgcgccaccgggaacgccgagtaccagcacagcaaaggtagccaccttgcccctccgctccccggtccgcccactccacccacagttcccttcatctcaggccaggtgcaagatgctcctttcccttggggcaggatggctgggggttgggtgagtggggcgggggcacctgaacaactcttttgctctctgcaccttagtgtgtgtgagggctctcgtgttatcccattagagtgacagttgtgcctggacgaatgtcagcgttggcacaagtcttgacttgaggggtccaaaacgcaccccaacctcccaacccccgagttttgtgggaatgattcagctaagacggaaagacacatccgtcgggtagggcaagatcaaacggttgtccgggcagtttgactggaggggagcaaggcacaaggaggcgcggaagcccggagaatataaaggaccgtaaaatcgtggcggactctggtctccggagggctgcagccctccgaccagtttgcacgtcggtcagaggtccaaattaccttgtcacttcccgggctggcggcgccaggtcggaaatggtcccaatggtctaattgccttt

SEQ ID NO: 89 - DNA, 7411 bp, Mus musculus
ggtcatttcctgttggccttgcgtatcacctacttgtacaattggactctagctattatttctggaagacttctaatttgtcttggcccgatcagactctacacccattaaggaacgatctgttggctcactcatcgctgtattcccagaacctgatcaatattcatgaggtggatggatattccatttcaaggcacagcaaaattaaggtaacatccctaataccataaggtggggctttatgtatttcctataaagcaatttaaggaacagccattgtctgggcaggcgtatccaactggtggtacaacctggctttttcccaaaaaccacataggggagaaaaaagagactggcattatctgggcatagtggaacatgattttaacccaagcactggggaggcaggcgcaggtggatctctgagagttgaggccagcctggtctacattgtaagttccaggacagccagatcgacatagtgagtgagaccttgtctttggttttgtgagacagggtccctctgtacagccctggctgtcctggaactcactttgtagaccaggctggccttgaactcagaaattcacctgcctctgcctcccaagtgctgggatcaaaggcgtgcgccaccacgcccgttgagaccttgtcttaaaaaggaaaattaccatcctctctccctgagttcctggcattagggcagcctcctgtccatggagggaagaatcagagacatgggggtgagaaaacaaacagaacttgctctacttggtctcttctcctgggacccttcaagaaggaggcttgctctcagtgtaccagggtaggaagaagacaaaccaggatgtacagatgtctcctcaagtgttaacttccctcaggagggccagtaggaccctcttgagtccccagaatagatttgcatccaatatctccccattaacactgtagatggtgtgttagtcatggctggtgaaggccttagccgcttcaaaatgaattaggaaccatatcaagcatttgattctcctgctgtatatggaaggataaggaaaggactgctgattggatctgagaaaatgctggaaataagcctgggtgccagaagactaagtgcttctctgatgaggtatacttaaagccagcaaataagacacaaatttgagtggagagagatgtctaagtagttaaaagcactggctgctcttacagaagtccagagttcaagtccctcttatgatctcctaaggcaccaggcaggcagatagtagacatgtagaagatatgtacacatgtagtacacatagtacacgtctgaccaccacatgtattgtaagagtcaattcttcctgcacacacagacacacacagagacagacagacaggtaggcaggcaggcagatgtaaaattgaaaactggagtgcctggtttctatgcacccttgaggatctggccgtgtgtattgatacttttgcttaaggctatattcagtcctgataccaggtgggagactcagcgctgctttgaatcttcaaatcaccataaagcatgacagaaaaagactcactaagcacacctttaatcccagcacttgggaggcagaggcaggcagatctcttgagttcaaggccagcctggtctacggagttccaagacagccagggctacacacacccatacaaaaaagtctcaaaacagcaacaaaggctcttgctaatcattgactgagtaaggaaacacattcccctgcatgaaatgttctcttccttttagctctgatctgaaacacattactattttggtcacctccagagaatcaaaggcagcctagagtcagaagcacagaactggaagccaagggttttccatctctgtgtgtcagattgccgggtgtgagtggttccagaccgaaaggttttatttgtttcagtgatttgatagagggtttattttagtgagggggggaagacagcatccctcccttaggactttccagatacaagatttaaagcctagagttcaaagaatgccaagcagcattctagcgactagctggcacccctgtctgtggtgcaaacttcacttaaagcaaagacaggaggagccatgtgattgccacagccctttgagatgatggttgcggaagaagaaacatgcaggccaggatgtgcacatctgtgctgccccatcccagaaacagggaacccctaggtcctgtgccaggaagatggactgatggtgctcagggaggggctgctcctctgccccatcaactgtgttcccattaccatcagtttccccaacttctttgcttttgctacccccacccataagcatgcttttacagtggaggacagctgtagtttctgtcaattccagtcctgtgaagcattttatttaattttttaagctttatttatctattgtatgagtacactgtcgctgtcttcagacacaccagaagagggcatcggaccccattacagatggttgtgagccaccatgtggttgctgggaattgaactcaggacctctaggaagagcagtcagtgctcttaaccactgagccatctctcgagtccaacttattcattcctattttatgtgctttggtgttttgcctgcatgtctgtctgtctgtctgtctgtctatgtgagggtgttggatcccctagaacataaattacagacagctttgagctgccatgtgaatgctgggaattgaactccggtcctctcagaaagcagccagtgctctttattgctgagccatctctccagcccctaaatttttctctccctaaggacagagtctcatgtgttccaggttggcctcaaagtcactattagccaaggctagcctcaaacgcctgcccttctccagttttgaggctatgggcatatatcaatatgttggttagttttggtttgggtttttttctggcacaggccagggtcgtctgagaagaagaaatttcaattgaaaaaaatgtctccatcaaattggcctgtagacaggtctgtgggggcgttttctggattaatgtttaatgtggaaggggccaatgcactgtcggtattgccacccatgggcgagtgatcctgggttgtataagaagcaggctgagcaagccatgactaacaaaggcagtaagcagcagccttgctccatggcctctgctccagtccctggccccagttcctcctaccttgagttcctgccctgacttcccttcaagatggacaagtaggcacgcaccttaatcccagcactcaggagacagaggcaagcagatctctgagagttcaaggccagcctcaggtacagaccctgtctttaaaaacaaacaaactttaaaaagcaaactggggtgaccaacatgcccgatggctgcagtgctgaaatcaaccccaggcgttgtgctgaaaggcaggttttctcccagctgtcagacatccccagccctctggcctctctggcaaccttgcttaacagtggctggttactgtgtaatgcaggagacctctgagaacaacccaaggcactggcagcatccagtctctcagtctctgtccagggcactcctccacatcagggctttatcaagcaaaattcccaagatagccctttccttggttgttgcttttttccctcccttttctgcctcttccccaaggcagcatggcttcttaaacgatagggaaaatctgcttacctaccccaaagaataaaaactgcaattctcccaagataggaactttttgcataaaacagtgaaactcgatttccctgcatcacaatttttaggtcagcccttactcagcagacttagaattttctgcttagatacaaaaatgtcttcccccatgacaggcagagcaatgccactgtgaacaggcaggcagacaagggagaaatcgagtcttcagtagaaacaggcattgagggattcatgcagttgacgaggcaaatcaatctacctcagataatcaaggcagtactaatctatcacctgatcattatctggtaataagggaagtcttgtctctgggagccacaagacccaaatcatcaactgagaagactcatattgcacatacactactcatactcatgctccccatacgctgcttcgggcaatcggagctcccttgtctaaggaagacgtgttggtggttttttttactgcagaggtgtgttatcacttgagggtgatgggggggggggtgagatggcttaagtgagaaaatgcttgccttgcaaacataaggacctgagtttggtacccccacccccaaccccacccccaaaaaagctggacatgatggcttgtgcttattaccccagggctgaggaagcagatacaagtggatccgaggggcttgctggacagacagcctagttagtgtaaatagtgagcacaaggtcccagtcagcaagtctgtctcagaaacgaggctggggcagcagagagggctcaacagttaagagcacctgctgctctttcaaaggacctggatgtgattctcaggaccaataaggtggcttgcaatatgccaacggcccctccctgtatccagggaaacctgactctttcttctggcctctgtggacactgcacacatgcaaggcacacacacacacacacacacacacacacacacacactaaatatgcaaagaaggcttctgagggtctctatgtaagcacaaagaaacacacacactcgcacacaaacacaaaaagatgtgctataatcagaatcattgactaagaaggaacttttaaaagtatacatcaaatacactggcattgggccactggtggtgggcattgattagcggcaaagcacatggacctgcaactctcagttctttccctagcatgagaagaagcaagggggtgggggatggaggggacagtaaatgttcaaatacaaaacaaatccacagcagagggaatccagaaattcatggagctgggaaaagtagctccggggcacagtcctgagccagcacttgcaaggccctggattccttcttctgcatcaaggcagagtggagcagatgtttgtccagggctataaacaccacacatttgccacacagagggctttgagagactcaggaaggagtcatgctcagggaaggcgtgttgtcctgtgttgtcctggctttctttgcactgtcctcaagagccaggcaggttccggagaggtgacaaggatgtcctttctagggtatagagtgctgtcagtcaatctccaatgggggtgatgcaggtgcctagttgaacccagaactgatacaggataaactgaatgtctcaggacgcatcagcatccttctacctggaaccaggacagcaagatggcctctgggcccagctgctcaaaactactttgtttcccctagatttatgtatacttccgtaaaagcattatatatcgttatacaaaaagcaaattatgcaaaacctcataaaatggaattctatgccaagtcatctgttgctagagtaaaatggcagagcctgagaaacttataaaggccgcaagttgattcggtgcatgttccagaagctagaaagtccgagaacatggtacctgattctgcttatctgccaggaatcggagaattggcaatcctcctgcctcagcctcggtgctaaaattacagatgcaagccatcacacccagctcacttaatcctagttaccttcaaaacagcattaatgccaggcgtggtggcgcacgcctttaatcccagcacttgggaggcagaggcaggcggatttctgagtttgaggccagcctggtctagaaagtgagttccaggacagccagggctatacagagaaaccctgtctccaaaaaccaaaaaaaaaaaaaaaaaaagctttaaaaagattaagttgcccaaagaatccagcagagtgagcagcagaggtcctgaattcaaattcccagaaaccacatgagggctcataaccatcagtacagctacagtgtactcatatgtataaaaaaataagtataaatatttaaaaacaaacaaacaaacaaacaaaaaaaccgtgtagtgccaagaattccaatgcacccttccagcatgcagaggtacatgcaaacaaaagcatatatatatatatacacacatatatacatatatatatatatatatatatatgtaaataatcttgaaaaaaaattataaggtgaagggctagagggatggctttgagagctaagagcacttactgctcttctaggggatccaggttcagttctcagtagttatatggcagctcacagccatctgcagctcagttccactccatctttggaggtggacatcagggctcacaggcatacgtgcaggcaacacacacacacacacacacacacaagtaaataaatctttttaaaaacaggtgaagagagagtgagaagactggatttcagcctttgtccttcccccatgcccacttcatttacactcatgtatacacacacacacacacacacacacacacacacacacacacacccctttagttccagcactccggaggcagaggcaattggatctctgagtttgaggccaccctgttctacagagcaagtttcaggtcagcctgggcttcacagagaaaccttgtctcagcatgtaaaaacagaatattcgaagtgcattttccagcatatgacaaacatcctctcttcaaatttgttttccaggtaaatcaggtgtgatggtttgtatatgcttggcccagggactggcactattaaagggtgtggccctgttggaataggtgtgtcactgcggctgtgggctttaagaccctcattgtaactgcttggaagtcagtattctgctagcagccttcagatgaagatgtagaactctcagctcctcctgtaccatgcctgcctggatgctgccatgctcctgcttcgataataatggactgaacctctgaacctgtaagccagccccagttacatacaagttgtccttataagacttgccttggtcacggtgtctgttcacagcagtaaaccctaactaagacatagggtttgcttgttcgtttaaatcaatactttcgttctgaaagacgtgcctattgctgcgtatttattgtgtctagctttatcactcttgaccaaatccttccagaagagagtacagcatgatcctcagaaaatacattggagctccagacaccctgagtcagaaggagtttctgggttcaagaagacagaacaatttagatctcatttattaaggacgctgtggaaccattacataagcagccgtgtgattgtaatagccgacgtttcattagctctgattgttttttgagagaagcaaacaataaaatacagagatattaaaagt

SEQ ID NO: 90 - DNA, 7423 bp, Mus musculus
ataagtttttaaaattgcatttattttatattagtggtgtgtgtgtgcgcgtgcgtgtgcacacacatacactcgagcacacgtgcacgtgttcagggacatgtgtatatgccatagtgcacatgtggtggtcagaggatagtttgtaagagtcagttctctctaccactctctaccacgggagtcctggaggcagaactcaagtcaggcttttcaggaagttttcttgccaagtgagccatcttacaaccccaggaagtgatcttataccatacggtgctgttccagctctgctgattcctgtgtcacgagtgggctgcattggcggtctccacagacaggtgtgcccccgaggatttctttaatggctgtctcctattgactgctgtacaagcggaagcataataagatttatatggatttgggcctccaggctccgctctcccgctgatacagggctcatgtcagagaccagatttcgagtggggagatggatctgatcgacatcctcagaccagaattaacctgctaaaccactggatcacttccggcctgctctggtgtaagcaaaatgcggcccctcttggcttgttgagaagttatcccaatagctgaagtatttgggggtacaaataggaaaggggacaaaaaggtttcattcacatttatcatgttctttaacataaaagtactatgaaaaagatctccttccctgccctttatggctgatttcttgaagaggataaggttgacatgtagttttccctccttctagagcagtggttacttcgtgactgtaattttgctactgttattatagctgcatgctttgatgccagtactggttggggggggggcgcaggcggaggcaggccgatctctgagtttaaagacagccagggctacacagagaaacactgcccccccccccaagtgtgtgtgtgtgtgtatatatatatatatatatatatatatatatatatatatatatataatctttttaaagatttattttacgtatatgagtgctcttctacatgtactcctgtatgccagaagagggcatcatattccattatagatggttatggatgggaattgaactcaggacctctggaagagcaaccagtgctcttaaccactgagccatctctccagccccaaagatttatttatttttgtttttatgtgtatgggtattctgcctgcatctatgtcagtgcatcacatgtatacctggcattcaaagaggccagaagagggcattggatatcctgggactggcattagagatggttatgagctgccatgtgggtgctaggaaccaaacctgggtcctctagaagagcagccagtgcccttaacctctgagccatccctccagcccacttaaaatgtttttcagtcagcttggagggatgcacttttaatctcaatacaagggaagcagagacaggcagatctcttgtaaattggaagccagctacctagtgagttccaggccagataggactacatagtgaggtcctgtccaaaaaaccaacccagcagttttagaagacattgatgtttgtttagtgtgtgtgtgtagtgaggccggggggagctcattctctcccaccacatggttctaaggcttggcagcaagggccttgcccctgcaccattgatctgactggttagctctgtgctttagttcaacaagttcctatcctatcctacctatcctgtgctaccccatgctatcccatgctatctcatgctactccttgctatcccatgctaccccatgctatcccatgctaccccatgctatcctatccagtcttctatcaagactggaatgtggatttcagcattggccgagtatgacccccttttgcatccttcacaaccagtttaatgaaagtagcagttagctgttctctcatcggctgataaacctgccacactgtagctccaggccattggtcttgactgagaaagtcaagctcagaagaggctatgaatgacaagtacgtcttgtcaaaggaatatgtgagtaagttccacacaattcttaaccaaggcagtgagttgctagtgagcgttacctagtaacagggtcaatgtcaggaccactctaacatacaggtaatagtccaacttgttacctttccatgccttccacaacaaagtagctttctttatagctgctttgtaaatggggaacccatatatctaaggcctctgctatcaatgaagaaagccactaatactttaccgccccttggctgattaatgagtcctctaaaagacccatttctgtgttcctggtgttaattgtaagagtcagttctggtctgggttgctttctaggtcttaggagaagcaaggtatgggtacttgtcatcactgagggacagtgctccctgatgttgtcatcactgagggacagtactccctgatgttgtcatcactgagagacagtactccctgatgtcatcactgagggacagcactccctgatgtcatcactgagggacagtgctccctgatgttgtcatcactgagggacagtactccctgatgccatcactgagggacagtgctccctggtgttgtcatcactgagggacagtactccctggtgttgtcatcactgagggacagtactccctgatgccctctggttactggctatgcacccaaacactgttcagccattaaaaagaaagaagtgtggagaacaactctgacatagaagggccttgcttcttcttgacacggtcacaaaataccatacagagtgtgatcccattgactgaaatacatggaacagtgatagctagtatgtggtaagggtgctgggtgtagcggcaggcacctataatcccaggacctagaaagcagaggcaggcagtctctgggagttcaaggtgcaggcttgtctagaatgaattctaggatatccagggctattgagaaaccgtgtgtgtgtgtgtgtgtgtgtgtgtgtgtgtgtgtgtctgacgtctgtccgtctgtctgtttgtctatctatagggtgtgtaggggatgaggattcagttctatgactatggatttttttgaggcagggaggtaaaatagtctgaaattagattttttggaatggttttctaactcggaatatacagctattctcccatgtctgtgggatcaatcaaccacagatggagaatctatgggcagaattttttttttttgtctgtcctgaatatggatggcaaccactatgtagactggtatgtctgctgctgggatttttctggcctgtagactctaactgattgaggcaggagaactcgggaggttatgactggtgtcatcagaagtccgttttctgtgcagggggatggtgcagttgtgcaggggcatagccaggtttgggtggagtaggaagacagggttgtcaggagcctttggaggccaagagggatttgggccaagcaatggttgcacctgcctttaatcccagcaggtcagcctagtcttcagagtgagttcccagacatcctgggttagacagagaaaccctgcctcaaaaaattaaaggggggaaagggggggaaaaaaaagaaagagggacttgggtcttactttatatctagggtaagattttttgatgaagacagcgactatgtaaactagagggtgggtcttggagtagtgctgtcccaggatagctgcagcagtgggggttggggggggggggagagaacaatgtagaaacaaggatgctggtacccgaggctttcttagctcagagatgagtttctttcccacattggtcagcaccagctagaagttacgaccatgggaaagggcaggctgctggctccttcccttgggagcagtgccggtccgttctcttcgctgagttctttgggagctactgttttgtctctgtgacctgtgtgagtagactgcgcgatgcctgactctgagaatttgacttcgctgttgttgaccagtggctagtggctggtggggatcgagagcagcaaaatatttaatcagtgagatcacttgaggggaaatgaaatcggatcaataggcggaagggacgcttgctgttttccttcagggtcaaatccaggctgtttttctccttttggcgaaaccataaaccactaagaatggaaggaatagtccgcagcagctatttttaatcagccgtgcgttctgttcccctctggtgctctccttgaccagaacacaaaaataaacatgtattagcttactggtattcagatgctaacttgagatggcactgtgtttagaagagagagcccttaggttgataaactgcagtgtgagctccttggaagaaaagccatggtcaacccccatggacctaaggcttctagtgcaaaaccaatggaccacttcagagagaggctcattaaaatgagaagttagaggctagagtggtagctcctaagaggatcagagtagggagggtcccagtctggttcctactccccatgtcacgtggctcacaactgtgtgtaacacctgctttagttgatgggacactgctcgcctccatagggacccacaccccacatgcacacgcccacagacagacacaagcagatacacacagtcaaaaataagaccaatctaaaagagagaggagccacaaggcgctcagtggcccagccttttcccagccctggcttccaccccaagcactgctaaagaagggatgggggtgtcagatgctgtggggccatctgtgctatacagtgagttcaaggcactctgggctatgtagtaagactttgtctcagaaaaacaaaagtcccggtgtaagtaaaggttggttacataccttgaaccccagcatggaggatgaagaagctggtggacctctgtgagttctgggctagccagggctgcaaagtgagaccctgacacaagaaggaggccagatggtggttagacctgagatccctgccagttctaggactagatggtaaactcctagagagaagcaaagggtggagtcagagcaggattgggggagctgcttcagagtttcaggcacacgtgacttccggcacctagaacattcttcagaggaggaggccaggccagccattcatttaaatgtgcagaaaaaaacccagaaagttctttgcttcctccttagcaaagggattaatttatttggtcagtatggctgactactggtagtgccaagaatatgggtctttctgatcacatgactaaagcagctcatccacaggaggggtgggtgcaggggctggccagatggcttagcgggtaagagcactgactgctctaccggaaggtccctagttcaaatcccagcaaccacatggtggctcacaaccacccatgatgagatctgacgccctcttctggtgcgtctgaagacagctacagtgtatttacatataataataaataaatctttgggccagagtgagcagggactgagcgactggagttgaccagagtaagcagaggtcctaaattcaatgctcaacaaccacatgaaggctcacaaccatttgtacagctacagtgtactctcatatacataaaatgaataaataaataaatcttttttaaaaatttatttaaaaaaaaggcaggatgggtgctttccatagttggatgttggggggggggtaggtcttgttctggttgagatacagaaggggatgtgtaagggtgtgtgtaccttagccacttttctgtctctgtgaagagacaccaggactaaggcaaattaaagaaagcacttaattgggggcttgcttacagtttcagaggggtgagtccgcgaccatcctggtggcaaccatggcagcacacgggcaggcaaggcactggaactgcagctgagagcttacctgctgtctacaagttagagggaaggaaaaaagagagatagacagacagacagacttggtctggcatggacttttgaaaccttactcatagcaataacacctcccccaacaaagacacctcctctcactctgtcccagaacagttctgccaacccaggatcaaacatccaaaagccattctcagtcacaccacccacagtgcgacactgtgtctcaaggagaaagatggggtgcaggagagggtgagcccaggcaagcgatggatgaggagggctttatgtgtgccatgtctgttgccagagcaaatgtgccgtggtggcagctgcaggccttgggcctaacacctgttagctggaggctcccctgagctgacctcttccttggctgtccttcccacaaacgcatctgtgttgctggagggccaggcccccacccacgctgagtcatgtgtaccaagagcccctgttgaccaaatgcctgctctcatcttgggcattggggttgctgggttcgtgaggggttggttggcttgattcgctagggagaggggtgaggccgactggggtgtgttctggtgggaagtggcaaagaactgagcagcatatggggaagggggcattctagagacggggagacccttccccttagaacagtggaagttgaaacactgcttaatgctgctgctgcggctgcttcctaactttgcctctttcttctttgactcatggagaagcggggtggagaagagctggggacctcggtttgcccatcatttccgactgatacacgttccggtccccagctctcttgccttagctaaggcctggacagtgcagtgacctacgactcggctcgccctatggctcacctaactccctttctcctcctcctttctccacttggctcttcctcctggcccttgtgggtggctgctgcagctcagccctggggagtccctgtggaagtggagtctctcctggtccaccctggcgacctgctacagcttcgctgtcggcttcgcgatgatgtgcagagcatcaactggctgcgggatggggtgcagctggtggagagcaaccgtacccgcatcacaggggaggaggtggaggtgcgggactccatccccgctgactctggcctctacgcttgcgtgaccagcagcccctctggcagcgataccacctacttctccgtcaatgtctcaggttggtagcaatgccctctgccctatcccactcctccaactttgctagtttgaaagggaggcgggcttcccctccatgatcccgcccctactctgcttcagaactgccgcccactaacattgctccctgcccgctgcgtggcttggcgctctcgggttgaccgggtagggcagacgccaagctaagacctacctcagaggtgattatgaatgctcgggggtgttaagaccctgtcatttctccagcacagcagtccagagcacgctaagtggggctcgccagcttcatcttgtcaaggcctaggcttag

SEQ ID NO: 91 - DNA, 1642 bp, Mus musculus
agaatttcctacccagaagagtcttaccacaactccttgtaaagaccaagattcctttgtctgatgaggttaaaaggcatatccaatacatttcaaccaaaaagaaccctccctggtccccaaagacaggcttcctatacacagaatagaaccttccaagccttcccatattctcagtgcctacacgacctccacgaagcccttataccatgctatggctagcttctcccccagcagactttgcttctttgaaataaggccctgcagccaggctgcggtgacttacaccatcaatcctagcactcaggagacagaggcaggtggatctctatgagctcatggccagcctggtctacagagtgaattccaaggcagtcagggatacaaagagaaaccctgcctcggaaaaaaaaaaaaaaaaaccaaaccagaccaaaccagaaactctatcccaaacaaacaaacaaggccctgtcctaccctgagattatcctctagaacctggaaatgaggaggcacttagtgctcagccaggacagagggatgagcagctgatgtgctatatatactaagtcctaattccccctatctgaatcctgtatccagaaccaccaggcattattaatcaacagccatcactcagccaggcaatcacactatccaggaaggagcactggcactgcctggtggccagtgcaggaagtacatcttcctgaataggaagtttctctccaggtgcagctcactgttggaaatgtcaaaagtgggcgtaatctacattttcagtggctcagcctgatgactgtgagtcacagggagtgagaaagacaggggagtggaaagtagccaggaggttattttgccaatgctgaatgtcaagtccaagtctgtggcatcaacactatccaaacaatcatcttttgatacttcttttgacagggtttctctgtgtagccctggctgtcctggaactcactctgtagaccaggctggcctcgaactcagaaatcctcctgcctctgcctcccgagtgctgggattaaaggcgtgcactaccactgcccggcttgacacttcttatacccaaaattggttactttctctgtctcattatgacaaggatctctgtcttgtgctctctgtgctcttgtgtaattccttcccttccatgggctggcttagagaccagcttctaaaccgaatccagcaaaggtgatgtcattcctgtgggggggctacataggttagtgagctccagacctttctctcatagcgagtgttcctatgctgctgggttcctgtggtaaggagctgaggggatctctaccatagcatcagcaggtggcttagcaatctccaaggaaccaatattctggaaaaatcaagtgaacttgggagcagacagtaagtccctagccaaagacctgactgcacccctgtagtatctctgaaacctaggggctgacccagtcaaactgtggccacaaaaccatgaatagatgagggttgctttaagccactaaccctgtggcaatttgtttacctcctaacaaagtacccagcattaccacacaggtcagaacctcctgaagatgaggcaatgttctggggtcagaatcaactaagatcccagcaaagccca

SEQ ID NO: 92 - DNA, 4989 bp, Mus musculus
agaacatgttaatgtttattcacttaaatcgtgctaccatatgtcctacagaaaacaatgtgagactagaatagaatagtagcatgccacgccctcattctaacacactctgctgctggaactcttccagaggctaataaaatgaacaccttgtattgaatgcagtcatgtgttgtttttatttcagccctaggtagcctagaactctttagacatggtaagccttgaaggtgaggtttttggggggctgcacagagagatcctatcttaaaattcaaaaacaaaacccctcagttcgctgatcggagttcctggtctctattgtaaatgtcacagccctgacttgagtctgactttatcttctctctttcccctctaggacagtcactttgtttattcattcagtcctgttgctggccccaataagttgtttataaggttgacggaagcaccctttgccaaggtgaaaatctttgcttcatatttacacagtaactgctgacataataatagcaatactaataaatcctctcactagaaacgtcaggagacatggttcagacaagctctttgtactagacggcttatgttgggcaaacttcggctctctgaggcagctatgcatagcatatttggcaagtctgggggcatccctgctgagctctccaaatcttgacttcagtactaaaatgccactaccctcacctaggacagatccctccatatgaaaaaaggaagctggactacttagaagaccattctaataatggttacctaatatatattatagcaataacttggatgttcttacaaggtggaatttgtgtactgacattcattctcttctttaggttaagttgctaataggtgcatacagagtacagctgcagtgaccacaaaggatggagaaccggcctcttttcagctggattccaaggaccatccctgtagcagtttggaattctggtgcagctcaaatgttcctacctagttgtaaacttaaaatttaagcctgctgcctgttcaggtttgtctacatatatttgtgccattggtcgaaaacgttcaatgttctgcttagtttatttccacaatgtggaacagtacgtgtaagaaatatttaaggaaattaaaaaccttttgaattgaaattttctactagtcgttgtgagtttgtatttgaaaaacaaaaaccagattcagggtgggccccactactgagttcaagagtagccatgtctacaacaacatgaaccttttacaaatcaggtttaaacatttactatacaactaagtttgatattcttaaaggtggaaaagcaacttaattataattataaaatgtaacaatgcagctgcaggattttcctctgagcctctttgtttccagaataaagacatctgagattgaattataagcttgggcttgttctgactcgcttgtaacttaaccaacacgtttattctattccatggtcagaggcaattctgtcccctcacccgattatcccagagtcctcttccctaccagaacttccacctatttccttcctgcctcagctagcaggccatcagctacttatttatggcaggtgatgcttccatacagtacacaacagattctctctacagtagaaatgtgtcccgtagcatactcttgacatgtgctgtgactgctcataagcataaatcacaaaataaggttttctgcctgcggcttttgcgtcattaggagtttttcctcacagcgtgctgtaacctgtaagagacaaagctttcatcaataaatgggaatggtatacatgtgcacacatgcatgcattttgtcctttgtaacacagccctgctggcctcaaatccagactcaggattacaggtgtgttctaccacgcctcagttactgtgtactgtgtgtctctttctctattgtttaaaagaggtttcagccctaattgccaagaggcaagccttaaacagtcaatacgtttctcctatctatgcattctctaatccagtatatgtgtgtatatgtgtgcactttaaggtaatttttcttttcctctaagccttggctgtcttgggaactcactgtaaccagactgtcctcatatgcacagagaatctccaaatctgccaacaagacctgcttttttcttaaatgaaatggcaatttttatagtttataatgaagggaggttcatgtatgtcactatttttaaaagcacatttatcattttatcaactaaatttggtttacatatctttctatagttaacccatttccatgtttctacttgataagaaaaaaaaatgttatgaagcagatgctttaagtaatgacaaatgcacttacaagcttttaaaaaatcttattttctccctatttgaatgccacatgagccaggcagtaatggcacatttaatgccagcactcaggaggcagactggttgacttccgtgaattcacagtcaatctaggacagccagggctacacaaagaaaccctttctcaaaccctccatccccaggaaagggggaaaaaattagaccacagctttgattctgtcatacatggcctatgttcagattactacttcaaactttacttaaaggaagaatctacatatatagctatttgaaaatttaattccagtgagataaccacagaatcaataatcttactctaagcatatctgaacagttgcttaaacttacatagtcgtacaaaagactttaacactggtactaacagtgtctctggccaggaccgggcctagtacagtatgttctgcttgtttaaaggacaggtagcaaaaccaagctgcaaggcgtccttggtacagctacataagagaatgccaacagataccttaaaacagatactgtgtttcctcgactatgtgcccatgggtcttccagagccttgtaaaaatggacgatctgattcatcaggtccctatgtcctgcctgtagttgtgcatctcaggtcccaggcaacagcatcactgttggtccacagcaccacacctgaagcagccagaacaggacaggtgggaaggacagaagcaccaggggttttgccattttctgttttactttaaaaaaaaaaaaagattgttttattatatgtgagtacactgtcgctgtcttcagacacacacaagagggtatcagatctcattacagatggttgtgagccaccatgtggttgctgggaattgaacttggcacctctggaagggcagttactgttctaaactactgagccatctttccagcctgacctttttttttgttgttgttttcaaaacagaaaatgtatgagtctttcctaaagagattggaggcgacaggagccactatacctagcatatctactgtacattagccatttttaatatactttccaagggaacagagtgacagtgggaaatgtggggctgacaggagcactgaaagctagcagctggagcagcatggccaagaagtgggtgttgccagaaaaaatctgagagagacagagacacacactaaacatttcattctaaacgcccccccacccccccaacccatgcacatcaaatcagaagtctggacttggtgaccacatggacctagtaccttatcccaaagatcaaggatagaaatgactttggaatggcagtagaaaaagatgaacactttccaggcaaacaagcatttaaaaggtgggatgttttagccagggcaagccacaccgtggactacccactcagcttggtgaatgagtgacatgaggccacctatcaggagctttaccagaggcagtgagtgactttgagggtatcttccgcccaagaagaaaacctaggtatgtactgattccaagactggagggctctcctttctctgtgctggagcatgcccctttttctttccctccccttacttccattcccctttcctcatgataacttccctggccttcatccttggggccagtaattcacccacacacccaagaggaggttaccaatgaacctgccttattaaaaaaaaaaggaaaagatttaaactttttcccccaattctttaaaatagggtcgaactatattagtccactgtcctggaattaaaaaaaacaaacaaacacacacacaaaaacccctcttgaacacaggtagagctgtaaggttgcagctcagtgatgagacatttgcatgtgcaaaggcacagaagcaccagacacaaaaggaagctctgcgtgcacacgcctggtacccagcaaagagatgaagagagtggctgctcttccggaaagcccaggtttgactcccagcaccaacatcagagcccacaactccagtttcagggaatccaatgccaccttctggagtctggagacaccagacacacatgtgattcacagacatagatacaagcaaaacgatcatatacagaaagatggaggggaacaaagtccatgaatagtctgaacgacacagtggtttacacaattaagactctgtcccaaaccaaacaacaacactgggactattacctatggagagtgtaggaagcacaatccaaacgggagaattcagaactgtaagcagcagcagctcagtttctacacagagaagagactccaactgacccaaagcagcagtgtgagcccagacttcctggcttttaaactcttctgtattacagcagtggcttcagtagattcatgctgtctcaacaacctagggagagaaaaattttagacctttaaaattcagacactggctcaagtgcccaacaataatcaacacttcacaaagataccattttgtcttacatggcctgctttttaaaatcttatttttaaagtttttttttttttgttttttttaaataaacctaagtacacacaccagaagagggcaccaggtcccattacagatggctgagagccaccatgtggatgctggggattgaatcaggacccctggaagagcaatcagt

SEQ ID NO: 93 - DNA, 10613 bp, Mus musculus
acttcatgtgctttattagcatctagtgtgattgtcatggtggtgaagaatgtatatctgacatcatcggacagaccaagtagcctggagagttgacaagaagattgtctggatggcctgctgggttttgctttttgggtttttggggggtggggtggggaaggagttggcttttttttttgtctttatgtaatgtttttgttttaaaggactaatgtttattacagtgttatataaaagtgtaacatattaagtgtatagaataaagggcaataacaaaaatttactcgacaccaattttagccgctataccctcctttcttgtgcagtgtggttctttccatggcattgttacagtgggaccattttatttgtttgtttgttgtttgttttgtttttgagagttgcagcccttgcttttgtcttagtatagcctgaatggctgcactaggtttgtggagtctcctggaagctgttaggatatggataccaggtgtgctgcgtaataaaaaccacgttcatgttccagcgttgcctgtttggcttccccttctcctccctcccttcacaagctcacagggtgctctcaagccctgcttccctccagggcctattgtcaacatggaaaatgttgggagactgctgaaatactccaactcccttcagcctcatcgactgcaacatccttttctctcttgaccaggttccatacctggtctgcagctttcctaggtagatatcccatgaccctggcatctccagtatcctggggtctccaacaatccaggtttcaccttcacagcttcacaaatggtctctctgggcctccaggcctggctgcagtggctttccttaattgtggagggagattccacagccctctctcatgtctttgactcttggaagctgccaagttctgctgcttgctggggctggaacttggcctcctgttgtctgacatcaggttcagcttctgctgttggtggtctccttcactgagcttttctttcatttcttttcacagcttgggtacttggctgggtggggtcttgcccagaggtcaccatccctttattccttttagtctcaggcttttctttaacttttgtatcccatgagcactggacttagctctgattacactcctagtgttccttttctccgcaaactgtacgttttctatttctttgtccagcttgcactttccattattgatctgcataagagtaagtaataaccacactacacagtcagtactaggctgtattgaaatcacctctgccaacatcattaatccaatgttcttccatttagcctcaggacagttttaggacaaaggcaaaaagcagtcacattctttgccaaaatatgacaagaatattctctaggctactcagtaatattctttccctcagaaacatcttgagctgccctccacagttccccctcagcactgtcttcctgttcctaccaagatgactcattaatccctgcttaaagcatccagcctctcttctagtccagagtcccaaagtcttccatattcctccaacaaacagcatagttgggcctggcacagaatgtcccagtccctggtaccaacttctgtcttagtcactgttctgttactgtaaagagacaccatagccaagcaactcttaaagaaacagcaaagtcactatgggtggccatgtacagatatgagtttcttagggtttagggaatcctatatcctaagattatttcttagtatatgctggaggggacatttcaaatcaatgggaaaaagacgattcaataaaactggttattgggggctggggagatggatcagtggttaagagcactgactgctcttccggaggtcctgagttcaaatcccagcaaccacatggtggctcacaaccatctctaatgagatctgatgccttcttctgatgtgtctgaagacagctacagtgtacttacatataataaaactttttaaaaacctggttattgatctgtttcaataatgaaagccattgatagaatgattaataagtagaataaacttgtttctcacagtctcagaggcagggtggttctgcttcatagatggagccttgttgctgtatcctatagagattaatgcattcttcataacggaagagcagaaggacaaaaagggacaaggtcagcaccctcacatggtagaagagatggaactgcaacaagtgcctagttttaaaatgaaatggctctagaagctgtgtgatctagtgaagaaggatcaaggaggccaggtgatggcggtggcagtgccaccgcacgtccttattccagcacttgagaggcagaagctggtgaatctcttgagtttgaggccagtatggtcaatagagagttccaggataaccagggctacacagagaaaccaggtctcaaaaaatatcaaaaaggttgtggtagggggagaggtgtcaataaaacattcagagagagggggtcaggggagagcagcagaaattcccaaaaagaacacagaccatgttacactccctgccctggagaagcaggggaaacagaaatcaagagagtccttgatgaaaaatggctggcagccagccatatccacaggacaagccctgaatccagctgcagggtttgctgaagcagtggcctctccaatgccatgtggctcagcagtcagaagagttcccctgtttagggggctgtggcagagtgcattcttgagattgtttaacctaagctatcctgctggctatggtcccagggcaagagacagcccagggatcagctgtgggatgcaggagggcactggccatctgtaaaatcctattggcatgggacccaaacagtggagtgtacaaagaaaggtagcccttgccattggatatgtggaggaaggccccaccctctcagaataactggaggttgagagtgtaagcctagggtcagtggatcatcctttggcattctctgtagtttgagaacactgaaactcttgcagaccacttggtatctacagctgcatcccttcagcagggtgactaatgtttaagggctctaaaaagtatggaggtatgttcaccagtacagaactcggggttgtggctaattctgctaatttcagaataacggggagacactaccagatagcatactagtcacctatgatctgaagagtcttgagggtgaggaaagctgttgcccacagactacaaagctaagtgtgacccagcaggggcccctagcacacaaagggagacccctgcagactgatggtggacattgcacacttattccatataaactctgcacaaatacagggaagatctgagtccatgcacttgtccctccatacacagatatcggtggacttgcattttcaagacccagctagaaagaagccaatcgggctggcgagatggctcagcaggtaagagcaccgactgctcttccgaaggtcctgagtccaaatcccagcaaccacatggtggatcacaaccatccgtaatgagatctgatgccctcttctggtgtgtctgaagacagctacagtgtacttacatataataaataaatcttttttaaaaatgtaaaaaagaaagaaagaaagaaagaaagaaagaaagaaagaaagaagccaatccaacactccatcattttaaatattttctttcctttcttttgagtatgggctttgtgatggtttgtatattcttgggaccagggtgtggcaccatttggaggtgtggccttgttggaataggtgtgacctgggtatcactgtgggtgttagcttaagatcttcaccttagttgcctggaagtcagtcttccactagcaacatttagatgaagatgtagaactctcagctctgcctgtgccacacctgcctgggtgctgccatgctcccacctcgatgataatggactgaacctctgaacctgtaagccagccccaattaaatgctgttttttataagacttaccttggtcatggtgtctgtttacagcactaaaaccctaactaagacaggctttgtgtaacccttctttctcttattgtatgttagtagtatgtttacttattagtaaaatatgttttttatttcctttcatgaatttccctatttttatttacatgtttttttatccctcttgccaattttcatctttttcttcctgtctacttttagtagtattttgactatattgttttctaaaacctttatattttaaatttttattccaatttatttatctaattttggctacaaatttcttcactcttgggaaacctttttgccctttttaaagtttcttcctcttctttcttccccttcataacatgcttcccttttctttttcaagtgatttaaatttctttcatcttattatgtgtatgggtattttgactgcatgtatggtctgtgcaccacctacatgcagtgcccatggaggccagaaaagggtgttgggttccctgaaagtagagttatggataattgtgagctgacacctgggaattgaactggggtcctctgggagagcatccagtgctcttaagcaccgagccgacctgtggctcgtacttttccttacagtctgagccaatcagcagcaggacacacccagtccatctctgggttgctttttgacatggagggctatggtgaccttcaccaactgagcttgctttttaacatgataatctcagagattcatctttgggcagatgagaaagaacaaccagttatgtagagaaagccggtaatgggccatagagatgacaataccaaatatcctgccagcacttggctctggcagcacagcaattaacaactgaaaccacagccatttgatacattgtgtgtttttccgtcatccaaccacattctcctctggcctccaaggtcaggacatggatacattcctacatacacacattaaataaataagcaagcaaataaagaaataaatacaaatgttaagctacaaatgaggctagaacactgtgtctagcatgcacaaggctttggggtttgttgcagtgataacaaatgtcaacggtaaatggaatgttaaagtaaaaaagctgagaccgggaacactgaagaaggtagaaagtgtgtaagtgtgtgtgtgtgtgtgtgtgtgtgagagagagagagagagagagagagagatacagctgggtatgagttagccaagatgaccagattcgaggaaggacagggtctctgagaggagcaaggtcaaagtcagcaggctggctggctcccactgcctcggagtcctttccccaacatatgcaagctactgctgtacttccatagcttcttatctctggggcagctcattctaacagactaaactaagtaagaatggtgtctaaagctgggcagtggtggcacacgccattaatcccagcaattgggaggcagaggcaggcagatttctgagttcgaggccagcctggtctacaaagtgagtttcaggacagccagggctacacagagaaaccctgtctcaaaaaaaacaaaaacaacaatggcatctaaaaaccgtctacctattccaggaagaaaccacaccagagcaccctgggacactgaactggatgcgaggtaaccaaggatgactgcaggtccatcttggtagctgtggtgggacttggtagctgtggtgggtgtgttgggtagactgtggtagtagcttccccactatggtaaaaaacaacacaatgtcatacagaagtatgaaaacaaagagcaggctaatatatggctcgctggccccacccaggtctgagacccatagcaaagatgtgtttcttcctgacagtcaggagggagagaccaggatcacgacaggagagcctcattctgtaggtctgggaaaaggaccccagaagactcatgaaatttttctgtagttgaaattataagggaaagatattcaagagagaaaaactgatccagtaatagagctgaggatagacttaatgccaacttcttgctacctgggattctcattgtaattgtccagctggttcccagcaagaaagcaaagcagtttgaatggttcaaaatgatgaaagttccgaagggttagcaggtgctgggatggttctttctggtttggtagtgctgaggactgaacccagggtctcacacatacttggtaggcaagggttctatggctgagattcattcccatcccccccccgggggaggggggggactcatatcgtagcccaggctagcctcaaatgcataggctggcttttaaccagaaaccatccttcactggcgtctagcatgatgggttgaggtgggaatggctacccctagtggaaggttgtgtttacaatgattttcttttctttttttttttttttttttttttttgctactgctttttccccctcctccctctcctcctcctctcctttctcctcttccccttcttcgtctccctcttcccttcttcttctttgttttttgtttgtttgtttgtttgtttgtttgttgttttttttcgagacagggtttctatgtgtagccctggttgacctggaactcactttgtagaccaggctggcattgaactcagaaatccgcctgagtgctgggattaaaggtgttcgacaccactcccggcttgctactgctttcaaatggcagatttctttaccttttttttttttaacgtcatactgggagagataagggtttcttactacagtttatacatctctaaactgtagtatagcattacttattaggaatcatgaaacatgttttcaacaattaactggagttgcaaagcatggctaggactggagacagcaacggttgagagacggtattgtgctcggctacttcatgcataactgtgatcacaacaaactcctggggggttctgacaaagaaattggcttttatctacagataaaataagacaggacagagcagggtggtggtggcgaatgcctttcatcccagcactcaggaggcagagtcaggcgaatctctgagttcaagaccagcctggtctacagagtgagttccaggacatgcaagattatagagagacactgtcttgaaacaaacaaataacaaaagttagaacaaattatagatttctaagattctgcagaatgattaataatgaaaaggtcaggccggacggtggtggcgcaggcctttaatcccagcactcgcgaggcagaggcaggcagatttctgagttcgagaccagcctggtctacagagtgagttctgggacagccagggctacacagagaaacccggtctcgaaaaaaaaaaacaaaaaacaaaaaaacaaaaaaaaaaacaaggaaagaaaagaaaaggtcaagctccctgcttttcaaaacattcaattgtttcagttatctggcaactacagaaaacactttgaggaataatcatgtatgtgtgtttgtgtgtgtatttttgtacatgtgtgtgtatttgtgtgtttttgtatatatgtttatgtgtgtatatgtttgtgtgtgtttgtatgtgtatgtatgtgtgtatttgtaagtgtgtttttgtatgtatgtgtgtttgtgtgtgtgtgtgtgtgtttgtatgtgtgtgtctgtgtatgtatgtatgtgtgtatgtttgtatgtctgtatttgtgtatatgtttgtgtatgtttgcgtttgtgtctgtgtgtttgtgtgtgtatgtatgtttgtatgtgttcgtgtatttatgtatgtgtgtgtttgtgcatgcatgtatgtatatgtgtgtatgtttgtgtgtatgtatgtatgtgtgtgtatgtttgtgtgtctgtatgtatgtatgtgtgtttgtatgtgttcatgcatgcatgtatgtgtttgtgtatgtatgtatgtatatatgtatgtatgtatatgtgtgtgaatgtttgtatgtatatgtttgtgtgtgtatgcttccattgttttccagggaatggcatccagacctacctatgtgcttttcttcccttctcaattttcttgtctccagggaattcagagctgtgttgtaactgtcctttttttctctctttaactacattaaatctgtaattctgctgacaatgaacactgactgcacttgtcccctttttccgggagaggctttgatccttgttttgtatttttgatgccacccccagctctctgctgtggttgtcaaccttgtctctatgctggaagcacacagctttcaaacacacttatgttctctatgccagctgccaggagctcttggctgagtgtgaacagaagggttccaggtagagtgtttccaccccataccccatggtgcttcaggctcaaccccacagcctcacacaggctctaccatacattccagcctagaatgtatgatttttatcagtaagggggataaatactagctggcctcctgcatgaaggacagaaaatatcttactgagagggaagttcagcctggctaaaaaccaagttcttttttcatgactgacaggtacaaattgctccaggccaagaagaaaaaaatcatttaaaatttctcccctttaaacaaagcttcagataccctgtttgacaattagtaatattaataaactctaattagccctcacaaagcaaagcccaccaattatagtttttaatcaaagtagaacacaacgaattacaaggaatacaatgtctaccataccaaaaaaagaaaataaaaaagaaacccaaaaataaaaaaacaaaccaaaccaaatcaaaccaacaacaacaacaacaacaacaacaagccaacccctacggctccattctgagggataatcatgcatgtcgtgctctatcactaatttggagattttttttcagagattttttttatttaggtattttcttcatttacatttcaaatgctatcccaaaagtctcccagaccccccccccagagatttttaaagtgcaaaaatatgcatatataaacttgacaaaatacagtacatctttaaccgggacctctttgaagtccacgttttatcatctctagtcaacgtgtctgggcagaacatctaccttatacaggctgtttccttctctgtatcctctgcaccagcaaatggagcccccaaagcagaaacatgtcacacacacacacacacacacacatcttttgcatttatgccgcttccaattctgtctcctaatctcaagctccttgattgtttttctctcctgtagattggattcagaccatccttcacggccaacagtaaactcctggagagtttttacccctcaccggaactcctactcaacagtgtctttaagaggttgatctttagggctaggcttataggtaggctctgtaggtaaggcttaggttcaatcaccagtaccagaagagctgaaagcaaacaaaccaaacccaaacccaaacccaaacccaaacccaaaccaaagcaaaccagcacagcagcagcagctgcaacaacaaaaatcccaacccgtctaatgttatttccttcttctctctcactccaggactcactagggagcccaggctccttcctgagtgctgagattacatatatgagctataagactgggtaggaatttttattttttaaacattaacttgatcatattattccttccttgaaaattttacaaaatgcatgttccattagaaaaaaacatggccagggacaccaacagtctgcctacagaaaataaacccatatacacgtgaaaagttcatcattattacttcataagtgaaacaatgtatttttttttctgtttcactaagccagtgggtacagccaaagagacctgataataaatcactgtgagaagtgcagaaatatttctacaaattatttctggttctatagtatttggatagcatttcggaaatattggacacgaaagggagtgaaaattgtccaatatctctgagcctcaattactgtttttgggttaaatggctacatgaaagacatatttaggagatagtaactggtaaataatggcttatacttgctgtcacctgatttttttatgcactttatatgcttaactcatttaatcctcgtaattctctaagtagtattattatcactgtcattttacgcacaaggaaagggttaaatacccataacggtgaagtcagttaggaggacctctagattactgtcattatagctacacaggggtgacttgcccaccacattggataaacacttcccaccccacgcccattatttaccattagctggtcttctctgattgctctgtgtacatcaagtctgacagaactgtgggacactcagtccatctctcttgacaatgttcctgtgccctaatcgatgttgtgtacacagtaataccgcaggaaagggcctaacaaatactatcgtgccgttttatgtgatgcatagcatagttttagagacgtgaaataatcttcacgaaactaagtcagacacatagtaattatagtactcatagtaaggtgagccaagccagcacgcgctctgaccacgccaaagagctccaacactcttgcactaggggccgacctttcccgctt

SEQ ID NO: 94 - DNA, 18089 bp, Mus musculus
acagcgtcggttgcccgggcgatgcgcggcacgcgtgcggaggcccacacaccctgaaggcggagccccgggtcgagtggctggctcccggaccacccagcagtctggaaggaggtgagggcgggcattttcctctcgggggccccactgaggttagcgcagggtgtgttctggaatcgcaggttctagaaggctgggagctgccgccccaggtgccgcccatttccaccatctccccccacccacccggggtccgcacgatttatggcctttgacaggtggcctcgagcttagcaagggtgagccatcgatgcagttgcactcagggtctcgtagggcttggttcgaagctctgctgtcacattcctgaagtttgtaagtaagtgcgtgtgtctgaggaggccctgggcttgagaggcaagttctacgttctgccactgaaccctgttttctttctttttcgttttttctgcccgtgtcctccccaccctaccttagcatcgtctccctaagtagccccaggatgatctaaagttcgcatttcttcttggcgcctcccccatgcgccatcacaccgggttaaattccgaattttataacatgacactacatgcttatttcgtactgtagcccctgtgtagctggtactgccctaggagaccgtatacatactgatagcctaatgattgaaggagaaattcgggaaagggatcgcgtatccaggaggtagagcctgtctgccaggcagtggggacctcaagatctggaatgtgggtggatgcccagtgtgtacaggtgaggctgcttcctcggatagaatgtccatttgggcaaagtttcttggctgaggatttatttatacaaaggaagacgtatcttaagaaagtgatcctaagatgtgtctcctctggcatttatgactaatcgtacccacataataaataaataaataaaaataacaaaatactgggctacccctcagtcagtagagcatttgcttggtatgagtgaggccagaggctgcatatttgatccccaggaggctccaggagggagtcagaacactggaagacaggaacagaaggatcagaaattcaagtccagctttggatagatggcgccaaggctagcctgggctacatgagatcctgtgtaaactgccctcccccccaaaaaaataaatgaaataaaacgagtcagcagcagtgagtgggtgcttgacctctgctcagcaccgtaccactcacaacagctgtgtctgagaggatcttctttttcttgctctctttaaaaaaaaaaaaaaaaaaaaaaaaagctgggcgtggtggcacacgcctttaatcccagcacttgggaggcagaggcagacggatttctgagttcgaggccagcctggtctacaaagtgagttccaggacagccagggctacacagagaagccctgtcttgaaaaaccaaaaaaaaaaaaaaaaaaaaaaaaaaagtttgtgggtgtttggttgtatgtccctgtgccacatctatgcctggtactcagggaggacaggaaagggcattgggtggtctggctctgggatttcagagagttgtaaactgccatatgggtgatgggaattgaacctggatcctcagaagaacatctgtaactgctgagctctctttccagccccaaggggaccctctgtttttacattctcggcgaagctgtgcagctgggggttaccttgaatccctgatctccttgctcccacatttcaaggactggaatttaaggcacaggccaccaaacctagtttttaaggggttcaagaactgagccagggccttgtgagtctaggcaaacgttctaccagcagagccatttccccaaccctgtctaatcaggtatcagctgtagtggctccttcccctgaattcctttttgcctctcaccaccatgctgttatgtcctagaatacttagatcccctccatgaagtttgccttgtgctttccccagagggattagctcctgtgttgtccttcctggtgagtgtccgtgggccctgcctctcctgttccctattccaacttcagcatccacttcactgtctagggctagggatgtagctcaggggtggggccctaggtttctccctatgccaagaaaaagaatgtactcgggaaatatgactgaaaatgtaaaatgtctaggtcttatgacatcccagcccatcttagaagatcaggagatttaaaggggccagtaagatggttccagagtaaaagcacttgcggtgcacgctggagaacctgaatgtgatctacaggaagtccatacaggcagaaggagaaaaccaacctcacagagttgtcctctggcttccacacgtgagacatagcccacactgaaaataaataataataatgttagaaaacggaagaggggaaggtaagaaatatgctgccgtttggatgtatgttttgagacaaaggtctaactgtggagctgcgtatgtagagcaggctggccctggacttacagacatcctcctgcctgtgcatcccaagtgctgaggttgaagatgatgtaccatcacagcccacttttctttttccttaaagaaggccctccctgccgggcagtggtgacgcatgcctttaatcccagcacttgggaggcagagacaggtggatttctgagttccgaggccagcctggtctacagtgtgagttccaggacagccagggccacacagagaaaccctgtctcaaaaaaaaaaaaataaagattaaaaatttaaaaaaagaaaagcgctgaggcagtgatgtcctttagtaggcagactgctggtctcacttcctttaggaagctaggatggactgaactccccgattctaccttccaggtgttaaagagtacaggctgatgccaccatgttggttctggtacattttgattgggcattaagaggggctccatttactgtggacagtatgggggaaaggagagagttggggctcaaatgtcttctgggttaattagagcattgtgtcagacagacagatcaaacataggtcattcctagatcctctggaactgcggctggtgccacagtaaagcccccgtgagcccaccaggcagcaggcagagtcccgcagattccctaaagcaccttcatgccgttttcatctctttgctatctctattgtcattgattctttttacaagtatgtgtgtctatttgtgcaccacatgtgtgtgcatgcccaaagaatccagaaaagggactcagactgaacttagaggcaactgtgagctgcctggtatgggtgctgggaatctaacccgaatcctctgcagaagcagtaggtactctccttgctgggcaacctctccaggcctatttgcgatttttaactttctatcatctgattggacagagaaaggcataggacattagtacaggacaactcagtgtgcctgtgaaggtgtttccagagaagaggaaccaaagggacagaacctgctctggatctgggtggcactgtcacacagacctcaggcctcggtggaatttaagagggggaggtgcgggtaggggggctggggtgtaccttcatttaggtgtaattcttgcctattatatgaatggccttgtgtaaaaacccagttaaccggaaaagaaaacaaaaacaagaaggcagagatggaggcagacagcctgagtgggtatctgtgctccctgctgccgaggttgaggctccgtggtgtggaaagctctgttctgccaaccttccctggccaggagctggtctgaactcaggagtgaagacgctttccacccggggacggtgatgcacagctgtgaccccagcacgggagaggccaaggcaggaggagtccctaacgtttgtactcagtcagagctacatagcaagacaggtatctgccaccaagactggaactgagtttgatctctggaccctaaatggtaggagctgactcccagttgttctctgacaaccttacataatctcaccataaaaataatgtgcatttctttttctttcttttttttttaaagatttatttattttctgtatatgagcacactgtagctgactttagacgcaccagaagagggcgtcagatcccattacagatggttgtgagccaccatgtggttgctgggaattgagctcaggacctctgggagaggtgctctaaacctctgagccatctctccagcccctaactgtttttctttaaagaaggtctcactacatcgctttggttagtaatttaataattactattttcttttaagctctctttatgtcttaagtatatttacattactaccactactattgtttggagtcagcatcagtctggctggccacaaatgtgtgtgtgtgtgtggctgaggatgacctagaagtccttgtcctcttgctctctcctcctccctagggctaggattacaggcagctgtcattatgctcaggtttgtcctgcttgctgggacttgaactcggggcttcatgcatgtcagacaagtgctctgtcaactcagttgcagccccaaccccaaattattttagttacttctatttagtaattccagttttggtttggtttggtttggttttggttttttcgagacagggtttctctgtgtagccctggctgtcctggaactcactctgtagaccaggctggcctcaaactcagaaattcgcctgcctctgcctcccaagtgctgggattaaaggcgtgcgccaccaccaccggcgtaattccagtttttgttttgtgtgtggttgctataacccccaaggaggtcagaggatgcccttcaggagtcctcccttctacaatgtagggcctaagggtagaattcaggtcatggggatggctttacccaccaagccatctccgtaagaatgttcaaatcggggcatcagcatactgagaggatattctgccagtaatctatattcctaatacattctcaataatgtatttttatttttaaaaactttagcccagtgggatggcccacacagtttatcctagcactcaggagacagaggctggtggatctctctaagttcaaggtcagcttggtctacagagtgagttccaggagatgtagggttatgaagagagtctgtagtgagaatttttttaacacctagttatgtgtagccaggcatggtggcacatgcctttaatcccagcacttgggaggcagaggcaggcgaatttctgagtttgagcccagcctggtctacagagtaagttccaggacagccagggctacacagaaaaaccctgtctcaaaaaccaacaaaacaaaacaaaacaaaaaccctagttatgttgggtgaatatgttttcattttaatcccaggtgggggatatggggctgcttcagactgtccacagctgctgactgtggttgtctcatgctctaggaggggcgtgattttgccagctgcggatagtttacttctggggactctagagagagcctgggaaggcagctgctacttctggttgctgctgttatggtttctcaagtggtcttgagtaaaaagaggagaagttgttgatttcctggtgatgaagcttggacttgccccaaatcagcagcaagtagtctaaagaggtctattctcccctaacctttctctcctacctagtgtggtgggggtggaagagatcagggtgggataaaggttggaagggaggtatggatataagaacccaataacatagctttaaaaaaagtatgccaattgggctggtgagatggctcagtgggttagagcacccgactgctcttccgaaggtccagagttcaaatcccagcaaccacatggtggctcacaaccatccgtaacaagatctgactccctcttctggagtgtctgaagacagctacagtgtacttacatataataaataaatctttaaaaaaaaaaaaaaaaaagtatgccaacaaccctgtcaaaaaaaaaaaaaaaaaaaaaaaaaaaaaggaaagaaggaaaaaggaaggaaggaataaccatttctagaagggttccattaggcagttcatgttttgagcccaaaattctcctccctacccgccaagtgctgggattataggtgtgtacaagcacacctgacatctgagttttatctattttttttagacatagtcattatgttgccagtgggtttcaagctctggggctaaagccattcccaagctgcagatccctacgtaacaggacagcacgcagttaagtgcatttatcgtttatgctttccagtgtcactctcgattttcagggtgtatttttcttgagacagagtctcaaggagtctccaacttgtgactcttcctgccagcaccctgaaaatgctgatgcatcaagagaggaagattcttagatgaagtgcaaagcttttcaaaggttttgcaagtgccttgaaattgagaatgaaaatgtgtgtgggacttagacatttctccaaggagaggagccatggctcctctaagattcacaatggcctgaacccaaagatgacaaataccggcctcagacacctgactgttgagatgagtgtgtgtgttattcagtcgagtgcatgaaactggcccatcacagtgtggtaactcactgtcttctaaatgctaaattctcctgaaaacctttatttttcttgtcttaccccagcatttgtaatgagaggtcagtcagcaagatttcctggaggatagctttggagtcaggtctgagaaaacctaagctatgaccatttccaagttagtcaactttgtttaagttgcaagttataagattattttttaaatcacattttgtgtgtgtgtgtgtgtgtgtgtgtgtgtgtgtgtgtgtgggcactctcgtgcactgagccatcttgccagctcagcctctaattcttcagtgaagaaaaacagcttcctcatattctgtggcaaggattatattaaagtctctaaagacctgctccaggaccaataaataatagttgctaccactgcacaccgagacctcaccccgtgccaagcattctagacatgtgagcctgctcactgcactgaggtaagaattgtttcctcatacacagaggaggaacgtgaaggtcagagaagtgaagtctctcacctaaagtcccacactaggaagtgacagatctcagccctgaaactgtgagctacccacatttctaaacgttcagacacagaagacaatggcgtccttgaagattcaaagcatcctgagtcctggcaaccagtccctaaatagactgttagatagataggtcatcttctggtgtctccatccatctatctgctcttctgttggggaggtggtggtgaccggaaccggagcatgctaagctagggctggaatggtgagctacacgctggtctcagaatggatccttctaaaggattcaggatcatctccttagctgtgagtgccttccacttgcctcagtccttgactgtcctgatcttccctggacaggaatgcctttcagccttggccaccaggctttccaaggacctggaaagccatctcaggttgccaaatcaggtaaaggagcggttctcagccttcccgatgcgaccctttaacacagcttctcatgatgtgccgactccagaagattgtctctttgctacttcataactaattttgctactgttatgaactgtaatgtaaatatctgataggcagggtatttgatctgtgacccctaagaaagggccatttgacccctaaaggggtggagacacacagctaacagccaccgaggcaaacggattcctcatttcctcaggtaacagcagctattgctgtcctcagacacaccagaggacagcagcctgtcccgaccttcacccactgctggcccagaggcactgttgccagccctcagcagccagttcccttcaagcttgtgagacatggagccctttgttgggtcatgaattccttgaccaacctgaccgcttactcctccctcacctgaagaaagtataaagtgaccttgtggttccagagttgattcagagacactttccagaaaggactggcctcttgggagagattgcaatgtctgggtatgaggaaggtgtgttggtatgtagaggctggcactggcctggggctggcatgggagctgagcttcggagccgaggactaggctgtagtgcaggaggattgaggctaagacaactcaggaggactagcctccccactagccactagctaagcatcagcctcgtaagtgtaagaggacacactgctgttcatggggaagtcaggcatatgcagagatacctaatagcccctcagttcctgtcagtgggcaaagcagcccacagtaggtgaaaaggatgggctgagaacagccttgtgtgtatatcccaacttggcttcctctgctattttctacagcaagctagtctgcccctctgcctctcacatctttttttttttttttgtttgtttgtttttgtttttgtttttcaagacaggttatctctgtgtagccctagctgtccttgaactcaggaagttacctgcctctgcctcccaagtgctgggattaaaggcctgtgccaccactgcccagctcccatcattctttaaaggaaccatgatggaaaagggagattgcccatttggccatcatgaggacctgcattcagatcctccagcaccttcataaaatcagacaaaagtaaacccagcactgcggaggtagagctgtgcaggtccctggagcccgttgatcagctaatctagtaaaattgatcaactacaagttcagtgagaggtctcgtctcaaaggctggagaagggccagggctttagctcagcggtagaacacttgcctagcaagtgctaggccctgggtttggtcctcagctcaaaagcaaaacatgtgcacacaaataggatttcatttctgtgagtttgactgtgtagctctgtcctggaactcactgtttagaccaggctggcctcgaactcagaagatccacctgcctctactcacctggtgctggaagtaaaggtgtatgcctctctgcctggctaggaaagaaaagtcttaaagccaagcatggtggtagcatgatagaaaccctagcactgaagaggcagagagagaaggatcaggagttcaaggacagtctgagctatgtgaaaccttgtctccaaaatcactctgcaggatgtggactgagtgtgaatgtctctggacgttagcgatctcacactctgtgccccagtttaatttctgttgctgaggtgaagtaacaggtattcatcttacaattccagggaatcaggcagaatttgaagcggccacatcaaatctacagtcaagagcagagaaaagtgtgtacacatttgcttgggtaactgtggggagttgcaggctggtatccagtcaagctgaggtctgaaccccaacagttgtaattcaccttcatgacacggtaggcgttcccttatgctcctggaactctggcccctgcctaagttactgcccaccacagcccccacaagagaagcatggtcagtagtcacataagcaatggctcaagcttctgaccttcaggctaaactcctccccagttacctagcaacagtgaagaccataaaaaggggtgctcagcccccacctcgctcttactctcttactcttactcctttgtcctctcactctcacttctttttcctcttccctttctctttgtcctctcctctcctcctctctctctctatctagcctttcctctccccccttatctccttcccttgcatttctataataaatctctaaaaccatagagtgtctctgctccatcaaggcccgctgcacactctggtcagtgttgggaacttcttccctcatccctctctcctacaaccctggggctttagcaaggtagctccagggtccacggttgggggctgccccctttcccttccctgctgcgtgggtcaggcatgctcacccgagtggaaaagcgtctagcagctctgccttcgtctgcctgcccagagcacaggaactctggccggacgttaggccccttttcctcccccactttttcccaggcccccccctttattttgttcccaacaggtaactgtttcagcttgaaacctcggggctcagctcaagacccctgtgtagggaatggtgttgcccagagtaggctgggtcttctcacttaagacaacacctagatcataataactccagtactgactatggaagaaaggacctgtaatctcccctgagtgcctggggacccagatgacctaatagatgacctcagtattactctgtaattatatgcaaagtggtctttaatcaacctaattattctagaactctaaacaaaagaataaatacttggagtttgattccagcatcttcattctgactcactgagacaatctgactctagaatgtaatagttcctaagaccttctatcaggatgactgggatgtgtctagagagagcttggtacctggcgctatcctctgtgctgcagaaatgcaagagagctgctggacatggtggctggtgccatcattgcaggacctgggaagccaaggcaggaagggtatctataactctgaagtacacttggactgcagagtagacccttaaatcaacaaaggggaaataaatcaagtgatagcctgtgttaccgttgtcctacgtatgaggcccgggaagcaaaaactctctcctccagcctgtagtctagtaggagaatagacaataaaaacatacagacttggagctagagagacgactcagctgctcttctggaggtcctgagttcaattcccagcacacacatggttgttcacaaccatctataatggggtctaatagcctcttctggcagtcaagcatatatacagatagagcatataaaataaatttaaagaaaacaaaacggactcagggctggagagagatcgatggttaaaatcacatactcctcctgtaggagatctgggttcagttcctggcactttatcaggtggctcatcaccgcctatatctccagctctcagggataccctcttgtagcctctgccagcacctgtacatgcagataccctccccaaccccaaacaggtacagaactctaaaaaacattaataaacagacttggataatataaagtagaaagagtgagggtgtgtctgtaattctggtacttggagaggttgaggcaagagatcagggtcaactgtccagcctttggggacagccagcctgagctaacaaaacaagaggtaatgaagccctggaccagaacagcagtgactatggggatgagaggcggttacactttgcctgtcctctgaaggtggggctggtagctgataagctgtggtgtgtgcagaatacaagggaaacagacatcaaaaattccactgggcatgccggttcacatagtcccagctgctaaagccggcaagaggctcacttgtgcccaccatgagtttgagactagcctgggtaccctagtaaaagcccatctcaaaatggcttcaggctcgtggcctcagcaataaggaaggaaccaagatggggagggctggcagaggaaacccttttgctgtgctaagtctaagatgcttcctagagctctgcagtaagtgtcaagtgtgtagttggaagtgtgagtcctgggaagacctgcatgctagagctgcaatctagggagtcaccagtttacaggtgacatttaaagccacgagcttggatgaggtcacaaccaagggaggggtccttgtagacagaggacgtactgctgagtcagtagtccctgatagctcagacaaggcccctgaggaagtgagcgaaggagcacacaatatggctgaacttcacttggaacccatccaaaagaaacctcactcctttctggttcctccctgcctgcctaagtgccatcttatctagatgacgaaccttcagagtggtcctgccacttagtccttccactccttgaattcctgccagcgcttctggaaattggacccagggcttcctgcaggaaggcaagtgttgaacgctgggctctctactccccagtaactcaaactggcctgaactctgtgaaccctccacatagagcagcactgatcttttaactctttatttttgagatggtttcactaggtaactctggttagtctcaactcaccctacagactaggctggctttgaactcacagacattctcctgtctctgcatgaatgtgttacagcgcatgttaagaggtcagacaacttgggttcgattttctttctaccacattggggatgaaactccagacatcaggcctggtagcaggtacctttacagctgaggtgtgtctctcagcccatgccctttaactctttatctccctgcctccaccccctaactgctgcaattacgcaccggagacaccacacccagctctatgaattctttccaacatctcttaagcacttactgggttataagcttcccacctaggcatccagagcgtgaagggacaagacaggacagttccttcagtagggagggagcagcaactgaacgtaggtgtgaccggatgtggtcaggctctgagggaggcagtgaaggcgagaacaggccagaggaaagctccaccctgggaggtaagggaggttgctgtaggaaatccctcctgagaagcaatcaaaggctgacggggctgaaggggagtacagagagtctccagtactgaacagcacactccaaggcctgaagggaaaggagggggagggagagccaaataatatgaattaactcccttggggcgggggttgagagagatgaaggcagaggggaagacatcagtgagaccctggggtcttgcaagcctggataagagatgtggcctccatcctgaactaccaaccgccctaagaggccacagctgtgaggagaggagactgtgccatcagagtccaggtgggcagccaccatgccacggaaggtctctctccgttcatatttattttatttaaaattttttttaaaaacggtcttgcttgtctggtgagtaatactgggtggcaataaggtctttaagacataggatgttttagggggaggtgagctattccatcctgcagggaactccttaaactcaaatcttcaggaaatccttaaaacggacagattcattgggtcatatgtttcccaagcatatgaaagctgtgagaggcgggcagtggtggcacaggcctttaatcccagcactcgggaggcagaggcagaggcaagcaaatctctgagttcaagaccggcccggttcacagagtgagttccaggacagctaaagctacgcagagaaaccccatcttggagaaactaataaaataaaaaataaaagctgtaaggacagccaagatactctctcaggtgagctgagctcagctgtgtgtaacaggctgaaaacaactgggctacctggaaaacaaacaaaaaaccacccactgacttgccaagctgcccacagggtgtgtatgcacaccgggtgggttcccagctttgaccggttgtctcagcccttgctggaaggggcttcggtggtgcagctatctgagttggttccactcctgtaaatacccctcaccagtatttttgtgagtaaagcttactttacagtaaagtaaccccaagttgggttttggtgaaggtcttcctttggtctggggttggctcccaatggggcggttgcttgtacctccccagcagcagtgtcacaaaccacctccagcccgaggaccccctgctttatcaagattgagttcgtccatcttgagcatctgtctatagagtcccagttctcttcaagaggtaagaaagggggtacgtgaaattgtcctgttaaaattgtagtctcctgtggtaccctcaaaatgtcacctggccaaaccaaacgtcagggtctcacccgagaaaggaacccgtagttaggagcgtgaagtagaaaccatggaggaacactgctacctcactctcttttttgttttgttttgtttttaagacagggtttctctgtgtagccctggctgtcctggaactcactctgtagaccaggctggcctcgaactcagaaatctgcctgcctctgcctcctgagtgctgggattaaagacagctacctcactctttaacgcttagctaacttccatatacaacccagggctacctgccaggggaatgacgccgccaacagtgggcaggatcctcctattaaagacaaccaagacatacctggggctaacaaggcccagtggttaaggggcatgaacttgggttcgattctgtaactcacacgtggctctaagttcagttccactgcaggatcttgtgctcatgtaatgcttatatacacattcaggcacataggcatataaaattaacagataccccttttataaatttatttttattttatatatgtattggtgttttacctacatgtatgtgtgtgaggtgatcagatcctggagttacagatagttgtgagttgctatgtaggtgttgggaattgagcatgggtcctctgaaagagcaactgctgagccatctttccaaagagtttcttggttttttgttgttgttgttgttgttttttgggttttttttctttctttctttcttttttctgaaacagggtctctctgtatagccctggctgtcctggaactcactttgtagaccaggctggcctcgaactcagaaatctgcctgcctctgcttcccaagtgctgggatttaaggcacgcgcaaccattgcctggcaagttacaggttttacacgtgtacaagaacatacacgtacatctctgctcacgtatgccgtgtctgtgtgcagctagtatgtggaggtcagaggacgaccttgagtgttgtccttcgggctttcccacaggcctggatcatccacaagcacactggggccaacagggctggcacctagggtttaaaagtttgtttgtaattatgtgttcagtggatgtgagtgtaggctacccacagaggctcagagggagttgtgagctgtctgatgagggtgctaggaatctaatcaggtcctccagagaaacagtaagcatttggaaccactgagtgagctctccagcctcctcatttggctcactcttatggctccaggacatcatgggaggtactcactgagcaatcctggcaacctataattcagagtgtttgttagtttgtttttgcagtgttaggcattgaacccatggctttaggcattgctgagtaagccctctattccaacctatgtctgcacctctaatttaagatagggtctcatctagcccaggttatataatctaggctggttttaaatcctggtctctagcctccaatgtgctgggattacaagcttatgccattaaccctggctttcttgcttgttttttttttgtttgtttgtttgtttttttaaagagacaaggctttgccttgaagtcaccatggtcctgccatagcctccgaagtggcaggaatactccccaccactaccactgtgcccaactcgaagtttgtatatttaacataatatcaacaaaatgccacagagaaccctgttaggatagagtgtttccagcgggcagaaatactcagggcagtaaaggtacagagcctccggagggcgagcttaaagggaaattacgcaggtctgctcccctctaacctcacaaagagagctcaggtagatagggaagcgggaggcctgggagcagagagagaaagcagcccaagcagaggcccagaaggaaggcccaggctccagcagtcgcctggagtagccaagagggaggggcaggcaaggaggggaaagctgctagaggcaactcctgaatcccaaggcaaaaacgcctggaggtagatggggccctcagcaggcagcaggccctccatctcctctactgggtctctagcagctagcacagtggcatgagacgtccataaatacaaggagcatcttttcacgtgcgagtgcgtgtgtgtggcgtgtgtgtggcctgggtcctttggaggagcacacccctcccgttgatcaagccctctcctgaggtttctttcagtttggagtacatcacagttattaatatgactaccgaccaccgacagcacggagctcctacagcctagacttttggtcggtctgatcttgctagctttctggcttctaacaattctcttgctattctgctctctccctttctgcagactctctgagaccagactcccgaccgactggctcctcccacctccacacctccagcctggtatcaaggctgctttacaatcatcctattcagagacacacaataaacatttgtatggtaaaggaaactgatgctgacttctgcagaaagatttacaaatgtattctaacccagcggggttctcagttaccttaagcattgcaccctaaattatgtgtgtctcttaagtaaccatcattaccccacctccaccctgcaactgtgtagtgccttagggcatcaggctatctccccagtctcctctggagtcttcctttgtgtctgttttctttctctctggaaagccttttccctctcccctcatttcctgcctgacaccatctggttgttctggtctccatttagaagccacgccctctgagaagtctttccctgacagctgcctgcagccctgaggcggaagacctgcagaccctgtgtttcttgtaatcactacctgctccagttgactttctaatgtactgcatgtgagttcggagcggccagctgtttagcaaaggagccacttctcggtgttacctccctttgaaatgttggattacccatgacgactatacagagctcagaacacttcagccattgggaagttctaggctggggatgcagggatgcagttcactctgtagggggcttgccgagcaggtgcaaaacgtggggttcaatccctagcccctcataacccaggcgtggtgacacacacctgcaatcccagcccttgggaggtggagactccaggatcagggggttcaaattcaacctcaagtatctatggagttggaggccagcctgagttacaagaggacctgtacagctataacggagtcaatgaggtggctcagcaagtaaaggctctggaggcccctgctgcgtaggcatggggctataaattcaatccttagaacccacaaaaaggcggagggagggagacaagagactgcataaagctgtcctctgaacgccacgtgtgtttattttaaataattaaaataatttaaaataaataaggctgggcgcagcggcagcacacaggcttttaacctcagtactccgggaggctgatgtatcctgtaggtgaagccacagctatttattgtctgtatctgatctgtctaatgagttccaggccagccagagttacatagtaagtctctgtctaataagtaaatgaaagatgcctgggaagatgggggggaagggttaaggggggaggaaaggtgacagaagggggggggggaaacacctttaatcacaacatttgggaggcagaggcagatggatctttgtgagtttaaggccagcctggtctgtagaatgagttccaggacagccaggactacacagagaaactgtcttgaaacaactaactaactaactaactaactaacaggcatggtgacctatacctttaatccaggcactcctgaggcaggagctggtaggtgagctacaagccaggctggtcaacatattgaattccagtcaaggctacatagtgaggccctatctcaaataaaccttaggtatattaaggaccctatctgcttataacaaattagcaaacacaaggctcagggctgctacaaaccttgctttaaataacctcatacaaaaccaggctctctccccacctgtttggccacatgcaaagaaactgcagttccttcctttgctatcctgt

SEQ ID NO: 95 - DNA, 117513 bp, Mus musculus
cagttcaacaaagatgtttttatgtattttaaaaaatgtgatacataaatcatttaacaatggagatatgctcttgaaaatgttatcaggcacattcatcattttgaaaatgacagcgtgggcttacagaaacttagatgctccagctctgctacataccaaggttgaatgatgtattattctatagctctcaggtcataaatttctacagcatgctactttactgaatacagtgggaaactgtaataaaatggcaagtgttcgtgtacctgaacatagaaaagatagagcaaagccacaaggtggatggttaaataaatagtgtgtctgttaagtaataccaagaatgaggctttaaggactagaaattgccctggatgagggaatgagtcactggtaagggaatgtgaagacctcagatattatagtgcacttctgtaatatttttaaacacatatatgcttaagctagatgacattcatataatctattttcttgccttaaaaataactaatgctaatataagtttcattttaaatttcaattctttaaattttgtgaccttattattaatacttatctagctatctctaatctcttagtacccttcccaacaattattcactgctgactatcatttataatattggcacaaaatcaaaatacagagtagactgatggtaagagccagagatagtagacatatgctgtgaaaaactatttgccagttatgatagcaccattgcacacacgaactctcagtggttgtggccacatgcacgagccctgcataagatcaaacatgtcatcctcgctgtttctgaagttccactctggctgagaagctattgaaattgatggctacttggggagaaagaaacagttttcttcaaggatactgctccggagagcctagtcatgcccttgtaggtggttctgcatcgatgtccatacaggcagtagtaagtgaagtcagtgtattaaaaataagagcgtatgaaattcagagggaaagtggtgaggaggatgggggcggggaagggagggaatttgatcaatacacattgcgtgcttgtatgaaaccctggaacaaaagtgtacagggctggagagagctcagtgtgtaacagcagttgctcttcttgtagaagacctgagcttggttcccagcatccacatcagaaggctctcaactggctgcaataccatgtccagggtgtgtgatacctctgtcctcctcaagcacttgccctcatgttcacatacctagaagcagacacacaaccctacatataattaaaagtaataaaaacacactaaaaataaacaaataaaatttaaagagatccataaacatccttatcacactgtttgccccaaggctctgaaatcatcttagaagaagaggagaaatgactgtaagagacagaggtgacaaatgactatatgaaaacagtgttttccagacacataagagatgttacacacacacactcaaagtattatagtagcatgcacaacaccttcacaagctcaaaccacacaaaaatcccattgcaaaattttaatcactaggcatgaattttcgcctctagttaaggaactattggcatctagtcattgccaggaagaggaaaatcagggttttgggtgttgttattgttgttgtttgttttgttttgagggtttgacctctgataggtcaatcacactccagggccagccccatagccaagagtatttgggctgcacaaattggactccaggagttaacaaaaaacaaagtaacctccccctcaaaataggaagttggatgagtagggaggtagtggggaggtctgagaggagttggatatggttatgactaaaatacattgcatgaaattctgaaagtaacaataaagatatttaaaaccaggcgtggtggcacacgcctttaatcccagcactcgggaggcagaggcaggcagatttctgagctcgaggctagcctggtctacaaagtgagttccaggacagccagggctatacagagaaaccctgtctcaaaaaacaaaaacaaacaaacaaacaaaaagaataaaagtatatgttttatcacagcaagtgtcttatcacagcagttaactaagaagttggtatgagaagtagacttttgctactgctgtgtcagtcccgaccatattatttagaggaatttgaaacacttgggccctctagagtagaaaaggggttacccctactataaaattactgatagccttaccttcctatctctaattctatacctcttaaattgatcgtatctaggggatccaaataactatgtacccacagattttcacagtctatctccccatgttaagtcagaatgctatttcctgtaccttagactatcttataatctatccctatgaaataaggggtgtattagtcaaacttatactctcagtcttcatgcagtcattcctacacaatagttatctaatctgaatacaataaagtatattcctctccagtaagcccatagttagtctgaattcttgtagctgatatgacatttaaatgaattagaagccaaccatggcacccttcattagtcatggacaaattttgtgtccctattgttatcattcttacaccactcacgagcccatttgaaaataatctaatgaaatgaagagcacttgtggttaatactttggtcttagaaatgaaaaaaaaaatgagcaagacatgatctccacaggagtcaaagaagctaaaaactttatcatcagcatctaaaagctgaaattatgcttaagctatgacctgattcttctatatgaagtacacgatttgttttcaagtactatgtaagtattaataaattataatgtaatcctgtgtataataagtacttcattcttaacttactagtagtggactagtaatccaggtgtggtattgcaaacctatagccctaacattgcagttctaagctagcctatgttacatagtaaaaacactagtattgtacatgtttaacaatatattttacacatatttaactagacactaaaatgtattcctggagttggagagatggctcagtggttaagagcacttgctgctttttcaggggatccaagttcggttgccaacacccatttttggcagctcacagcctactgtaactccagcttcaagttatataatgtaatcttttggtctccacaggtacttaaacatatatggcatacacgcatgcacgtgactaaaaataaaatgaagattcacttctcatccatctaagcatatacacaaacctttataaagtgcataattcgctaatttttaatcacagaggatccttttctatgtgaacattaaccaatcacttttagttaatcaataaggcataaatggtattgattgtacatggtacattaaatcaaaacaactctagccaacaagcttatcatctcaaatggggacactcataatctaccaaccagtgtgaaatcagaaactcttttaagtgtttctatactgaaattgtaagtggaacttttgtttgtttgtttggttggttggttggttggttggttggttggttggttggttggttggttttttgagacagggtttctctgtatagccctggctgtcctggaacccactttgcagaccaggctggcctcgaactcagaaatccacctgcctctgcctcccgagtgctgagattaaaggtgtgcgccaccatgccaggctcgtaagtggaacttttgaagaccgtttagttaaaactcataaaatgtttcccctaaatgtaaacaaccaactatcccatgatcatgcatttgctgttttagtttttgtttttttgtttgtttgtttattttaattgaaggattataagactcagaacagccatcaaacctttgacatagtcttatcacctcatagctgaacttgaatgaatattctatataaaccataaagcactaactcatccatatttaatggacaatacagctttacagtccacactaacacaagggcacctcatacacatacaaatataacattttctggttaatttttgtcagcttcaaacacaggaagctgaccaaaaattaacctttccaattgaaggtattgcctctgccagactgttctgcaggcaagtctctataatgaattgatttggaaaggctcatcccaatacgggcagtgccactcctaggcaggtaggtattcctgggatatagaagaaagcagactgagcaaaccctggagacaaaccctgtaagcagcatttcctcatggttcctaccactgatccaacatgggtgcatgccctgacttccctcaataatgaactgtgacatggaaatataaaccaagtttttggtcatgatgtctaatcacaggaacacataaactcacagtctacagattgctattacacaggtaaaattaatcttttaaccccctcagacctattccctcaaatctctaaattcattaatgcattcttatattaacatcatacaaacatctcaaataagtaaccgtctgaaacagtccaagaatagagtcatggaaggggaattctaagcgcttatgagaaaactccaagaaatcaatacaatagtgacctcagtttcttcaacagaaaaagcaggtttgttcttggattgtgttttcgtgttatttcagctgttgttattcatgtgtctctacagaaaaataagtttttgtcatgtgtggtttatccttgtgatcgaacatcttactcatgtgattcttcttaaccctcagagtataaactgtttgatacactgaataaacttggctattgcatgagaccagtctacctcattatcagggccctactctcccacgttcacactgccaacaagagcagtaaacaagaaatatcatatattcattaattgatgataatcctataactaccacatttaattatgacattaataagcaagttttaacccaattcttataagcattttatttttgttttgttttgttttttgtttttgagcaagtgtagttcttgctgtcctggaactcactatgtagacccggctgctctcaaactagcctgagtctgtcagctgagtactgggattaaaggtatgcaccatcacaactgacttacaaagtattttaactttatctagacagtgaatatatcgaaatatgtaatccaaagcatgaaaatagccacatgcctttttctagctccataaacatataggtttgtgcttgttcttttaaattagtttcttgtgagattgcacatggaagcagtcatattccagtgaaaattctctctagtccagtgcttctcaaatttcctaatgctgcaaccctttaatacagttcctcatattgtggtgacccccatcataaagttatttcattgctgtaactttgctgctgttataaatgatagtaactgatatgcagaatatctgatatgcagaatatctgatatgcagaatatctgatatgcagaatatctgatatgcaacccccaaaaagggttgagaaccacaggttaagaatcactgctctagccaggcagtggtggcggatgcctttaatcccagcacttgggaggcagaggcaggcagatttctgagttcgaggccagcctggcctacagagtgagttccaggacagccagggctacacagagaaaccctgtctcaaaaaaccaaaaacaacaacaaaaaagaatcactgctctaaaccatattgttcaaaaggaacaggcattgagctcatagcagtttgctcaaccacacccccatagaccaaagcagtgttaagaactaagcatttcagaaagactgttttagaaagtttgactaaagtataaaaaactacatataaagtaaaagtaacttaatgtaattttagtatacctgagtatgcaatgaccaaaatacaaattatgctttcggcaaaacacacatagtatatatacatcttctctctttggatttttccagcttaaatatttaatttttttaaacctttaaatatttttgataagacaggaggctcaatcacacattagccttgtctacacagcgttaggatcatcacttcgtcttctacctccacttgtttcaaggaagttcccaggacaatagtaaaatccaaggacccgcttacgcgggtaacacaatgacttctgaaatctctcctgaagtacttgtctgaaaccattcagcacttaactttttaataagtacaaggaatatactctaaaataacactgaaaaatattacctacatacaatagaacattgttcaaacttaaaaagaagaccccctgccacatgctaaaaaagaatgatggatttcaagacgaggtaaagcagaggaatgattctgcccatatatgaacaatcaaaaggattcatcctcgtaggtgaaaagtagagtaaaagtgagatgggaattgaaacacaaggttgtttctttgattttctgttgggtctgggggtggggggttgtggggacagtccgcgctgatgtgtcacagaatgtgtgtggaggtcagaagacaaggtgctggattcagttggctccttccactatgtggaacctgacaatgcaactgaggtcaccaggcctggagcaagtaccttcactgactgacacaagccatatttattaataggtacagaattacacttgagccagattaaatttttctggagatgtgtttcagagcatgaatgtacttcacaataaggaactctacatttgaaaatggttaaggtggccattttgtggctttaaaaaaacataattaatagatatgcagcatctatatattgccacgaagggagtccataaagaaaacaagaagatgctattattacttacttgtcagagctgagcttgagatgtcagtgcacatgcctgataacactagaagaatgccattaacattgctattctttctgtgagagcgaggtaaggttattctctgtggtaaatccatgacggatttgcttttgatttcctcagagctttaagattcaataggccccctagtgacatgtccagcagcattaaacacacaaacaactcaccgattggtggaaaaaaatggaatgaggctgaagacagagctaagggttaagagcccctgttgcacttggagaggacccaggattaggtctctggcagacacaatgctttacaaccatgtgtaacttgttccacggcatctggcaccctcttgtggcttttgagggcactacacacatgtggtacatagacttacgtacaggcaaatcaccaatacaaataaaaaatcactataagatatcccaacagactaagtaccagaccctcctctgaaaggagatagggcaaagaacatggcagaggaggaggaggagcaactgaagactgagaaagtaaagtgctttcactagttatatctgagaccctagaagatgtctctttacatgaggccaacatctctctctctctctctctctctctctctctctctcacacacacacacacacacacacacacacacacacacacacacatacacacacagaaagagcagactcgagtctttacctctgcttgatcatcaggttgcaggtattcaagtagcaaaacctaagcttgagttcttgagaagaaatggagaagtgacgcttagagccagtggacactgcctacaagacgaatccttatccaccttttcttttctatcttttcattgcctttgaatggttttttaaaaattgtcaaatcaccagcctcccttaaaaggcttgtagaaaagacttcaatgacatcaagacagaaaacataatgcattacctcttatcaaactaaacactaaaaagccattcaaatacaaatacaatcaaatacagttcacaacagcaaccctggggagggaaaggcaagagatctggactacctacattagctttctttgttgttgttttgttttgttttgttattttaatgaggacaagaggcaaaactaatggaatgcaatcaagaacacacaataggttactagcaaggaacacacggtaaaactgtggttacagaggatagaagaaggaactgggagataacatgaaatacaaaagcagatacataggatacaaaggtttaaaatctcatgtccaccatgaagcctacaattaataatagagcattcagtatttttcgtgaaatggataaacttttccttattgtccttgctacagtgaggaaaaataggtaattaaatgagatgtgtatattaatttgtctcactagagtaaccatatgtagcgatgcttcactgagagtgatggagttattgtcctgttaaaactagtggaacctggactattgtaattcagatgtacatttcatgtcccttatttaccacacatcatagcttagcgacacaagtctgtagcataccagctgtttcctgtcgtatcaggtacgtaagagctatggttcaccgctactttccagcactgagaggattttgccttataacactatcctaggagaagataaaaattcaaaatataaagtataatttctatgagtatatattattcatgcactgtccaaaaaaaaaaaaataacccaaagccaattgtaaggcaggagccatatgcatcctatcatcttatactctttaagaatatatagggtgctggtgagatggctcaggagttaaggacgcggactgctcttccaaggtcctgagttcaaatcccaacaaccacatgatggctcacaatgatctataatgtgacccaatgccctcttctggtgtgtctgaagacagcaacagtatactcatatgcatacaataaataaatcttttaatatgtacataaattaaaaagtgctttttaaaaatagtaagatttgtctttttccagttgctgattttataaatattatttatcaaaaagaaaattcttcattacacatgcaatgaggccattgtcactgcaatcttaaagccaaaaaaaattacaaatgaaaatgataaaccagtcctctgtctatgtgaaaattctcaagatacataaaaactgtataagattatgtttggatatgtgatttttctaaaatatattaaaaacataggccctatcttggaatggttaggagatggtggaaagctaggaacagtgtacatattaaaaggtgctcaagtcattggacacatgcctttgaaggctataataggacccagcacttcctctactttttatgtcctggtaatgatgggaacaggtttgctccaccacattcttcctattacgaggtgccaatgcatgaaaaatataaactgcaagtcaaaacagcctcagactctttgtaacttaattctcaatatcaagacaagctagacttatcctaggaattcaaggtctttcgactaaataaataaaataattaatttaaaaacgaattttaaaaaggcaatgcaataatacacccattaatggactagaaggtaaaaaaacacagagtgggaaaaaaatcatccaatgattttcagcatcctttagagattaaaaccaaatacaccacaatccaataatacacaccaataggaataatcaaaagagttctgctaagggttagtattaaaaacataaaaagagctaaaggaacttgatcagagtgcctgtatatgtatttctcaaaaagagacaactggcacacacacacatatatacatatacatatatatacacatatatatgtgtgtatatatatatatatatatatatgtatatatatatatatatatatatacacacacacaacacacatgtggctcatcatcattaagtcgatgacaacttaaaacaaacctttagcatcatatagcataggttagttacaaaacaaaagaaaagagataatatgtgctgatgtgagtatgaaggaaagaaaacctttagcatgtctactttgaaaacatttatgaggatcctaaataactggaaacaggttaccatatgatctagcaaacctaggtctgagtgtataaccaaggaaaataaaatcaccatctcaaggagatagatatctacatgcctatattcactgaagtatgatttattatagcaaacaataaaattcagtgcatctcaaaggagggtgaaagaatggctcagctgtttagagcactggttgctcttgcagaggaaccagatttgatttccagtatccacataatggcttacaaccacccatagctctagtttcaggggatctgatgccctcttgtggcttctgcaggcaccagacacgggggatgcacatgcagcgcatacagacatgcaagcaaaacatgcatacaaaataaaataatcattctaaaatatatttttaaaaaggagtctctcgaaaaatgagtagatagtagaaatgtgatgtggtgtgtttgagtgtgtgtgtgtgtgtgtgtgtgtgtgtctgtgtctgtgtgtgtctgtgtgtctgtgagagagagagagagagagagagagagagagagagagagagaaagggagagagagaaagagagaaaatgagtgttcgtgagagagtgagtatgtgtgagagtgagtgtgtgttatatgagaaagagtgtgagagagggtgtgtgagtgagagagggtgtgtgagagagaaagtctgtgagagattgtgtgtgtgtgagtgagagaggagaggagaggagaggagagagagagggattgtgtgttttgtatcattatggccatcagtcataacaaaaaaatgatactattcatccttttaaaaaggaagaaaatcttttaaagtaacatagatgaatttgttggcttggccagcacactatgtaaaataagcaaaatgtggcaaagtaaatacagcatgatcttagcaatatatgcagtgaggagtcttgtttgttttaaaggctgaacccatagcaaaagagaatgttagttgtcaaggctggaggcaaggtatgcaggtgtaatttctttgtcacacgtcacaactttttagatatataggatttatgcattctggagattcgctgataacacagtaacaacagttatatcatttattacatgctttaaaaccatcaaatgcccagattttaacatgaagattagtgaatattagatgccatagccataaataggtgactattcgtttaatcatgtatatgtatatagtgaaatatgtcccatgtttacttccccactggatgttaataaatctgagacaaaaagtttaaaagatgaaagaggaggttggagtggtacaatgtaagaaagagtcacctgttattactggcttgaaaatgaaggaaggagaagctaagtaagaattcaggaaatgtcaggaaactgattttccatctagtctacagaagagaatgaaatactgtaacaactttattcaatacacatatcagacacatatcatacttttgagatacagaactgtaatatgattaattcattttgcttttttttaaaaaaagcaatgtgagagttgaaaataatttcctcgttgcgataaggactctaaggaaaacctgtaagtaacagcacatcacagagtgatgaaaggctgaaagatttctaagatcagaaaccagtcaggagtgggcaagatagctcactctgcaaaaacccttgctgtaaaagccttatgaatccatttttccccatattccactgcagaaagaggtaaaggagttgtgaaagttatatactgacctctacatgcataccatggaacatgtgtgccccgccccatactcatgataacaataaacaaaataatttgcctgccttcactggctctacaaaatattttattggaatgtttatccaaattagccaaaggaaaataaggtaatacgttgataaataggtcttcttaactaatccacggatgtttgcataatacggctccataatggacccatggaaatgaaatttttcccctctagtgttcacaattgcacattacatctttggtaatagtgaagctaaagttctgttcatgcaccctctgcattacatgctatatgttgctctgccaaaattcttgagaaaagcaatggaaggaaggtctacttttgctcttagttcaagggtgcagtctatcttggcagagaggttaaggcaatgtgagcttgaggcagcttgaggcagcttgaggcagctagtcacactgtgtctactgtgaggaagcaaagaggtgaattctgatgctcagacctcattgttcttttaattaaatctggactccacaccctagaaatggtgttgcccatagtaagggtggctcttcagttcacttaatatagataactgttcacaggcatatccagaggtttgtctcttaactgattctcagtgtgtccaaggtgactagttaaacatcacatcttctttcatcaaataccatacaattgttactatgggctttgccaacattttctattgtgttctgagataatagcttgacacaggacaattgtcttaaaatctatacatttattttcgaaaacatacccagtacacatttgttaaataaattgaatgaacgaatactatctaaaccaaatctcttaagtcctgatctttacttgcctgtgagaaagacattttgagaaagttgcctatgatctctgagccattgaaatcagtataccaactctagtaaaatgttatccagaatgtagcatctgaattaaattgatggaatccaagaatttggagtgctttggaaacattagagaaagcaagtaaacatgatgtgtgcttttagggttttaattaaatttggaacaggagcaaaattgggttttattactttccttggaatcgattccttcatttggaatatatataaaggggacagagatgtcacccatatttggggcatctccatattgttgccattttaagtgatctaatatttttagaatctctgtcacatgatgttgagcaacatagataaactttggatgataaaaatcaaaactcacagcaaacacatggtgtaatattcgatctagagagcacaagtctctgcttgtgaatggacatctggctcacatggaacctagcttacaaaagaacacagaggccaaatagttcactcaattcataactttactgccagaaaaaaaaaggattcaaaaaagcaaggtaaaaagttcaaacatgctgaaagaaagctacctccaataagatccagtgacagaatataactatactcttgcttttccatcagtttaattagaggataagtcacgtatgttcaaagagcaaaggcctagaggagtattggaatggaaaatatgagatgcagatacttacatccaaccaatggagtcaagctggggacccctgtagttgcattagggaaaaggctggaagaagctgaggaggagggtgaccccataggaagatcagagtctcaactgacctggacccctgagatctctcagaccctgagccaccaaccaggcagcatacaccagctgctatgaggccccgacacacatacagcagaggactgtctggtctggcttcagtgagagaagcatctaactcttgagagagacatgaagccccagggagtggggagtcctggcaggggtgaggacatcctcttggagagggggcagaggaatgggatgaggaactgtcagaaggtgtactgggagagggataatgactagactgtaaatatgattaaatataataaaataataataataataataataataataataataataataaataatcaactagtttcccaactccatggaagaaaagtttgacttgagagtaacactctgatctcatctctctcgctcactttccctttcctctgaagaaggattggcgggctttataaactctggctttttctaggccataaattaatgtagacctgtcctgtgctgaaacttggtgaaggcactgattttccagcaaactcagaggctgttcttgtaaatctgtctagtttttaggtaggagtcaagtattttaaaaggttttggttctagattaccagggataaatccaatctcactgtcattcacatcttatttttcaattagttctgagcatagaaatatatatatatatatatatatatatatatatatatatatataacaaatcttttatattaatctcacaaagacaacaaaagttaaaattaaatacaaatataaacacactcgatgagaaatacaagaaataattttatgggttattccatttctgacaatatttcaaattttgaaaattaaaaattacttctaccagatcatgttggggaacatgaccatggtgaggaactccggaaactgaaacaggaggatggtgagtctgagatcagcctgggctatatagcagaatggtgtctcaaacaaacacacaataccctaagactacattgtcacttctgtgtcatttcccttgagaggctgttgtcaattttgttccttggtgaacaatagcagaaaaacagctctgggggccaaggggttgggacaacattccattagtaaagaacctgcaatgaatgtgccatacaagtatgaagacctgagtttggtccccagtctccatataaaattgctgtgtgctggtgaatacctgtgataccaggactggggaggcacagacaagtggacttggaggctagttatctacccaaagccacgagttttaggttttatgagagacccagtatcaaaactaaaggtggcaaaaatttaaaaaaaaataatgaagaagacaacctaattttacctctggtttccaaaagtactaaccttcattccacccccacccccacaaacaaatgctcacaaatacacataagagtgaataatgaatgagttcactcatatatatagtagaacaatcattgaactcacagaagtagagaagagaatagtagctccagaggttttatctttctagcagagaagccagaaagatgttaagcaaaacatacgttgttcttgtggaactcctaacagtgggggtgtttgttagtcacaataaagtggtgtctctccttcttttatctgctcttgggacccttttcctcttactgggctgtctcagccagttttactataagggttttactcctagtcttattgaactttgttatgccatattcagttgatatcactgggaagactgatctttcctgaacaggtagacaggaggagcagtggatctggggttgaaaacaggagcagggaggggctgggaggaggggatctaggagaaactgtgatgaaggtatttgagagaataaataataggaaaaataagattagcaatacagcaacaataaccacaatcaaaagataatcagatctcaaaagaccaaaaaacgttgtacatgaattcataagaggatagatagtaaacgagaagaaacaggtgactgactataattggctctgaaattttatttttttacttaaaaattgatagtagtggtttgtgcaactctgtgagtaaattaaaaattacagcattgactacttcaaagggatgaaatacacattaataagcctcatttgacagtgattgctttcagatgcatgtatatgtcatttttaaataaatttgccaatatattataaggaagctgtcttagtgcttccactgctgtgataaaacaccatggccaaaagcaacttggagaagaaagggttttatttcatattacacttcgtactctatcatctaaggaagcctgggcagcaactcaagacagaaaccttgaggcacgaactgatgtagagccatggagggatgctgcttaatagcttcctcccctggcttgctcagtcagctttcctatagtatgcaggaccacctgccctgggctgataccacccacaatgggctaggcccacccacatgaatccctaaataagaaaatgcacaacaggcttgcccatgggccactctgttcgaaatttttttctcaactgaagacaccctcttctagcttgtgtcaagtagacctaaacctagccaacacggaagcacttcatgttattttttagttttaaggtactctcctactttgcttctctattcctgaaataaaatccatgaccaaaagtaacttggagaagaaaggatttgttttgcttacacttccacatcactgtctatcatgtgaggaaacaaaacaggaaatcaaggcaggcacctggagcgagaaactgctacagagacgagcatgagtgcagcttactatgtgagcctccatggtctgtctgatcagcttgctttctctctctttttacacaaaaatttcattatgtggccctggctggcctagaactaactatgtagaccagactggccttgaactcacaaggcattcactttccactgcctcttaagtctgagattaaaggcacgtactactgccctggccatctctctttcttttctttttctttttcttttcttttcctttcttttcttctcttttcttctccttttctttcttttcttttcttttcctttcttttcctttcctttcctttcctttccttttcttttttctttatctgcgcttattttatgctgaacttattcccgtgccatgagtttttgtttcttcagtctcttctgggatatctttttcatctgtgcagcctcctcttctggctttggaacggtctgttccttctcagtgaggatcatctcactatggcagggagaactcatgtatgggttaatctggccatgagctctgtaggttcgtcagcgcatcttaggttcacctggatatgttcaacgactagagaatccatgtctaaacccttaaattcagcattactctctgcatttttaagcatctgcagcaaaaagtcagcactcttttttggccaccgtccatgtccagccgtactatttggccggtgcacaagtaccattataccaccgggtggcacacactgcttcttcttccttttttttttttttttttttttttttgcaattttttattagatattttcttcattttcatttcaaatgctatcccgaaagtcccctctaccccccccccgccctgctcccctacctacccactctcacttcttggccctggcgttcccctgtactggggcatacatccttcagatacttggtggctttgcgaatatgcatacccttgatgacctgggcagtttcccgggtgttcttaaagtgaacacaaaggtttgatcctcttgatttgcatacttttgtggggttttctgggtcaagagagtagcgaaccatcttcacaggtcacctctggccacttacaggaagagccccttcttgcattctttttttttttattacgtattttcttcaattacatttccaatgctatcccaaaagtcccccaccccctctccccccactcccctacccacccattcccatttttggccctggtgttcccctgtactggggcatataaagtttgcctgaccaatgggcctctctttccagtgatggccgactaggtcatctcccttcttgcattcttatataaactaggaccaccttctcaggatggcactgcccatagttgggagcaccattccacatcaaccaaagattaagaaaatgcccccaacacacaagcttatagaccaatctgatggaagccgttcctcaatcaagattccctcctcccaggtgactctagaaagttgacaaaattaacgagcacaagcacaaagatatatcatgcaaaataatgcttttaaatcctattttaaagttagaatttgaaatggttatttgcatagaattacatgaaatataattatttagctcatctggtcagagagtccagcagacaaatacataaatgaactatgtggtacagtaaatgcgagggtatttattttcatacaaatgagaatatggcacggcaagtttgggagaagctgaattcgtccactctattattagaagattagcatgaattgtgcaaccacacagtggttccctgaataatgaataatattttatacatctgtacttagcacaatttttggcatcttgtggcagccatggttatttgtttccaggtatgaacacagaaattcagttctagtgcaatggaggtggtctgtgggctgtttgtaatgtttgtaatgttctgggaaatatgaagtaagaacattttccccaactcggcctctgactgtaaaagttgagcaaaattcatagggcagctacataagggctgagatataaattatgggcaaattgagaaattttttaacttataccaggtgtatgatttcaaaatagcttttctatcccttggttttccattctcttagcactgttccttgaggaagacagatgtaattttgacaatgtgaatctatttcttgttatggccaatgcttttattatcagatcctagaaaacttggtcacagatatggcctccaagttatttctaggtgtgctattcttttaaagtcaacatttaatttcataatgctttttaataaaatcttgtgtgtgacatgaagaatagcaaaaagaaaaagagaaatgtttgtgttctcttggaatattgggcatccccttcttcttgagccacaacttgaggatcaagcttgaaaaaaaaaatcctgagttaggtaactcagactcaaaaagacagatatggtatgttttatgtacttatatgtgaatgtcaattgttatgtcttctataagcaggatacagttcatataacctcagaggttagctatggttagtgactaggggaatgattaactcaaactaggtgtctgaaccaggcagaggtggcgcacgcctttaatctcagcacttgggaggcagaggcaggaggatttctgagttcgaggccagcctggtctacagagtgagtttcaggacagccagagctacacagtgaaaccctgcctcaaaaaaaaaaaaaaaaaaaaaaaaaaaaaaaaaaaaaaaagaaagaaagaaaaaagaaacaaaagaaaaaagaaaagaaaaaccatcaaactaggtgtctgagaaataaaatatggatggatggatggatggatagatgggggaacagactggaatgaaaggatcaaatgagtaggggcacagagagggtagtgaggaagggaatatgggaagggatggctaaaactaagggccatttgggggtatatggaaacctaacacagaaaaagcttcctaaaatatatacatataatgatgatccatatagaaccacaaaatacctggggtcatggtgcccaaactgaacagttcttgtcaccaaatgaagactctgaaaatggtttacgtttatttgaattttgggtcaaagaaggctcatgggtactcccttggctatttccaaggctattgtttgcttgataacacccacacaactcattgaacacggagaaaacaagcttgtgcctcccaagagccttcacctctactgactagtgatcatggtactggagggaactccgcatgctaccaaaggagaaaggtatctatctcaccaacccagctacaaaatctccaatctacaattgtcaccagcatataagatatgttgttgcaatagtagcacaaagcttgtgggactaaccaaccaatacttgagtgtgtttaacccccattccatgagatggaaccaaatattattgtttcctaaggacattattctcatagatctgtgtcttgctcagccatcatcagaaaaagattccttctgtaacagataggaatatatgctggggacagcataaaatgacagggactgcctgcagtagggcaggatggagacagcacaaatgaactatatacagccaatgtccagggctaaggttaggagaaatgggaacaactgctacaaagagctgccgcaaactactgagatgtctccatcctggcctactacaggcagtacctgtcattgtatgctatccccagcaaatatatacagagattcacagctgggcaatgtacagaaagtgagagatcttggaacacttggtcctaaattggaagtctccatcaaatccctctcctcagggctcagggaacccttcagaagaagaggcagcagggttataatatccagaggtgatagaagacagcatgtaaacaaggccttctgagtatagtagaaccaatgcacttatgaactcacagagacagtggcagcatataaaaggcctccaggccagttggggttccactgctaagaggagagatagatacaagcctccatggctaacctagacattatgtccaattgacaaccactccttgaaaaagaaaaattacttttatctaacaaagtgtcactgggtatacaaaccattcttttggccaggctctgtagccagcagtagatggctaacacaaaatgaacttagaatatgttctgttatgcttccagtatgtttgcctggagacaaattagcagggcagtttcttgattaatataattgatctaagaggatccagcccttttcgggtagagccaatcctggggaggttatcctgggtgctataagaaaggaggttgagtacatgaggaggagcaaaccagaaagcagtgtccccctgtggtttctgctttagttcctgcctccatgttcctactctgacttcccttagtgattgtgatcagagagttgtaaagtgtaataaatcctttttccaaagttcaaaaaaaaaaaagaatatgttttgttattgttgctatcctacaggtctcttgcttatggttccaaattttatgtttttaatgggatttctgtgtttgccaatgtgagtgtctctgtgtccatatgtgtatcttaaactttgatttctaatcactttttgttttgttttgtcctattctgttttgtctatttttattttctcttttttttattttcttcttttgttttttagatgccaaggaagtatgtgaatttgggtgggcagggagctggggacaatcttgtaggactttggggaggaggaactacaataagaatatattatatgaaaacaatatatattttttaaaaattagtattttgtttgtaatatgttgtggttctagaatatcaatttcgttatatccattataccacttcatatctccaaacacatactgaaaagtaatattgagatgcctatatgaacacaattatttatataaaatataataataaggaaaagataattttcattacaacatccatggttccacagtatttcattgtttctcataacatacacaaagaaaggcagacagaaaggtagcaagacagacagacagacagacagagagaaatatgtttaggaatacaataaataagctcatgacaaaaatttgacaacagcatagagatcttaatagatgatgaaacaatcatacagccagtttatatacctacaagtgtgtcactagaaaggatatttgtcgtcaaagatgtgtcattagattctggactccagacctcatttcttagtcatttaaagtcacaggggtttcatgcactctccagtctttcaggtatgaaagcatggatgaaagagaataataaaagacttttttgcctattgaatagatgaaagagaataataaaattgtgttggcctgtagaattgttgagtgattgtgagttttatagagaagacagtttaaagtgcctgttaaattgaaaagattctctatgaaatattaaaaaaaaaaaaacctgtaagtgaaacaacaaagaacaagaaacactggagattctctggaataatgcagctcctaaatggtaaagctgggatttcaggctgcgcacatattcctaactatctttctgattaatatgcattaatatggatgaccccaatgaaagaaaaaatataagatacccaactaaaatttaatttcagacacaccttttttttagtttcttttattgataatttcttttattgacatatcctctcctccttcctcctcaattcattccatgtccccatactccgctcttaaaccccaaattcccatcctcttcctctaagttgcatgcgagcacacatatacatgcatacacattatgtattatatattaattatattttatatgctatagtatatagtatgtattaattatatcctgtactaggtccaattagtaccgtccatatgtatttaagtataggtatcacaatgaggggtcatgtctctgaagaaaactgagtcttcctccctcagcagccatggactgcctatagcttcaactcaggatggaacattgtccttccccagttcatactagaatgtatattggtatattcttatgcaggtaactatatcattgggagttcatacatgccacctccttgttgtatccaaaagacattatttcacatcagcctccctagttttctaatcattctttccctgctttcaacacattccctgatgcttgggggaaaagattaacacatcttaatgtaagaatatcttatcaaatgactttgtgtgtttaaaattgaaattcaactggaattctgtaattttagttactaaatccagggctattaccaataactatctcttgtcataaaatacaaagaatgcagtgtgtattttggttttcttccccattttatcctcaaggaaaggaatatcaaggtagtttttttttcagtgagtaaaagtgctttcattgcatataagagtacctgattttcaacctcagatcctatgtgaaatagccaagcatggtagcctgtacttgtactggggagacagagccaggtgggttcttgggctcactggtcagtcaacctagcttgcttggtaaagtccctaccaatgagatcctgtctcaaaaaacaaggtgaatgatccctgaggaataaatgactcttaaggttgaccactagccactacatgcacatatttgcaagtatatgtacaaacctgcctccaataccctgtggattaaagaatgtttaaggtaggttcttgctgctttttttgtttcttataagagtgtcttttatttgtttctaagaaataaaactatattataacttgaataattatgtagtaataaaaacaatgagtgtttgcataatgcacagtaagtttctatagtcataatacatgtgcctaaatttcattgtataaaagaaattctagaaagaaattaaagaagatctcagaagatggaaagatctcacatgctcatagattggcaggatcaatatagtaaaaatggctatcttgccaaaagcaatctacagattcaatgcaatccccatcaaaattccaactcagttcttcaacgaattagaaagggcaatctgcagattcatctggaataacaaaaaaacctaggatagcaaaaactcttctcaagataaaagaacctctggtggaatcaccatgcctgacctaaagctgtactacagagcaattgtgattacaaactgcatgctactggtatagtgacagacaagtagaccaatggaatagaattgaagacccagaaatgaacccacatacctatggtcacttgatctttgacaagggagcaaaaaacatccagtggaaaaaagacagcatattcaacaaatggtgcaggcacaactggcggttatcatgtagaagaatgtgaattgatccattcctatctccttgtactaaggtcaaatctaagtggattaaggaactccacgtaaaaccagagacagtgaaagttatagaggagaaagtagggaaaagcctcgaagatatgggtacaggggaaaaattcctgaatagaacagcaatggcttgtgctgtaagattgagaattgacaaatgggacctcataaaattgcaaagcttctgcaaggcaaaagacaccgtcaataagacaaaaagggcaccaacagattgggaaaggatctttacctatctgaaatcaggggactaatacccaatatatataaagaactcaagaaggtggactccagaaaatcaaataaccccattaaaaaatggagctcagagctaaacaaagaattctcacctgaggaataccaaatggctgagaagcacctgaaaaactgttcaacatccttaatcatcagggaaatgcaaatcaaaacaagcctgagattctacctcacaccagtcagaatggctaagatcaaaaattcaggtgacagtagatgctggcaaggatgtggagaaagaagaacactcctccattgttggtgggattgcaagcttgtacaatcactctggaaatcagtctggcggtgtcttagttagggttttactgctgtgaacagacaccatgaccaaggcaagtcttataaaaaaaaacaacatttaattggggctggcttacaggttcagaggttcagtccattatcattaaggtgggagcatggcagtatccaggcaggcatggcacaggaggagctgagagttctatgtcttcatccaaaggctgctagtggaagactgacttccaggcaactagggtgaggattttatacccacacccacagtgacacacccattccaaccaggttacacctattccaacaaggccaaaccttcagatggtgccactccctggtccaaggatatacaaaccatcacaggcggttcctcagaaaattggacatggtactaccagaggatcctgaaatacctctcctgggaatatatccagaagatgttccaaccgggaagaaggacacatgctccactatgttcatagcagccttatttataatagccagaagctggaaagaacccagatgcccctcaacagaggaatggatacagaacatgtggtacatttacacaatggagtactactcagctattaaaaagaatgaatttatgaaattcctaggcaaatggatggacctggagggcatcattctgagtgaggtaacacaatcacaaaagaactcacacaatatatactcactgataagtggatattagcccagaaacttagaatacccaagatataagatacaatttgctaaacgcatgaaactcaagaacgaaaaccaaagtgtggacactttgccccttcttagaattgggaacaaaacacccatggaaggagttacagagacaaagtttggagctgagaccatctagagactaccatatccagggatccatcccataatcagcttccaaacgctgacactattgcatacactagcacgattttgctgaaagaacccagatatagctgtctcttgtgagactatgctggggtctagcaaacatagaagtggatgctcacagtcagctattggatggatcacagggaccccaatggaggagctagagaaagtacccaaggagctaaagggatctgcaatcctataggtggaacaacgatatgaactaaccagtacccctctggagctcctgtctctagctgaatatgaatcagatgtcctagtcggccatcagtggaaagagaggcccattggtcgtgcaaactctatatgactcaatacaggggaccaccagggccaagaagtgggagtgggtgggtgggtgagtgggtgggggagcatgtgggggacttttgagatagcattggaaatgtaaatgaaataaataccaaaaaaattctagcatatcattgatattaagtacttgcccatggaaagataatctatagtacatatagatttcattattgttgagggactggcatagctcctaaaattataagctcatatttaactttcatatgctcttgtatcaaagcacagtgatatgccttatccattttttgtgacaaaatattgaattgaaaaaaaatttttaaaattgtagacattcaaggtacaaatatgcatcaattaaaaattactacagattaacacacccatcaccacccacactacccgtaagatccccagaacatcttcatagcataatttgatgtttttcaccctttggccaatatttttttttctgttatctcagcccttatcccttgataaccacactactaactgtttctatgagaagaactttgttataaaagtgagatcgtataatatttaactttttgtctgtggcttatttcacttagcttatcgttccgattgtttgttatggatcttggtatgaaagtgatttttttgttgttgttgtttctattttgagacagaacctcactaaaagtatctcaatatgacctcaaatgtgtgccactcctaccaagtataccaagttcagagacaatagttatgtactaccattcttgtcttccagggtgattcttgagtcaagcctagacatttggaacatcatgttaagagagtctttaacctatttagtttcagtaggcagtcactctatttgggcctacctggaagttctcaggcaatgtttgtgacctcaatcctcaatgtcagattaagtgctgagaactctggccagagttagcctgctcactgtgttctgtctcagctagattcccactggtctttagaaggtgcctcccatctgtccaatgccattggatcagagtacatctccccactatgtctttgttgtgtttcctgtctgtgcagtgccttttggccaaaacgatggagcttcctttgcttattcatttgtcttctatacccattggtacttcctggctataggaatttctacaacctaggcaggaatgaatacacatcagataaaaagaaattctgaggaactcacagtggtgttgtcttgatttccctgaaatgacaacttcatccttccatttttggagtcctttgatgattgattcttgaaatgttcctgtgatatttagaaggagggggaggagaagaaagaaaaaagtgaacttacaccattttgtcatatacttggaagtcagtttatcttttctaaagtcattgtaatcataccattttcattaatatttatctaacaataaatacatcagtatgcttagcccagacaagtcttcagcagttagtgacccaatacaaagctttctcttctttattgttccttgattaccaaatatccctaaatatgacatcattatataaacaaatggtccattatcaacaaagatatgggaagagagaaaatctcattctcattattaaacaaaacacatattaaaactatcacaaatgcccaaattctaatgttgtaagcttctaccttattagtttctttagctttgccatcacatggcatcacatggcatcacatgtgcatcacatgtgaatcactgagttgtgatggaaattcacatgcaatagaaagaacgtgttaatcagagccttcttacatggttgcgaatgggttagggcggggtctgaaatagatggactaattttgagattcttttcaacaccaaaatcagtgccttcagattctaccatgatcctaaacagacagcgactgagttcaggtttggagtgactgaaaggatggttaaccagcctttctttccccctagtcccattgtttataaatccttttatttcattccaagaaatgttttgagtaatgataacatgacctgttctaatattctgaggatgactttgtacttcttaatttcagtggaaagctaatgtaaaactggtttttttaatgctctctggttgctatgacaactaggttatgctctaatgtcaagaggtaaaatcagtttgcaagaatattaagtatctaaagcaactattttggtatctatgatcactatgagagacagacagacagtcataaagagaaagacaaacacacaaacacaaagaaagacagagagagggggaaaagaaagacagagagagggagagagggggagagagagagagggagggagagggaagaggggggaagagagaaagaaggaggggagagagagagagagagagagagagagagagagagagagagagagagagagaatctgtatccacatttactttttttttccttgtttgagtcagtgaaatattgtgttggcaaatctggttttgatgtcttccctcatgtcccaagccctgttctagccgagtaacttgagaaacactggccattcatgagaagagatggatgtaagcagccaagttgtcagttacttagccacttcccctgcttttatgtcctaaaataatcccacacctgtgcagggcgtgcctaattagccttagactctcaacactagactctgctgctggacaaggaagacagttttggaaagtgtaaaaggtgttaggtgaaacgtctaattttaaaaatgcttggaataaattttactgttggcattatgtttttaaaatacccccaacaaaacgggtactactgagggaaataaaatgataatgtaggcctatattctccctaaactgtcttataaatccaatgccaaaatcattatcaaaagtttcataaacaaagactcaaggaagtgaccaaaaaaaaaaaaaaaacctgtttttatatttgaacagagagcaacaattctggaaagataagtagaacatgggctggatgaaggaagataaggctcatttcaatagggtctgtttgtacagaattctctcagctgtgactccccaatgaagaatgttcgttttgatggtggaaagagtctatctctcacatgaaaggttaaattttctgattgcagaaagaaactgccagcttcaaatgctcctgtagctgcatatttctcaagtgcctttcacttatcctgaagtgggcacagtcttgcggtgtcatggtttacatatttctcagtcacgtgatatcataaggaactgtgtgttagttacaataaagaaatttacttgttgacctgaagcaaaaacttcactcagcaattcttaacttttcaaagattacatagtaaaaataacgatttaaaagatgtgaattattaaaaaaatggcaaaaataaacttgtctgtggacatgactgttaatatgggccccattctgctttaatgtcattctcgcctgtgttccattagtctttctttctttctatctctttgccttctcccttaagatcactacctcctcaggatcttcttccacttttgcagcccacaatacacatacaaacaaattaagaaagagggggagagaggagaatcttttttaagatttacaaaaaaaaaaaaaaaatggaattatacctgaatctgttgcctgcttgccttcttgcctgcctgcctgctgcccgcccgcctgcccgcctgcccgcctgcccgcctgcctgcctgcggatcccattcctctgactgggccaccttgtcggggttcagttggagaagatgcacctagccttgcagagacttgatgtgatgggggggtgggggagctgtgaggaggaaggaatgggggaggatttgcaagagaggttactgggaggagaggggcatctgataattggtatgtaacgtgaacaaataatgaatgaattttaaagaatggaacagtcctgtcattccatgggtatatttcccttctcatccagctgtgtacaaaaataccttgagttatatgttctttatttatacctctgcatattcatgtagataataacttagtaaaatatgacatataataggatagcaggcattcatatgtctacacttcaaaatatgcctaacaaaattaatttgcaatttatgcaatgaatgaagtaaaggccaaatgtacaaacaagaaaatgaaagaataaaagatagtaaataatctcatgtcaggaataaaatgacattaaaagaagaatctcattaagctcaaaaactctgtatctgcgaccaagtgtcttatccagtgctgtgaaaatgtcatgatcacagaaactcatataaaggaaagcatttaattgggcttgcttatactttcagaggtttagtccattatcatcaggtatcagggagcaaggtggcacacaggaagacactgtggaaaagtactagcttgaaagtcttacatccagatctgcaggcatcaggaaataaagacagacacaggacatggccttgggcttttgaaatctcaaagcccacctctagtgacgtgcttcctccaacaaggccacacccactccaaaaggccaaatctcctaagacaattcaagaatgccactctctgatgactaaatattcaaaaataagagcctagggggagggcattttcatgcaaaatacagcaataatatagatttttctatgtacacaataagggtacatagagaatgttcagtggttgtaggtctatgattgatttgaaagttctagctttaatttttatcatgttttatttttcagaagaaaataggaatttaaaaagattaagtaataatttacaaataaaacaatgagatattagaagacaaagtttcaaaagtatgaatggataatgaatttttaagaaatgtgagtacctgatttagttacgtaaacaaaatagtgattggagttctcaattctgacatataataaacttgaagcctggcaagttctttcccaaaagggattctcaaagctctaggcaaacattactgcacaggtttcagatgtttcagatgtttcagcattgcactatggaaaatacagaatggtatccaacttgtgatcattggttatcaccagtgaagctattgttttctatgttcactggccattgatttgttatttccctatttggaagtaaggaggcacaaacagtccaaattgtgttccccaagcagactttgacggatgttacatatgcatgtaattatctgcaggcaaattaaatgctcacaattacaggctctgatgttcctgcacaccagatgtggctcctctgagcaggaattgccttcagtttttgatccagatacttatttctacatctcaggtgaaccaaggtgtcctttttgtcgccaaaccaaagctagcatggaggcaatgttaatatcctgtgtgtcttagagaagtggactgagagacagagcagctgaggaaaagacttacctccattctcccctgcagtagcagagccatgcttcatccccaactgccattctaaattgttctctggaggaaaaggttacccagggagttgcacaactattaagcactcaggagaagctgatagccagaatggggttggggtacccacttcgttttctctttacaaaggctggcaagtgctccacacaagtatatacacatgatgggaaagtactgtagactgtttacacacaaggtgctgtccagggttggcttttctgtgtaacccgcgaagagcatggtggagcctcctgtgtagtagatacttttctcagtgatgtgagcatatacttgacaaactgaaagcattggcaactgagatatctctccagcagttagtaaaaaggagagaccaggatttgaggagaatggggagggaaacactggaggttgtgaggaggaaagggcagggacaattatagtcattaaattataatctcaagaataaaagattagcctaagggaggaaagagattcatcctccctgagagtacagcagaattctacacattatggcaatgaggtcacagcagaaggggcagcgaggtccatgttgcagcatggaaacaaagaaatgtgcacagctgccttttctctcctcctcctcctcccccattcctccttgtcctcattcttctccttaaacttacacccttttttctccatctgtattttttggtacattttggcgttactagacagggtcttaatctgtagccccggctggcctagaactcactatgaacctttggctagccttgaactcacagcaatcctcccctcgacttgatggctgatagagttacaagtgtgagccaccaagcattcacacagggcatgtttgctcctctcttgtttttaatgggaaggggtaataaagtatcttgtgtcagccaggtaggcaacaaagtgtctatgtagcaaaggctggcctagaactctccattcttctgctttctttcccccaatctttaggattaccacatgcttcaagaggtcaacctaattccccctaatcattcagacttgggctacacccaacatttggtgcctttcacactcaagagttgctctcctgtcccccagcccccagttaaacatctctcaaaatattctccagattgactcactaatgccagagacaacttataattcaaactgacaaagttatccatcatagtcaagaaaggaatatcaggacaattgtctctgcattttaaatctgggagaagtggttcttaactatacactggatatatttgtggacacagatgcatgtctacgtgagtactattattgtaagggtaaaattaatacacctcgggaaggagttttctgtcttgtgactcaggctatgacaatttgtccatccactgctgcaccgatttatgcacagcccaacagtaagcagagtaaacttgatctgttgtgtttgataggtcactgacatgcttcccctgacaagttagtcaggggggagtttaggttctggttggccagtggtgacaaacaacagaagtctcttgtcccagtaatcactgaggcacattcctcaatgtcatacattatattttatatttctttggcatcattgagtctagatgtaggctatgtcaactaatcagcacaaagatggagcatacaaatggtgatataggtttactaccaatcagagagtatgttggaagcaaatccttcccaagaatgagtttgaagggcaataggagcctatgggcaatcctaaacttctgttttatatactgtctgaaaaatcatatctcataaaaggccacaacagaaatattaccactttattcctctgtgtggtgcctcatatcctgacttggcactgctcctatgactgacagctcagtaatgattctgaccctgagaaggaatagcatagatcccccaacttatactcaagctgccctaatggaggaaacacacagccagttggtgtttatgtcagctctttatgaggctgtgctctgagaactggatcagatgtatttagaggagcaaagttttaaacaacgaatcaattacagacctacacggagtcagtgatgttattgtgtctgtgtgaggctctgtttggcaattgacttattagttttaggatgcaggtgcttgcttcttcttgtgtgggagagagattctggcagctcctgctgaaagcagcctgaaaaggctgagtcacccatcagtgttttcctttgctcgattttctgagttaaggtgagaggaccgcaatgctcaggagcctctgagggtctgctttcataaatcagaagtctctgagcaaatatttaaagatgtgtcatgaggctgttgtggatgcagtggtgcactatttgcctagcatgtgtgtgacccttgattcattcctcattaatgaataatacaactaaactgaatcataagtcacagatattactgtaggcataataatccttatggcaagttatgaaacacattttaattagtggtagaaaccagaagctggcacactttccagttttgcagcaggtaggacttattctttgctttgaaaatgatatagtctcttccctatttgctcagctttgccataatacctgatgcaacagccaaagccgttaagaaaaaagattaaaaaaaattattgtcactgggctccaatacacttggctaggaaaaaacacgcggaagccagacaacactctgtttatcatttattgagcattattgtaaaatattatgtgcccaaatatttggaaaattcttgtgttaacagtctgtttcccaatacgttatgatttatcagtttgaaaacctaagttcttataaaaaagacatcatgctgtgattttttttcaggcttaattgagttctgtgtgtgactttcctaagctcgtggtatagagcacaggtttcctagcagatgttcctccaggtcagcagatattctcgttgatggtgttaagaactcattgttcccttgtctatgtaaaaagtatgcttaatgagaaccagatggttctctgaagaaaaaggtcatctgatggatcaactcagcattgctcagatgtattgctgctatggctgccccccacatcaccctctctacttgacccctggctctttcagtttgctcaatgataatgtcactgggcaattgagccctaacagagaaagagactacagttccgtatctgcttttccttactggcaccaccccacctctgacaaaagtatttttcatggtggtgcccataagaacaggaaagatgggaggatgctgagacagaacttagcctctcagataatcccgtatgagatcccaaggctcactaacagccaatcatgcttcgtcagggagaaggtggtgagagcatctatcctcatccctttatatgttgcttcaggtctagcagaccccttgtctgttgtttgtttctaggactttggatctcttctttctctggagagtcactgtaaaccccaggccttccctctacctttctcattcaaatgcaatccattccttcatggacctcttctctaagtaaatggattatgtcacttcactgaagtttggaaattttccccaagagtttttatccatttccttcaactgcatctaagttgtccaagacttggtgtttcattgaacagacacctaacgtcaacctccccagcacatgtgtgtttctgactccatcagcctttgctgtttactacgatgacttctgtggtctgtgacaggcagctcccatagttctgaggaatattactgtaccaccctgtcctctgatatctccttcttctattctctccctttccatttcttgggatccaatttcacatctttacctttctgttgtgccagcaggtctttggggcctgtctccgagaactttctcttagagaagcactgccgttgcctttctttcctgtctctgagccacacaacaatagagttcatttcagccaatggagccatgtggttactgtaggtatgctttgattttctaaaaaaaaaaatctttgtttgtaaaatctatgatgtgccaggttggggtgatcccaggggcatctcccccttctcagaggacaagggtagggggaaggggttgtgtgagggggagacttggacaggagagctatgataggtatgtaaagtgaataaataagttttctaaacaaaatacatgggattttataacatctctgcatgtgttttagaaacttgtgcttaattggtctactatcaccgaagctctgcttgtatattttcctggtgttataacccagcttaccttggcttatgtccatgtgtttttacattgggaactcgggcagccactgtagaaaccagtttggaggattcaaataaaagggagggggataggcatcctactccacagatgtttccttggctacatttgttgccactcataacctatagaaaatgcaaacatcctaatcctcttttaactgaataagggataatgaaaatattgcacatatgcaaaaaggaattctatttgactgtaaataaaaaaatgaaagcattcaattttcacataaatgggtggaactagaatacattcatactaagtgaattaaaacagacacagaaagaaaaatgtcaccttttctcccttatttgtagagtcatgaaagtagaaagggaccatggaaggaggtgtgtttaaggagctcttcagaaagagatagtgcaacacaggctttataaaagaagacatggggaaagtggagaggacataaactagagagacgggaggaaggcaatatgaagggaaatggagaaaagaaaaatatacgacactaaggatgttttttaaaaaatatagaaaacatattattttgtaatacatagatgtagtttaattagagatatgcccccacaggatgataatgccctccaaagactcatagattatctaaaagaacatccccggggctagacataagaaacatactttccttctagttcttgctcagcagagtccaagaaactcccaacatgatataagctgctggtgcctcccagaacctgaaaatcagaacctattgctgaggacacccggtacttcagacacagcaagagtcaagctggaattgactagaaggctcctttctacagaccagctctcccagtatccaaagatactatgtaagttgcaaacggaaaagcaagcaacttaatattcccacacagctgtaacacctataaactacaagaaggatgatgagcccagcaagatatcctgaatggtgccatcatgatatattgactttgtgtgtaagcaaaagctgctaaattgaatttaaggcctatttgataggagaaaaattcatgcttgggattgtaaatcttgccagctacccaagagcagtaaggtcatagatcttgaaggagaactactgttagcattttcctaagccaatataatttctagctgtattctaaatactcacctttatacaacaaataaatggaattctcgctcctcaccaaacaagcatctttttgtgtcgggaaaagagaccattgcagagaccttgtctagaacttgttcaaatggaaccaactgaccaaactggaacttgtcaaaaatgcaagaataagtgattgtggggtgctcagcaccccataacacaactctgacatctaaagctccaggaaaatggcaggcctcatctgtcctaggtaagctctctgccacagagttacatatctagtcccattttataattttattatttatttgatcattttattaatttttttttaaaaatgatatagagtctcaaggatggaccatctagagactgccatatccagggatccatcccataatcagcctccaaatgctgacaccattgcatacactagcaagattttgctgaaaggaccctgatatagctgtctcttgtgagactaggccggtgcctagcaaacacagaagtggatgctcacagtcagctattggatggatcacagggcccccaatggaggagctagagaaagtacccaaggagctgaagggatctgcaatcctatagatggaacaacaatatgaactaaccagtaccccggagctcttgactctagctgcatatgtatcagaagatggcctagtcggccatcactggaaagagaggcccattggacttgcaaactttatatgccccagtacaggggaaccccagggccaagaagtgggagtgggtgggtaggggagtgggggggggagggtatgggggacttttgggatagcatttgaaatgtaaatgaggaaaatacctaataaaaaatatatttaaaaaattgagatagagtctcaccaagttgtcgaaactggccccaactttgctatcctccatcagcctctggtacagcttgcatttcatatgagcaccatcattcctggttaaacatgagatccaacactggtgactatattctatgactattgcttatttacaattcttttaaagtttctatttccagtataaatggtgttttcatctttagtaatttacttatttaatgattaagtaaaaatgtaaaactatgtttaatatttttattaaaaaataacttcattaatcattgtaagctcagaaatcaaagagattccctataaataattgagtctacatgtctccagatttcaattctaagtgtttacacaaaaatatcagaggcaccaaaaattgtacatgatatttaatatttgctaatattaacatttaatttcattttccccagtaagtttaatatatatgcatattatggttatagcctgatttttaaaagcaacgtgtgtttgaaacacaaagaaagtatgctaaacaatataattttgctattcactcacaatagtaaatataattttacagatagttttgcttttatattctgtactagtaggaatacctctttgcctcctctaaataagcagagaaatagatattgatgatagaaagtgacctaaagatatacagatacttatcatatttccacaatattatcaatactatgttaatcaacactgtattaaatattactatattaatcaatactatattagctaatatcaatagtatattaacaacaccatgtgtcctaattttgttttgcattgctgcaataaaattccctgggacaaaagcaatgtagtatatagtccattacgtcagcaaagtcgcagcaacaaaagattgagggaaatggtcacatgaaattatatcctcagtatagagaaaagagcaactgatgcatgtgtgctcactttcttccttctgtacagtccaggacccaaacccaaggaatgatataggattttaggcttcttaggttttaggctgaaacttctcatatcaattgaagtatttaagacggtcccttgaagacatacccacaggccaacctgttcacagagactttcttccaaggcacttctacattctgtcaggttcataaaactatcattttccagcctccacagtccctttgactttattgctttcaatacctatgcagggttttatacttacacttgaaattttggaattaggagccacagatgagagcaaatgtgatccttgtctttctgaatctggattatctcactcaatgtgatctcttctaattccacccatttatctaaaaattcaaaacattattcttaaataaaggaagcgtaagaataaaaaaaaactaacaataaccataagacattcaattgctccaaagatcatgttcataaaaacactttgaatatgcgtctagaatcaactcaaacagtatctataaaatggaattattgtccaccctgaaatccagagcatcataatcaatagtagaccataaagcaatagattcaaatcatgtgtagtagttcacgtctataagcctggcacttgggaacctgacaaggagcacttactatcttgagttcaaggccaacctgcataacatagtgaattctaggccagcctaggacacactgagacattatctcaaaacaccaaaagtatttattaatacctctttcaaattaagtacttttcaggttaaagttcttgcttaacttctggtatatgacatttactcactaattgaagaatgaaaaagtcaggtaattatgtagaaagtattttgtttttccaggtatcagccacagtttctggagaaatggttttagctcaaagttgtgagcccctttcccaagtgatgacttccattactccccagttgtggaaggtaaatccccattgctcaagacaccatgaaacagcgtccacaagcgtcaaagctggaactgacctgaattccacctgcctgagaactagacttcatgataccagaaggttccatgcaagtttccaaaggaaggaagaactcatcagtccttcccagctatgacgcctatgaactaaatcaacgaccagcatggcacaaaggatacagtcctggcagtagccaacagctccctaatttgacttaagacccacttaataagagagccatcatgcctgggactggaaacctagctaactactcgaggctagtgaaaccatggttattggaggagaatctaccacttctaatttactaaacctgcaacaacctataaacatgtgtccttatgcccacaaccaatcaaaatgcacaaatgtgcagcacagtccctataggaagaaaagaagggaagactgtaagagctacgtggtcacagagtttgctatgagactgtgtctcctagtaatgtcagaaactatacccataaactcttatcaacgcaattgtccagaaatgaggtgaacacagacagcaccaatggacatgccaaactgaatgcggaaaaagccaccaggcctcagccttacacaaagaactataagcagtagaggaatgctgggaaaaggacttttgcttttcctcagagaagagcacaccaattggttgttcacttccaaatgatcagccctgaaacacacacacacacacacacacacacacacacacacacacacacacacacacacatataaacaatacgtgaagtgtacaagtagctatactttggaatagatatagacagacaaatgaacagacagacagatgacagagagacagacagatgatagacaaacagaaatacatccactaacagtttttttaaaagccatgaattttaaggacaataaaaagaagtatatgggagggtttggagagaggaaagatgagggagaagtattataattatataagctcaaaagtaaaaaaacttttaaaatatcatattttttatataaaccttgtcacaacatcctcctgaaaaaaaaatttcatttttccacctttaaccccaatacactttctctacaattactagctttttattacagcttcttttaagctcttggctttatgacttcaaaatctctaaaaggtatttttaaaatgagtcagaagtatcctttattaaaataaaattggtttacaaaattgcttttataaagaaaatacatctttaattattcttgcacaattgcatctccagattcattttagcataaatcttcatgatcttaagactgactagtttagccatgaatttgtcaaaaaattgggtagtaatatgcattacacatataatacacacacacacacacacacacacacacacacacacacacacacacatatatatagttttatttatgtccctgataaaagatatatcttcagagaagtctttcctactattgaagcaatgcttctgtacagagtatttaagtgacaattcatagaactggcatcagctttataactgagaattactttaaaaatttgtttcattcctgagaatctctgaagtctcttacttctgccagatctctggtgcattttggagggtccctcccaacctcctatttcctgaaattgcctgtttccatttttttttctgctggccctcagggcttcagttcttttccctcacccaataccagatcaggttcccctctcacccctactccccccccccccacacacagagtccactttccctcccaggttcttccctccctccccacttgtgattgttttcttctctctcccaagtaggactgaggcatcctcccttgggcacttcagcttgttgacctttttgagttctgtggactacatcttgggtattccgtacaggttttgttttgttttgttttgttttgttttgttttttgttttggctaatatccacttattagtgagtacataccatgcatgtccttttgggtctgagttacctcactcaggatgatattttctagttccatccatttcctgcaaaactccggatgtcctcatacataatagctgagtagtattccattgtgtaaatgaaccacattttctgtatccattcttctgtcgtgggacatctgggttgtttccagcttctggctatcacagataaggctgctatgaacatagtggagcacatgctcctgtggcatggtggggcatcttttgggtatatgcccaagagtagtatagctgggtattcaagtagatctatttccaattgtctgaggaaccaccagattgatttccagagtggtagtaccagtttgcaatcccaccagcaatagaggcatgttcctctttttccaaatcctcactaacatgtgctgtcacctgagtgaacaaaaaatgccctaccatataccaccggggcacgtgttccactatgttcatcgcagccttatctgtgatagccagaagctggaaacaacccagatgtcccacaaaggaagaatgaatacacaatggatacactactcggctattaagaaagaggatatcataagttttgcatgcaaatggatagaaccagaaaatatcatcctgtttgaggtaactcaggcctaaaacatacatggtatatactaactaataagtggatattagtcaaaaaagaacagaatacccaggatactatctacagaactcaggaaggttaacaatcagaagggtccgagtgaagatgcctcaatccctcttgggaagtagaagaaagcaatcatggggtcagagggagggaggaacctgggtaggagaggggacagggagtataaagggggaatgtaatcaggtaatgggaaggggaaacaggactgaagccctgtgggccagcagaaagaatgaaaacaggcaaccttgggaggtagtaggtggggggaccctctagagtgtaccagagacctgggaggttagagactctcaggactcaaagggagggaccttagatggaaggccctacagtggggagagggaacttgtagagtccacctccagtaagaagacagggcatcagttggagagatggggtttgtcatggtttgactatgcttggcccagggagtggcagtatttggaggtgttgccttgttggacaaggcgtgtcactgtgggcatgggctttaagaccttcatcctagctgtctggaagtcaatattgtgctagcagccttcagatgaagacatagaactctcagctcctcctgcaccatgcctgcctggatgctgccatgttcccaccttgatgataatggactgaaactctgaacctgtaagccagccccaattaaatgctgtccttataagagttgctttggtcatgacatctgttcacagcagtaaaactctaattaagatagggttgccaccccacagtcaaaactctgacccaaaattgttccagtctaaaagaactgcaggaacaaaaatggagaagagactgagagaaaggaggtccagtgacaagttcaaagtgggatcctgctggaggggagaccccaaggcctgacactattactgatgccatggtgtgtttacagacaggagcttagcatggctgcccgttgagaagcccaaaaagcagctgaaagagtcagatgcagatacttacacacaaccaatgaacagaagctgctgacccctgtgattgaattagggaaaagctcgaagaagctgaggaggagggcaatcccataggaagaccagcagtctcaattaacctggacccctaagatctctcagatgctgagccaccaaccaggcagcatagattagctgatatgagacccctgacacatatactgcagaggatttccgggtctggactcagtcagagaagatgcatctaacccttgagagacctgagggctcagggagttagaagatcaagtggggtggggctagggggtggagacattctcttggagatgggggaggagttatgggatgagaaacagagggaagaccaggaggggaataaggactgtgctgtaaaaagaaaagattagagaataaaaataaaagtttgtttctcactttcccaaattatatcatataaccataaaagtacattttcaaatgaccaaattctcagtactcagttgctaaattgtacaatttttctaaactggttgagtcctaaaacctgttctttgagtggacaattgcaaagactgtctctgacttagaaaaggaaaggcagagtacttcggaccactatttcacaatttacctttaggccgtttgtttttttgaattatactggataatctccatttcacaggccaatactctatcacacttggacttatttatccagtcttaaaggccaacattctttcaaaggtattcttaccttctgatcctaagtactttgtgagagtggcagtatccaatatcacttgtaactgtaataattacacaggcaggggcttagcagttaagagctgctcttctcgaggacccaaatttcattcttagcaacaccaacagaagcttacaactgcctgtaactccagctcaaggggagctagcctcttcttctggattttgagtcatctgcacaaacatagacacctgcacataaataaaaataaaattaaatcttgttttaaaagcacacacagtactttggattaaaaggtaatagtgactgatatttccagtagtgagatctctacagttactaacattcaggtgactaacgttaagacagaaacggcatgtttcttgttacttgggttacttgtgctgttgtgataaactctaatttaataaatcgttgtattgtaatttatcataagaacaatggattagatacaacaacctgttatgcacaagacggactgaactgtctctattctaaaccaacatgaagttatttatccatttcaaagactaatgtggttcttagtatactgaaagagaaaaatgacgctttaaaaactcaaaaactcaagttaggctacaatgtaatacacacaatgcagattatatactggtcagctctgaaatcatacacattcaagcaacatcatatggactgaccacatatttatataggatatatatatatatatctcctatatgcatgtgtgtacttataaaaacaattaaaaagaaagagatgaaatcaaggggatacatgtgagggattgaaggaagggaaagaagaaaattctgatataatatgctaggcatggggtacatgcctttaatcccagcactagtgagacagagtcaggcagatctctgtgaattccaggtttgcttgatctgcatagggagatcctgttgtataataaaagacacatatgaaaaacaatggtatatatggttaattcaacataaaaatgtcagtgtcctgaagagtacagaaatatgatcgcatagatgcatagtaagcatgaagagagcaaatatggaagtggatggtgaaacaggcatgatttaaccctcaatattatgaagggaaatgcatttgcatatgtgtatgcatttattataagatactttcaggaaatataaaacgccagatgtaaatttataaaggtagagttatggaaaaaagatatcacacaaaagggcatatttgaaaagttgttatattaataattcacattgatcacagattgtgcacctaattacacaagtaatatgcaaattagtgccaggagagagcctagagaagcagaactttaaaggaaggcagtaatgcacaatagaacgtggactattccagatgtgctaaccaaatttgtaaccaattgtaactttcactcacataaaagacgaaatacatgcctcctacatatacatacctgtaaacacaagagaaaaactcctacaaatcaaagtctgatgaaaaacctggacaaattcaaaatcagacatgattacacatcttccttttttggaaaaagtcattaaaagctaaatattattattttgagtcttttgaaacctcaaagcctgttcccagtggcacacttcctccaacatggccacacctcctaatccttttatgtatgtgccatatgcatataatttcatatatatatatatatatatatatatacacatatatatacacacacacatacacacacacatatatatatatacatatatacctatatatgcattatatataatcttaggtacatctaatataaaagtggtaccctatgtcattttcaaccatctttagctgttactaatccctcctctctcactctttttctgttttgccagccttcttccttccccagttagagctctactccctcctcactccctagttaaagctctcctctatactccatccccacttaaagcccccatatactacatcttgtcctactctacatgttcattgacctactcagctacgttcattggtactctagtcaaaatagctagaaaagaataacaatttaaatgcccttcaattggtgggagaataatgaaactgcggaattctactcaactgtaaagaacactgaaataatgaagttttcaggtaaatagatggaaatcaaacatatatataacactaagagaggtagctcagactgagaaagaacaatgccacatattctctctttttttggaattttagcttttatagatgttagtatgtaagcgtgagcaacagcagaaaccggcaaactaaaaatggaccacagggagtagagagctctagagttggggaaacagcaggacataggaactttgagatttcttaaggaattcacaaaataatactctcatatggtaggagttatctgaggacatagaaacacaaaagatgacaggtgactcataacttcagactctctgcagtataaacttgccttccatatagacataaacacacacacacatacagagagagagagagagcactcattaggtcatatttttgttgtttatcctttctagcctataaacagctttgttaaacctttctgtcttgagtataaagttggcatatcctagttgccatagaaaccagaatttcattaaaatttctccctttggtgttacctttccaaggacagcaggaaatgcacataaatcctcatcttactggagtcctaagcacaaggtcggcccctgagttcaaacgctcgcctgcttttataaaaaaggacaatatagagaaagaaacaggaaaaacagatttttgttctagagttttgaaagaactggggacagagacattttcagtcttactataccttgcctgaagcagtgttaaatttgctataatttatagaaaaaccaaggacatgaaatacgcacctatagctttagcttaccagagagaaatggcaagtctttctccagggagaacaggtacctctctggcaccaagctggaggacctgggtatcagacaagggacctacatggtgggaagatagaaacctaccgcatcatgttgacttctggctttcacacgctcacctgtgcacacaaagaaacaaaaaatatgaagattaaatgtgtggacctcagaagaagaaaaaacaacaactacttttgccagggccagagaaagttgagcgtgcaatacaacagatgtccctctgaaggtttgtgaggacaaaatggttgctgagaacataaacaagcccgacaaagtacatggtgctcttgagtaataaagaggtgaaactgagcatatcatacttggaaatctgttcaactagttatattgaaaacatgccatcattgaatcatgtttttagaacttgtatttctaaaactacattaaaatcttcaggaaaaaaaactcagtaggtctgcagagatacagagtacacagcacagagaatttgttatacacagtcactcacgttagggacatactgtgatgcagccccttctgctacataggagctaagacgccattcctatgtgggcagtcctatacaggaataggaaaataaacggttttcgagagcagtggcacacagttctgttttggactgtttacctgcgttaacaactccctgtttgtattttagctacaaagataatgccactagaccctgacatggaaagttaaacagaaaatcaactctcatatgattttctctgaaccaactctaacacagtattcttcccaccaacgggcatgtgaattacgaagcacagcaagcttcacatggatgccaccgaaggtcatattggaatagatatatagctatatgaaatcaataggaatgggtggttcttagagcaaatcacatgaatcaacatgagtttttccagtttaaggaaggtatagttatcctctccatattcaagagatcaagagcttctggacaaaaatatgcaggtctgagtctgtcaagtgctgctcataagctctgtgattttaaatggctgagaaaatgtcataatccaataagctaaactgagtcacaatggcatgaatgaatgaatgaatgaatattaaccataagtactttttctgaaaacataatttttttggattgaattatatagatttaagttattaagttattattctgagtgaaataacattatcttaaaatatatgcagataggagttacctaagtaaaaactgttgggattcttcacatcaaaatactttaaaacaaacaaaaaaactgatacagaattcaggaaggtagccacaaggctgtgtcaaagtgtacatgagctgatcttccaaagagcaactactgcttaacatttcttttgggaaaaatacagtaatagatcggacatttctgtacaataataatacacataatccacacagtaataaatcaaagtgagaagtacaggcagagcttccaggtgacaaaagccaccaccaaggacagttcacagtcacatccttgagacttggaggatctatactgctcacctaaacagactaatgcaggtatatgtatcaccatatctgtgtggtgattttcctagacataagagtttgaactatattctatacttgaattactttgctcatgaagcttcacatcattgaaggtcactgcatagtgctctatttcgtgtgttagaggctgtactcccttccattgtttgcatgcatatgtgtatgttcccgctatataccccatattgtattgtgagcatccttttaaaaacctgctttctgagggtttgcaggaatatataaaagggccacttatttaacttgaaagcagagataaatcatggaatattctacagacagatgttctgtaataaccaatggattacaaggctggtctgtgtctgtgtgcgcctatgttgatgtttgaacataaaatgttcccaaaactcagatatgttaaggactttgcctcacttggtggaactacttttggaaggtgttgaatattttaaagatgaggcctacctgaaggggatgggtctcttgtgggcatgcttgtagaaaaatattttgtccttcctaaaatgtcttcattcttcatgaggctatcagctgtgtgttccatgttccagtgccaggaaagtaggagggtcataggaggttggaggccgaagagattgtgaggagctacatgaagataggacacaatttatttcctagaatgggatgctaggcagacaagggcctgcaggtacccacacatatggccaacacacatggggcgcacccatgctagcacagatgcacatgcagactgacacacacacgctggcatagatgcacatgcagactggcacacaggcttacaaacagacatacagacaagctctgagggcaaaggttaaaactaaagttcagactaagcatcatatttttgaggccaagcatcatatttttgaggcttacatttatacaaaacatctcaaggttacatttatacaaaacccacgtagaggtagcattctgacagaaacagttatatggcagttatatatcactgtttaccttggggttcccagaacatctgctgccaaccactttgtaatgaccaagagccttctctccaagacgttccacttcagccattttgtctcatatcaggtctccaacctgcccaaacataaactgtttccccaaagcaccatcagccacatgctttccttcccatgggattagccttgcctcatttccatagtgatagatctgaagtaacctcatgtgaaacctctgaaaaatgagccaaaagaaatcgttctccctttcaaactgttttactcaagtgtctgccacaatgatgaaaaggtttgattgatacagctcccctcaaaagttatataaaaacataatcatcccttcattttccacagtatggaagaatgaaatcccttcaacattttaacatttgctttacagggtcagagtaaacaaaacttctatcttccagtcttctgcccatgctattttatgaagtctatgaatcatcatgtaaattcagcccataccatgtttacctaccctaaagaattctcatttgtctttatttagtgtgagtcactacaacaaggtatactcaggagctgtggaaaaggtaacttgaggaatgggtatgtttttcaataaaagagattaatccatttcaaagatgaacaaagagtaggaggttctctcaaactatcccatgaagctgccctatcacctcattaagcaattcctttctagcttcagtacaagatgatacatttttagaacactggacatgactcaaacagtttaaatcaactccaagtttcttagaggtccttgagtttacaaaactacccaacactttaaaaatgtttttaaaatatcaactacaacaatccaaaaatgaatagtaaggtcagaattcactccaagcatgtcttcggtttcaaattcacaggctagtgaggatcatcaatggaataagagtcccaagaaattccataatattactaagatattcttatgacattggagttccctattttacttttagtcatggtaaaagcatgcttatatattattaacatatgtaacacttggacaccagagattggcagcccagtttctaagagggggctgtgagcatttatgaaaacaaacttctgtgtgtaaaattccctttcacattggccaaatttcataaaaatatatttatgtaacctatggaagacttggtaaatgggtacatgggattagggagctgagggtaggtgtgggtgagttggtaagctcaggtcaagggcccctactgggattctttatgtgtagataattctctcattgtaattgatcaggtgactttactggcctgataggatggaagcttacttgtgcaaagctgccaatatcaccaatatttcttgttgtttcttcactaaacggtttctgttcttagcaatgaatacttttggtcctgtagcaaggaatgtcagcttaaatctcattgtacaaagctataaggagtgtgtgtgtgtgtgtgtgtgtgtgtgtgtgtgtgtatgacttatatttttattaatttttctgttcaaattcttattttttatttttacatacttattaagaactccatatatgactactctacttacaccatttctgctccttcctccctattgttcccttattgccccacactggctcccaaattcatggtctatccttttaaattattatcctaacatggatatataaagttaacctagtgagtctatgcagtgttttttgtatgtaaatatgtttagggctgactatttggggatggataatctttccagggaaaaagccgattcttccccctcttaacagccattgatttcttacggatcttcaactagacatgagactttgtgagagttctcctatccacatcaatgtggcaactggtattgtcactgtgcaggccgtgtttagattaccatagtggtaagatttcatgagtgcaactcatgttagaagatgttatgttgcaaatgccctggtcctctagcttttatctttttctcctacttcctcaatgtttcttgagctttagtggtggatggatcaagtggggttggtaccccatggtctctggttctctgtattttgaccagttatggattttgtaagtttctaactgctataaaacaaagtttctttgatgagggataaaagatatacttatctgtatagataagaacaggtatttagaagtcagttttcaattatgttagcttaggagagggacagtggtaggttctatgacctcacaagccaagggtagatttacagtagaagacatgaattacatgcaattaaatgttccttaaacagcttagacagctgtttgccaccctttgtggtattgaactcatgtttttgccatgctattcattgttatgggtcataggttgtacagctttgtgaaactcttgattattcttctcccatggcacattacaaagcacctttgtatagtatgagagcttgtcttcagggctggatcttccaggttaatttcattttgactcctctgagtcctttgtctgaagtatatggtatattaagtaatacatcttaccttcaggtcctgataggcagccaaggacaatgcaatagtctattttggggagcatctctttgacttccaaaatcaaaatgattgaattctgtaaatctatgaagaaaaataaaatcatgaagtttacagacagatagataggcctagaaaataccacaatgaggggtggagagatggctcagcagttaagagcactgactcttccagaggtcctaagttcaattcccagcaaccacatggtggctcccaaccatctgtaatgggatccaatgccttcttctagtgtgtctgaagacagctacagtgtactcatataaatgaaataaataaataagtaaatctttagaaaaagaagaagaaaaaaaccatactgagaggaaacccagacccagaagaacaaagcctggaggtggtttctatttgtgtattctagctctgaaactttaggtgtaattttataacccaaagtaaccacagaaaccaggaagtaaaaatgggaccgggggagagatcactaagatagatagtgggatagtaggacacagctgttacaggaaaggaaatgggaaaagtgggggaaattgtaggggtggggttgatgccaaggtcctattccccaattggttcttgatctgtcactaaagaagccaggagccaattgctgggaagaagaaatagatgggacttccaggtccctggaggcaagcagatagacacaaggaaaggagagcaaagttcaccatgcttctgatggagagaagaaaaaggtgactagccatgtggtatctcaaatggagtggccacacaggttgctcctacaggcaggcaggcaagggtgtttagcagggactagattgtaactcagaaactacagtttagggcaggtagagaggtgcagagataagaatattgataagtgcctgcttttccaggtgggagataaatagcacccagcaattgtgtcaaagggcaagttgaaattgaacaactgtgcgtgactgtgtcttttatccatggagtcaaaggaagctgggtggggacttgtagtgtggcctgtttccggagtaaggtagcaaagctacatgcaacagggaactctgaggaggcagaaaaaatagaaggggaaagagcacaaaaagtgattgaaaattccacaaggaaacattattttagttacatatatatttaatatgtataatatatttaagtacatgtatatgtatgtgtatataaatactttaaatgaaataagctgtttggagaaatagtgctcccactaaatgtcataaactaccaaaagccatagaaatctccctttgagttcatatatggttttaatagttttttttttaatttttgagattatactataactacatttctcctttccccttcctccctccttgctctctttcaaaatcatggcctcttttttttcattattactgcatgcatatatgtgttaacatatattcctaaatgtaaactgtcatgcctgtatgctactcatatgtatgttttcagagatttccatttagcactggacaaccaatggtgtgctccttcctagggaaacccacctctcctgattctagcttttctcaattgcctgtagttctttgtaaagagttgagaccttgaggacttttcccattctactctgtcatgtccattggtgtcatccttgtctaccttatatttgggcagttacgttggtgagatcttatgagtggagcttctgacagtactggaagacatactttcacagtaaactcctatatttaaactattaaagaggcatcaaatatcaacatcttggtttggtcttacaagggaagtttagagtctgtcaccacttacaatgaggtaatggactactgtttttggaaattccatttactaaatctaggaaaatacattttctattttctctgaagctgctacctattgtattaaagcagtatttctcaaccttcctaatgctgtgaccttttgatatagttcctcaggttgcagtgaccataaaattagttaattgcgacttcataactgtaattttgctactgttatgaaccataatataaatatctaatttacaggatgtctggtacgtgatccccaaagggaacactagtcacaggttgagaataatgtattaaagaataaggtagaattattaggacttacatggagagaatgtgctaggtgtaaaatatctgattcaagtcaagttcattccactttgctgaactgatatgaaacccatatatacatatatgtgtgtgtatgcatgtgtgtatgtatgtatatgtgtatgtatatgtatatatatgtgtgtgtgtgtgtgtgtgtgtgtgtgtgtgtgtgtgtgtgtatgtatatacgtgcatgtgcatgtgcgtgtgtgtgtaaagccattcttcattttcgggataaagatgactatccatgagacccctggcacataccagcagcataaatattttctcccggttttgatgatgtgagaatgacatcgcatctgcatatgcacagttcttgcctttgttccattcttcaaaaccaaactgtaactctctcatgaatatgtcaggggtgagtgagaagttctctctccttgttcctaaaaaaaaaaaaaattgcacaaattcagttactgatttctttccacatattactctattttgtcttaaatcagaatgcattcaaatgggaagccagagtttttgttaaaatgtacacctagaagaccattctctacattgtcttctcaaaataaaatgacatatgaatccacaggaaagaagaatactaactctaatttccaaaatagttaaaatgcaattcatgggttcattgtcagactcttatctaatagtgaagaacaactctctatttcagtacagagtccattgaactattcaaagtgtgtttgttttgttaagttttttttggttttgtatttgtttgttttttgttttgttttgttttttgtcaacccggacacacctgtgaagaggaaatctccatgaaagaatggtctccatgagattggcctgtgggcatgtccacagggcatttaattgactactaattgatataggagagccagccctctgtgggaagtgccaaccctggactgtaggccaggcctctataaaaagggtagttgtgcaaaagaagtgggaggaggccattaagcagcctcactgttcctttctgcttcatagtcatgccttgaatttttcccttggcttcctccagtgatgggcttatagccaaataaactcatcatccacacacaggctggttttggttaatattttatcagagccacaaaagtaaactggggaacgtgaataagtttaccaatgccttgaaacctaatttccagaaaccatatggatgtatgccaaaaatttggagtcacaatggaaacaaaatacataggtggagatacaatgatggcagataaattaaaatttaaagcataaacatataaaacctatagagatgttaacattttgtactgctctttatatagatatttttaattgcagcaaataccactgaagtcagaagaaatgcttttgatctttctttcaggtccctaattaaacagtattgtcctggttcagagagcaccttggttgagatagcaacaatagcaaaataaataaataaatacatgcatacatacatacatacatacatacatacagatgcaggaagggacctgttatctgctcctttcttccttgcaggaatccctttccctataacattgtccctgatcaaactgaggcagcagtcaggagacaaaggaaaaatggtgatgtgagaagccaagatccagcatcagaacatgtgagaaatatccaaataccttgtcgctaatacctgattgtcattagcatagtttatgtacagaccacaagggacagtgagtcttaatcctatcactaagaacagctggtggcattcatgaaaactaagacaaaagatcctttcccaagaaacctataattcttcaagcacagaaatgccatagaaaggtctgattcagtgactagaaaacaaacagaactctactttccaaagtcatactctacaatggcggagtaaataaattaaatgattgaaatattctaagaaagagggctaacagcaaaacttacaagtgttttaagcatccagtcttttataacataagtcaacaaatgaatgaactgagagtgcgttttggattgtcactttttttcttcctagtaaaagtgtattggagctcagtgatcctcaaattttatttttatacagtagtggtattatggcaaagttgagaaattgggggaaaatgtatggctttaaaaaaaaaacaataagcaagttaggaacataacgtgaataatagtgtttgaaaggaagtaccctccgtgtgtagttaatattgctctcagaagctctatgttaaaaaacaaaaattccaatgccaagtacactatatggccatatgtatttcaagaaggagttctgtgaaataatatattcaagctatgacgaaactattgtgcccatgaacacacagtaatagtggttagctgtggaaccaccatcgctccatcatagctaagggagatgctcatgatgccttaagcatccctgaagaacaacaggcagttaatggctactgaggtgaggagaatcctattccttggcgataatagtcacctttaagtttatgtttatccacctatgctcatgcaattgaaagcaaatgcagcaggccccccaaaaaagacatgcaaatagaagaggaatgctttagtaagaagggttttgtggttgtagaagcagaataagagtataatagggaacttgtaatcaaagtacattacatactacaggtgaaatgataatttctattgtttgagaaattaatactccaatacagctagctttagcaaatcttcactccattcactttcaccaaattcctccaaagcaccgccacattcgactcaaacatctatgtgctgttcttaaacctaacgaatccccacagtataatttttaaattaatttttatcatattttggtcatattctcccctaccccaactcctcccagacactgcccacatcgctatctaccaaacttcatgttctttctctgtgttgttcaaaaataaataaataaaaatactaacacccttaaaaagaattttagtacgacaaaacccatcaaaacaaatctaaaagtacataaaaaaaatcatgaagtcccttttgtgttagctaactatgccttaggcaagagtatttgatatatgcagtgacacaccattggggaaactgatttttcctatccaagaaggtaataattataaatatgtaattttaaagtagtgttttaaagtttatattttaaaaagataggaataagtcctatctggttcaccattaaaaagtgtacaatcttctccagtctaacattaatgtgatgcatgtgtttcttaacctgctataaggattattatgccgactgtaatttcagtgacatgatgccatttggtagtcttcttcattaatgaagaatgaatctagggactcacacaccctaggcaagcactctgctactggatacagcacatccttgtgatgtttttaaaaagctacaggaaaagaaaaaaacccttgtgaggataaaggatgcttacattttaatgtctagagacgtctgatttatgaaagcagaccctcagaggctcctgagcattgcggtcctctcaccttaactcagaaaatcgagcaaaggaaaacactgatgggtgactcagccttttcaggctgctttcagcaggagctgccagaatctctctcccacacaagaagaagcaagcacctgcatcctaaaactaataagtcaattgccaaacagagcctcacacagacacaataacatcactgactccgtgtaggtctgtaattgattcgttgtttaaaactttgctcctctaaatacatctgatccagttctcagagcacagcctcataaagagctgacataaacaccaactggctgtgtgtttcctccattagggcagcttgagtataagttgggggatctatgctattccttctcagggtcagaatcatcactgagctgtcagtcatatgagcagtgccaagtcaggatatgaggcaccacatagaggaataaagtagtaatatttctgttgtggccttttatgagatatgatttttcagacagtatataaaacagaagtttaggattgcccataggctccatttgcccttctgaatctgtattggctggttttgtatgtcaacttgacacaaactagagtcattagacaggaaggagccttggttgaggaaatgtctctataagatttggctgtagggcattttctccgttagtgctcaataggggatggcccagcccatggaacacaagcttagtaagcagcacctctccatagtttctgcatcagctcctccccccaagatcttgtcctgtttgacttcccattctgacatccttcaataatgaacaacaatatgcaatatgaaagtaactattcttcattttatcgaagtaatagaaaccctaactaaggcagacttaatcttggttattacttgcttccaccatttcccctgattatctgggaaagaatatcactattggtaagttcctaaccttgccctgatagttggttacatagccaacacgcagactcaagggtgacaaggaaagataaaatacaatgcatgacattccctttatttgtgcctcagtgattcctgggacaagagacttctgttgtttgtcaccactggacaaccagaacataactgactaacttgtcagaggaagtgcggcagtggcctatcaaacacaggagatcaagtttgctctattcactgctgggatgtgcataaattggtgcagcagtggatggacaaattgacatagcctgagtcacaaggtgaaaaactctttcctgtggtgtattaattttacccttacaatagtagcactaaggcagactcaaagttctctcttatgacttatttagctctagggaggtgaaggtaggagcagagaaagtgtcagaatctgaacttaagcagatgatgcacatcacagggccatgagggaaaggagtttgtcctctgagtatcacattaaaagggggatgacataatcttttaacagctggccccagggttgtcacacaggtgttttgttttgtgtgtgtgtatgtgtgtgtgtgtgtgtgtgtgtgtgtgtgtgtgtgtgtgtgtgtgtgtgtgtgtgtgagagagagagagagagagagagagagagatcaggcctcataggatatcttagaccaaaatcatgatgtcagaagttagagttgtcaaagtctccatgtacctaggaagcagccacatgctgagttctgcctttaccaggacaattaacacagatctgtcaatgactcactgacagattcactccaaagtctcaatgttagagaattcctttcagctcaggcaatgctgaagtctccacagcaccaagagagacaaatatacaatcttatggatttgacacacacaagagatgttttgagaagcaactttatggcttaacaccagccatattcagcatagagttaagaacagcttcttccagactcaaagagcagtgacaattgtcctgttattcctttcttgactatgatggataactttgtcagtttgattggattataagctgcctctggcattagtgagtcactaggtatatgcagagtgttttgagagatgtttaactggggggtgggggacaggagaacaactcttgagtgtgaaaggcaccaaatgttgggtgtagcccaagtctgaatgattagggggaattaggttgacctcttgaagcatgtggtaatcctaaagattgggggaaagaaagcagaaggatggagagttctaggccagcctttgctacatagacactttgttgcctacctggctgacacgagatactttatcaccccttcccattaaaaacaagagaggagcaaacatgccctgtgtgaatgcttggtggctcacacctgtaactctatcagccatcaagtcgaggggaggattgctgtgagttcaaggctagccaaaggttcatagtgagttctaggccagccggggctacagattaagaccctgtctagtaacgccaaaatgtaccaaaaaatacagatggagaaaaaagggtgtaagtttaaggagaagaatgaggacaaggagaaggggggaggaggaggaggaggagagaaaaggcagctgtgcacatttctttgtttccatgctgcaacacggacctcgctgccccttctgctgtgacctcattgccataatgtgtagaattctgctgtactctcagggaggatgaatctctttcctcccttaggctaatcttttattcttgagattataatttaatgactataattgtccctgccctttcctcctcacaacctccagtgtttccctccccattctcctcaaatcctggtctctccttttcactaactgctggagagatatctcagttgccaatgctttcagtttgtcaagtatatgctcacatcactgagaaaagtatctactacacaggaggctccaccatgctcttcgtgggttacacagaaaagccaaccctggacagcaccttgtgtgtaaacagtctacagtactttcccatcatgtgtatatacttgtgtggagcacttgccagcctttgtaaagagaaaacgaagtgggtaccccaaccccattctggctatcagcttctcctgagtgcttaatagttgtgcaactccctgggtaaccttttcctccagagaacaatttagaatggcagttggggatgaagcatggctctgctactgcaggggagaatggaggtaagtcttttcctcagctgctctgtctctcagtccacttctctaagacacacaggatattaacattgcctccatgctagctttggtttggcgacaaaaaggacaccttggttcacctgagatgtagaaataagtatctggatcaaaaactgaaggcaattcctgctcagaggagccacatctggtgtgcaggaacatcagagcctgtaattgtgagcatttaatttgcctgcagataattacatgcatatgtaacatccgtcacagtctgcatggggaacacaatttagactgtttgtgcctccttacttccaaatagggaaataacaaatcaatggccagtgagcatagaaaacaatagcttcactggtgataaccaatgatcacaagttagataccattctgtatttttaaaaaaacatatcataatggtcaaatgaaactgcaggcttcagcaatggctccattggtaagaacactgtggtcacctggagttcctggtacaattcccagcaagcatctggaagacccgttccaggatatcctatgctccctttagcctgcattggcaataggcacacaatgtatcacatgcatagtcgtacatacaggcaaaacactgcatacatattttttaaagttttaattaagaacaaaaaagtgtgctgttttttggccaagaatctatgtgtacacgatagtgaaaatgatcataacacattgtacaaaatgctcaaaggattagtaagaacatacattaaaaataaaagcacaaatgaataaatacagatgtctcaataaaaagactacacaatcatgttttcctagactctgaagtattattactgagagcaacatccaaacactcatgtttagtatataatcttataagacagcaacaacattaatacatgtattattaacacttggaatagaaatagaaaagaagtctttaatttctttatttcttccttgaccaaggtataattgaggagagtgttgttcagtttccacgtgaatgttcgctttctcttatttatgttgttattgaagatcagccttagtccatggtgatctgataggatgcgtgggacaatttcaatacttttgtatctgttgaggcctgttttgtgaccaattatatggtcaattttggagaaggtgccatgaggtactgagaagaaggtatatccttttgttttaggataaaatgttctgaagatatctgttaaatccatttgtttcataacttctgttagtttcactgtgtccctgtttagtttctgtttccatgatctgtccatagatgaaagtgaggtgttgaaggctcccactattattgtgtgaggtgcaatgtgtgctttgagccttactaaagtctgtttaatgaatgttgctgcccttgcatttggagcatagatattcagaattgagagttcgtcttggaagactttacctttgatgagtatgaagtgcccctctttgtcttttttgataactttgggtgggaagtcgattttattcgacattagaaaggctactctagcttgtttcttcagatagtttgctttaaaaattgttttccagcctttcactctgaggtagtgtcttagtcagggtttctattcctgcacaaacatcatgaccaagaagcaagttggggaggaaagggtttattcggcttacatttccatactgctgttgatcacaaggggcctttcccccttgatcactaattgagaaaatgccttacagttggatctcatggaggcatttcctcaactgaagctcctttctctgtgataactccaactgtgtcaagttgacacaaaactagccagtacaattgaccccttgtcaacttgacacacaaaaacatcactagtaagcctcaacccttacaatcttattcatccccaagatctaaataactttaaaagtcccacagcctttacatattcttaaaatttcaatctctttaaaatatccatcttttttaaaatccaaagtctttttacaattaaaagtctcttaactgtgggctccactaaaacagtttcttccttcaagagggaaaatatcagggcacagtcacaatcaaaagcaaaagtcagtctccagctgtccaatgtctgggatccaactcacgatcttctgggctcctccaagggcttgggtcacttctccagccatgccctttgtagcacacgcatcatcctctaggctccagatgcctgtaccccactgctgctgctgctcttagtggtcatctcatggtactggcatctccaaaacactgcatgaccccttcagtcctgggccttcaattgcaactgaggctgcaccttcaccaatggccttccatggcctctcacagtaccgagcctcagctgctttgtgtgaccacttcatgctttcaaaaccagtaccacctgggtgacccttacatattaccaagtcccgctgcagcaggagtacaaccttggccatctctggaacacagcctctttgtgctttcagaaaacacttcccagaagatgtcacctcaatgatgctggtctcttcttaatcaccgctaatttcttagctccagctaaccagcatcaatagtcccagtaaggcaaagtttttgctttggtagttctggtatcttgttaatcacagctgattcttcagccccagctaaccagaactacagaatcttcacaatcaaaacagcaatggccctgaaaagagtctttaattttccctctgaaatttcacaaaccagagctccatcttctgcggtgttctcaacattatcttccaagctcctatacgacatccaacagagctcttaacaatggatggatcttcaagcccaaagttccaaagtccttccacagtcctccccaaaacatggtcagattgtcacaggaataccccactctgctggtaccaatttgtcttagtcagggtttctattcctgcacaaacatcatgaccaagaagcaagttggggaggaaagggtttattcggcttacacttctatactgctgttcatcaccaaggaagccaggtctggaactcaagcaggtcaggaagcaggagctgatgcagaggccatggagggatgttcttttttggcttgctcagcctgatctcttataaaacccaagactaccagcccagagatggtcccacctacaaggggcctttcccccttgatcactaattgagaaaatgccttacagttggatctcatggaggcatttcctcaactgaagctcctttctctgtgataactccagctgtgtcaagttgacacaaaactagccagtacaggtaatgtctgtctttttccctgagatgggtttcctgtaagcagcagaatgttgggtcctgtttgtgtagccagtctgttagtctatgtctttttattggggaattgagtccattgatattaagagatattaaggaaaagtaattgttgcttcctattatttttgttgttagaattggcattctgttcttgtgtctgtcttcttttaggtttgttgaaggattactttcttgctttttctagggtgtagtttctgtccttgtattggtttttttctgttattaacctttgaagggctggattcatggaaagatattgtgtgaatttggttttgtcgtggaatactttggtttctccatctatggtaattgagagtttggctgggtatagttgcttgggctagagactagacagtgagagaaataatgaagccaagacaatttttctctgatcgaggcctggaagtttaataagagactgtgcttaaaaggggaaaggcccaaccccacccccctaccccacccctgtccatccttggtgctttgtcgccatgctgtcagcacttggttgccaggctgttgcttatttaggaatgtctcaggaagacaggttcagcctcttggcaggtagcagcatctctgagaagagcagggcagtgtccttcaaaaggagccagccaagtcagaaagctgcaccgcaggtggccccacctcaatggagacaaagtctgcacaagccagcttcaggctgggggaagctacattctgttacaactcccaccccacccccaaaatgtaacaatctagacagaaggccattgatgagaactcataaaaattgtaatgaggatgctgaaatatagctctccacactagaaggctacaggtggaagtcaggctggagaagaactcactttcctgtaagggactagccaccagaagttcaaccatgctccagtgagtatatggacaacacaaattggacttgttttttttttttttcttaatcatttttgggagaggccacaagtgtggaggtgctaacctggaaagagagggaagtaagggcaaccagggtgcattatgtgtaattcctaaataatcaatatgttaaaagaaatcttcacatcactagtgttctactcagttattaaccttaggcataattcattgccattttgtgcggccacaggacacaaatcaggtttgcatgttttcctttgaaaaagatgttaatttcagccattgtgctggtccagtttctctagcaaatcctatcagcagttaatagagaagcaactcaattaattctttcatataaactaaaaacactaggtgaagggagaaccagtgggcattttaaaatgcatagtaaatgcagctgtattctgccacattcaattttgacagaaggaatgtaggggaaaactatctcatgaagtcttaacaatactggcatagagttataaaggtcattagagttactatcttgctgagggatgcccctggtactggcaagtgcaattgaaaccttggttctagaccatggagacagatatagattgggatgaaaacacacacacatgcccatgtgtgcgcatgcacacacacatacacatacagatacacatatacacagacaaacacaaacacatacacacatatagacaagcacacatacagacacacatacacacatatacaaatatacacacacagagacacacacatacacacatacaaacacatacacacatagagacacacatacacacacacacatatacatacagacacatacagatgtatacacagagagagagagagagagacctgtatcctttccaaaatcttccagaaatacaatgaaatcaacataatttagacccacctatacatctgcaaacatgaatacacacatgtgtgtatgtgcatgtgtacatgtgtatgtaaaggtgtcatttttcacatgtgtctcttcattccttttagaaaactttctttgcccattcaaatatgctatgaaatcacttttctaaaggcaataaagatatgatatgacgccgggcgtagtggcacacgcctttaatcccagcactcaggaggcagaggcaggtggatctctgagttcgaggccagcctggtctacaaagtgagttccaggacagtcagggctatacagagaaaccctgtctcgaaaaaacaaaaaacaaaacacaacaacaacaacaacaaaaaaaaaaaacaaaaaaaaaagatatgatatgacttgttgatgtgctctttttgactactgttgagatgtatggtttataaagactgatcattggcctgaagaattataactcagtgttctaaatcactgtagcatcttctgctctgatttttaacttaataaaagggcacgtctatttctgtttacaaacacttttcagaacaaagggaaaatatgtatatttccacttattaacctttttcaaaatgccaacaacactcacactgtctgaaggtctctaaggatgtattagaaaaatcaatatagcatttttagaacttgcctttcttattgagtatgcaagacatggcccacagtaagtgctcctgtcaggaactatttatagcctcccagagataccgataattgtctgaatatggttattgtgccatctctatacgggacattcccctctgggtattctgagcatattagtaagctagcttttcattactataataaaatactggatgcaggcaaatttatgagtaaaagagagttcactatacttttagacaataagattcattagttctagtgatagccttcttgttggcagaatcctaatgaaggaaaaaaattatgaaaaatgtctatgtatttcatatttgtgctctctgcctctattttaaaaaaatctactagcatcctctcatggatgctttacttgactttatttgaattatgttaatcagtgttctattgatgtaaccaacacctcagataaatcaactttttttttttaaaaaagagctttatgatagttttagaaggtccaaatgatatcatatttggctctattactatgagcctatcagagtgacagtatgcagcgaaggaaacccatctccctcatcaccagaactaagaaagagatgaagagacaatggcccaacaatccccttagaaagcacataacctctatgatctaaaactttgcagtgagcctcactacttaaaggctctgctacctcttagttgattttactgttcacctgagattaagcctttaagccactggtctctgggggacattccaagctatagggtaagtgtaataactttccagaattcccacctcttaatatcacagatgacttaaattcccattttctttttataaaaagatctgtatggtttttgtgtatattaatatgtgtatatatatatatatatatacatatatatatatatacacatcttattctaattaactgaaataaaactaataaaccttctggagtcaatttttccatcagtaattatagttcatcattcttccaaatagaatgtccccccatctactttagaaatataattcataatccaaggttgtatttattaggcagttaagagcttggcacagagaaacatccatgtgacaatagagtatggcatatgaccaggtaattttaaagttaaactaatagggaaaggacacatgtctaatcgtgaatataatacgtccttgcattattcctatagaatgagtctgtataaattagcatatattatggagatcttctgaacatgccttccttataagacatagttcacaatattttaaataacgctttcaagattatgttatttcccagtcttagtggaagctttaataagtactaattatgaacaattttctctcaacaatacatcatagactgctgtgtctgtaaacattttggttccaaaattctatccgtctttgctaggcagtgttccttggcctttgctattagccctggcctgcaattaatgcaagctaggggtactttccaaaccatgactgtggatcataggaatccaaaaataattgcttgaacaaccaagcattgtgaatcagattcaggttagtattactggtcaggcctccattcaaatacgaccttcttgtggtgcattagggttagagttaacagaattctcacataggcttttatacagtctccaaagcctagaagagcaagctgtcattgctcagagtaggcaacaatagcattctaattttagttgcaggtgcaatgtattatcagtgcttgccatccacgttagtcctaacgtaccatgtaggcatgctctttaatttttactggctatttcagccaggctttgttaatcattcacgtcaccagctcacttagataagttcaggtactttgcttttcctctactgataggattttgacatcctcaaaataacatatcattacagttcatacttacatccactccaaatcattcttaagcaggttctgagtaagctaatgaatctggatagccttgaagaaggaggaggaggaaggaggaggaagaggaggaggaggaggaggaggaggaagaagaagaagaagaagaagaagaagaagaagaagaagaagaagaagaagaagaagaagaagaagaagaagaagaagaagattcattgtaaactgagatcttttccacatgaaggaaaaaatgatagctattgttttatgattggtgacaaacaaaaataattgcccagatccctaactggtgaaagtgctgacaatccatgacgattgactgttcatcccaccgagaatcgatgtcaccccttcaaggcacagttaacatcatggaagaggggtcagacgagataaggaactcggtctgggaaatggaaatagttcaggacacaacatagtggctgcacccatgacctcacagcaacagaggctacctgcacaaaggcagactcaaggaaggagagaggcatttctgccatgctttgaagggagaacccagcaaccttgtgagatatcagggaagcttgggctgtggtagtcagggtgtttgaaggactagatgggaccagccatggaagtttagggcaggcggaaagactgataatgcattggtaaagacaccagtttccaggtgtctggcaattgtgccaggaaggcaagttgtaaaggaactgtgtgagtgcatgcgtgcgtgcatgggtgtgtgtctgcgtgtgtgtatgcgcgtgcctgagtacgtgcatgagtgtgtgtgtgtgtgagtgtctgtgtgtgcatgcgcgtgtgagtacatgtgtgcatgcatgcatgtgttgtgtgtgtgcgagcacgaacgtgcgtgagtatgtgtctgtgtgagtgtgtgtgtgcagtgtgtgtgtgtgtgtgttttgtccaaagattcaagggaagcgggtagaggctggtagtgtggtcacctccccgagcagagcaaaagggaagctgggtgggggcaggtagtgctgcggctggtccagaagcaaaggcggtagcataaaactacatgcaacagatgcacaacattggttccatgaacattccatcacagatggggaggatctgtagggaaagggctaataggcaattcactgttgctagggtagacaaagtcatattcctcagtggtgtatccactattaagttacccttgctcaaagaatcccccactcatgcttctgcaagcaccggtctaattaaacagtgggtcacaaaaacatgaaagtagttagggacctgctggaaagaaaaataattcagcaggaaggcaagacgggtaaggagtagttgttggtcatggaagatatatacatatgtgtacacataataatgtagatttgtttgttgttagcctccacgagccttgtcactattcccacaggactagtacaccaagaatttactggcggcagtgctctcacatcattaatgaaagcaactatctatttttctccaccaggaaggatattcgttaccgctttaaattgaaatcccaagtcgactccataggttcccacttaacatattttgttactgagccagggtttgctcatgaaggctttgggtatttctacactggatagataaaagtattccactctagatgtgagactcacttcagtaatacatacagacaaagaagatacagccacttcacgtcaaaacctgctcaaacatttcaattttcgtcaaaacattaaccctaatttcaacagtaattacatcctcatatgctcccaatataatagtgtcaatccgatcactgctattttattcaatccattccttaataactatttcaagattcccacttcactggggtaaatctcttgacaattccattttatttttatctatttttagagcaaatcattatcatttttgtagcatctgtgagacccctggaggaaactgaattgaaaattttgattctgcttcttaaagccctgcttgattttgcaagattgaagggagtaagcatgcaaaatgtgtccctaaatgacagcatttactctgaacttgctgagaggtataaattgggtaaacatttagcctttgtaaagccaatctagcatagattctatattccacacagcagccgctacaagctgatgggcatttccagttaactgctttaggacttatttatttgttgtttatcagtgtttggtctgcatgtaagcctgtggaccacatgcatgccttgtgcccatggaacttagaaaaggttatcagatccctttaaactggagtcacagttgttgtaagctgccgcgtgggtgcttggaactcaatcatcctctgcaagagcaacaagtgcttagaactgctaagtcttctcttcagtgtctctaggcggcttttaaagtaggtgaaaaactcattcctattttcagggcaaatgaactataaagtgtctttcattcagtcttcgagattggctagtccctcaagaagaatttcgatgtgtgttgagatcgtataccacaacgttaaacgctggatctataatatttaaaaccaaggagactgttcatcctcacgatccgcttgtatttggggttcttcgggaagcaactccttaacatcgtatcatttcgcttccatgactccctgatttgcttccacctaccacatggagtaccttcttggtgaccacaggcatacagtgtcatccattttccagtataatttttgtttttggtgtcaattctgatcagactgggtgaagtcttgagttaagtgaaatactaggatctgcatcagcactcccctttgctttatctagcagggataaaaataactaagagcttgtatattgagactgttttgaatttccttttgtatccagatcatcaactaccgaggatcaatttgtaattgattccataatcatgtaacttttacctccatcaaccgatcacataacaacctctgtcacatacctgagtggcccagtagctctccaggcctcagaggcttgtcattacactttgccattattgtcagatcattctctttccacttctcaacaaagaactcatcatgttttgctgatttttaatttttaaaaatttaaaatataattacaccatttccctccctctactatgtcctaccctacctatgttcaaccctctgtcccatacaaagtcatggccacttcttccttaaccattcctgttacacatatacatatacgatgcataaatacttagtacaacctgctgaatctgttcagtgctgcctggatatgtatgtgtctaggaaaacagtagtcctccctctctcagctgttgctaattgcccatcttctagtcatctaaagatggtgtcctgggagacttcccctgtgtatgctgggatggcaactggtactggaactgtttatatcttattgttgaaatgttgcgggtgtatatagctttgcttttgctgcaagaaggcacaatctcacaggcatgtttagggacattctgacaaatcccagtcctgatctacaatcagtatcatcaagacaatacttaagttcagggatgtatctgaagaaaccaaagacctccaaggagctttcatactattcaaagttatgattcattatattaaacaaatgcaaatcattatcaccaaggaggagttatgaatgacgttaagttcaagagaaaccggttcaagcttccaagaatcccagagaagtcgcatatgaacacatctcattttactagaaatgatgtataccagccagggaaagtcatctgttccttgaagctcagggatattactgtgtgtcactcctgaggcatgcagcacacttatgactgaaattctagtcccttttccaggacagaaactgccactcataccaagtcccattgttagaattagtgtaaccaatcaaacaaaactggaatggttcaaaggctaagacatacaaaaacaaacttatcagacagaatatttgaggagttaagaggttatctaccaagaaccagccaagcatcaacaatagagacaggcccttctttgaaaaggatatggcttaagcaactcaaactttctaagtgaacccctcttatccctcaatacactacaaacaatgactattcatctgtccaaattcaggagtaataaattaaaagttttctaaacttttttcatcaaaaaccaaaatgtacaaatggtgagttttacatacccatgtttctaacaaaaataaggatctattctttacaatttctcttacgtgaaaaaagaataactgccgggcatggtgggtatttaatcccaacacttgggaggcagaggcaggcggatttctgggttcgaggccaacctggtctacaaagtgagttccaggacagccagggctatacagagaaaccccgccttgaaaaaccaaaaaaagaaaaaaaaaaaaaagaaaaaaagaaagaaaagagaataactaaagaaagcatagttttaatttatgtgatatacataccttataacaagtgttcatttggatggcatattttgatgttctctacccaggtgttagttaacctgtgcctagaaaaaaaataaaaagaaatgctaactatggagttctcccaaaataagaacatgattcttaaaaatatttacatgtaaatgtttttctcaatttatccttgacctccaatagatacttcaaacctctatcttgaggtttcttgtgatatgacttgtaaaaatataaattcccctaaaatttgtaaaggaagataacttttaataataaaaggacaattcacagtaggcttgaataataaaattattttggccatttaggaaccttactgatacaaccctgtatattaagaggaaaatttaatagatatttatatagatatttcatgtaaaagacaatttttaggtctctgaaaatgtttccattttatcccaacaagtaatagtcaaattagaggaggaatctgagtatttactgttaaaactattctaagcatttatagatatttagtatatttattgaataaagctaattcatttaataaaatgaaataacattaaaataaaatccgtatagactgttctcttatttctgaaaagaaagaacttcaatgttctttctgatttcaattacaaattttattctgtatctatcaattgaatccaattgaaaaatgtcacagcctaaatagctttccacgctcaaatgcctggctattttaagtcacacaaacaagagaaatgaatgagtagctggtgactcaaccacttcaagctttacccatggggagctaacggtctctctgaagcaaaggaggtcatcaacacaatttcttcaacaaaatataaactcttcaaacacacccacacacatacatgcagtcaaagcaaccgtaggctttcaggaggactgctatagaattaggcacactatagcatttcccggttatcatgaaaccagaatgtcagaataataatgaccttgacataaaagtgctttgctgtgcaaacatagggacctcattttgcatttgcagaaccaacattaaaatgtagacatggcgacaagtatttgtatctcggtattcggaaggtagggatactttgggcttgctggctatccagtttagccacgtggaaggccctgagttcagtaggagactgtgttacaaaaacataaggtaaagagtgatcaaggatgaaatccaaagctgaactctaacttttacatatatccatacacacacgtgaacgttcatatacacatgcacttacacacagagatggggggagtggggtatgaatatgatgtgttaaatagacaaagtagataatcaatcattctgaattttttcttgcacaaactaacagtttctgcctttgttcaagaactagaaaataatacgtacatataccaaaagagaccccaaattccatatagcccccccaaaccctttgtaaatactcaatagcaacagatgattttttttctgcaagattaacacactcttcccctgacaacttaaatgtatcataagcttgcatcatagctaattggctcacacatgactcacaatgctacaactaatgaatggataagtgaggcagaacagaatacattaagcacttagtcttgggcatgactctaatgaggacatcgaatctaggtagtatgtgagaatagtatctttcctctgagatctcctgttgactcttagaataccacagctgcataaaatcatcattcataagatataattttagcatatatattgaattaaaattaatgacatttccctttaattatagtcttattaaagttacatactcatgcaaatatcacactctacccaattttataacagttctgatatctcaaaattacctcttgtgcccaatttcaatcccttggccaagcgttttccctaactatacacactcattacttcttaatatttctcataaataaaaacataacatatgtagcttatctctgtgtgtggtatatgtccaatgccatgcaaggacatattaacttttcaaagctgattcaataagtcgattgcttgttctttagtggatatacattgagttgtttgatacatttattcctaagtattttattcatttttttaatttattaggtattttattcatttacatttccaatgctatcccaaaagtcccccatacttccctacccctacccacccacttccacttcttggccgtggcgtttccctgtactgaggcatataaagtttgcaagaccaaggggtctctcttcccagtgatggcagactaggccatcttctgatacatatgcagctagagacaggtgcttgggggaggggggttagttcatattgttgttctacctatagggttgcagatcccctcagctccttgggtactttctctagctcctccattgggggccctgtgatccatccaatagctgactgtgagcatccacttctgtgtttgctaggccccggaatagcctcacaagagatagctatatctgggtcctttcagcaaaatcttgctagtgtttgcaatggtgtaagtgtttggaggctgattatgggatgtatcctcaggtatggcagtctctagatggtccatattttattcattttgatgttctccatggagaattgattttttttttttagctttagtgttgttcatggataatgtaaacccaatttctgtctgaattctctaggtaagaatcattatctgtccattcaaccttcaggcttttaatttccttttaagtaatttatcattaaacaaaaataaaagtatgtttttatcatgtataatataatactttgaaatgggtatgcactggccaaatacagctaattaacatattaattaaatttaaaacctcactttttattttggaaaatcttaaaatctactcttagcaatttctagggatgaagcattattgttaactgtagtcattatgttgtacaataaagttcttgagtatattcctcctgtttagccagtaatggcatatccttgaataatccttccccaaatccttcccccgagtaacctctatttccttctttgttttcttaatattctctctctttctctccctccccctccctcccttcctccctcccccctcccccccctttgtgtgtgtatgtgtttgtaaatgtgtacatgctatatgcatacgtagacgtcagcggacaatatgtgggagttaatattctccttccatcacaagaatcccaatgatcagatttaagttttcagactttgtggcaattgtctttgccaactaaggcatttttctggcttcacaattctattttctccttttctgaagtcatttgttttgggttttttgcttatttggctttgtttttttgtagattataccttgtttttatagatttttatatgatcatgcaatgtgtctttttcactagatggcttatttcatgtaacatattatcttccagatccataaattaacacaaatgaaaggatcccaccccccttctgcccaaattatattatgctgtatttttcatctcttcttctcattaacatttagactaaagctgaaacaaaaacttccctaggggttaaataatatatgtgtctggtaatataatactggaaagtttagagcatattcttaagatatatattatttggtatatagggaagtaggaaatgtcagtaattcccacttggaaaggcaatcaacagaattaaacattgtaatgtagcctcccgcagccttgaagcacattgattccgactttgctgccactaaatatgagatcacctggggtgtagccttccgacttagatggctatattgttatgtcaactactgctgctcttctctgagactctgctacctgctgagagactcttgagacattccgggagacacgtcctatcctacaggctggctccagccaccaagaatggactggtggggggtgggggggtgggggggggatgggccttcccccttataagcacagtctcttagtaaacttgctgtctaatctctctttcagccccagcctgccttccagaaatacctggttcatgtaggctgtgtgggctggcctcctactacagattggcgcctgaaccaggggcctgaaaacggcaggaagacactgagtgaacgctgtcttctgtggagctccatgagaagggaagaatcagaagatcatatcgggcacagtgagcaacaggtatttatgccagcgctggatttaaacttcatttttaaaagtgttgctggaggatacaggctaagttggaacagtgctgacccggtgctgattccacttagggtttgacagcaaaatatggaactagggccaagaagtgggagtgggtgggtaggagagtggggggtatgggagacttttgggatagcattggaaatgtaaatgaagaaaatgcctaataataataataataataataataataataataataaaaagaaactcccaagcaggcgtttgtctgcagttttcaagagctgcttcaggcaagaggagtggggtttgaaaaacaattgttagaaaattttttagataagatagattcttgttgcccatggttcagggaagaaaaaactttaaataacagaacctgggagagagttggagaagctttgaaaaacacccaggcagataatttcaccctttgcctctgggcgctcgtaaaagatgctattgaaaaagagatctcaaaggggtcagatagtacccaggcagatcttgaagaatctcaggaagagcacctgtcagagaggactttctcagaaagggaccctctcaaccctaaattagaaagatatagagactctgatgatgagctaactttagacaaggaagatcattcagaaagaggagccgccaaatattttgatgaggattggcctcatggcctccactataggagatgctactgaaatggacatgcaactaagtaaattagagtttgaaattaagttgcagaaattgactaatgagcttccagagctaaaaagggtgtcagatacagggaagagcaactcttctgaaatgtaccaagcgccactagaaagagctatgagccaggcttgtgagaggagacaggatacgtctgatgtgctagtctttcctgtagttgagataattgaccagcaaaataatagaatcagataataccagactttggatttcaaggtgataaaggagttaaaaacagctgttgcacaatatggccctatagctccctttacacaagcattattggatactgtcatggagtcacacttagccccccaaattggaagactctatgtaaggctactctattaggaggagtttctttctttgggattctgaacggtgagaaaccagtaagaaaactgccgctttaaatgctcagacaggtaatcctgactgagatgccaaaagcatgggagaaggtcgatatgaagacaatgctaatcagattggttttcctgttggagtgtatgctcaggttgccatggctgcccgcagcgcttggaaacagttgccagctaaaggggatcttggtggaaatttagccagcattgggcagggtcctgatgagctttaccagatctttgtggataggcagctagtaggattcttggagattctgacccgggaagtcctttcattatgcaactggcttatgagaatgctaacgcaaatgtgtcgcaccattatccaaccacacaaaggacagatggaactagcgggatatgtccctctttgtgcagagattgggctgtcaggtaatcagggtttggcttttgctgccaccatacaagcaatgctttcacagaaacgagggaataatgcatgttttaagtgtggaagtttaggtcattttaaaagtgattgtccaaagaataaaggtgctaagagtaggcaagccagccaagggcaacgattggactagggtgtgtaaatccaagtcagacattagggccgtccgttgccaggaaacgagaggaggggccagccccaggccccaaaatacccatggcaggcagcttatggagccatgaagctgttgcccagccaaagaaatccctttttgaacttatcaggggaaccccaggaagtgcaggattggacctcttttccaccacccacgcaatattaaccccagaaatgggagttcagactctacctacaggagtttttgtacctctacctgcagaaacttgtggattttttttttaggatgaagcggttctattgtaaaagttctgcagatttatccaggtgttatagataataactatgagggagaaattaaaatcatggctgcttcccctcatggtgttataactgtacctgcccaccagagaattgctcaacttgtcttaactcctttgtatccgctaccgtccagatttgttaagaatgagagaggacaaggtggctttgattcctctggtgtgcattgggttcaatctattactaatcagagacctaaccttaaattgacaattgaaggaaaaagctttgaaggattaatagatactggagctgatgtaacaattactagaagacaagattgtccttcagcttggcctttgtctgatacgcttactcaccttcaaggaattggttatgccaataactcaaaacgaagctccaaattgctaacctagagggatgaggaaggcaaatcaggacaaattcagccatatgttatgtcaaatttgcctgttaacctatggggaagagatctcttgtcacagatgggcattataaaatgcagtcctaatgaggtggtgaccaagcagatgctcagacaagaatttttgcctggtcatgggctaggaaagaaaggacgaggtattaagacttttgaaggtcctaaacctcactctaacacaagaggtttggggtattttcagtaatggccactatcttgcctgcatcccatgcggataaaattcaatggcttaatgatattccagtgtgggttgatcagtggtctttacctaaagagaaaataggagccacctcttcactagtacaggagcaattagaggcaggacatttagtagaatctcagtctccttggaatactccagtttttgttatcaagaaaaaaatctggtaaatggagattgttacaaatctaagaatggttaatgtgaccatgaaatctatgggaactttacaacccgggcttgcgtctccagtagccattcctaaaggatattataaaattgtggtatatttgaaggattgtttctttactattcctttgcatcctgatgattgtgaaagatttgcttttagtgttccttctattaattttaaggaacctatgaagagatatcaagggagagttctcccacagggcatgactaatagtcctaccttatgtcaaaagtttgtggcacaagccattcggcctgtgagacaacaatggcctatgatttacatcatccattacacagatgatgtcttgatggcggtaaaagacccccaggatttgcttttatgttatagagatttacaacaggcattagctaataaaggactacaaatagctcctgagaagatacaaactcagaattcttataattatttgggttttagacttactaatcaagctgttttcccccagaaaatagttatttgcagggacaacttaaaaactttaaattattttcaaaaattattaggtgatgttaattgccttcgcccctatttaaagcttactacaggggaattgaaacctttatttgatattcttaaagggagttctgatcctaccttccctagatctttaacctcagaaggactgttgtggcaaaaggctcttctaatgtggatacatttgaggatttctcctaagcgtaatatcctgccatattatgaagcagtagctcagatgatcatacttggaaggaaacaggcactaacttattttggcaaagagccagatatcattgttcagccttatagcgtagaccaagatacttggctgaagaagcacagtacggattggttgcttgctcaaataggatttataggaactatagataatcattatcctcaagataggttgataaaatttttagatgtacatgaggtgatatttcctaaaatgacttctttacagcctttatataatgctctattgatttttactgacagctcctctaaggcaaactggatatcttatgaataatcaacaagtagtcatagagactcctggcctctctcctggcctctcagctcagttagcagaactgacagtagtactgaatgactttcagtctataaatgatgcttttaatatttttaatgatagtttatatgttgcacaatcaattcccttattggagacttgtggtacttttaactttaatatgacagtaggatctctgttttcacaattgcaaaacatcattcttgccagaaaacatccgttttatattggtcatatatgagctcattcaggtcttcctgcgcctttagctacaggcaatgattacatcaacagggctctgataggagaggccttaatttcagatcctgttgctttgtctagatgtgatcatgataaatttcatctctctagccataccttaaggctccaacacaagatcactaaagaacaggcaagaatgattgtaaaacaatgttctaaatgtattacattatctccagtgccacatttaggagttaatccacgaggtcttatgcctaatcatatttggcaaatggatgtaactcatgtggaatttggaaaattaaaatatatacatgtttctattgacccttgttcaggatttctttttgcttctccacataccggagaggcctctagaaatgtaattgatcattgtttacaagcctttaatgccatgggaatgcctaaactcattaagacagataatgggccatcctatactggcaacaattttacttcattttgtaaggaatttggtatcaaacataaaatgggaattcttataaccacatgggacaaggaattgttgaacgtgctcatcgcaccctgaaaaaattggcttttaaaatgaaacaggggcagttataccctccaaagacaccaaaagcacatcttgcttttgtcttgtttgttttaaattttttgcaaactgatattaaaggtcagtctgcagctgatcgccaatggcatccagttacttccagttcttatgccatggttaaatgacggaacccattaactaatatgtggaatggtccagaccccgttttaatctgaggaagaggttctgtctgtattttttcacaaaaagaagacggagcacgatggctgcctgaaagactggttcgtcaagtggacacagatcctgaatcttctaggaagtatgattctaaccactgatggctaaaaatcctttttagccgaaaaagttaatttggagcacagcctccactttcagagaattttcagcttttctgttaattctcaaagttacctcccccacactgagaggtcagagtctgagcttccccacactgagaggtcagagtctgagcttgatcgttgctaatttgcaactgaataaagtacctggacttccccaaagaagcttttatcctgttacttttcaactatctcaagcaggtcagtctctccttacagcctgatttcagcaagcgtgcagcctcacctccagcaagcacaggtggcagaaattaatcaatatgaagaagcatattaagtatatattgtggctttggtctgatttgggaataaggtgtgctatgagggccgatcagtcaatgacatgcaaccagatttcggagccatatcaatctaagacagaggtacatgccaagaggccatggtttgttaataatacaccacagagccatgtttgtgtaaaataaacacaaagaagctgcatgtatgcttcttgatagataagaatggctcgggagaatctgagtccccaagccaggcccggctgccagctaccataactcccaggcaggatgatggagcataaataaattttatgttctcggtccagctaattttattatataatcaggggggaaactgtagcctcccccagccttgaagcaggctgattcagactttgcagccactgaatatgagaccacctggggtgtagccttccaacttagatggctatattgttatgtcaactactgctgctcttctctgagactctgctacctactgagagaaccttgagacattccagagtcatatcctatcctgcctacaggctggctccaggcaccaagaatggactggtggggtggatgggccttcccccttataagcacagtcttagtaaactcgagggccttgatcagagaaaaatttgtcttggcttcattcttttctcgctgtctagtctctctttcagccccagcctgtcttccagaaataaccggttcctgtaggccacgggccagcctcctacaacattgtaatgacacagcaaacttaaacaggcccattacaagtgatgagataaaagctattattaaaaaccttccatcaaagaaaatcctaggaccagatagattccttgctatagtctattaattttgaaggagtacatgatagcaattcttcttctgttctgagtctttaggaatatttgagacatatctcaaaataattaaggaaatatagaaaaactatatccaacattgtattaaatggagattaagagaacaattacctttaacatcaaaaatgtctattcatccctcttgtatattatatagtgcacaaagttttacctattatatcaattacaaaattaaaaaaacataaagggactaacaaccaaaagggaagaagtcaaactacctttatttgcagatgacatgatctttcccttaagataacctattaaatttgctagaaagcttttgtacctaatatttaccgtaaagttgaaggatactagacacatccagttgtcttcatttatactatgtctaactctccaagaaagaagttaggaaaaatattccattcagaataacttgccctaaattaagtatttaagtatatatctaaccatagaagtgaaagacatccactacaatcaaaattttaagatagtgaaaaggggaaccacaagatgatagaaaatcttacatgtgcctgaatagacataattaagattgcaaaaatgcctagactaccaaaatttatttacaaagttattgaaattactatcaaaatgcatatactatatacacaggtatgaaaagataacaaataaacaagaaatcacatggcaccacaaaagatgatgaatagccaatgcaatcttaatgagtaaggacaatcaatactggaggtattataattccagataaagacaggctaatattgacataaaaataaccatgtagaccaatggaattaaatagtgcactcagaactaaagcaacaaagctctgcccacttaatttttggcaaaggagggaaaaaataaacactggggaaaacatatggactatttaaaaagtggtgcgggcaaaaccagagttccacttgcagaagaatcagattagagtcatagctttcagtttggtcaaacccaattcaaaatggatccaagaccttattttaaagaataaaatactgaaacatttagaagatacatcgtggatatacttcaaagatattgagccaggcaataactttaaaaatagaacactgaagaactaaccctaagaatcaaagtataggactacatgaaaataaagtttctgtacaacaaaggtacagtagcacttacagagagtccacaaatagaagaaaacctttaccagctccacctcagacaatagacacaatccagactctacaaagaattgcagaaattaaatgccaagggaataaatgtgacaatcagccaatggacaagtgagctaagtggatattttttaaaatagcaatggaaatagccagtaactatttttaaagtgttcaatatccctatacattagggaagtacaaattaaaattactttcaggtactgtaccttaccacagtctgaataagtagcataaaaacaaaaaaaaacatatctaaacaaacaaaagtatctaaaatcaaatgttggagaggatgtgaattgaagggaaccccttttcactgttggtaggaaaaacaaattaatacagccattgtggaatctgtttggagagtcctcaacattttagagtagaactgcctatgacccagctctttctctcctgggtatatccatagataattccttttctcaccattgagatatttgcatccccaggtttattgctgctttattcactatagcagagaactagaatcaatcaagttgtccaccaacagatgaatggataattaaaattatatataagattctaaagaaaaatgaagttaaaatttttcaggaaaatggtgaacttaaaatgtataatattaagagatgtcaagcagtctcagaaagggattaaatgtcatgttttattttatatgcagaatctaggcaataatatatacatccatgtatacaaaagaacatgtgcatacagcataacatgaatgaaagagaatatgaaaggttagatataagggggtgaggaaagattgaatagaggtcatggatacaaaaaaatgaagctaattgtttttctagctctatttctgtcatgacttttgggggatttggtgatagataagtgcagaaactacatccaaccctgaaaagaagaatacaattccacacaaagctccgcatctgctccaaatgctgattctaactgggttgaagttcattaaattttgcagactttggtgtacagtgttttttatttatttgcaaggatatattaataataaagcttaaaaatgaaaaatatttaaagatgtcacagtgctagacttagcaagaagaggttttaaagcagcctggttcataatgtaatggctggaaataacaggaataatccctgattttgctaggctatgccagtgaggcccacagaattacctgtttctgcttcacagagctgagattaaaagtgtgtgtcacttttaatatgtctgtattttacttatcccaggaagtctgctgggagagcacactcaaaccatgcctctttatcagtctagctaaaggtttgtagctatttttatttatttttattaattctatttttagttttatatgcaattttatataaaattcctcctagaaatgactgcataaacaagactggcacattggcgatatcaatagacatgccaacacgaaagggagggggaatcttatggggtcccagcccaaggaaaagaactaaaaaacaactgactaatgactacaaagaaagggagaattagtctttcccaggaatgagccttctaattggttgtccaataaaaagtgtttaactgtgaaatcatgtacacacaaacaaactcaacaggttgtatttagatatgagtgcatcatgtacatacatatgtacatatatacatgtatatattcatatatacagatatatattatatatattcatatatacacacttcatatgtatgtatatatgcataataataacaaaaaagaagttatctatttgagaatgagggagggacacaaaaaaagttggagggagacatggtaggggctagagtcatcaaagcattagggaagtgatataattatattttatataaaatatttacataaaattgcatataaaactaaaaatagaatacataaaaataaataaaaatacctacatacctttagctagactgataaagaggcatggtttgaccgtgctctcccaatttcatgtactgtgatttttatcttcaatgcaggaggactgggaggtgaaacttatgatgtgctcattaggtcataaatactctgacttttatggatgggccaatatctctatgatgggagctgggtacttgtaagagtgattgtttgcccatcctgaggcactggctctagtcagcagcaccaaaaccattaattgattaaaccaaaaaatgtaaaggaatatattacaatactttgactgactgactgcatgccaataaatatataacatgtgaaatatacaccacgatagtggccagacagaaggtaccagatcaactaaaagagacatggaaaatctaaactgcactataacaaatcttctcagaaagagcaacccagagggcctggctgcttatctctgtagagataaaacaaaacctccctagccggttgtggtggcgcacgcctttattcccagcactcgggaggcagaggcaggcagatttctgagtttgaggccagcctggtctacagagtgagttccaagacagccagagatacacagagaaaccctgtctccaaaaacaaaacaaaacaaaaaaacctcccaaaagtggtaacaagaaatgtttcccaacacacactccattatactgatagaaacacagacaaaaagtatgacaggaaaagaaatgcagatgaaaatctactataaacggaaacacttttagagcaaaacattaccaaaagtaatctgagacactaacagatgattatacactacccagaaaagtagaatgtcaggcctggagagacagatccatagttaatgacctgtactgctctagcagaggacccgacttcattttccaggactaatgtcaggtcacttacgagcctccgtagctgcagctccaagggattccccttctgaactcctgacaccctcaggcatgtgcgcatacccagacacaaggcaggctcgatcacaacttaataaatcttttctaaaaggtgtaatttgggcaaaagagatggatccgtgggcaaggtgctacctttataagcacgacaacctaagatttatccagagaggccccatgaaacagcaaagtgtgcttctgtgcacccttcgttgctgcactgggcaattcagaccagtgagagactgtctcaaataacaaggtatatggctcctgaggaatgccatcagatgtagatctctcgtctccaaaagcatgcccgtttacacacacacatctacacacactcacaaacatgtagaaaaccctgtgaattaaggtcactgtctaccatgtccagataagtcctctgagcttggtacaaaatcaatgactctctttaccatcagggcttccccttctctgaccttatctaaggagccaggccatccacaccctctacctggggaaggtcatgtagaccttggcaaacctagaagttcaatttcctctttcccactaagaacctgcccagcaagtacctgggattactggaatgcctcgccatacaagtgagacattaacagtactttaaactccagccaatgattccattcaccctgaaaactcctttccactcctcgagtttcatataatgctcttgaccaccccgaataaggtatacgcatacaagcccattccaaataaaggtatgcacacaagctaagatcctctgagagttccattaaaatcattggagaaggccttacccccacactcactcccaccctacctccccctaccccatcactcccacctcatccctccacccccactgctcaccccttcacccccacccccatctcatacccctcaccccaccggacccccggtctgaattcatttccaactgaaccagaatactgcagaccccacctgttccatactctccttcatccttccagtctgctgtgcattcaatgcctggacaccctgaggaaggaaacagaagataaggaaccatagctggatcccaacaccatgcataacacacacacacacactcacacacacacactcaagcatgaacacatacaggcattcaagcatgcacccagtcacccatgcaggcatgcaggcaggtacactgacaataagtggtttttatcctaggaatgtaacattagtgatcatgggaaaaatctgtccatataaattcgtgacaaagctcatagactcacaatctgtagggctatacataacaccacgaaagtgtgctttgggcctggaccatttccttgtctagtgatacagagttctcataatgtgttttaggtttatgctctcatcttatcccactgttatctttgtatgtatcattttcttcagagtaagagtatgtctcaagtgctcgaaaacatgtatttggtccttagcgtttctgacattacagttcaggatccttttctggtagaatttggtacatgcaggctttctgactgaggtctgcgtcaaacacatctgtgatcctggcaaaattagcatgtcacaaggagctggatcttttgaacatgctcacactacttttgatgtatataaaaactgaactgttagataaatatggatgttgctactctcagaaaccacagtctgatccatgcacccctttttattttatcttattttttttcctggttgtttatcctggagcacagcctgaccaacaaatggccaataaaatacaaggtatgatagtcatgaatagagaaaatcttcaataatgaaggataatgaggtggcttagtcaatattattcttcccttgcaagcatgacatttgaagttcaattcctaaaatcgacctttaaaaagttaggcatgatgggccatgcttgtactaccactgaagggtaatcagagactcactggggttcatggaccacagaccctatccaattttacacgttccaggccagtaagagaccctgggtgggaggaaaggtaaatgtcccctgtggaatgatgcttaaagttctgtaaggctgacttccatatacaggtacgtgtacacacacacacacacacacacagaggcatgtgcacacatgtgcacaggtacacacatgcatgcaatacctccatatgtattatctgttcaccattaatacacacagaaaaatcacataattatctcaaaaaatcaaaataatacagatcaaaccacgtttttaaaatgaacctatgcaacagactaaatattgaagagcagtagtctaagatgacagactatccataatatttgaatactattcacagtcatgctatagaccacctgcagggccaggccatttgtagtggatacacctgcacatggttttgctctttggacctgtataggcctgacttactttcgggctgaagcctacatcttactcatcaggtaggtacgtgggaccccagagtcttgccagatccagtggttacagacacttagtgctcaatacagcactgtcaggtttctgaccctgggctctaggtcaatgccagaggtcagtttacagagactcatgcttcaggctcacccctaatgccaggtttgtttctgtggcttcagacacaaactcgtataaattaattggcagtgggtaaaagatgcaaggaacataaaatttaataatctattgattatgaagaataaaaaaaaatacaacatattcccatttgtggcagtcagaaggaaactaataactcttaagtaaccaaacttcaaaagtgaaaaacttaataacggtcctgcatacaaaagatatgatatttggagcaacgtgtaaatatactcttcctctgctttgacaaattctatttttaaaatttaccccacttgtgataacataataaatgcatttatacatttaaaaagtcaacaagtctagccttggaaagtgtgcatgcttgtaattccaacagttgggaggggggaggaggaggagaacagctgagcttaaaatatgcaaaggaaaactcagaatgctattagcataatggagataaataaaagagacaacaatttaagtgcaaactcagatgtgggtccctccaagtatcaaatctcctcagagattgtctggtaagcaacattccaggattaccctggcatccggctctcttctctgcactttttcccctgaaagatatgccaagcaactccaagtactgttttcctggctttcactttacattattgttgctgttgttgttattattaatttcttttcctgagacaggtttatctgtgtagcctcaggagtcctggaactccctctatagaccaggttgccctagtgctcagagattcacatgcctctgcctcctgcgctccgggattaaaggactacaccaccaccactcttttatcttaggtttgaaatgaagtacattaagtgttttccattcatcctttgaccatattggtcttcctccctgactttacacccccgaggccccatttaccttcttctatgccctccctatttcttcacttgcccacttctgttttcatgtcatacagattctcactttcccctgtttaagattttgacacccacatgggagttggggatagggcatgcctttaatcccaacacttgggagtaagaggcaagcagatatgtgtgagttcaagacacacatgttctaccgacttcagtttcagaagagtcaacgctgttctaagaaaccctgttccaaaaaaaacaaagcgacataaaaaaaaaaaaaaaaagattttgtcagccgggcagtggtggcgcacgcctttaaatcccagcactcgggaggcagaggcaggcggatttctgagttcgaggccagcctgatctacagagtgagttccaggacaaccagagctacacagagaaagcctgtctcgaaaaaccaaaaaaaaaaaaaaaaaaaaaaagtcaaccatgtcatgtttccctttctggtttcaggattctcctaaaaagacacacacacacacacacacacacacacacacacacacacacacacacacacaaacacacacaatctagaccatgtaaaacatgtacatatgtaccatactaaacatagtacgtcattaataatgtacagtaaaaacaaactctcaaattcaaggctatttgtgtcccggaagaaaaatagtccataattatacatttgactttggcttttttagtgttcttatttgaaactggagcccttaaatagagctcccttcaaccaaagttaaaacatagcatgcgcgcgcacacactgcaatggtggcaagcctttctgtcacagtcccctggagactacttctgtacagacttttgccacccctctcgcgcctcctgcaatcccctgacctgtgggtttctcctgctttgtccactattacggttctatcctatgtggcttgtgtgccgaaactgatggaggtgaaggatgaaactggaccacaaatcacttgcagcagccctggttcctctggagtagcagactagcgtattagtcttcatgatttttgcagaatggtggccacgaacagtttttttgtttgtttggttttgtttgtttggttttgtttgtttgtttgtttgtttgtttgtttttcgagacagggtttctctgtatatccctggctgtcctggaactcactctgtagaccaggctggcctcgaactcagaaatccacctgcctctgcctcccgagtgctgggattaagtgcgccaccacgcctggctcccacgaacagttttagtactgttaatccttacgaatggccattctctctcgggtgtgaagtttggagatcgcttataacatattgctatgtttctcatgttaaaagcctgtgtacggtttgttacaagttgtccctaagaaactatgcaaaacacgccgatctctgtaccaaataatcggctatgctgtaacactgtacactgtaagacagttccgttaccacaggagaatgaaaagaacccgggactcccaaagacgctagatgtgtgaagatcctgatcactcattgggtgtctgagttctgcgatattcatccctcagccaatgagcttactgttctcgtggggggtttgtgagccttgggtaggaagttttgcaagttccgcctacagctctagcttgtgaatttgtaccctttcacgtaaaaaagtagtccagagtttactacaccctccctcccccctcccacctcgtgctgtgctgagtttagaagtcttccttatagaagtcttccgtatagaactcttccggaggaaggagggaggaccccccccctttgctctcccagcatgcattgtgtcaacgccattgcactgagctggtcgaagaagtaagccgctagcttgcgactctactcttatcttaacttagctcggcttcctgctggtaccctttgtgccatgtctgataacaagaagccagacaaagcccacagtggctcaggtggtgacggtgatgggaataggtgcaatttattgcaccggtactccctggaagaaattctgccttatctagggtggctggtcttcgctgttgtcacaacaagttttctggcgctccagatgttcatagacgccctttatgaggagcagtatgaaagggatgtggcctggatagccaggcaaagcaagcgcatgtcctctgtcgatgaggatgaagacgatgaggatgatgaggatgactactacgacgacgaggacgacgacgacgatgccttctatgatgatgaggatgatgaggaagaagaattggagaacctgatggatgatgaatcagaagatgaggccgaagaagagatgagcgtggaaatgggtgccggagctgaggaaatgggtgctggcgctaactgtgcctgtgagtaacccgtggtctttactctagattcaggtggggtgcattctttactcttgcccacatctgtagtaaagaccacattttggttgggggtcattgctggagccattcctggctctcctgtccacgcctatccccgctcctcccatcccccagtccttgctccgctctcttcccttttcccaccttgcctctggagcttcagtccatcctgctctgctccctttcccctttgctctccttgctcccctccccctcggctcaacttttcgtgccttctgctctctgatccccaccctcttcaggcttccccatttgctcctctcccgaaaccctccccttcctgttccccttttcgcgccttttctttcctgctcccctccccctccctatttacctttcaccagctttgctctccctgctcccctcccccttttgcaccttttcttttcctgctcccctccccctcccctccctgtttacccttcaccgcttttcctctacctgcttccctcccccttgctgctccctccctatttgcattttcgggtgctcccccctccccctccctccctatttgcattttcgggtgctcctccctccccctccccaggcctttttttttttggtttttcgagacagggtttctctttgtatccctggctgtcctggcactcactctgtagaccaggctggcctcaaactcagaaatctgcctgcctctgcctcccaaatgctgggattaaaggcttgcaccaggactgccccagtgcaggcctttcttttttctcctctctggtctccctaatcccttttctgcatgttaactccccttttggcacctttcctttacaggaccccctccccctccctgtttcccttccagcacccttcctagccctgctctgttccctctccctgctcccctccccctctttgctcgacttttagcagccttacctctccctgctttctgccccgttccccttttttgtgcctttcctcctggctcccctccaccttccagctcacctttttgtttgtttggttgtttggtttgcttttttttttttttttttttttttgcaccttgttttccaagatccccctccccctccggcttcccctctgtgtgcctttcctgttccctccccctcgctggctccccctccctttctgcctttcctgtccctgctcccttctctgctaaccttttaatgcctttcttttctagactcccccctccaggcttgctgtttgcttctgtgcacttttcctgaccctgctccccttcccctcccagctcccccctcttttcccacctccctttctccagcctgtcacccctccttctctcctctctgtttctcccacttcctgcttcctttaccccttccctctccctactctcctccctgcctgctggacttcctctccagccgcccagttccctgcagtcctggagtctttcctgcctctctgtccatcacttccccctagtttcacttccctttcactctcccctatgtgtctctcttcctatctatcccttcctttctgtcccctctcctctgtccatcacctctctcctcccttccctttcctctctcttccattttcttccacctgcttctttaccctgcctctcccattgccctcttacctttatgcccattccatgtcccctctcaattccctgtcccattgtgctccctcacatcttccatttccctctttctcccttagcctcttcttcctcttctcttgtatctcccttccctttgcttctccctcctcctttccccttcccctatgccctctactctacttgatcttctctcctctccacataccctttttcctttccaccctgccctttgtccccagaccctacagtatcctgtgcacaggaagtgggaggtgccatcaacaacaaggaggcaagaaacagagcaaaatcccaaaatcagcaggaaaggctggatgaaaataaggccaggttctgaggacagctggaatctagccaagtggctcctataaccctaagtaccaagggagaaagtgatggtgaagttcttgatccttgctgcttcttttacatatgttggcacatctttctcaaatgcaggccatgctccatgcttggcgcttgctcagcgtggttaagtaatgggagaatctgaaaactaggggccagtggtttgttttggggacaaattagcacgtagtgatatttccccctaaaaattataacaaacagattcatgatttgagatccttctacaggtgagaagtggaaaaattgtcactatgaagttctttttaggctaaagatacttgggaccatagaagcgttgttaaaatactgctttcttttgctaaaatattctttctcacatattcatattctccaggtgttcctggccatcatttaaggaagaatgaagtgaagtgtaggatgatttatttcttccacgaccctaatttcctggtgtctataccagtgaaccctaaggaacaaatggagtgtaggtgtgaaaatgctgatgaagaggttgcaatggaagaggaagaagaagaagaggaggaggaggaggaagaggaaatgggaaacccggatggcttctcaccttaggcatgcaggtactggcttcactaaccaaccattcctaacatatgcctgtagctaagagcatctttttaaaaaatattattggtaaactaaacaattgttatctttttacattaataagtattaaattaatccagtatacagttttaagaaccctaagttaaacagaagtcaatgatgtctagatgcctgttctttagattgtagtgagactacttactacagatgagaagttgttagactcgggagtagagaccagtaaaagatcatgcagtgaaatgtggccatggaaatcgcatattgttcttatagtacctttgagacagctgataacagctgacaaaaataagtgtttcaagaaagatcacacgccatggttcacatgcaaattattattttgtcgttctgatttttttcatttctagacctgtggttttaaagagatgaaaatctcttaaaatttccttcatctttaattttccttaactttagtttttttcacttagaattcaattcaaattcttaattcaatcttaatttttagatttcttaaaatgtttttaaaaaaaaaatgcaaatctcatttttaagagatgaaagcagagtaactggggggcttagggaatctgtagggttgcggtatagcaatagggagttctggtctctgagaagcagtcagagagaatggaaaaccaggcccttgccagtaggttagtgaggttgatatgatcagattatggacactctccaaatcataaatactctaacagctaaggatctctgagggaaacacaacagggaaatattttagtttctccttgagaaacaatgacaagacataaaattggcaagaaagtcaggagtgtattctaataagtgttgcttatctcttattttcttctacagttgcaaagcccagaagaaagaaatggacagcggaagaagtggttgtttttttttccccttcattaattttctagtttttagtaatccagaaaatttgattttgttctaaagttcattatgcaaagatgtcaccaacagacttctgactgcatggtgaactttcatatgatacataggattacacttgtacctgttaaaaataaaagtttgacttgcatacactacagttgtttcacgttaacgtcaatccccatttttaaaaatctttttggtttcgcctcatctagaaaaagaaaagcacctagcttaccaggacactaaacaaaatgctgttgggtaagtgtgaaccagcaacagcagcagcagctggaaatttgctagaagtgtatattctcagactctactccagaccttttgagtccgagattcttaaggtggaccttcagtagagatttctaagtgctctgaatacttaaaccttggagcaccattggtttgcagcaacaggggggaaaggctatgtagagacagccttcattaacttggtaggtggtatgtttatggtttgaatatcagccaagggcaaagatgctgaggtttgttgcacagtgaggaggtgatggcggtggggtattttgggaaagatgttagtgcattgaggctgagtccttgaaggagttatcaaaaccctacctacttcttactcttttgcttcctgctgccataagccaagacagttcaatccatcacatcttccttccctggttgaagggcttgtcaccagcaaacacagacctgctgaaaggatgcgcttatttcccagggcagctgtaataaaagcatgaactggatagcttcaaacaatagatgttcattcatttgctcgcagttctaaaagttgtaaatctgcaatgatgttgctggcagagttcattctttctggaggtggtgagaggaaatcctgtcttttcgcctatgctgactcccatattggcaacagtagggttacaaatgtaacattttaatcattttctccatcctcacatagtgttcttctttattagagtgccagtcagtgaatgaaggcttcaccttaatcctctactactttatttttttaatatttttaattagatattttctttatttacattataaatgttattccctttcctagtttctcctctgaaaatcccctatcccctccccctgctccccaacccacccactccaattccaggtcagggtattccccatatactggggcatacatagcaccttcccaggacctagggcctctcctcccattgatgaccaactaggccatcctctgctacatatgcagctggagccatgagttccaccatgtatactctttggttggtggtttagttcctgggagctttgggagtactggttagttcatattgttgttcctcctattgggctgcaaaccccttgggctccttgggtactttctctagctcctccactggggaccttgtgctcctgtaaatggtctttgatcatatctagggagcctaatagttgtccctatagcatctatctgtgataaaccattaaattcattaaggtgttaaggggagccacccagagatgactattaggacatggtttacagacacttggaagtcttaattctaggcagtagtggttatattcaaggacccaagtgtagccacaagcatttagagtaagaggcttttgaaggcaaaagccatatcctcagtatctcattatatagctacagtgggaggtttgtgcacaagctagcagtctaacaaaagctaagataagcagttatctggagagggttctgctcaagcaggcagcttactagaagctgttacctggggtgtcttgacctcaggttcctagaatagagttagatgttttccccaagaattctccagcaaggccgggtgtggtggcgcacgcctttaatcccagcactcgggaggcagaggcaggtggatttctgagttcgaggccagcctggtctacaaagtgagttccaggacagccagggatatacagagaaaccctgtctcggaaaaaaaaaaaaaaaaaaaaagaaagaaagaaaaaggaaaaagaattctccatcaaggagataaaattctagttaaaactgaagtagtcacaacaagattacaagttggaggaacttctgcactgactagaagaacatctacactgtcttgcaaaggtacaaagattccgtgatgactatgaaatacagagaaagggaaaactgggaaaactaaaacaatctattacatttgtaatgaaaggcatagacacacttaaacacatacatacttgtgtgtgtcatttatatattgttttatctttttcacaattccttctgaatactgtttgtatcattttatgtgtacataaatatgtatgcattcatgcaaacatcattcagaaagaattatgagaaggataaaacaccagatgaaagacagtggttaacatttgtggaacaaagggtagaattcacctggggatgtgcacagtgaattttaattctctttataagtgcattatcgggatggataacgacccgatggttataatatgctccatacctttttacaggctctgaactttttctgaattaaagagaaaatgtaaaagaagaaatctgcttaagtctgcctaaagaaaatgagagttgaccagagtaaagggttagagaaggtaaggatcgtgtatttaaatagaaatctaccctctacatgtagttaaggctgcctggattcctacatactggttcaataacatttcatatgttacatagcagtacatttcatatcttagtttatactattttttatatatgattatctcttcaccccatagaaggtaaactactaaagggttcagattatacatgaatttatgtgtatcttcttctccagctgcacttcaatttttttaggaagtatttgaagtgcttataatggtttgatttttgtatagatgttccttaactttaacatcctttggtgtctgtagagacaggaacttttagaatccctgacatctttttcctttttgattatactaaaatccatcttatagtaaccagaaaaatttaaatctaggtagggtaataagggagtagcgaatctaccaaaccggccaatccatgggtaggaagaagatttttattagagatatgagacagacaattgccagaggcttttgggaaagtacagagcagctatggatccctctctggagcagaggggcacactggccagggcagagagaaaggagtgggaaaaaaaaacacacaaactggtgagaggaactgggatagcctggaagcgtagggtagtgagggaggggcttacagcccagaggctttggtatgttgcggtcaataaggaagtggctcttcctggcagatagaatcctgttttacagattcctgaggaatgataagactgtcacaagactgtcattttgaggttccctttagacatgacaggcagcacttcctttgcaatgttattgacttcactactgcatttttccatcctgttgctataatttgagcctgaaatgtataccaaaggcctaagttttaagtttaatccttagtctttaatgttttgggggaaatgatgaaatttttaggaagttggccctattggcaggttttagattattggctctgggagagatgggagcttgatctctttgccttcatattatgctttgttgttttctcagtacctaaatgaacacataggtccagtcttaaataacagagcatgttcttggaggttgctatcttagcatttgaactgaatcaatgaagaggaccctattggtacctggggctttgggctacaaggacagcatacataggccccagatacagagactacatttgagtgcaaggatctctctatgtatgactatccccttaactgtcacccttttaaatttcacagtctttaaagctagagaaatggctcaacatttaagagtacttgcttctcctgcaaaggacctgggttcacttcccaccaaccatgtggcattggtcttccttctctgcagtaaccaggctgtagaaaagcctggtgcacataacacacacgtgagccactggactttggtgccgagaattgaactcaggtcttctggaaggactttaccaagtgctcttaactactgagccttttctctcacataaaataaaataaaataaaataaaataaaataaatcttttaaaagcccttcattagtaaaggagatcctgttacatatgtcaagcaatgctgggatacctaggaaagacattaaagttgtcaacaagcaaaagacaggaaggaaagtgctcttaggttaagaatttaactcaagttttttacaagaaaagcagcggatggaggttgaaaagttctgggttgtttattttcagtagttttgcatttatctggtacctggctccgggatgactggggcagaggagtatttcctcttaggatgtaagtcaaagaaaagcagagagaacgtattgcttggttaatttatgtattaaaaggcatgctttggttgggcctttattaactttgagaattgcctaccccagggaagaaccactttgtctcttccaggcagtgaggtgtataactagcattagtggttaaaaaaaaaaactgaaaatgtttataataaaatttattctctcgtgcttggcatcataatggagagtcttagagagtagggcaaaagtttcactaggattccaaatatttttaaaaggcaacataagtaaaagggatctctgcaggccaattcctaaccacattcccgttttacacttagcaaagtaaaacaggtaggcagcttttgggaactgtactaccttggtagaagtgtagggtgtgttagaaagtaatcaggcaaggcagccaggtctgtcagttaggttgctatggatatgaaatcacaaggtaggaatgtacatgtaaatgttaatgatgtttatggatattgttggagttataaaccgagatgcatgatgggaatctaggggcgagaagtgagggtagagtgagggctcctctatggaaggagatggggtggcatttttttttaacagtcccgaaatttggatgtcaggcttcatttatgccaggcatgtgttcttctgttgagcttcatcagggtctcactgtttccacactggcctggaactcacactagccagctgacctaaaacatgccatcctccagcctcagccattggagtagttatgagtagacttggtaccatcaggtccagtagaggtacaggttgtaacaaattgaatagatttgccttcatgcataggagatgtaggaagaaaagatgtctcagcaaacgttagcttcatgactgacaaacacactcacaacacttagattatcaaaagaaacgtatacaaattagtgtaaattttatatggtgtaagaatctccagaagtcaagactcagagctttagtgaaacttgtgtaaatttgcacttaaattttgtcaagagtggacactaatatagaagaataatcagacagaaggagcttgatccataggtactatgcctagggaaatttagcaaggcttgctaatttttttttctgattaaactaagagccttacacttgctagataaatgctctaccactgagatacatactcagcctgtattttctgttttgatacaaagttttgttaagttggttaggatgtccttgagctcactctgaagaccagacgactcttaaatgagtgattctcttgcctcagagctgtcagaatagccagaaaaacagaattgtgacactatatctggtgtgccttggcttctagtggtaatttgtagctatttatttgatcttcctaggtttgtggactttataattttacagctttagaaaaactatatttcataaaaggagctagaagctctttcatacaaaggaacattttatgaaattactttttagtaatttagtaaatgttcctattactgtgtttgagcatttcgggggaattttagcattaataaatgttatgcacactttaaagaaatgtattgatttttatgtgtatgagtgttttgtctgcatatatgtttgtgcaccacagacctgcttagtgggtgtggggttcagaagtggccttttgatcccctggtactagagttacagaaggttggttgggagcccatttaggggtgctgaaaatccagcctgggttccctgcaagaccagtgtgtgttcttaactgttcagccatagtctctcctgccccaacccatttgcaaaatgctttcaggactagtagtgaatttgtatcttcagtatgttttatcctgtttcactcgcatatatttcttcctaaaggttatttctcatttagggtagatcattttataggtgatattgcttaaatagttacttgaaactgaaaattcatgaaattgatctcatatgaaattaatctcattcttctaccagcaataagtaaattagacttgattttttgctatgcaaactctgttttaggtacacatattcaaattaccacatggaccataaaaccagtcgaaatagctcttctcccaagaacacatctttaccttaaaagggacataggagcacctgagaaagagaacacagtgcctccctgtctcagagcaaatgaaacaaaaccaagcagtgttttctcatgaaaacatgctccctgcaaatcctcattcattccacaaaatcaaaaatccatgttgctcctccagcagagtgggccattttatgttcaaaagttctcttagaactctccagtgcaaagtacagtatagatttaaatatgttaccattattttattttattaagaattatttatttatttatttcatgcatatgagtgcactgtcttcagccacaccagaagaaggcatcggatcccattacagatggttgtaagccaccatgtgattggtgggaatttgctatgcacactccagtgaagtctgcttggcaggccaggaggcctagaagtactcaggaggcaaagagtttcactgaaactcaacctcctggaaccttggcgttctcataaccagtatactcataccctatccccgtgttagtctggtgtatggatccacgtgctctcttttagtattattttattataagtgcctttaaagattgaattctgacatagctaagccttcgccagtgttccaacatcccagaaaatccttgaagctgagaaacttggaattcagtaggaattcagtgagaaggttatctattcagtaacattcaaatttacttctcatagagacagtgaaactaattaggcattacaaagaacagagctagaatagctcaggtctggtctgcagagttattacttaggacagtagccagtctcacccaaacaagggaatacacaatggcctagctaataggtggatttaccatgaaagagttggggaatcccactgagacaggaatcttcactgcagccaagtatagcaggctacattgcaaattagaagcaagttggtgaattcttctgacaaatggagattctccacagatacttaaaaaacagccaagttacacacatacaagaatttatcagggcctaggaaataggggggttgcggtattgcattattcatgagaaggtgtgctagagcagaaccccctggtgctagctttcacaaggctcaaaggagtagcacaaattgtgactagggtgtgaaatccttacctgtcattagctgaccctaggcaggactactttatctttactgtaaatattacctggttcctgtaagttcctttgaagtcattcctttgttttatgtcaggtaactgcaatgtactttgcctgctgtgacttcctaccccctttattttctgtattatataagactggtgttcactttgtgacaatacattcagattctacacaatctcctgtgtgcatctgtctgtcattcaccgactccttgtccatctgcaaccagagacccgttctacgcagacaagggacccagagggtctgctgcaggaatttaactcaggacctctggaagagcagtcagtgctcttaactgctgagccatctcttcagcccaacatgtaattttaaaattcaggtaaaaatcaaaataagagacctccaaagtacaatttcgtctgtatgtaaagcattcatatataaacagtagtatatgttctagagttttatttttattttctttctttccttaatttttttaacacagtgtccctctatgtatctcagaactgcctaaaactcactagcccaggctgggctcaaatttatggtcttcctgcttcaccctcccaaatgctaggatgacaggcatgcacattgaagcctggcttgataatggtatgtatgtcatttgtgtttcatttttgagacaaggtcttgcagatcaggcaggccttaaatctctgctcataccactgggtgactgggttgacaggcaagtacagacacagtttcctgtgtctccctggctggccacttccttcttaggtagagattctgtacagtccgtagaatgatctacagtagacattctttgttttgaatgagtgagtttgttaagtatataaccagccaacataaactactcgatagaaggagatcaaaatataatcaaacatgaacctcaaaacatctagcagggatccagtgaaaagctcccttaaagatgaccagcaaaagtactcaatggagggattgattccgtgtctgcgtagaccatagtgtccctcctgtgaagttcctaagtaaaacaacaaataaaataacatcaaaaaaagtcaagccctcacatcacccagaagaaactgagtagggaaatttcaggcagctggaagtcctgcctcaaattttgcttcctggctgaagctcagcttctttttcccaccccgctgcaggcactttcccatcccaggataactactagtagcatctgtgggaaagagtttgctcttctcagaggcacagtgtcttcacatttaggctggtctgctcttctctctcttccttgtcacagacccggaggtgccagccccatctccagacaccaggcttcagaagacatttgacataaacaagcttgtgtatgaactagagagccatggtcccactctcaaggccagtgtctcagtgagctcaaacaacagaacaacttaccagcaaaagcaaacgtacctccaggctggccttaaggttgaggcagttcttctgccttagcctcctacgttctccaaactggaattttttttttttttttaggttttctgagacagggtttctctgtatagccctggctgtcctggaactcactctgtagaccaggctggcctcgaactcagaaatccacctgcctctgcctcccgagtgctgggattaaaggcgtgcgccaccacgcccagctcaaactggaatttttgagttgtggtttttattttaatagtcctgagagatttgcttccttataccccgtgtacagactctaggtaaaaagagatcgttccttttactttctgcatgtcacaaaaggcagaccgtttgggaggagggcttaatacgttcagcataatagcagagtccatgcatgtttcctcatgtaattgtgacagtcaattagggctgagttctcttcgatctagtagatatcatttccattttaatgaagaagcctctgctgttaatgtaaatgaatggggaactcttccatggcttgggctgtaatagaagtatcagtccacagggccactggatcttcccaggtaaggacttcagttgtagtaagtgcccagcatatctcccgaggttggaggttggttaccctagaaaaaaaagtgtcatctggctgagtctgagggttgtttacacccaagtgtgtgggtaaaactgtttacttgcctatttggtccagaggatccaggcaggcagtcttggagtcgtggcactgattgttgctggggtattattgggataggcaaagtgagagctagagtggtttatctgcagcagttctcaacatgtgggtcacaacccctttgggagatgtagatcagataattaaatttcaatgcataacagtagcaaaattttacagctatgaaaataatttcatggaggggggtcaccacatctgtattaaaagagtcttttcattaggaggtttgagaacaagtgagctagttagtgcctcttattgctttggtacccactgaaaagtggaagacccagtatatagggccaatgaagattagaggtgagtaacggtgtttgctgttgcaggccatgtttatagatttaaccagaagcctttgatttgattggtcttccataagtctgctaaatccagggcactgtgatttcttgacttgttttagcattaggcatcactgccagtaagaagggattatagatgttaggaagcccccgagaaacaactgagtggactcagctcaattcagcattctccatacttgccaactcaccatgctgtatagcatctattgaccaatgagcccatcccaatatcccagctgatggcaaggtagcagtctctgttgtctatctgagagctgttaggaggcctaacatagtatgtgaaacctgcttagccataaaaattcacacacacgcactcgtgtgtgtgtgtgtcggtgtccaaatcctgttactcctactttccctattgtgtggaatcgtttaggaatgatatcactttccatatcatatgatacagtgcactactccatttttagtctctgttaggtgaagcttacatcccagcaggtaccttctatatagctcataagccaggaagctcatcaggggttagagctaggtccttaaggaaagacctggtctccgtgaaagaaagaaaatctattttctcctccactagagatacggtctcacattcttgactgttcacatttgcatgttctgtttaaggggcccaagaaagttgagggcaaattgttctcatccataccatagtgatactttactgcccttgcttctgaagggcatcaagagaccttgccactgtcataacaccttcagactcttggcttcctacctcccacctggcaacactttagttaactaccacactgagcaaagcccagaatgggtctggtgatttagagtacctgttcagtagggtaaaccacttaattcagaaggttgagaggaacagaaacaaaaactttcttttacttagtcactggcttagcccaaggatctggggaaggatgccctttgacagatgatttcaaatgatgccttcttgccacagcaaatcccagttagagaacaataaggtgacactaatcgtttatacagttctctctccaaactatgattaagagagaagccttggcctgacaaagtgacttgttatcttatttacatgctacagcaatccccaggaacaaagaaatgtcttctctacaaatgtccagggagtcaagaatgacctactgtcagatcagaggttcaccgccccgcctttctctatttgggcccacagggcaggctgacattttcatgaagctccatgtctctggctcccaatcagttgcagaagcattgcttcactaaaatgccaatgttgctgcctcattaggctaatgaggcacaggaggaggccataacaaatacaaagttgctagtatggagcgatgctgcactgacctgggagcataccaaattttgattcccaaccataaaacaccgcctaggagaaatcggtcaattgattgttctgctggctgattaatttcctgattaacacccaaattctctcctttcctcagcaccacttgtgctgactttaagggattttagggctgatggaggcaaaagataggctctccaaggtggcaatagcacacaaggagatttacttagagtacactttgaccggtttacacgagatggatagcccacataatcagagaccttccaggaaaagaaaaagcccaagatgatagggagatcagagagtggacctatatgtctccttgatggaatttggcaacagggtgagaagtctttgggtcaaggaatgcacacagcggtgtaattgggggcttttataatgataacctttaactcctctatgggtaacagctgtccggtgcagttttgtggggaatgcaaatcaggcagtcggtggctaaaatctgcttattttgaatatattgaaaacaactgagtgtgtaaaattcgagtttggtgccagccagcttttgcactaatgctttctagcttgccgtgaaaaagaaaacgacatagagtcagtatgcagaagtcctttgtatcttttatataccaatgtctatgttgtaaataagtgggtctgctccagtacgagtgcttgtagttgtgtgactatataggtatgcatattcatgtatatgagtgaatatataaacatatatttggctattttttgtctctgagtatgcattacatgttttgtgtgttgttaatatgtgagcatctgtgagtcagtttctaaatcatgtgtactgatcctagtatgtgtttatttgtggataaatgtgtaagcttgttcgtgtgcagatatattagtaactaaatgtaagcatataatatgtgcatgtgtgtgaatatgtgaacgtaactttgtatattctcatgtgactataaatgtctatttgtataaacataacagcagaaggatgtctggttgtgtgcaagtggaagggaataagcatagaagtgatgtgaatatgtttatgatgaatgattatgtgaatgactcctactgtgttaatatacagtcaggatcatgtttctgagtgaatgtgcattgtagttataaacaaaatcttgtgtagatgaaaactttcatccacaaagtatcctctgcatgtggatatattcttgatttggaaagaattatggtggcaaatatagatgtgaatgtgtgcctgtgagtaaacagtaaatatttgggtgggtacgtgtccaaattactgatatatttgtatgtttaaccagcttatctgtgtgaaggagtacacaaaaatgtatcagtgtaagtctgataataatgtgaatgaaaatgcaggcaagtatccttaagagattgcatgaggattttcatgttcttctatattaatatttagtatgtttatgtgttggtgatcagttttgtgtgagcacaagtatgtgtggataaaagttgagcattcatgttttgcttatgtagcgtgtgtttctatgaattgacttataagcatagttatatgggtgatttaaactaaaatgaacattcatttgaaaatcagtatggaatgacttctgcaaatttgtgtgtatgttcgttcatctcaggcatgcctatatattctaagtgtatttatatgtgttgatgtataaacaagctcaaagctgagagttgagtcagtggttaaaggaacctgttgcctttgcagatgacctgagttcaattcctggcattcacatggttagcccacagtcacctctaattctagttctaatgcctcctgtcttacctctacaggcactctataaatgtggttcacagacatatagttacaaaaatccatacacataaaataaatataagtaaagtactttcaaaactgtatacagctcatgtgtatgagtgtgacaataaataattttaagtgaaatgaaggtatcagattaagtgtacatttgtgtgagttaatttgcaaatatgtaagtatgttataccttcaagtgcatgtgagtatcttgagttatgtgtgtgaatgaagaaattgggtatttgtatgggcattttcacataactataatttttatgtgtatgttaaattaaaatatattgagcaaaatatctgtgcatatagaaaataagcttattagtatatgtatcttgatatgtagtcctatatttaaactaaaatgaacattcatttgaaaatcagtatggaatgacttgtgcaaatttgtgaatatatgtgttcatatgtaagtgaatctatgactacttctgtgtgttgtagtttcaatgtgagagtgtgattgaatatctaggaatggaatctaagtgattcttccttttgaagttgttcttccagcctctgtgttattgcctttcagcgataggactcaaaatatgaccacagattttaaaatgcataaagccataaagcgaattcacagcgcatgtttattattttttgacagttcaaagtggctatcactgggtctaaagccaagccattcttccgtgtgtattacatcatactgctgttatggaaatatgcgtgaccctcatcactctgcctgctggcttcactgtaggctgactgcccagaagctgagctgcagaaacaaatgggttatttcaagtccagtgcttcagaaagcaagtgcaattggacatgagtgtctaaatgactcctgtgaagtgaatgcttccccatgtgaggggaaaagccagatttcagtattcaggggtattgtaaacaaatgcttgagaagtgctatctagttataagggcttcctacagcacagttcttgagaataacttttgaggccccttgcatggctgtatggaattgtagctgtgtttggcagttagtaagtgagattaaattgccagctctgtcctcccaatcccaaggtcagacttcttatcatagatcattttgtgtcatttaagaagaagaaaaaaaatctgtggtcccttttggtggaactctgggtgaccttaaagttcaaacacagagccctggctaagggctcttggatgaaggagcaaatggaagccgaaatgacatgtgcttctccagaccatgtagatgtaggccataaaaatatttccttaacaagagtggacaccttctgtgctagcaaataactcaagtattcccacatctctaatgggataattgaatggaaacctccagataaattacctaaatgtttctttggaaggatggcttcagcctaatagtgcagtcctccccaaggaacttaagagggcaatacaagaacaatttcttcccagtgctgaaagggtaggtgcacgaagcatccctcactctacaacattgtagtgtctctgccataccaagaactaaaaatgaagcctcggggagctgcttttcagagctctgtgacaatccagtttgatttcttatctgctcctgtccctccacccattgctccagcccctcttctcaagaaaacaataaacctcctacttgaaaatgacaaggacagagtcacctaggcatttgcctgtggactctgagcaaagtgaaagaattctgggtaggaattcaatataggaacctggaggcaggagctgatgcagaagccacggagaaatgctgctcactggcttgttccccacagcttgctcagcctgctttcttatagcacccaggaccaccagcccgggagtggcaccagccacagtgaactgagtcgtcccacatcaatcaagacaggacaccacaggctgatgtggtgggaacatttttctcaattgaggtgctctattacaaaacgactcaagctcctgtcaagtagacaaaaactagccaggacacttaatccattttcatatttcaacttgacatacaaatgcatttctaattagctttgaactttccttccttgatcacccctaaagtctcttagtagtagtaataatatcacaataagaagcattgcaacttttaaaagggctccagtctttacacatttgagcgggttagaagttcaatctctttaaagcatccaaagtctctttcaaagtttgcctctctaaaatagtcaaagtatctttaaaaacaatacccatcgtctctccaaaattccaaagtgtcttttattgtgctctcttataaaatcaaaataaaagtaaatactctgttattccaagtggaaatgaaatgaaatgaagacatgactgtccctgggtatggttgaagaggtggtttttgttatcaatatgagttaagaataccaccagaggcatctggaagagtccagagcatggagaggggagtagactgtatcaggtcaggagaggggagagcaagagaggaagattaataaggagggggagggaacaaaaagggaggaaggagcaaaggggaaagccaagggaaccaagagatatttttgtgtggcaaaagtggcagtcagaagctcaggaaagggaaccaaagcccatgggctggagagggttaggtcagtgtgaacggaacttcggggagtcatgggtactgagcaagccttgtatgctaataggtaccatagttagccatctgtccccaggttctttaggatctgacagaaataaccaaggcacgatgattgttattggggagtccgccagagttggccactcagacactgtttgcagtcaatttaaattctttattccagctggttgggactacactcagatactcagaacctaagttataagcctgaatgtctagagcatggggattttaaaggcaaaaaccacatcctggcatctggctcgggagctgcaaggggttttacagaagcaaacagtgcaacagaagctaagataagcagttagccagaggaggtaccacccaggcaggcagtttaacaagctaaaatatacaattctcttgagaggatggtttgcacaaacaggcaagttaacagaagctaagttaatcatggtatcttgacctccggttcctagaatagaattgggtaattttccattggattttctgttaaacctgaaatggcttcagtaggaatataagatggagaaacgactgtattgtcttgccctgtcacatcataaagcaaaactaaagcccaacagtattaaaaacaactcaatgtcagacacccaggattcacttatgaattttctggactccaaacggcttacccccttacgctcattgtctcccaggctcaggttagctccactccacagctgctgctgttcttgttggtgatctcttggtactggcataatgtgctattctgtttgagaaaataaaagcagctaataacacctgcaactgggtcacaccttcattactaacttctcctggactctctttggggactgtgaacttgctgcttgatgccacgccctgtctcccctctccccccttctctccctctctctccttcaattctgaaatcgaactttggctgccaccatgagatacagcctaaccaccctacacaccctccatacataagtttctatgtgctgacactctggaaatccttcaagactattgcagcccccaatgatgctggtctctttcaccactgctaattcttcagctctagctaaccagcattgattgactctgtatagccagggtttcactttaatggatctggtctctcattgaccacagcaaattcttaagccctgtttgatccgaaacacagattcttaatgctcaaaacatcagacatagctgatagtatttaaggaactcttacacttccctctgaaacttcacagaccttgcctccatcatctgtactactcccagcatcttctaagttcccaccaaatagcagctcattaaacattgagcagtcagaggtttttctagggtcgaaagaatgtgtgcccaagtgcctgtcctatagtgcataacaagtagagaagaaaactctggcttgagaatgtaccctacgtatctagatctgcatgttatgttccttttacacacaaacttttggcttggtaccttcacaaggagcagagaaaggactaaaaacctgtacatatgaaagcggagggatgggtgaagcaaaaagcctaaagactggatgtctctgggttgctccactcactctgcaggtgcggaggcacctggggagtgtggccggtcaggttattgagtgaaatattttacattgttagctcaatggcctcaaaaggctctggctaatagaagagttgaaatctgctctcagatggaaaccacatcctgtcagcacctgtctagaccccgtgaaccacagcctcatttgcagccttgattttacttgaacgtgggagctgccaatcatcaggaaatgccctatgctcagaacatagcaatgtctcaagcagcagacagcatctcaggcatcaacttccaggggcctcctgcagacatgtagcccagcccagtctgtcagaagcacatacacccttcttacctctcccactgctgaagcaagtagaagcagcagcaatcgggcagaatggatgttcccacacatgttttttttttcccccagaggctggaaaacagtgattcggtgcatgcatgttaccagacaggatacggtgttaaaggatacacattctaaaaagtaaacagggaggaagcagccaggtgggagcctcagagaaacgcactgattcaactccctaaagagcataacatgaagtcaaaaggagcaaattctccagagtggtgggctcttccttccaggggtacccgattcatttaagaaaagcagcctactcacagtgaccttctgagctgagccacactgtttatgttctctgctcaaagccacatcgccttatcttgatggtatgaagtgccaattccacctaagccttgttcttgcacatctgttcccagggctgaatatgtggcacaaggtgcagaaagagcatcttactcacattgcagaaatggatgatgtttattcagtaaaagcgatctcagattcttaagggggcagggctgtcttcgcaaagacctgttttcagtgaattagcattttactaatcaatggtttctagtctggaaatgtcgaagataatgtcatatgtgcatactcagtgatagtgcgagggagctggctttttcccgagttccctgatttatgcactccaaatatccaagattattatgagtaccgttttcttccaaagagcagcttgtgagatcactaagagcctgcactgtgtgaaaatctgctgtacccttgtccatctacctattttgttattggttcatgttcactttgggtgagccttatacgaacatgttcttcattatttttaacataaaattttatttttaataattccaaagtgaggaggctgggaagatggctcagtgggtaaaaggacttacagtacgaatgtgaagacctgagtttgatccccgtcatgcatgcaaaatccaggcatggttatatatgcctgtaatcccagtgttgggaccttgaagccaagtgaatctgagagattgctggccagctagcttggccaaatccataaaccaaaggttcagtgagagactgtctgtcaagaaatagaacagaggatggtaaggcaggacacctaacattctcctctggcttccacacacaggtgggaacaagccggcgcgcggacacacacacacacacacacacacacacacacaaacatgtaagcatcacacacacacaaatattctaaagtgagtacttgaaggccttggttcagtatcctcttgctattataaaatacttgccctgaccgtggggaaactccctcgcagataccatgactggatggctcttcccagcttttcataaaatggaggactcccttttgcagcagagagtcccttgtctggggagcctaaccccacacagcctctc

SEQ ID NO: 96 - DNA, 7973 bp, Mus musculus
cagttttctgttaactttaataaggacaaaccagccagtgactgtactgaaataaagatttacagcaataattgtaatcctatgaccatagaacaatagttacataactataagctatagttatataatttaaattatgtagttggtaattacataaatcacagacaggcatggtggaaaatgaccataattccagctcctagggaagctgaggtaaaattcacaagttccaggccagcttattctacgtagtgagttccagaccaaccagagctacatagaaagatcctgtctcaaaaagaaaaaaaaaacatactatgaatatcatatagggatagaataattaggataacttgtctgatctaggcggacagcttgtatcatacacacacacacacacacacacacacatatatacatatatatatatatatataatcattttttaaaaccactttaaaatatcaggcaataatacctggagttggaaatcaagcaggtgtcctatcattgaaccatgtgctcactttgtgaacttagcttagaaaaactctatacatcttttcattgtttttatgaatattcattcaacaaggtatttaattgaacaactggttaatttgattcatgggctttaagtgctctaagaatgttgtgtagccctctatgttttactttggcctcaggccactcaattctttcagcagaacttaaaagaacccaatgtggcaggattttccctgtccaatctatttaaatattagagcagcaggaggcctgtgattgttgagggaaaagggaggcagcactaagagttggagaggcagagagtacacagagagtacaggagagagggggcggggaagaagccaagatggctgcagacagacaggaagaagatcctgatcctgcatggttttaaatagccacaggtagttatgaatatcatatagggataaaataattaggataacttgtctgatctaggtggacagcttgtgtcattatcagttggctctgaaattattgtgtgggcatcttgtgaattgagcatttattgatatataaatctgacttgttaattataagcttctagtgttttgttttactggcttactggaaggtttgaccgtcaaccacatggggatgatagctgagagggtactggaagtactgaggtagtgaaccaaatcactgcggaatgctgcagtcggttactgatggggcgggtctagaggcagaggctcagggaccaggctggggcagtaacagggaaagcctgccagtcttcaaatatttgccacaacaccccaaaggtatggctatcttcacaaggtcataggttgtcactcaagatattaaactccttactgggccagcaatttaaaagaaaacactgttttaagttgatataaatactttgaactttatttggactaccaaaaagtaaaaattcatttctacattcatcatcagaagtaacacaacttttgatgttctttaaaaaagaagaaaaactaagataagctttcatatggtaggcatttgatccatcttgctaatgctagttaacttacagaaaagtatgcatttatcgttacaacatttcaagtcttaacttacactagagtacaaattacaacgagctattacactccacaatattatttaattggtattttacagcaaattggagtaactctaacagccatcacagaggtataaaccttaagatttctgctattaatcagcaattatttctcatgtcctacaaggtcatgattaagacaatatcaaactctgatttgatggttggcattatggctaaacagcaaagtgttaggcaggttcccgtcaatcctgttgacacctctcagatcatgacatatacacaagaataattgtgtcttccagaagccaatatttacataattttctgggtattcaaattaagagtatacttctgagctcgatccatacacaaataatttaatatttgaggtggttcaaatagctctgttttcagagatgtgtgtgataagattatttggaataaaagatcacttaaatcctattgcttaggaagatgaactacaaatttctttatcttcacctgcaccttcaattggaaagatgaggaatgaaaaatgtagtcttcgtctgattctattctggtgaaaataacagaaggcttagatttcaagtcacttaccatctaactaccttttcctgaggcttccagacctttcacttgtctggacctgttctctttctaatcagcaaacctctatcagtacttaagtaggacacagagatttcatctttatctgcagcccgcagaagtatctgtcaaagagccccacccctctgtttccaaaaaggccaaagcctatgttccagttaggtttctgtgcctgcgatgaacactatcacctaaagcaactcagggttggaaaaggtttatctggattacaggttatagatggtcattaaaggaagccaaggcaggaactgaagcagtagtcacagaggagtgcagcttgcttcctttaaccttctcagtcaacttccctacagaacccaggctgtccttgtccacactgggctgggccatcctaaaccaaacagtaatcaagaaaatgcctgacagacatgcctacaggccaatgtgatggaggcatttctcaggtgaagttctctcctcccaggtgactctggcagcccatattaaagtgtttatatcatctatccacactagatgttttagagtgaaggtgattatgtggaagagtctagcttactatgtgcagtgccactccagggctgggttgtataagaagactggctgaacacaccataggaacaaacaagtaagcaggacttctccatggccctggcttcagttcctgtttccaggttctttgctttgaaactcctcacttctttttaggatggactacaaccagaagttgaaataaaaccctttcctcctgaagttgcttttggtcgtgatgtttaatcatagcagtaaaaagcaaactaagacaaaagttggaaccaagagcagggaatgacttgacagatctgtctgtgttatttaggggagggttatggaaggagtttgaactctaaggctggcaaaaacaatgagtgaatgagtgtttagggattaatgagctgttgtggagacttggaagataactgtgagaacagggcattgtcttggagacaatggaggtctgacttggggcacttcagagggaagtttgagaatccctcaaagtttctagaggagccgttcatgtgatgttttgtattaagaatttggtgttgccatttggagctaaagaatcggctgggattaaaaagagaccaataccagtgaagtgaaactttactggaacaaatgacccaggttagcatgggttaagtcagctgtgtgattaagaagacgtcagcatcattgaagctgaagtattttctcctggtcagcacagagctgctgtggtccagacagggccaaggctgcaactcatgctgtcaggtggatttggtagtgtgtaaaagtctcctaggtgacattgcttttaaaggcatgaagggattctggagaatagctgaggcttgacactgtgagagccgggtggggagggcgttggtgaaggtgcagcctcacttacagtggcaaccccgggatttaaagggttagagagaggagctgaggcttggcactccctggagagggcccagaagtggctattcgtgaaggttcacctaaggtgcagtacagacccaaacataccggacactgcaaaaaaaaaaaagcagcaagtgtcaaatgctgttggcctatgttccaagagaagctgtatgctctgtgaatggcagaccctgacaggtggagctgcccaagctctttggagcccagaacgtcgtaaggaatccgcaggtgcaagacattgagctataggatttgatttacaccgttgaagcttggttttgctttaatttgattgtgactggactttgatttgtttccctcttaaaataagatgtttaacttctttttgattttcatgcacccacaattaataaataaccttttaaaagttgggatgtttatattattatattgatattactatgggatcttaaagataaacaaaaaagaagagattacttttttaaaattagatattttctttatttacatttcaaatgctatcccgaaaagttccctatacctcccccccaccctgctcccctacccacccactccatttcgtggccctggcattcccctgtactggggcgagttgtgttggtgtgccaaattgacaaggggccaatctctctggttggttttactttattttatttttttcataacttgacacaagttagacttaacagggaagaggatttatcagctgaagacattcctccataggactacctgtaggcatgtctgtagggtattttcttgatgaataatgaatgtgggagaccccagctcactcagtaaagtgctacctctgaacaggtggtcctgggttctctaagaaagcaggttgaacaagctgtgaagagcaagccagtgagcagcatccctccatggcctgtgctttggtcccagcctgcaggtttctgcactgagcccttgccctgactacacttcaggatggactacaactttaagctgaaataaactattttctaccaatgttgtggtgttctatcacagtgatagaaatcaaagcgaggcatcagtcttcttgaaattttttttagtgaacttttctagtcttcttttgagttctccacttgcagaaatgcctcccaagggtgcttaagcattttgctactggtattgttttgacgtcacagatgacctcaaacctaggttttaatgacattccattattatctagccttttcgagaatctgatgttttcttgctgctaatagctccttagccatataactccaatttgaactaatcataaccacccctccactccccatttcctctttagtcaacaaaaaaggtttgtactgcctgacaataagttaaaagggcttttctggtgattaggtaaactatatcttatccaaatgactttttaaggctgagatgattcatgtgataaatattatcaagcagttcctaagttattagcactgtgtttagtgctaaacacatggggtacacaaggtaagtagtctaccagaccaatgagggtgctgcagagcaaatgagcaactgcagtatgacaaactatatgaagccagagctctacaagctatgggagcccacgggaggaacaactaatccagagttggaggtcgtggaagacaaagcagatggttagcatttgtctgcttatgcattcattgatttatttaacaaaaaatagagaggtggtatacataaacaaggcattacagaaactatgtttctattaaacattttcaaaatctagtataaattcaataagttcttataatctagcacaaaaaggtgacattacgttaaatgggataatacatcattaagggaggttttacaaaaatatgtattctgtatcagccggggttctctggagaaatagaattgataaaatgaatacatatactcatttatatgctttatatacatcaccatatatacattatatattatatatgatttatgtatgtatttatgaatatattatacacacaagcatacatatgggattaattagagttgcttacaggcaagtccaacgatggctgtctatgtctgtggagtccaagaattcattagttgttcagtccttgaagctgaatgtcttagctgttcttcagtttattttggactccaaggtatgaagttgccagcaaaagcaagagcaagcagggaaaacagcaagtgcttccttcttccatattctattcaggctgccagcaaaagttttggcccagatttaaggtggatcttcctgctgcaaaagatctggatttagggtgcatctttccacctaagattattcaatcaagaaacccccctcattggtgtacccagccacttgggtttttattaaattccagatgtagtcaacctgacaaacaagaagagtcgtcataaattctgtgtggaattctgcttgtccctgcaggctaagcacatgacagagctaacagcatgccagaattaatagagacgtgaaagaatatgaattcttcttacctgcagtacagctaccaagtgtgacaaagacatgaacagagattgacaatgagtggacaggacgatggtcatgggatcacaaaagatctgtgccattataacagggcaggacttattctagaaacatgggacaccattgggtagtttccagtctggaagtggctgtttagatttgtaagcatgcagtgacggaccagaagaggaaacgctttcctagggctttatctgctgtaactacagcaggattttcactgccattttctctgtgaggctctgggactgaaaatattcccaaactgaggtaaagcaacccatcatcgcattggaatgtgcttggaaacttctagctaacccactctgggaatctggctacagagttggttctgattagctttgtgtaactggttgaatagaatttgtaccaacctgaatcagaccctttgaagcttcctctttgggttgctgtgaggattaaataggataagacatgcaaagcccttgtcacataagacctcatcaaatattagtctttttttttaaaatcacagttaccccatcatatatccccatcatatatccaaacagtgctgtatgactgtgttcagtatatgcttactgaaaaagttgtctgtctgtctatctatctatctatctatctatctatctatctatctatctatatttcttgccattagcccaggatacctggagctcactatttaacccaggttgacctccactgctccacagttctacctcagcctccagagtgcttgacttacagattccagacactatgatcagctattaagtaacaaacaaaacaaaacaacaacaaaaaaagttttttaaaaaatctttttttcagagatccacgttattatagctactcttcacgggtagaaagtcttattgtcaatgaagaaatgggaaatttcgctcaagaagctgttccgaatcacattttgcctgaggaaacccctgtgaggtacatgcagaacaatcattttgactcagatactctaaaactagactcgttgcttttgaactgggcttatgacaggcacctgatgcttgctgagttgagaaaagcatataagatgctcttaacagatgctggctcctaatagtacacacacacacacacacacacacacacacacacacacacaatagcaagtacttcacaaatagggaactattattcatgcttcaggttttgataaaactgtccttaaatgagctatttttctccccatgaaaaatgtatagaaaagctcattgtctttaagatagtttcaaccaggggcctagcacatctgctcacaagcagctcactgccccatgtgatgtattccttcctttagattggagcaaattactcttcgccggtcaaacttatgagtcaactgcccttgggcttctctgcactctgccagccacagccggtgcacccaaaccctttccatgcgaatccactaaacaaggtttccctggacccaatatcattccctaagagagtaccctgcctaaaaggtaacagagaaggctgaaccactcttgggcccacccctcctcgcggcagcagccaatcgctttgctctgtagtgcatccgaagccttggattggactcgctgagaccgggcgcgggagtagagcgcaggggtggagcgcgaagccttgtccatcacgtgcggccgcggggtctctccgccttcaccgcgcgccccgcggcgccga

SEQ ID NO: 97 - DNA, 34455 bp, Mus musculus
atctttattcattcttatctttgctcccgctgcagatcttagctccttaaccattcccttcgaagaggaggaggaggaagaggaggaagaagagaaagaagaggaagaaatgtacaatgacgtcgatggctttgactccccaaggtctggctcccagtgcagagccatggccttgcctgagcctactgagaaagaggaggacatttatgaagtcctaccaggtaagatacatcaccggctaactacccacctcctgctgctcagaaaaacaacaacaaaaacaaaaaactcttgacatgcgaaagaacgaaacagcccccaaagttatccctattcaaggttcactgtctgaaggagatggtgtaaaaagcccggtgactctgccttgttctgggaacaagatgaaatcctctttcagcggtaccacgtgacgtgacgtcacttgttcttgagccatgaaggttaaaggctagagaccactccctctgtttctcattggctagctgtgagtttgggggtgcgttctcataactctctagccctggcttactttctgtagaatctggagaaggataaagcattgtctcaaaggtacggaggatttccaaagtctggattgtgcagatgccaacaatggtcttgatacagtaaaactctgatagaacacacctcatcatcgcccagagtcaaatctcatctcctcagagtaagcctaccctgcctcgcctctccccgtgctggggccggttgactctggagccctccccttcacaaggcaggctcactagcatctcagaaaacgcacagtcatcactgttcccgcagagccacttctggtgggaatccagcagctggtgaacagtacagaacacagtgggggtcagactggaaagccggagcctgagccttttaattgtgaggtatttagacaatgggaaagctgaatcttcaagtccattcaggaagcgctcctgtggaaatttgccaggagtttagtactctgctaagaaattcaaattaagccaaaatttatagcaatttaagcctgcatcccagatgaacctggaaactaaggtgaacccaacacttaggccccagaagacagggccccttgctaaaagcattatcagtaaataattgcatctcaaggcttcctaagaggaggacccagccttcttaagtaggtattccctatttgtctcttgcctgagagacaagcgacgtcattgctctctgagtcaagttgcaagtctgtgtgtcctcaaagccccaccaagaagtgttcaatcctcctcagtcctccagcctctgccagactccacttcccctggcggcggcggcggtggtggtggttgttgttgttgttgttgttgttgtgttttattatgcaaatgatatcttggttgaggtcgagccatttcttgtgtctgaagttaaaaaaaaaatgataatttcctcagcaagtcatcgtcgttaatgaagttttacaaaaacagatacaaccaaaggaaaataaaatttcacaggtgataaatttttccaatttccctggcagaattcgataggattgttaaattaagagtgaaggtgtctgttaggaagcaacgagcggtgatgggtaattttatagagtggaaaattgaatcaaattgctacattaaaacagagctcctccgagaatcttcctccacagcctgtgccattgcaacagcagggtgcagaaagcgatctaattcaccacactccctaaaaggagatgctctccccagcttggccaggatcttcctagagagctcacgccagcccaggttcggggaaagagccggatgaggcttcacctgaggttccaacgatctccaagccactctgccttctgggctgcagagaaaagctatgtgatgcccaaagaagccagggaggatgaaactgatgctgggggggggggggggagtgaaggagagagaccgcaggaaacaggatgggattccttactctgggtcagaaggaaggactgtaccaccagcttctgagtgaccaagttcatcctgcctcctaaacactgctgacaaacaagctgaggtccctaaaatgcctccaaacctcccactgcttatatacaagagtggagccgggggctggtgagatggctcagtgggtaagagcacccgactgttcttccgaaggtccggagttcaaatcccagcaaccacatggtggctcacaaccatccgtaacgagatctggtgccctcttctggagtgtctgaagacagctacagtgtatttacatataataaataaataaatcttaaaaaaaaaaaaaggaaaaaaaaaaaaaaaaaaaaaaaagagtggagccaacggcatggagcttagtcagcctcctcaagcagccactaaccctgtgcccacaactccagtccacggaaattgagggaaccacactatagaaaaggtgggatctctttctgcaggttagaaggacagcagctaccttgcctgtgcatccaatgaacagaagccactatacaccacagttcttacagacagcatggggtggggaggtatatagtcatttaattatcatgtgattatttcagccacatgtctccatcatccaagctctctatcaccccaccattggtgcttctgaaattgctctgtgcgttctgcctatgccacaccacagtcctaaagaaatggagaaagaacgtgagggggtccagcctcatctccccacccgggagctcccctccccgcccccacaaggccctggcatgccagccactatctactgaaaaatagcatgtgagggacaactagatacaacaggcacagagctggctgtaactcggaatggatctacactgccacctgctcactgtgagaactggagcaaactccttgccctgtctaattgtccacttgtaagatgcgcaaagtgatgacgtaacttcctagagggacttgaggaggaaccagagagtgatgtgtgtgcacttagcagggagccctctggcaaagaaacactccacacgtgacaatagtgtagacctggtgccatttaataggaaatattacttcctcatcaaagagttgggggatggctaggtcccaccctcaccagccagacccaagacagtccagtaaggcacttgcggttgattatgtgtgtgaagcagatgtgaacccaaaaatcctgaacagatggactgtggagaacaccttctgctcctgcccttttatttatttatttattttctaatcaagaggccaggtgctggatgaagggacagccaatagtaacactggagtgtacaagcactgcacactcaccaatagtcacatggcactcagatctctagtgtccatttcattatagcaggtgaacatgctttgtgaaggatgtttagtgtaggcaggcatgctggtcctgctctgggtggggcctatgggagtcctcactgtgcctatggggaaagccgtgtaaatgcagcttcctttcccgagtgcaatagaaaactgaaaagaatatgcaaagtataccaagtcaatacaaaaaaagtcttcctaaccaaaataatatatgggccatcaaattaaatgtgtgacatcacattagtcatgaggtaattagcatttactctatggctagcgctcttgtccccaagagggaaaccagagcactcaaggttttcagccagaccacagaaaaaaatgttagtccgggctggagagatggctcagcagttaaggacactggctgctcttctagagttcctgagttcaattccctgtacccacagagtggctcataactgtctaccacagaatctgatgccctcttctggtgtagagacatacttgtagacaaagcacccatatacataaaatatataaatagagagggattggggggggggggggctggagagatggctcagaggttaagagcactgactgctcttccagaggtcctgagttcagttctcagcagccatgtggtcgctcataaccatttatagatgagatctggggccttcttctggcctgcagacacacatgcaggcagaatgttgtgtacataataaataaataaatctttttttaaaaaaaaagttagtcgtagaaaatatggtttatattcactaggattctgagattcttgttgagaatatagggacccttgagttttaggatttcatctgtagtagattaaacttcagagaatggcctaaatgcagtatgaaagccagatgttaaaatagaaggctttggagctggagaggtggctcagtggttaagagcacttgctgctcttccataggaccagggttcagttctaagcacccacattgaacagctcacaactccagctccagagggcttgataccctcttctggccaccttaggaacctgtacatgctatacacgtgatacacacacacacatacatatatatacacatacacgcacacacataaaaattaaaataaatcttttagaaaacatttttctaaaaattttcacatcttctttgaagtgacgttaatctgcagatgagcgcaatcccagattcaaaattccatataagggcattttttaatctgatcctgcattatctgggccctcaaagctagaagccaggaagacatctgagaccactggagatcactgccccagagggttactacagacccagaaaccaaactgctttatagtaaagcatataactaggtttctttttaattagaatcaagtggaaacaacattctgtaggattatcttcccccctgcatagctgtccagacacacaggaagaaggaacagtgatagttaaagatctaaagaaagaaaaatgcaaacaaacccaagcccaaaacacaaaacagacgaagagtcggtgtggtccctagcctttttttagtttcttggcctcttttcttcctcatccctggttgctctgtgtatgtatcttgtctgtctctctgtctgtctgtctgtcacctcacactcttgagcagcagccatgggggcccgctggaaccatgctgtttcttctccctagcatgcccctctagtctctgcctgggaagtgctgcactctgctcaggtgcatccacagatgggacaccctctccaccaccactgaaattaaggtctgtctctcaccgtgctgatttgtagtcttgtctctctacccagttagcaggtactcggttattatttgtagaattaaattctgtgcaatccaatggttggtattagcacaaactgagtttaatatcttgcagatcaaccataccacagagattggatggagggattgagaggcaacagttaagattacccaatacacacaatacacagcagagagtaaatgtgttcttagcctcctgctcatatgttttattgttgtgtagagagctgctatggcatacaggggtctatgcctggtctggccttgccagggagtaactcattcctactcttttggatggtccctttacgtgtcaagtctccctgtatttctcttgcatctgtcaccacagcaccttgacatctggctgcacattaatacgtgaggcattttcttaaagctgttattgtcactttctgtgtggggaaactgcttttccctccttttgatgtaatcatttttctcctgctattctttctggtatccgtttaatgagtgtcaggagtgggtgcaagagccacacgtcagaaaagactcgggtgtcagaagcagctagcacctcgctgtccctcctaggtggattcagtgtcctgttcctctcagcctctcattagcgtccctgatactgtgccaagaatgttgattgaaatcgagtctccggatactgaggctcatttgtgatgccccatggttccctcacatgttcacacagttaacagaatcttcttcaactgttttcccaactgagatgagatatttggggatcaagtggagcatttaatgtaataagtgggcagtaatcttcagaggttaatttgtttaaagcctgtgtgagattggggtcccatatgccccgttaggagccaggaccattataatctattactatttaaagttgagctagcacataaattttaattctctcttaaatgaagatgtatttccatggatgtaatgctaagatgcctaataatattcttagaaagaagtccaatgagctctttaacctaaagaaatgtttttgtttcaaaattgtcttttaagatgaaaacctcaggccaacaagatgccccagtaggtaaagatgcttgtcatgtgacccacacagtagaaggagagaaacaactctcccgaggtattctctggcctctgacatacaccctgatgcatgtgagcacaggtgtacacacacacacacaacacatacacacacacacacaattaataagtaaaaacaaagcttctttgtacagagtaacaaaaataagaaatttaactccctaacccacctgtctttttaagcagaaagccttttttaaaaatcccagttacataaacattgtcttgactttggaccttgtcagataccagcttggtttcacagaagggtctgaaatcaattgtatcaaaccctctcagtctaagaaggtaccaagagcagtgcttgtcattaaccagctgtagaaggggcgccttctactgtgtgaccccaacctctgtcctccactgtgtgaagagagcccatcctaagtcataggaccccaacctcagtcctccactgtgtgatgggagcccagcctcagtcctgcactgtgtgacaggacaccatcctcagtcctccactgtgtgatgggagcccagcctcagtcctccactctgtgatgggagcccagcctcagttcttcagcgactcctgagacacagcccacacccagcagtaagaaagcttcttaatgggaggccagtttcaaccaccagaggacaaggtagccagaacagaagtggggaccggagcttcccgttcacatccatccctgtaaggcctggtaacagtggcaaatcatacgcatacttaatggccagcatttttctttctttctaggtgactccaaagttacaatggaagtcagagagtctgttctgagactgaataatgcacatttctattttttccatttttttttatcatgactagattaagtgctattgcctgaaaggataaaggaatcaggttttagttttcatttttatcattgcaaatacatttacattctcctttttttacaaatgcaaagagcaggcaggccactttcaataatttattttaaaatcaatgctaatgaggttatgtctcgtcagtggccgagttttacaataaagtctgatttatttagaaaagatctttggtgtagcttcccatctaatggcggtgggaaggaggtggagtagcaggcacggtgaccctccaacttcagatccaatttgtaattcacagcggagatctgacccaatttacattgattagacttgggaggaagagacagctgcgcacggacagcagaggtagaataaacgctctctgtaaaagtgcctaagcacagcacattattggtccttgtgattgagttgtctgataccaggaaaagagccgcttgctgtccaaagtattgggcatcgctacaagaaggatgcaccaactcacgctgtaatattgtcagtcctataaaatcggccccacagcaaaaagggaaagcatcctagcggaggagagcaatagaaagatgatgtgaaaagaatgggatttgtttctatgtgcccagttcccctacatttgacgtcatgcctcccttacctcctcagtctttgttccttgaggtgaggctgagaagcagggcaggcagtgacagggaaagcctactgctggactcgacacagaaataagaatcctttgaagggctggaaggttggctcagaagttagcactggctgcttctccagaagaccagggttcaagtcccagcacccacatggcagctcacaaatgtctgtaactccagtccaagggatccaacaccagcactgggcacgcacgtggtatacatgcatgtacacaggtggtatattcatacacgtaagataatcaactttttttttgtttgtttgtttgttttgtttttttctgagacagggtttctctgtatagccctggctgtcctggaactcactctgtagaccaggctggccttgaactcagaaatctgcctgcctctgcctcccaagtgctgggattaaaggcgtgtgccaccatgcccagccgataatcaactttttaaagtaagattttttttctaagggtgcctcctcttccaccgaattgtagggcaagcatgtgaacgtgcgtatctttaatcttggtaacaggtgagttatttctccagaatgttaaactcttaattttgtattttttctgagtatcatttttataaacataaaatcagggggtagtttgtgtttctttgtttgagacagggtcttacacataagcccaacctggacccagacccacctgcctctgccttctaagtgggatcaaaggtgagcgccaccacaacccactctaaactcaggtattctcagtgctctggagtaaactagcacttttcatgctctttctgctctcctttgagcttaggatttattttctcaaatctgacattttcaaaaagactagagggagactgtcccctggccatctcctcaaagatcccatttgtggagaagcaaggcaagtgtatgaaataaaacctaggaagaggcagccaagtgtgctcaggaaaaactgagtcaccagctctcaacccatggctgactgtgccctagcctctgtgtgtgtgtctgtctgaatgactgactgactgactgactgtgggtctaaaagaaaaaagagaggagggctagttgatggaaaagtcattgagcctatttctaccccatatctatgtatacatatgttataattctgtctcctaaaacaggattattaaatgtggctctaattctcatacttttgtaataaagacccagttcctattgtatcatgtagtatgaagcccgagatgaaacaggttaatgagggtaagaaactcaggccaatcacgttgtgactttggccatataaacacttgactggagttagacactagcattgacttagaacccattgtgaatccgcagcaattaattaaaagaccattccatctgccctcaggaacctatagtctaatgaacaaggcaggctgaatacaacagttaaagaataaaaataaaaataactacaggcctcaagtaccaggaacataaaactatgttcatgaccagcctccgatacagctgaacaaaaatggatatgttaaagactaattaatcacagaaggtttaaaacccacttccaatcacacacacacacacacacacacacacacacacacacacacacacttactctggatgactaaaaccaaggaagatgcctctatggagataataaatgcaagcaagcattccacaaagagaagtgaggacttacgaaaagaatcaggtctaaagaaaagccccttgagctgggcggtggtggcacacgcctttaatcccagaacttgggaggcagaggcaggcagatttctgagttcgaggccagcctggtctacaaagtgagttccaggacagccagggctatacagagaaaccctgtctgggaaagaaagaaaggaaaggaaggaaaggaaggaaaggaatgaaggaaaggaaggaaagaaaggaaggaaagaaaggaaggaaagaaaggaaggaagaaagaaagaaaggaagaaaaggaagaaaagaaagaaaagaaagaaaagaaagaaagaaagaaaggccccttggtgatccaattggaattgtttttgaagttccaccaaggccggaaccttgacacgcttgtccgttgacatatctctgcagccccctgtatattgtatgtgcttcaaacccaatcaggaatagaaaaaaggggaggagaggaggcccatttgaaggtgcgagataattgaagggagaaaagaagaagaagaagaaaatgcgttaagtaaacttcccttaaaggagagaatttcctaactagacgtgatagcatcggcctgtaatcccagctcttgagaggctaaggtagtgggatcacaagttcaaagccagcctgggctccatagcaagaccctgctttgaaacacaagaaagaagagggggtcactgagctcagagaaaggtgacccccctacccacaaaagaaagagcacgaagaccggctccccacacacactgatgctaatgctgaccgtttgttccctcagatgatgatgatctagaagaggatacatgtggcgctcatcggcgacgaggtataagacaaagtcgcacaacacggggtgcagcaatgtggcttccggtttgagaagtggtcctcaaacactatcccaaaagcccaaaatatagtgactggatagagaagtgccttaactttcaaagcagacacccaatcactttaaccgatgtcctagcacagccaagatttgttgtcttcagaaggtgggaagccaaaccagaattttttttttccctatcagtatttcttaaatcagtgcagtgaaaatagaattgtctcatcgaagatcagaagattgagagtggaaatgtctcctctctgagcggcccggagattgcgagtcgagagaggaatagaaatgtgtcagatctgaaaagtgagcctggggtgaaggatagaacgacagagggatgctgacctctgatgggctggtttgattccaggcacatttggaaatgaatatgtaacaggtttgttgaatacaaaattacatcttattcatcccggactgttagccgtgcctcaggctcttagtgagcccatccctggtaaggtcagatgctcttgggagtctccttaagtggaccaaggactcactccttcactgtcagtgaagtgaaggagtgttgcacgttgcttgggccacctcaaggacatttattctatcagcagagtcggattcaagagttatttagatatgagcagattttttttttcttagaatctatgaaattcgtaagcttaggagttctttcccggtttcccttcccgctctctggctctttgctcattctcctcttgcctccctcctttgcttttgacttttcctctcacgaatagtcttctagaaaatcctcttttccctttccggtcgctgcaggaaataagtgtacgtgcgagtgtgcgtgcgtgcgtgcgagcatgcgtaagaggggaggcaagctccggtctcgatcttggtcctagccttctaccttgtgtgatgcgagcagggtctctttgttgttttggccctacagtgtttgcctggctgacctgctggctcatgaacagctacccaggattctttagtctcttgtctcccatcttgccatggaagcactgggttcacacacatgtgacctctcctggcttttagatggactccagttattaaaacctaggtcttcatgctggctagacaagggcttttcccccactgagccatcttccccatccctgcaggaaatgactcttcgagggttagtgaaggactcaggtttgcaaagatccaacttctccctgggaagagcaaagacagtcagaggtcatgaaagcactcaggatacctaaactttgagaatgttagctcctgatgattagcccatgacattaaatcctctaaaaccaatcttccgaagtttgggttgtgagctttagcctttaatggctgaaatcactctccagccctgaaacctaatttctattcttttctacttgccatacagaaaaatctgttgtgacctagcatgtcccaaataaggcttttctctatctacttctgtgtccagcatagggagaaacagctcccacacggaccccttgggtgggataacttcctgtggccaacattgtattaaactctattcaggaagtgccagtgtcctggcaaagtctggctttccctcccagactcctccctcctctcattttctcctgcctgcccctccactcaggctctatctgggagataaaaggagatttatttcttagctatcccaacaggtataattcaattaggattttttttttaaagaagtcttttgttcctcatacattctgcttcccaaataggtgtcgttaacatcaggctagctctaaatatgtttctgaggcttgtacttccaccagttataatgattggtgacttgctgattaaaaaacaggaggtcttttcgctctctctgcagaatctgaggcagtgatttttattatttgtgtttacttatttatttattgaatttatatagtgcctttcctccaaaggagctattgaaactgcagcacatatgtaatttcccaatgtcatctctaagttttataacaacaaaatatagagatctgggggaagggctaacagcctgaatgaaggcatttaaaaggctgggacagagtaaattcttgggtcacagatgagctatgtacatatgtgtcttttagtttttctcaggtgtcatgtgtttgggagggaaagacctgtcccggctgccttcccaccaaagtgctatggctgacacatctgaggactcttctctatcccgcagaccctgtcacttgatgctgcactttctctgacagaactgctaacatttttcaagcctacccccagatcttatccaaagagggagagaggaacagaattcagtttatccttattgagtgttaatgaccctgtaagatgcaatttcttttattttattctgttacctagaaaatctatcacagccttgtagtattgattgcccaatctataaagagcttgctttacagcgtgactgttagtaacatggttactttaatgagtgactcttcaacacctcagattttctctaaattccagcttggcagtcccacaggatctaacattgacagtctttagtggtgagatcatattttcctgctttgctgtgagaaacttctgggtagcccaaagcaagactcactgtgagctgttggtataaaattttcctttgcttgggtgtgccatactgtagagacaagtcacccttagacacataaagttgctggccaaagaagatcttagaatagagctctcctttctctctctctctctctctctctctctctctctctctctctctgtatctgtgtctatgtctctctctgtctctttgtgtttctgtttgtctctgtgtctctgtctctctgagtgtctctgttcatttctctgtttctctgtgtctcggtatatctctgtctctttcttgtgtctctctctgtctttgtgtgtctgtctatccttctatttatctcttggtgtatctctgttcctctccctctctttctctctctctctctctttgtgtctgtgcgtgtgtctgtgtgtctgtatgtctctgtctttctgtctctctctgattgtgggcaaaccaggcttagtgcttagtcttataaacatggagtcatgtcagaagagtggtctttcataggctttccatcctggagaccctctgtcagcccactgtggtgcctgctgacagaaaactcctacaccaaacaaaagggagctacatgggctcctgtggctcttgtcctctgtttttccaggaccaaccttgagttgagcatcacccactaacattttaacccaatcaaaggagccgatgaggtgagaatcaggccctgtgattggtctccacacataaatcatacttacaaaattaaggagcatagtaatttcataagtcaaggtgaaatgggcttgaacataatcagatggtatggaaaatgagcagaaaaatattcttcctgctctagtgtcacagtgagtggcacctggcaagtttcatcgtatttctgaaattgttaataaggtagcagtgggtgtctgctttgagtgtactataacatggtggcccctcctggcttggcttagactagagcattcgaagccactgtttacagagttggcccaactctcactgggccctactgtggtcaggttgttttcaaggctttgtatggtgtccctaatttaaacagctgtgcctaagaccagacctcattgacacagccccccctttactcatcaagaaaatgtaaacaccacactgacctgcctttagcctcttttccctgctcacagctttgaattctgaagctatcccatgccccccccccccgcccccgcccccaacaactaagctgtaggagatcagtcatcttctgctgtgcctgaagacaaggagggctagataggtgtcctggtccttttactaggtgctgctattgactctgtcaccagtaacaccagcctggactccataaaaggaaaagagcccatcctggtcacaaagaatctggtgtgaaacaattcctaacaaccacctgggaaatggagaaacaattctgtccgctgctcttctttgtgataactttgctcacttgaagcttagcctccctcacaggggattagaaagaacaagacactcccattcctacccccaccccaccccacccccattttctctagaaacactccttcccatctctgcttgcaatttaaatgcagcgatcatcgccattagctcccctatcattgtaattgttgttaattgttataactgttttagttattagtgttgtcattattgctctaggtcctctgtctgttttatgctgaatatattagagcttttgcttttgaattaccaggctttgtttagtgcagagttcctttttttttttttttttggagagacgttgagaaatgctggcattaagctttcattcttttgtctttcattccaaatggacagactagaaaaaaaataattagatggactaatgtcctcaaaatgagaatgagggtgttttgaattaattaagtggtcagaagattgcatcatttctgacttaggctgttcccaatgtggtggagacctaactgagccaaaaatctagttagtctacagaggcaagacttgtcctcaggcttctaactcccctcattaccctataggaaccagtatctgccctcatccttgttaccatcctgtctgagggtaagcaagcctggtctagggcacacagcggaaactcatggtgcagacctgcaggccttcagacccttcctaaggccaagcttcaggaatgaagtcttgctcagcctcagctcctcccaacttgaagatctttctgtgactctcagcaggtcaaacttttgtagacagctgaagcttcaaagaatcctcccctgactgctaggactctgctaagctccctcttatacatagcatcctcaagttcctcagtcctgaatactggtatggtaactctggtccatagcacctccccagctagagggtagccttgagagcagggactgtatatgacctgtgtggaatcctcagtatctaggacagtccctggttttatgcacgggcctgatggatgccaaggaatgaagttgcctgcacacatatgcataaatatgaatcttataagttaaacaaagatcttgtactatgggggtccaatcttatccagctaaagaaggtctccctcattgatcttcttaataccaaaagactctgtgggcagcgggttaactacattccccaggtttagccttattctgcttgactgctcagagctgtttgtcatggtccttaagcgtgggtagggctgtctcctgggttcctgaacaccaaaggccttctgtattcctcctgtctatggttgattaaatctgtctccctgtcaccctgcaccccagctccctgttttgtttgttttgttttgttttgagctccctgtattctctcaccctatagcccaggctactcttgagctcaccttatagtccatctggcctcaaactcaaagcaatcctcctgcctgagccttctgattgctgggattatataggtgtgaactactctatctggtttgcaatgtgtctttagcttaggtctttccccaggtggtctcctccaccattattgagtcgtggtaggaatctcgtatctatccaaaaggtaccttaggagctgtctcacccccaagcacactgtgaagatcagaaactcaaagagataatgcactaggccagagagtgccaaggtagctctgccagtcttcccaccattcataaatagccaaattggggtttcgaaatctgttttttatttaaaaaaaatgtttttccctgtcacctacaaacccacaaagaatattaatgccaagtggcttctcgttcctaggcctagtcaaagtctcaggatgatttataaactctcttacaactgagaatgtatgacatagcctctggggaaactaccatcactttctaaggttgatatttctctatcatttcatgcactgatgtccccaaaaaatatatgctttctcttttcaacagttagcgtttttctcccaatatatttttcttcccaacgtgttcttcagtcgatggcaggaggtttccttggcagttacttctgtatgctgccctctattgtctgccgcagagacaattctctgtgtaaagaaaacacgcggtctctacggttgacatttttatttctgtttgcaatctgctcttttacccaaatgagccaatctctcctctgctttcgtgcactttaagatgcctaataagagtcttttacaaagacatacacagatctgttccactgcgcctgtctaatttgaattattcataagttaggaactaactggggagggagcaagcacagccaggtcctctgtggtgcctccctgaccattcgcatcccatctgttgctagtcaagagcagccttagaaccatgggtgctctcgagagaatccagacaaatccagaccaagtaggaatcggtgagatagaatccctagaaatcacatgagattttttttttcactccatttttcaagacagagtgttacagtgaaacccaggctggcttagaattcataatcctcctgcatcagcctcctagctaaaaatcacaccagtttttaactatatctcaggactcctgagtcccgtcgatcaaatctcacctttggaaggtgattggctcacaggtctagtatagaatattctaagaaactccaagtgtccctggtccagtgggcattagctctcccaccattcaaacccccgcatgttcgcccactgtgtccgatggtgtttaacctttccgggtagaagaggatcaatacaaattcttcattgttaagaatcgatggctgtcctgtggcatcactgccatctagtctggctgaggagcccagtaaatctctcctgggctgtctaaagcttggtttggtgtcttcagttgctttcatttttaatgcagatcagtttggtttctgttccccggggacttgcagataaatcttggcagacatgttcagggtctacaaatgagatgctggaaaagggccagcccacccagaatttagttgtaatggatgagacacccccacggctccacttgaagaccgggctattctgttcagtatttattggtgactacctcatgaggtacctgggatgaagctcctgggtaacagaggaggccagtatgtgaggcgtgatgatgcagaaaggtgctggctgactcagcctctctcgtggacaggcagaaggatctgttcctccagatacataaagaagagatgcactccggtgtttggatgccctggatcaagaaatctagcggggaaacatctttgtgctgcttgtttgcaaaccaactgagaaattatgtgcctggttttcttctattaataaacacatctattaccatattgttgagcagcactcctactaggggtgatctgtaaatattttatgcgagttaatgatctcgtcctcccatagtcctttgctctgagtgtttgtcatctggggccccctgaatcttaagtttcctggaggctgtatcagaaccccggtttccatttgcagccaaactgattcctttcatctttgctttctcttctctttgatcagtggactatgccgattattaccagggcctatgggattgccatggtgaccagccggatgaactgtccttccaacggggtgacctcatccgcattctgagcaaggtaaaaatgtagactatagggcttggagccgaagctatgtttttactcctgttagtatacttagtgtaaccagaatggtcccacgttattacacctcgctctgtatattacatggctctccttacacacagatcaaaattccctttaatgtataatggtttggaaaattttttgattaaaaattgaagcccaggaatcatttttctcacatttaaaggtacactaaagcaaatttaaatatatataatgaagtagatacaatactaaaattatgcccgtcaaaatttgatgttttctgagaacttatgatatataaaggtcacactatgtacataatttattaccatataatactattgaaaacattctggctaggtacactagatttttatttcatttatagataaatgagacgataatataattacctgggggaggaggagtcagaacctgttagctcaattgatttgagccagtgctgataaggccaacctactgaattcaattgcacacagccccgctaactttattctcttcctcaagcataagcaagccagccctagactcagctaacacatgctattgttgatcataaagcaacagggctttatttaaaagggatagattattgcctgtctatcataaaagaattttctggagttgcaggctacagtttgagggaattattgatcatcatcctgtaaacaaccaaaaaagaccacatatattatacagccaaactaagacagcacgtcttattcctaagagaacttatcacagaggctgttctctatgcagcccgtcaatatctacaaatacagttttgaaatgggcataatgtgctctttaattggtgagcatatgaacgtcacagaggattacgagaaacccactgtcctgtgaacatcgcgtttgccgtttctcttattctaggaccggtactacttatgctaagggtctgtttgtgcttgagatattctgggaactcctttacagaagaccaaggggcaggggaaatggctcagtgggtaaagggacttgctgccaagactaaagacctgagttcagtcccagagacgatgtggaaggagaggactgactcctgaaaggtgtcctctgacctccacaggtgcattgtggcatacacacacggtaaattagtgaataaaaatataataagatacaaaatgtaaaacaataaaataaaatgtagtaaaaaaaaaaaaaaaaagaaaagaaagaaagaaagaaagaaagaaacaaaccaagtctgactccagatgtcttccaggcccctttaaacagtaactaaattcagaccttgccctttgcaggaagctaagggctttgtaggccctgctggatgaaatcacggtgttctagtgatttctcctgcaactctaactcagcactaccctaccacaatttcggtgcagctccaatacaccaagaataaattggaagcagagaagggagtggacactggcctgattggtatttcaaatgcccgaaagcaaggtttgctgtgtaatagaatttgtgtacattactgtgctggcattacggggtaatcgagttacccactcaggtgtgaccaggcctctgtttgcccagagcctgcaggtgaacaaattaactgtttacattgtctggaggtgcctgcagcaggagggggggagtgcagagccagactggcggctggccttctctctgtcatgattattttgtttgttttacatgtcttttgcctttgttaatggcttctcactgggggtcccttccctccagttagatctaaggggctgtgcagtgacctgtccccttatagagtggtgtgtggttaccatggctgtggcatttctatgagatgcctaagaacattagactggtcttttaaaatcaaaccccacctcccttcctccatgactacatgctaaggcatcagagtttaattcaggggaaatgcctcactgcctttattctgtcagcgtctttctccactgttccggaaggttctaagtctatcagtatctctgccccctaagcaataccaggtgcctctcttcctcatacttaatccctgcaaatcagaggaggagacgagaaggttgtagttcaaggaccattccttctgcaagcttcattctgtttaacgtcggcttggggagcatctgagattggatttaccctgatgctattacctaactcgatcagagcccttggacaaaaaggaaccttaaaagacctcccttcctatttgcttgtctctaaaaaacacaaatgaaccaattcatacagatagaaaaggagattctgatgccatctagatgctcagccattccccgctctctggaattctctctccggctcttcctacctcagccccagctggcttccttggctggaataaaactgcctcccatacctggagcaagagaacaaactgacgcacactgagtttagtccgagagaatggtgtctggagtactccgtatttcttccctgcaaaggccagtagcctcttggctgagcaagaaaggcctctgtctagaaccctgccgaatgtctccctgcaggatgcacgacacagctgtgcagctcagctccatggaattgtttcctcacctgtaaaatgagggagttgtttctcccaccctagatactttcattctgaacacagtgggcctgatgttgcaaagctgctcgagaaatccacccagcattctagtgcagctttaatgacttgctccatttgatcgacaagcattccaaccgccacctgtcttgtcttcacccccataggtacaactggtttatccctctcaaagtaaaacttaacagtgctgaggatcaaatccagggccttatgcatgctaggccctggatggtctactaccaagttaaatccatagcccttcattaagaaaacactgtggtgggcgtggtgacccttgggagacagaggcatgccgatctctgattttgagaccaccctggtcaacattctgaattccaggacagccaggactacataataaagaaaccctgtctcagaaaaaaaaaaaaaaagaaagaaagaaagaaagaaagagaaaagaaaagaaaagaaaagaaaaggaaaaggaaaaggaaaaggaaaaggaaaaggaaaaggaaaaggaaaaggaaaagaaaaggctgcaaggagagagcctggaagaaggagactcaaggcagggaagtaagatgagcatttagaaagggggaagatgccagcttttaaccctggactgtccttgatggccctgctgggatcgggggatgtttgcttgcttgcttgcttgcttgttttatttaacatgtattggtattttgtctgtacatatgtctgtgccctcagaggccagaagagggctttggaccctctgagactggagttacagatggttaatgggtcaccatatgggtgctggaaattgaaaccggatcctctggaatggtaggcagtgctcttaaccattgacccagatctccagccctgtaatacacacacacacacacacacacacatacacgatacattatatatatatatatatatatatatatacatacatacataaatatagtacatgatagatagatagatagatagatagatagatagatagatagataaagaaatgtacttcatagttatccaaacagcctaccacttgtcctatactcaggtaggttatttgtgtaaccttgaaaaaaaaaaaaaagccgggcatggtggcacacacctttaatgccagcacttgggaggcagaggcaggtgaatttctgagttcgaggccagcctggtctacagagtgagttccaggacagccagggctatacagagaaaccctgtctcgaaaaaaaaaaaaaacaaaaaagaaaaaagtcacttaaacattctaggctttaatgtccttatctgtaaaaagtaggatagtttccattcatagggttgtggtcagagaatgtatgttaaggcatatttaccccttaagtaatgacaactcctatattcttccttcccatccactaacactacaccaaaaggaccctttgtgttgggcatttccttatgatttcattaaatcattgatacagtagagcaaaatgagggccagcaagatggctctgtggttgaagatgcctgccaccacgcctgccccttgagttccatccctgggacccacatgacaggaagaaagaatcaactcccagaagttgtcccctgagcgacacatgcttgcctgttggcacatgcgcatgcacaagctgtggcactcacacgcacgcacacacatataaacaaatttaattccttttggatatatatatatatatatatatatatatatatatatatgtaatgagaaaaatggtcatacaccaagaacttctcagaagctccatcggttgagacacaaaataaagttctctcacgtaggtaagaacactcactacccagtgaagaggcctatgtggaaatccactgtgtctttgtggtttagaaatatcatcactgacaccagaaagtctccaaagctctcttccagaagaggcctgagccaagtacccatctcaggagcagtaacaaggacacagcagcagagagccctcccgcggaccgcccctcagcacatccaaacattccgaggccccatgccgcttcatgcccacttaactcgctgacttctaatttggatcttaaaatatattagagaaagattttaataacgaagcggatgtgaacatccagcggatgttcctgcactccttttgggcccagagatttctgagcggcttttgctggtaagagcctctcttcctccccctggaggagccaggacacagcgccagacacagcagggcggtttagcgcttttcagtggctccagattgtggcgctggtgcaggtctcctcatacgtaacggatcactcctgagagcctgcccctcgtaaattacttcccacgatgccggcgaccaccgcagaattcgagtttgaacagagaagagaaaaggtgtttgagaggcctgttcactcggctgcattttaatttccttttcaatcttgtcccaattaatttcacagaattaatctcacagaagcaaactcggcggcactgaggctgtgtggttttagtgtggcggtcgctctgcctgaacatgaaataggagctaatataaaaatccatctgctgtgtttgaaatacacaccggctgccgctcggtcctgtccgacattccaagcatcaacagcaggggggaaagtgatttgggggttagtgaccatcagtacctggcaggggttcaacaacaggtgtactccaaaaatccattctgtctgagcaccatgcatgacagggcaggtgctgaatcactctcggggcgaggacatggtgtcctggcttagctccttgtatgtgagggctgcaagggccctctggaatccactctccggcctcttaaaggataagtaagatgcctctgtttggattagagaagtcacaagtttcctgtcagggaagtggcctgacttccagccagcaaggttttcccttagaaaacattccttctaaatagcataggtgcttctgctgtctgagataccacatcactgaatggccaatgggaaacagatcagttctagaactgatttatggcagtaacatgagcggcccagcaaataaaaaggagaaactttgtagggtgtagaggctcacacctttaatccctgcagactgaggcagaagcaggtagatctctctgttgagtccaaagcagcctggtgtacatagcaagttctgagccggccagggacatatattgagactgtctcaaaaaccgaaaggaaaaacacagttaactggaaactagaagagccacataccccttgcctcctgtggaggtaaactgagccagaaggatgcatctctgaagcttgggttgtgtccttcactgataaggctctaaggccttatttctttgggaatcagcattggagcaacaagttgggcattccttagggttgatacgtgatggcttagccaggacaggaaggtcttttcagggctctgcagtgcccgtctttgggctgacatcttagctggtggaaacagtgtatcatgaggctcttcatgtgggtagatggactttctatgaactaggatagattctgttacctgggatggaacagctgtctctggctcccgctgcctaaatgtagcaggcctggccgggcatacctgggctgtgttaacataatgcctgttgtaaggggacttaaaaaacccaggggtttcttcccccttacctccttaaaggactacttaagaatatagaccgttctcttcccttgggctgttccttccttcctttctttaaaaaaaaaaaaatctgtatattatttgagagagaaagagaacgtgcaatgatatttcctcttttaggtgtgtttagttgaatgtgacaacaccgctcataaaaacccctaagttaatcccttcgattgctttaaaggaaggatttatttatttatttatttatttttaatttcagggctctgagggaaaggaggtgtttggtgacatctagtgtccatttaggacttcctcaggcgtcgtacccccagcttgactgagtgggggtggggggatgggctaaggttatttgggaggtaatttgggagtcgtaagtggggaaatataggcctggggcacagactgcccaaacagtgtgatgaaactgatcaatgcctgtcaaagaactattattcacctctgacctaaccaaaggggtaggcaggggtagaccatcagaagctatcttttcttatttataatggcatgggggaaacgcagaaggtgtccccgccaccccattgcatgttaacaagcaggtcaacaccgtgctgtgatgacgaagatgatgatggtggtggtattttctctcattaataacccctttgggaagcaggagttagggggatgcgaatgggatttggggtcagctggaaggcaacggtcatacaccggtcaaattcagtggaggccattcctttcccccagacaggaaccaatcgtctagaacaaaccctggcagcctcattccttgcaggtaatttttataaatgaggggatacccattccaggagaggacaaaagggagaggctgcttgtttgtgtgcacgtgcatgcacataggcctgtgagcccatgtttgtgtgcctctgtttgtgtgcacgtgcatgcacgtaggcctgcgagcaaggggccgactgcacgacagccctggccccttggatcctgtctctttcttataaaaaccctttaagagagagaggatacaactgcagttttctctttaatctccttatttctaaactgttgtcctagacaggctctttcactttcaacacacacacacacacacatacacacacacacacacacacacacacacacacacacacacacgcacacaccccagagtcaggtagaaagtcccacaccagatgtttacacagaaccatataagccatgaaggggttaggttaatgctcagaattgcccaacgctttacaaactccagcataaaaaaaaaaaaaaaagccagccatttattttgcagtgaatttataacaaatgctgttaaaggcttcgtcttttgacagaggtaataataaattcactgttaaagacggtagtttaattccttacacctccaatactgcacagagtaaaccatattcatcaccgagtaattttttaccacataaatctttaaaactaaccggcgaaggctgttgagactgaaatattgtgaatttattagatatgcccatgtagtattggattcagaggtttccattcgaatatattacaggggaaatttgtgtctttaactgtgacattccctccatttcctgccgccagtcctataacaagctgctcctccagagtcagctacatgtctaatagacagagatttagtaataaactcctcgctaatctgctagagaggctagatgacatctcagtgatgtgccctatttaaaaggagtcgcgaaagctttgtttctgtgtaattacgttctcagaaggaacccagcctccctcagcctctcctgctagggtttctccagatcggatggtttcagcactccaaccaaacttgcaaaatactgaagcacattatagtctcgtagcaaacatacagagcagtaatttctgtcgaagttggaagattcattatgggaagtcaggggcaaccgtgagaatacagaaagcgagaagctgctgacatccacggacagaagatatttaatactaattaaaagattgtattgattctcagaccaataatagatgatgtcttcagaaaacttgctattttaaattttttaatgtgacaagacatattaatgacaattaaatcctcaagatttgagcaaaaaaaaatccttttgccctactatattttgagtgagattctgaactgataaatgagaaaactccaaacttttctcataatttaccaattaagcaatgtttaaactataacaaattggtgatattaaattatatctccagttcatttaggggatggtgacatacttaaattaaatttttttttttttagagatgccctttttttttttttttttttttttttttttttgcataaaggcacaagagtttctctgtccttactaatacactatgtttgagaggagttccaaatccagaaacttccatggagcttttatgcacttttcaatttctttttcaagaaaatgaaaccaaataggttcctaaccattcaacaaaggagaagactctcctggcagctcaagactgcagcccatcgggacaactgttaaaagccaggactctactgcaaagataaacataataccagcaattaatattcagtgtttcacattccagtcgagagggtgtgtttttctttgtgatgtggctcataagctgagggtgtcgggagccagattcctctcgtgcatgaggattaaggggggaaaaaaatagcaacaacaatccttcccccatctgtaaatgaatgaacatcttgattttatagctatttgctttgtaaaactgagaactgaaacaaaaattactggatgcctaagtaacactttaattcggaattcatttacgcagtagctatggagttgtcacaaaccataatgcagtatttaattaaaataacagaagtgcatctagatatgtcctggggtagctatcaccaaatgatagtctgtgccatcagtattttgtttatgaaatggcagattctaaggtgcagcgaggctgaggcgagagcataaacattttaaacttgcatttttagaaaggttcttttttttttttcctgctgcatcattaattttttcttcttctgtggtgtgtgtgtggtgtgtgtgtggtgtgtgtgtgtgtgtgtgtgtgtgtgtgtgtgtgtgtgtgtgtgtgtgtgtgtgtgtgtgtgtgtagtgtggtgggaatgacttctgggattgttttgctgtggataaagatctctctttctaactcttgcttttcaactattgacctcccaagcctccaaggctgtgaaatcctgtctgttgtcatggaaaggcgcatgaggttcacaggagtcacagcaagcgtgggacatctcaggcagaacttggacgtggattccgggagggtaggctcactgcgccggttcccaccgtcttccttacaccttttccatccataaaatgttctcatgcctgcctgttctaccctgtggatgctcaccacggttgccttcccttttcataaacgcatagcatctatcttgcacgcacccaccatctatctccacgctcacatcagctgtcccctccacctccttgtctgcagaattatgttcagcaaagtcccgatttataggaaataaataatgaaaatggaagggactgggaaagataatcgaaacattcaaattgttatttttcactgcactttacacaagcagagcatctgtaaacacctagagaaggtgtcgtctggtccctaaaaagctatgcctccagaataccctgaccaagtccgtctctgtcggcattgcttcatctctgctccaactctcctgctcttggaggctcccaccatctgacctttttaaaatggtaattcataccccgctattgttgtctttctatctgattcttatttatcctgcgtataatggcgtgtttgtcaccacttacgctctgtaagataattctaaagacaaacatagcagtcaccttcttaaagaaagaaagaaaaaaagtccttgtggtggcagtatgaaggtgttctgagaatggtctcacagcccagtcctacagctagggtctcctggaaggaggatttcttctacacttgtaattattttagcccctttcacaggtcacataaaaagttaatttcaatcgctgctaatttccgtccaacaagagcacggtactttaaaccacccaaaataattggattcaaaacaaatttaggaaattgagtgtgttagaaagcaaataaaaatatccttttggtagggaggcggggtgaaagtagtaaaaatggcctttttccccctctctcccttctttccccttcgcaactttgccattaaagttgcacctacagctagaagtttgtccgtgaaaaatggtcattttgtttctctgctcaaagaatgttattaaaatgctaatttaaaagaaaaaggagttaaatatctagcgatggtgcattctaattgcagccataatgagctctctaaatgtgcatgcccctgacacacaccaagcataaacagcagtaaacagatcattagtacccgcgttcatttattctggcgaccttaccatgaccccaccgagggtagggtgaaaagcaggtggatctggctgtgacaccccctagagggatccaggaaatgaagctataagctgttgtcatggaaacgcctatgtgtgcagatgatgtaacacaccgacaggctgtagggcccccgcaactgggacgttcgcctttccctcgccggaacaatcttgaggattaaattattcatttctttaattcacaaagcaaaaggaatcctaattttcttggtgatgtgcaactctctcccattcatctagggtctaaaacacagcgacttgtcccctctttcaccgaacccacattctagtcccaaatagctgaatttggcgaaatcaagtgtggaaatgcagcaggaatccaacactcagtatctgcactacaaggaaagaaaacctatgggtttctgcccaaatttaaaatgtaaagtgtcctttcctgattagggcaccttgggcagggattaaatgtatactgctttgtttgttgcaaagcagcagagttagccctgagaactaccaagcccaaattcaatgccatgagaacggagagccacagcccctaatgagcacctcaccctagcaaggtgcaaaacagagatgagaaacaagcagctgctcacccctcccacgctcaattgagagaatggagattaataaatataattctttggagaatgattccactctgtcctaccctgttttgtaccaaacaacctcaataaccttacagcaacaatagaataacttttcttcttcttcttcttcttttttttttttttttttttttttaaggaagcagaaaagacgatctctggaaattattttaaaataaaaaatctcccagcctgtgcctccctcccgacccccctccccattgcactttagatgaacctgtgatattgtagcaatggcccttgaagtgcagtggggaagtgatttaggagaatattaaaggcaatgtggagattcaaggcgcctctctcagggagatctggagaaatacgcagcacagatgggccgagcagattaaacatttccgtcacattgtttccaaattgtgttgcggtgcctgaggctggtactgcggtcagagcaaaacagagtggcggagctgcgagctgcacagtttatggaatacatattaatatgcccgtctcacatggtatcacaattctatcagctctgaaatggggctgcctctattgttcctgaattctgcaccgggcaccttgtttcctcccgtctgtaaatgtttaccttgcctttcccctctctctggtaggtgaagtgtaagttgtctgctccattcctggctctctttacaaacctgcttctctttacccctccctccatgatttctctgtggcctctgcttgcactgcacacagtttttcacacacatttccatcaccaagagcatctggtgtgcacagatcctacacacctccctggccttggctgcgaggtcatgtgttcattcacaccctcttcaggacattcaggctgtatcctccctctcgctcaagtgctcccaggtcctccgtgtggatcacacggtctcctcagagcactctgttcttaagctggcctgggctttgtagacttgtccttgtgaacccccaacagcttttgctgacccaccttccaatgtgcgctctctctctctctctctctctctctctctctctctctctctctctctcccttttaataacacctatctcctcagacaagcaggtccatcaatcatcaggatagcaagttccctgaaacgtaacaataaataaaactggctcaattggagcaaatttaatgactcatttgtgttatgatctatagaccaaaattctgaataatggaaaaagagaaaatgattgccaagaaccttaagcacagtgtaaaatagcctggagaggccgccaaatgactcaaggttttagctaagcgctgggctcccatcctttccagtgtcacaaaaccaccagctaaccagccaaccatttccttatcccttcaggaaaaatctcctcacagaatggtttgtgctgaaaaatgggtatgtccgtctttggtaaacaattcttcctagctttctgcttcctgcagatgggaacttgctgagctaaaccccccaagttctcttaaagcttaggctatctcaaagaaaattcccaaagctgaattttaggagttcagaatttgtaggccaatccagaaggggtgtgtgtgtgtgtgtgtgtgtgtgtgtgtgtgtgtgtgtgtgtgtgttgatcttggactatacaatctactctgcttaggaattcaaatttcacatctttactaatgataatatatggtaaatgatctctattaggagaaataagcaatcataaaccaatacttccacgattgattggattttcccatacatatatcaggcacttattgatcttttgtgtccaagcctgattgattgttttcttcaagagggagcctctcacttacaacactaacacagtgaactttgatggttaagagaatagaagtctcaagtgtttcagggcctcttgttgcacagaagcttagaggccactttgatgtgaaaaaggaactcacccaaggcctccataacagagccttctcaatggagctaagcccgtcagaggcttgtgccaaaagccactgaaatctatgaaagcctttgaagtcaaagtgtaaatgctggtccctatgacaggcaaatatggtcaggaagggagaggatacaggcaggattcaggaaaggacccacacctagaaaaccccagcaagtgaggaacaaggattcttggttgttgttgttgttaattatattttgttcagtaaagttagtagagtcaataataggacaaagtccagacctaggccatgaaatccactgtcttttcctctagggtgctcgtctgtaaactggggaggattcataaaccctttgaggatctaatgaagactccgggcatgggacccacgtatacttccacccaaaatgtaatgccaatttcgagaattcagaaaaagtctttcccatccctccatagacaggttaagggttgacagattccagtgtaagacttgaagccttaagaggctgtgagctccttctgttggaacagcctaggattcactgagcctagaaattgaattctcatcccaagacaggatggtcattccaggtcatgtctgtgctactccaggggagccatggaagagcttatacaaataggaaccagcagggaggagagaaattaaaatgtagcaatcatggagtaggggtatttaatctcttttaaggcttatgataggcgcctgctggttttctccctgatgtcccctgacacctactgacagggtatttacagcaccacacagaggctcaaggccctgtgacaggaggaacactgaggaggcctatcatagtcttgaaaccataaacagcaataggaagacactggaggcagagtcaagctgtgtgacatgcctgttgttgatgaccatactgctttttgtttataggatcggctgttctttttatggcaggtctggtgggttggttttgttgttgttttgggtttttttggctttgttttttcttgttgattgtgatcagcagcatacatccctttagggctgtgtgccatcccccataaacacttctgattgtgggtgacagtgagcactgtgtgcaactcaggttcatccaacctgccattcacccaagccaatcgtccctctgtcctgatcatggagaccaaacaccaactttcattttcaaaacctcttcgctgggagtggaaggggttcagggagatctgacaaggttcaagttgagagaaacagatgtttcatcaaaagtggaaaaaagcaacatgccatatttatttcttccagatgagatgtgatgtgaagcagaacatgtgaggagttttgttgtggggtcttggtttgtttgtttgggtttgggttttttttttaatctagaacttattcaagtaataattcggtaccattaagaccattaaacccagcactggggaggcaaaagcaggcagatttctgggttcgagaccagcctggtctacagagagagttcctgaacagccaggactacacagagaaaccttgtctcgaaaacaaacaaacaaacaaaaacaaacaacaacaaaaagaccattaaagtctcacctttagccttcatagtatacagagtcatggagtggagaacatgtgtagtttggatgccccagtgatatatacaatgatatgtataggtatgtgtccccagtttgaaggtagagacacttctgcgttgaagaagtctgtacatctcctgggagcctcaaagcactcttcccaatttttttccaaacagctgggccaagagaagttcagattttatggggaaaacattgatcccagaaattcagttcagttcgatcctaaaaactaaaacccaagaatcagcaacttaataaaaaaagcagtaaattagcacctctagacagtagaagagttcattcagagcttgggtctgcctggctgagccagtattctctccattttaatagtttaataaaaattagcataattaacgaacatctgtatgatccagagtggtgcaatttggcacttggaaacgagggcttaaacatgattgctgtgagtttaatgttgttttaattctttttggcactgtgcagtgaaataaacgtttggtggtgatagttctcggccggatctcatttgcatttttctccccttgattatgagcaattgtggactccccagcaattcatcaaagtagaaattattttaaaatacctcgtggtgttcagactgggctggagcaatgcatggggggtggtagtgggagagaaggctcgaaatttccattcatgctttaaaccgcagccctgcagccctttcttcggtatccagccaggggatgaaatctggaaaagacagtcggatcccaggacctgtaggtgctttgattaagctcccaggcttccacagcatgacacatatggtctctgagactctgctctcctcttcactcttctgccggctcttttgttttgaagggcagagagctgctctcaactcgtttctggtctcaccactgtgctgagcccactccatctgtggtcggcaggtcagcgctcccctcgagcaagagcaacctgactgggagcctggccttggcaggtgccctgctgagtctcatctgcttccagtgtgcaccctctat

SEQ ID NO: 98 - DNA, 2691 bp, Mus musculus
taaatctcatttttattccaacattttactcccgctcggtgagtacctactcagtggcattcttgtcctattcttttttttttccttttttttgtttttgtttttgttttttttttttcttcttcttcttcttctttttcttcccacttctttgattattgtttgtatttgggaaagctgacgagcatagtcttaagccttttcctcaatcaagttttcctagcatgcgatggttctctagacaaggcgctgtgtctgggagtccgcggcagcggtgctctctgcgagcggctcccaagtccagcaaaatgtgcaactggttttatggaaaaagcgttgtgaagtatggtgcctatttttttccctttgtaaagataagaaagcatgtttctaactcttttttacgtactctttttccgattgcatttttgtgtaggtgggattttccagcagtgttcacaagtttgtcgtcttgcaattcgattcgcaccactgagcaaagacattaattttgcatttttatgacctttttggaagcctgtgagaaatatttcgttttttcccctcctgtttttgatatcagttgataacatgaaacttttcttgcagctagttaaagggattatttttaagcagttgctttttttcctcctttacattaactattacttttgcatatttgacttttttatttaaaaaacccgagataattttatgatagatatcctgatatctatattatcccttcttcctccttctcccctccccgtaaatcaattttcaaatgatggcagtggaaggtttttctggaaaaaaaaatgaagtgcggtttggtttccttgtcaacggaggatgaagtgaacagcacaacagctcgcagagagcaggtacttggccccctcggtggcgttccccgggtgtgtgatggcaacgctggccaagaagtctgtgtgcgcgcgtgtgtgcgtgtgcgagggtgtgtgcgcgtgtgcgcgccggttctgggctgtgtccgagcccgcaatggggaaagccgcgccggaagccagaacaaaagtgctctctgggccgcgatggttttgaagatgcgaacaccccgtcccctggtggcgcctaggtttgggtggctgcaggggaaccagagcacagccggcggtccagcaagttggccttagccacccgcagcgccggaagcctagggccccgcggggcgctgactgtgcggtgatccggtcctccgggcgcagatggagggtgaaggggcggggaccgctgccgcccggaggctggcggctggtcaggcagccagagctcgaggtgtctaggatggcagcagtcactgagcgctgctctctcgcctctgcgacccgcgggagcagcgcagtgggttcttcccagccgcctccgctagctccggcagcttcacgtcttccgtgttgtctccctcatgctttcctggcggcgtcgctttgcttttaaacccttgctggtgtcttccgaggagagggaatggtcacttgtacctgtgcatactaggtttaatgggacgacgcctacaaggtacattatcctttctttaaaaatagactgtttcatttttaaccaccagatactgattgtataggtgccccctaccccaggccgacgactgagtagggcaaagggccactgaaggtggccactgatgtagtgctgaagtactgagggttgaaatgtcatctatagtgtttgagtgccctgttgcatgtctccataaacccagcagtacttttcaaagatgcactggctggcaattaaaaaaaaaaatcttttctctacttttcacagtaacagaatctgtgggagaatttagatcctaaataagtataggaaaggcttagactaaatattaacctctggagagggactacaactatttgagtagatggattccgaaactttcattttcttttccaaccttaaacgagttagttcactgctaaatttctcacgtgcactgtttgggttatggtaaaataaattaattatattgtttttgccttattaagttttcttctaggttatctaaaaaaattttaaaactaaactttggaaaacaaggacctatagcaaaagaatgaataacttatcctataggcttccaactgaatgttttattgaatttctatgtgtgcagcttgtgacatgaaaagtttgatgtttgtgttttatgctttgcagtgaaataaggaggaaagactctgagggaagtcttgcaatgcaataagcattttgcctgtgccacacctatataactctaagattcttgcaagttgcatacatatgagattgttcactcattcattcttttatagccagacaacttctcattaagaagtctcattgcatttttgagtgagaagatcgttttactttctctaaacaccagtctattgcttgaagtgcatagttctaaaattgaagcttatattataactctaaacaaaaatatgaattttcttattttgtactgtgagctcatagctcaaatacggatattcatatggattagacagcaaacaagatacttatcaaactcatttacaatataccatgttctttgtttgacatatatagaaatgctcatttaaaatgatgtgcatggatactacttttaatcggtcatatgataacaaaacttttagttctttg

SEQ ID NO: 99 - DNA, 7941 bp, Mus musculus
ttttgagatatttttctgctttaataaaacaacactaaatataaatgaaatagaaaactgcctcctataaattccagagcagtatggagaacatttgaaccttactttcaatcaaagggtcatgcctgtgaaggccgttctatataaaggttataacaaaagtttgaagtggagcagcattaccacagttttctgacctcaaaactcagtgatttgaccttatcattgtctctgtgggtggcttaaaattatgtagggggctgatgagctacctcagtgggtaatggagcttgggatcctcagtttagtctctgggacccacatggtagaagagaactgattctcttgagttgcactttgtcttcgatccacacacacatcacaatattctagtcacactcaagaataaataaataaacaataatgactgtgataacagagaaacagaggcatatggggatttttccatgtgaaaaataaggctgttttacaattttaattctgtggtgatgatacttgtcaaaaaatttgctattagctttatttcttcatccaaggaacctcttacttctttcttgccaactctcattctttcagcttcttattcctacaaattcagcaggcatagaagtatttccacaactttgaataaattactatgttaagtattttagtttttacaagaacatctctatcttaacactgattaaaatccatattccaagtaataggattatagtaatgaagtagatattgagaaatccagtcttacttagtaccaatctcaacagcatggaaagtggactccttggagaaatggctgacttcaggacgaggccaggaaaagttccttgtgcaatccatctccaaaagtatagaagcatcactgctaatggagacgcgcaagtggagatagcaagagttcctatgagcagaacgtgacctatgattgcaacgtaatagagatggtcaatttaaatgcatggatacatttgcatatttctaaaaatttaaagtaaacacaagtcaaaagggaaagctctttttctaaggtccatatcagcttgttccacatttggaccaacaaggaaagaatcacagagacagaaaaacactctttcacacccaccaaagtgatacttgctttctgcaggaattgtcaatggatgcttaaggcactagggggaaatatttggagaacgaggcactgcatggtcttgggttcctcagttattgcagtgaaaagcactgtgactatggagaaatctaaagaacaccaaaatattaactttatattaaattataaagtttaatatccctaataatcagacaacccaataccttgtttcttctaatatgcttagaatggaatctttccctcaaactatggagccaaatctgataagaaacactctgactaacctagcaatccctttcaaatatattgtagccatgaaagattatatatacacttagcaactgactgcaatagaggaaagtaaaaatcacacaattgtaaacatattgcatggtctttgatctcttgattttgtatacttggaagaaaacaagcagaagtgaggaattgggaacagttaagccaacttaatgagtacatattaaatgataacattacatcaatgttagatttcctaagtgtgaaaacactcatttatgttggacaaacctgattgttaggagagatatactcattttttaaagattaacagtataattattgattttgaattgtgtatgtgtgttgtggtagtagtagtagtagtagtagtagtagtgtatatgtcagtttatgcatccattgagaatatggcaattaaaatgagtaaaatattttatgtataaatattgaaatttcaggagtaggacagttctttaaagtggccaattttgttttatagaaaaaccatgttatatttataagagaaactatgaaatcataatagtttaagaggtatgcttttaatactcaggagcccgagtcaggcagatctttgagtttacggtcaaagaaatccaccaatcaaacagaacaaggcactatcaacagcttaatacattggaggttcccaaatcaaccattgtagttattgatccttttcattctgcagattctttaacaagtagcaattaatttcacccatttggacaagatggctttgcttacaaaacaatgtgaaggaaaagaatgtggactacttgaaacaacatgtctataaacaagtagatccagagttggccaatgaaggatcacacagactgcttattttacaaaatagtttgtaaaaatctgctctcaactccctcattacatttaagagagatttgttggaaacaaccagcttatgaacatggggacttccttaagcaccagcatgcttgattgtaaataaaagtcaaaaatatcgtgtcagatggctgaattgataggagtggacaagagaattggcatctgcgaagcccttagaatatggtatagcaactcattctcattcattttcacgagtattattgtatagcttcaggaccatgccagtatgcctcgtataatgaaatgtggtttggactaagccttgttgaggtttccctccactttctttttactcttcttgtccttttacccccccaccctctctctctctctctctctctctctctctctctctctctctctcattgttttgctttgttttcatgacagttggaaactattttcagttcacattgagactctttaaaattcagtcaaacagtaccacatattcactagctataagtgggcttatgggtatttttttttcaacttatatcaataagcatgtcacatgacttcaagggcaattttgccccctgtgttcttacagctaactcattattttgcacaaggaaataagttccctcttgtgtctttaaaggatttcatgaattccttccttttagcactttggtattttaaaatatattaaattatatataatagacaactaacaagatatctattgataggcaagtttcactttattttcaattacacagagagtttagaatatcacattttagccatgaaatcatatcaaatgtaattttctcttatataataaaatataagaagtatttctaacactgcaatggcagactttttttttaaaatttgggtttttattaagcctgcttaatatgaattgtgaccatgtttttattgcttatgtttcatttaagttatattctttgttaaatttaagtcttggaaaaataggcaatagcttgattagtgatactacatataaatctagattattcttgctttttatagacaagcatctgcggattaaatgattatccactatttgggccactgtttggtcgttgttttgaaacctgcttaggccaccagtaagaagcgtgaactatttctcctaaccaactgtaaaatggtaacatattttatgaatcaattaggcaaatacagacatgaaatgtgcctctatttacctgttgttttcaaatatttgaaaaattgacatgctttcccccctcattttagaaaggaagctgtaacagagttccttgatattaatcttttcccatgtagggtagttttaagtctcttgctctgaagatgctcacccttcagtggcagagctgccgttaccagcactttgagcttgcacttggcttgaaatttgcatggaaaccttagaactccctttgggcagtccaacaaactgcagacaatatcaatggcaagcaatgagctaaaatgtgttaaagggaagctatataggtgatatatctctgaaacattttctacgaaactcccagaccaaaattcccactgtcctttcttgatccccagtgaatactgattttccagcaggcaacagttcccaccagtgtgagtaagtgaggatttcttcctctctagagtgaaggaaggaacccatatatttgattccctctttgcagccaccaagtcgatattcaaccctgattaaaaacatccttggcaaggaagtttgtctctgtctttctagactgttaccacttaatatgcacatgaattcagttcaagactgtcccattgcttgcaggtaaatctcaaggatggattggacgaatggataactgggattgtcatcaaatgctgaacatgtatttgagccttatcacaactatgcctgtttatgagagctgttttgtcttgtgcacacccatcttctactgttccctgtctctgatttaccttgatactgtagtctgaatagattagctcctctaggcatacaatccttttctggcaaaggcttgagtacatattccaatttaagcaatcagacagatgacttctctaaaatctgaatcttgaacatgatgacttccagaaagagtgagcaaccattttactaatctcattacacctggagtgttctaaaacaattccctcattcttttttgctactaagattaaatgagctactctcccctctgttggatttttcagcttttcctctgaattgatgaatgttccattttattccaacaacattaaaaatatgccccccaacttaccatcagaaattccagaataatgtagaaacatagtggcattgtcctagttcactgccactaaaattgggataatgaaattaactaacttgctgaaaagcacacaggcaataagaaaatgagtcaagtctccatcacacagaagtttaggtggagtttcaaatagttctctctctggatagatatgtaagtgaatgtgtatgttcttcacaattgaataccaaccatagaaagagtttctaataattttgaactttacatattttctctgagaataagtttacatcaagtaaaaggatgttaaaactcacccactattctagcacttggacatgccaaaacatcactcttaacattttgatctcttttttttagacttttctctccactttctctgtctgtctctccctatctgtctcttcctatctgtctctctcttcctctctctctccccctcccctctctccctcctggatatatgcataagaaatacaggaacaaatagggatttttgtatgtaataaggcccttgttttatgttcagattcaattatcatattttctttgaataattataattgaaaatgtattaacagaaagataaacaatgttaatcattcctcttatattttatcaatgcctatttagaatgttgataagcaccactgtaatcttactattttcttagagtcaatcctgaaatggaaactatagctttgaaaatttcatcttttgaaatgttacattgttttcagcaagattatgttaatctatatttttataatcattgttttaaaattagatttattcaactgtacaaacttaacttataaaattaatgccaagttgatagctcgacataatagctcatggtgtattagctgtatcttctattgttttatcatcataaattactatatgctaactacagaaagataaaaacatataggacataataatttcacatataaacataatagcttaatatgtatatattaaatatatacataattatatggttgtggtcttatggttgattctcttatatctaaaattatatttaatataaattagttataataatttattcatgagatcttttctctattactaaatattctccattgttattttaattaaatatggttctttaataatagtcttgcttactagactagtaattaactattacttgtcattgattaacgttgaacatataattgatcaatcaatacttgtaattgatttgcaatatgttacttcagtaatttctgtgactgaatttgtgatgatttcacaaatggaagtatagaattattccaaaaatggaattatgggtttagataatatggttaatgtaaagttctttggagttggagagatggctcaaagttaaggggactgctattcttacaaaggaccagagttctgttcctagtccctaaagtaggctacacaaaactgcctgtaagtccagctccaaaggatttgatgccctcttctggccttcaagggaacctgcacacatgttgcagacacacaggaataaaaataaaaatgtatctttaaattttcccaataaatatgccaaacttcccttgaatttttgctttagatttatattcatttcacacttgtcagaattagtctttttttttttttttttgctgtttttcagtaatgtgattttctaacttttcaaattggaaagaattgaaattttagtaggtcacttatctgtgggtctcagtgataaacgtgctttaaagagtgtgtggttatagtaattcacattgcaaagtttacaattcccaacttacattattttcataatatgtgcttatattttagccagagatatctttagaaatgtagaggctgtggtctctacccgtaacattgagagcaacgcgggtggtggtgggggggggggagggcgggggttgggagagagtcacaataccgactcttcaattctttaggcctatagttttcatgaagtttcattagtatttattgtgtctagaatacactttagcaaaattgtgaggttgcgtcgaaaatgccctcactgtatttttaaaatgaaactgatttataacagggggtttataatttattgtccaacagttttgctcaacgtttaaatataaaaatcacagagagttaagcgaaccagctgcctcttaatacagagtatgaattgatggattaatgaatgagtgaagtggtgagaaccaagagttagaataatattgtagccccttccaataatgacacaatttatcatgttggattgccactttccagattttatggaccatgccaccaacatcctcagtggacacatcattattattattttttaacatagaaacgagcaggtagggtacacagatacagcctatgctttttgaacactatttaattttgctatctaaaaacggccttcccctttgccccatttaaaatgaaatcagccacaacctgtgattctgtgagggcttctttgacttaggcagcatggaggtctgttttttccttaggaaacacgtttcttggtcacgtggttcctcttgctttgggggtttcaattcctgagcactgtggtggggaatgagaagaggctggaggctgagagtgggtctgtactagtgctaaccaggagaaatggaaggttggcctctgagccctccactacctttggccactctagctcgcgcaggcgcgctctccttcctacccccagccccgccctcattgcacctgccaggtcataaacctccgcccacccacacccgcttcgcctggcggtccgggcttacccctccttgattggccaagagtctctggagcgcgtccaatcagcagccctcctgtgcgacctattcccgctcctcccgccctgccggcctcgctggtgcccagcttctttgtgactggtgctcgcagaggtcactcagcgtgcggtgtgcgatcggcgggcggggccggctcaggtgccgggacgcgggacagacgcggtgggcgagggggcggtcgcgccgcgacgtctgcgccgtgaggcttcgcgcgtgagtggcgcgggcgccaggcctggccgccgagctccagtggcgggcgcggaggtcgttgacgcgggcccggtcggaggcgcgtccgtcgctgtgagcgcggcgtcgaggttctcggaccatggaggacccgcagccgctgccacagtccgagctgccgctgtgtgacagcctcatcatctgggtgagtgtagttccacgcttgccagcgaggccacctgcggggcgagcggagcacggagcctccggctgccacgtacacctcctccgcaacccttccgtc

SEQ ID NO: 100 - DNA, 1351 bp, Mus musculus
ttcctcctggcaaaaagcagatgcaaagatgggggctggggtaaaactgtccctctagcaaagactgtggtgggaaggtggacccagagcactgcaagagctctttaaatgaccccatctctcacaaaagaacacggcttaggccctcagagaccccaggatcaggctgtaccagcgcaggccttccagggctggagccagaggcaagcagcctctgcaggaagcaggcccagcagcttctcacccagaaccaggaagtgcgtggaaggaggagagaggtcacactcagcttgggagaaaaatgtcccttcacctggcggcttccacaccagcaagtgaggatcagatggctcaggggggtgggcacttacccgccatagaggcagcttggccgcttagagagcctggctcctctgttccaaaagaggacagtagcaagctcccggcggcagacattcctgcttccggcggctgctcggcggcctctcccagggggaggaggaagccgagagcacaagctgagagtcaccacttaccaggccagctctggtcttaagactcattagatagcccggcaacacaaggacacctttgcaataggccaggaagagccgggccggcctcgtatccacaggccttagatctatctaattcatcaccctcggctgccgtgtggctgtgcaggacgtcatccgtgcacggcgcccaagagccatttattatgggagactggaataaatacacacaaccgctgtggttctgaggacatggtggctgtgggagaagggaggtgatttgcattttgaacatgttcttaatttttttttttttttggttaggggtttccgactccctttagttgtgacgctctttcagccatgaagaaagcctgcggatctgtctctacagtgccccccaccctctccaggcatcgaatcaatatgtgaaatgccaaccaccaaaaagaccaagcaggacagaaatggctatcagccaagaaaagaggctgacaaattgtgtttaaccctcaaccaccagactagtggctatagcttgggccttcctcatattcagctttgggggggagggaagtgtcccaggctagagagagacagagtcagtactgcacacctcccagtcctaagacttcctccagcatgggtacctagctaggtccttcctttggtgcccaccaaacattgctggctctgaaacaggttctgggattgataccaaacacattcatcccaccccagagctaggccccggggcctgtggcttgtaaactacagaggggggaggggtggcagcaagagagggcctactgattcatagggtcagacgaagaagg

SEQ ID NO: 101 - DNA, 3934 bp, Mus musculus
gttggtagcacatgcttttaattctagcactggataggcagatgctgtcagatctctgagttcagggccagcctggtctacagagtgagttccaggacagccagggctacacagagaaacactgtctcaaaaaacaaaaacaaaaacaaaaacaaaagaaaagaaaaaagaaaaaaaaaaaaggaggaggaggaggagaagagacatgacctcatacacttgctccgtctgaccacattaatgtgtggtactaagggcctagctggatgtaaggacacacctttctaaaagttacctttctgttgctgtcaccaaatacctgacaaaaccaactgaaggaagaaagacttgtggttcaagggtacatacagcctgtcatagcagagatggcatggcagttggtcacatgacccccacaggcaggaatcagagggtgctgtggctcagccagcccactttcttctctggattcagtccaagactcctgcctgtggaatggtggtgcccgcctttaattaaccctgtagaaaccttctcaggctcagagatttgttcctgtcagattctagatctcttcaaatggatgctaaccaaccacattctgtcctccaagtctccagaaccatgaactgaataaacctctgttctttataaatcaccccgtctccggtgtcttactacagttactggagcaggctcaagacaaacacatccagaggcttgcctcacaggcccaaggattgcctttccttgatctcatttacgggctctgcggtctttccgaccccaggacctgcagggctctgggtcatcctaccttactggaatcatggggctggccttgagggagaaagaaagcagggaaggggaacgggggtggggaggagttgaagagttgaaggaagggtataggaccccagccacgcactgttccccttctccagctccgcccacgctcctccaaccccgcccacgctcctccagcccctcccacgctcctccaaccacccttggcatccttgtagactgtgaatggcaggcagcaccacatcctgctactttaagccttccagtggctgcttcttgtactcaggacaaaattcgccatcgcctgtggctgacaagggacgtgtcataaggcctgttttccctgtagcctcgtgttaccccagctccttggccacttcctcatctcttgggttcaggctcttctctttacatgccgattcctccatttggaaggcctcctcagccagattgagttcctcgctaggcagagccggattcaaaggtaggcagcggtgtggtggcatgctgtaaatcctaaacaggggcagggcacctgtgagtttgcagtcagtgtgagctacatagtgacactttgtctaaaaaaacaaaaacaaaccaaaacaaaacagaaacaaagagaaggctgaggagatggcttagtcaaaaaagtatttgcaaaagaatgaggccctgggtttgatccccagcacctaagtggggggtctacgctccaaatcccagcactaggtaggcagaggcaggaaggtcactgggcttgctggtcagacagacagacagacagacagcctgctcagcaagtcctaaatcccagtgagagaccctgtctcaaaacaacaatttcaaggtgtgtcacacagcttcaatctcagcactcaggtgacagaagcaagtggatctctgtgacctacacagcaaggtgcaggccagccagggttatatagtgagaccttgtctcaaacaaaactaaacaaacaaacaaacaaaaatccaacgtggatggcaactgagattagcctctgaccttcacagagagagagagagagacagacagacagacagacacagagagaaagagagagagagcacaagagagagatagcacaagagaaggaaaggaagaagaaagactgaagggcaagagtagcctcctctgggattgcagccttagccctgagcctggctactcctttcagggtcaggccacccaatccctttggacaatgcagtcctctatcccttggacccatcacagctgaacaagaaagcagatacgtggttgcatcagagacagatttagattacagcctgacccacatgcccaccccggccctcggcagactctggaatggcaaggtgcctctctgaatcaggaggagacgggtggtcacctgcctccctcacgtgacaagcagagacccagcatggcccttgtcacagggagcttcccccagccagggtctctggttcacttccagcactcaaggtcaccggtaagctttcttcctattgagagctgttcctggggcttgggtctgtctgtgcccacacaaagcccacaggtgccgtgttagtcatggtctccagtggaagagaatcatcaaaacagggggattatcagatttgtttataggctaggtgctgggtggtccaacaatggctgtctgcaggatagagagccagagagccagagagctcagcccacagtcctgacctggtgctgaaggcctggaggaccccaggagagacactggtcttcaactcaagttcaaaatcccaagaagttgggttgcagtctctacaagacagatacagcagcaagaagcagtgctgggtgggcactggcaatggtagcctggatgcttcctcctagggctgctagaagctctcacccactctgaggagcttttctctccatccatcttccctgagaatacactcacaggactacccagaggcaggcgtctaagaggaccccagatccaatcaagctgacaatcaatattcgccatcacagctgcccaccaacttgacacattttagagtcgcccaggagatacacttctggaagtgcctgagggagtttccggagacgtttggttgaggagggaagacacaccctttatcacagagctcattcctatcctttatcaatttatccagagatgctaagagcagccaaccaacaaaataattattttccttatttcctctcaaactggttcaaagtttcgtataccaggtcaccaaaaccatcgccgctcacaactgatggatcaagataagcgaaggcatttgcctctgtaagcttaaagcgtaatttccatcatgggctttcaatactctccatctctatccgtggcagtcccagttcatggactagggttcctaatgcatagagaaggggagaaggggagccagctgggctccagcattcatctctgcttcctgactccagtgtgaccagctacttcatgttcccaaagcgcaactccagtcaccatggtggaaggcacacacacacacccgccttgagtgagtcccaaccctttccccttccatccgtgagttgcctttgcttggcatcttgtgactccctcctgcctcttctcccacaaacattttttttccccacaagaaagggccctgttccgtactcccctcggtttttgtggttttgtgtttaggtttttgagacagagtttctctgtttagccttggctgtcctggaatttgtagaccaggctggcctccaactctgtaattctcctgcctctgcctcccaagttctgagattatgggtatgagccaccatgtccagcttcaccccgctttttgagagaaaagagctggcttctcaggggctccaatctgccacatgctgcggattgcttcagttggccctcacctgccctctcagagactgccattatactcactgagtgaatacggaaactgaagctcagacgtgtagatggctgcatcaggaccacacagcagggggagcagagaggggccaattgcctcccgatgcccagccaatgaagatggcaatctagaaagagcttccatcctgagcagcaggagagggacaaggctgtgccccttcacccatgtctcaaacctg

SEQ ID NO: 102 - DNA, 2402 bp, Mus musculus
ggctctcaggcagaggctccacaagaagtggagtgctgcggcagctctcccccgtgttgtaagcgctggtgctatctttgtctgatttctctggcagttcagagatatcagacagctcatgctttttgggctcactggctgccaggtcatagagactttcctcctccagcagccaggccttcatacagcgctcccgcaactgctgcatcttctgtgcccgcaagatattgcggcacttgaactctaggtgccgaagctcttcctccagcatggccatctcatggcctaggctctcattgcggttgacatctagggcactgttgccactggaggcccgggagaagaagatgcccagctggttgccattttccaggtggcacttgatctccagcagctcccggtagcgttcatactcctcatcagtgagcccaggtaggtcagcccctcccagccctgccccctcagctaacagagaatccatgctgaagtggaagtccctgctctgtagggcatccccttgtagaccaaatttgcgtaggcttccaggagtgttggtggtgctgggaggttcatcccccagcaggtcatgttcagagctctcttcattgcgggtactctcatcagtccgacccaccccgctgtccaggtcctggctgttgtttaagcctgggcccccatcaggagcccccttctcatcatttccaatctgggacagaaatgacaaacatactcagttaggttctcacagacaagtgtgctgcagaaggactagaaagttcacagcttgctcctctccaggcccatgctggaagacagtagacacatttcctttctccttcctccctctctttccctacccagttagcaggccttcttccttccttacctgctggacaggaggtgactttagcttcctagcacgaaggtccccttcattctcagatccaaagtcatctaggaagtcatctctgtcactgtctttccaccgctttgctagctgcagagacaagcatgagatagtcaacactttaaagccctccccaatgcccttccaccttgccctagaccctgcgcactcagtaaagtaaaacaggccagcagccttcaagacagaaagcctgtgaggagccctgtgtcgccctttcataaagacatacacacctggctctcaggtcgggccaccagcagggagatgttagtgttctcctcctggctcaggatggccactgcctcctctcgattttggacatccattccattaatctgcagaggtttagagaatagtcaacaagaatgctagtgggggactctggctgtgccaaggacagggtgttgaactctgggaaggcataaattagcagaatgcattgggggaaaggatggcctggcctgtataagagcatatgtgctcagagaatggagaagtagaagagggcagggaggtgctggcaggaatacatgggagctctcagggaagttgagcagaacagagatgagatttggctcaggacatggtagattccagggtagaaggccaggttctcagcagaaaagatctaggaaggggttgaaaagaaggcagggcaggcacggcagcctgatttctagtgctcacctggatgattctgtctccctcacggatccggccatctttggctgcaatgctgttgggatttacctgcaggacacatgcatcttggggactttggcaactttgatgcccttttcagtgtgtgtgtgtgtgtgtgtgtgtgtgtgtgtgtgtgtgtgtgtaagcggggaaaatgccagtcttgctcactttcccacttcacctcagactagcagcttctaagctttaggaagcaggagtgggacagtgagccaaggcagtttgttccatcagcttgggagatacagggtgaccagaaacagttccctagtccctacccaacacttcagtggttttgcctctatcccttgtactactatactgtatatatcaaagtctttttttttcagtgttaaggaacctacagccttgtatatgttaaaaaagtattttactattgagctatacccccaacttcattgaagctttattttctttttgtttgcttcctttctttccttctttctttcttttcttccttccttccttccttcctattttttctttttctttttcttttttttgcatgtatgtgcacagctgcatggaggtattggttaaatccagaagaaggtattagatcctctggaactggagttagaggtggttgtgagacatctatgtgatttctgggaactgaacttgggtcctttgaagaagcagtaagaatcatcctcctaaaacacttcccacatgcatactcccctttaaaacagtttcactatgtagctctaatgaaccgcaagctcct

SEQ ID NO: 103 - DNA, 1782 bp, Mus musculus
agatctttgcctagacatgggagggcgggagacagaggaacaaaagtggttttgtttggtgatgcctaccgggaaaggcagcgagctgtttgcttgtttacaaccaaggtgagagtaaagttatctactgagagtccaaaggggagggggagttggtttctaagccagggatctatttgtggacttcaaagaggcatgctcggatcaagtcccaaagctttggcatgatgtttattagccaagagaagtgtattgcaaattaatacccggagtggcatttatgaatggggggggggagggaagcttccctcttcgctggcatatttccagccagaggtcttccctcatccctcccccttttttttggtatgttgtacttgtttgtttttggaggttcccagttttagttccagcccactgcctgcattggaaatccaagaggaaacgagtgcagagttctcccggagcctgacgtccacttcctcacggatgccggaggccgggtcaaccctcctggcctctctccctggactggcggcggtggaaactgagcagccaaagcagaagcggaggagaccaccgtggagtgacttgtcctgaaatcaccaggtgcaaaagctaccgggacaaaacagattctaacaggaccattgtgccctgtggatagctggaaaaaagactcggggtgtttgcagacaccctcccccaccgccccctatgtgtctcgctgtgtgtatttgtttgccccccccccgtgtgtgtgagtgtgtgtgtgtgtgtgtgtgtgtgtgtgtgtgtgtctgggcccgtccatgtgtttaactcctttgttttggatcacttagaagccttctttttcaagggtagtgcagtggctccctccaagttccgagacatgagggatttagaaggcaacactgtaatagaggaagttgggttttaagatcttattaaacatacaactgaagacacccctcccacacaagaccctatttggggttattaatgccattcataaactgggatagcttttcttcatttttaatatttagggcctctctgcctttgcagcttcgcgatcttgcttaagagagcctcctgcgttgcctgttctatgaatgactccagtgagaaggagaggctgttgcgcacactccagtgaagacagctgttactggaaagagttaagttcattcattcaaaagcgccctttcgtaagtcctggaggaatttgctagaggcggtaggttctccaaggctttctgggggtggggacttttaaagacaatgggttgtcaagtgttatgcaaataatgaaagcaaagcctaggcctggtcccctcggctggccgatttattagagaacagttcctcctgcgcacagttcattgtttccatcttagggaagctcgggagggtagggggtgagggtggagaaggcaaggaacagggtagaaggaggcgctggagaaacagaatggagaggagggttcctggcttctgttgtggcgtcttttctatttgacttcatggttgtaagtatttccagatggtgaatcagacaccagacgtaacaatatttccatatttgggtatagcagtagcctgcgtttttaacatttttctccctctgttatccaaccacaaggcattcttgacagcttcaaatgttgttaaatatagacttaacttctgttcccagagcaggaaattcgttggaattccttgtttttcacgcaatctgtctatcatgatttaaaataaagttgcagtggatgatcc

SEQ ID NO: 104 - DNA, 3614 bp, Mus musculus
gctggtcttgaggtgggaatcctgctgtgggcagcaggcagcccggccaaagaggaaacagctgaaggatctggagctatcccgaagctccatggtaagtatggaagcaggcgccgcggaccgagtctcagccttcagactaattgcgatgcttggccgtaccgtttttcataggcttccctatcttggactacatttcccgttgtccctcgcgggcttgagctctgttggtaccccaatccagtgctcagttttctcagccaaccttgtgcatttggggcaccttgggaagggttctccaccttagggaaattagggatgttttgcatccagtactatgtttgcctttatttttctgagacgaagtcttgttttattatacgtagtacatattaaagcggagctggagttaagatacatttaaaacagtaaaataaaatttaaaaatatttattcgtatgtgtatgttttgcacgcatgcatcgtacatagaggccaggagagggtgttggatcttctggaactggtgttacaaagagaagttttgtagtcgccatgtgtgttctgagacgccaaactgggtcctccgcaaggacagcaagttctcttagccaatgagccatctctctggcccctacatttataacagttttaagtactggggctaataggcgtttagaaaagaataatatacccaagtgtgagcatagtcttctaaaggcagatcttggtttatattatacatattgcaggggcctcacaacatttagacccatagcaccactgtcttagatgcaacacttggtgacatcgaagttatcttggtttaggttcactgtccaactgttgagtgaatcacaggctatttatgcaatcggatgttgtaccttataataagggagagcttccaattcatcatacttagtactttttttatataattatttcacttacaaattggaaatatttgtaacgtgacaggtattcctttctttaatgaactcaagaagtagttaaatgacaagactacaaaaaccttgggcatttttatttttgttgtgttattcatttgggaatagggcttgtgtgccatgaacaccagagtggaggtcagaggacaacttgcaggagtgggttctctgtttcaaccatgtgggtcctgcgaaccaagctcagcttgtcactttacagcaagtgccttttccctttcctgagccatttcatttgccacctgggatgttgttctgtcctgttactttggacccatgtatcagtagcttggtagtttggtttcttatgctagatgttcttatagttgtgcaaaggatctagttgtgccagtcatgaatcactttccttgataactgctgtttgtttgtttgttggttggttggtttgtttgagacagggtttctctatctgtttgagataggatctctgtatagccctggctgtcctggaactcactctgtaagccaggctggtcttgaactcagagttccgcctgcctctgccttccaagtgctgtaattaaatgcgtgagctaccactgcctgactttatttactttttgagagggaaagtctctgtgtagtcctgattggcctggaactcacagatccacctgcctcttcctcccgagtgctgggattaaaggtgtgtgcctagttcttcatattgtattttttaaatttgttttttaaaattgtgtgtctgtgttgtgtgttgggacatgtgagtgtagttgcttgaagagtctagaagagggtatggtattttctggaactgaagttacaggcagttgtgaactgccaattgtgggtgctgggaactgaattcaagtcctctgcaagagtagccagtactcttaactactgagcaagtactcttaaccacttgtcccttgaaatcatgtttgattattggctgtcatattctattattgttatggctatgccaaaaaatgattctatatgtaactacttgagaaatcagtgtttttgtggggtttttttccttcagcagatatgattgtgtgtatggctttgcacactactgtgtctgttccatctaattgtgcgattgtctcctgcaacttcaccctatttctccactcaaagtaagtcgagtttggcctgtggagttctttgtgagtttggaagttggagaaacagttggcttgacttgagagtggttccatttgatgcctgggagatgaaatggctgagtcctgtgaatgctgggattcctttcgagtctgcggttatgcacattatgcaagctctccttactctccgagtgaggagagctttccttgtctttagagtaccgtgtatgtctccatcgctggaacaggtctgaggacctctgtctgagctttgcaccacctgcagtatttcagggaagtgggagagaaagggcctctcattctataccatttctgcagcagctaaattggcctgctggtgatgggtttgacctagctctctgtaatgggcagttagagaaatacaggcggggacatcaccctggcattcagggagcttagaacctccatgtttgcttttcctcctcagctctgatacctaagaactctgtccttccccaagagagaaacctggaggaagatccatcagccttgaactcctgaaagtcatgctgctcgtgagttttaaaattatgtaaaaatttgttatcctgaaacttcccacctggattccatgagttaatctggtcccctgagatctgtttatggtgtaaaagacattttctctgacaaatgtgatttgttaattctgtagagaggttttcctagcagaccttcatgtcccttcgtgaagtgggaacatctttgtaggaactaaaatttgaaaggagagagtgaccacacaggaaaacagggaggtggtgttggttaccatttcagcccttgggaagactatttcatggccctgccttggaagagatggatgtttgggtgcaatggagatctagctgggaattaagatctaatctgaggttacgccaattgtcttagttagggttttattgctgtgaagagacaccatgaccatggcaatgcttgtaaaagacaaccccttaattggggctggctgacagtttcatagtagttctttatcatcatggcaggaagcatagtgtgttcagacaaacatggtgctggagaaggacctgagaggtctacatcttgatcctcaggaagagaactggcttgagcgtctgagacctaaaagcctacctcctactcacacatcttcttcaacaaagccacgcctacttcaagaccacacctcctaatagtgccactccctatgggcatatgggggccattttctttcaaaccaccactaagcatttgggtctttctccactagctccttcacttttagcacaagagaaacacagagctgggggttataggaattgcaagtgagactctcagcctgacaggttggtgggtgaattcttgaagcttggaagggctttggagattggatttctactttggtccaaaatatgaggatgtttagtcattcttttcacttaggagattgtttagtccagaaaaacataatggagagaaacccagtctc

SEQ ID NO: 105 - DNA, 1301 bp, Mus musculus
ccgatattggatttcctttattttacaatcttagatacagaaatgagctccaataaagaactgtagtgacatttaagaaggttgctagatgtatctgattttgatattaacgtgcaaacgactttgaggacttgattattgttctttgataaagggcttccatcccttattttgacatatggcaccaacacccccacgtgttttccccctatttttcccaattccctttaaaatgtacatcaagcatcgtttatttcaaagaataatgtctatcattatgcaaactattaagtcagttttagaagccattcggggtcagtgattttcttctcggagcatcatgtctaactttggaacgtggattcaatgaaacccatggcagacagatggaattgaaaagtatatgacacatcggatttgggtttggggtataagacgaagattgaagcattgtcaaagggagaaggggtcctgagatttgcaatctgttgtttaagtgcctacattgtggaaatacaggcgactccaagcttgtttttctaagtttccaccctttgttagaagcggttcaatcctgtttcggaccagttctgggggatggtgaggaggggcgcttgttctcctctcagcagattggttacacgcgtcaggtggtggcgatgacttaattcctagtccaagaagaatataatgttaaaactggttatgtaatttgtttctcctttctaatgcagtattttagtgcaaatactggcgacttttcagatagaggaatactttgtttttttttaatatctaaaatgtacatcctagggagacgttaattgaacttaaggcaagtgggaaatggaggatgctttaagttacacagaattaatgtatcgtcttttaaatatgaaggcgaagccaattcttagggtttacgcacctacaccagggtattccaaatactgaatggttccctagttctttttttgcagcgtccacacggatggggcgtacaatgcctaatgacagcgctctcgtttttttttaaaaaaaaaaaaaaaaagggcaggcacatgaatttgcttttgagcctgcttggacgttgcagcctttaatgaaataagaagagacaaagacttttgcctcgaagagttcagacttgtagtggggggtatagatagagagttctgtggacaaacacttgatccattgcaccacgatctcacggttaggataactacctgcaccctgcgaggtgccccggcaagcctggctacgcgtggacgggctcgcagggctggaatagtttcaat

SEQ ID NO: 106 - DNA, 34330 bp, Mus musculus
accatagagtttggcgaggcgtactagaggggctacctattgcacctcccgggtggttcgggcttaaggttagccaggctgaggctatgggagctgcaggtggatacacaaccttggatctggtgtagctctccttagcccagagacttttaagttaaacaaacgcccaagatacctttctttcactagaatatcagccgattaacaaaaatggtcccaaagctccgtgacactggacccatttttagggctagagatagtcttcttaatcactttcttcccgctctttagctctgggatgtcctttttctcctgaaaattcatattctgccaggtcctttaaaaaaaaaaatcgttccaactctcatctgaagctccggctgccttggctgccagtttagcatttgtctctgacctttctgcttcctcgaaggagagggcagacagcgatgcaagtgtcttgcaatgacagcgctactgcagaaaatactttatggactgagaggtacttaaaccttaccctctagttacttttccgtcttgaagagtcttacaaaatttgttcagtgttgagaataaattgtggtggtggtagttatagccggaccgttcaaaaagagactaggacgagctgttttttaatttgaaatttgcacagacccggccgagggcacgcactcactacaagtctagagagactgccccgaccgttaaagacaggtttataaaggggaaaactactggttccatacttccattaacgtggtcgctgttggcaagcatgacaggatatgaacttttaacaaaaatgaggtatagcaccatggcttctctgcttgatcgaggagcagaaaaccttcaggttacagaagcaggacgatgcaggttagtaatagttcccataaataccgtgtatttatgttttgcttacttgtgtgcaactgcaccgcgtacgtccaatgcccacagagaccagaagagggtgttggatcccctggaattgtagaattgtagttttagttgagctctgccctgcagacgacggtaactacagatccagcctggaaatatgctgatttttaaaagacttatcaagcaagcaaacaaacaatctaaaaggtgaaaggaactgttggtgtaaacgttaaaaattaaagcgaaagtttgtttcgacttaggaaaaagtaatttctgttaaatagtcgcctttataaactggtatttccagtttgagggaaatgtgatgagtttcgggcttcagagtagttgaaacagtgttaaggtgaattttcatgagcattgagtttcattgaattttaataagcattttgaaggaggaaatggagtgtttagttatatgatgtgtgtactaattgctatctatgtgctatattcctcaaagtgtgttcaaaatatctcacttagcggccttttttcaaatactttcgctatagttctcatagtttgtaaggtagcctttcccactttacctgcttttacagaagaggaaggtgaatcaggtggaaaggagcagaggagagccagagaggggagagagagggaggagagaagtggagaggagaaagaggtgcagagagggacggaaaggtggggcaagagagggagggaggaggcagagagcagaattccaaatatcaaatctagtgaaacaaatctgtactgtgctacccgttaggcccagtaaaactaggtcttctccgcccagcgaaggattccaccttttacaggcgagcaaattgctttatctgggtctgcttgcatctgaaaatccactccatttcacccttccaggcggcaggcaaggttggctttcaccttctggaggctgaaaggataactgggaacagaatcagtgaagccagggactatgggtacaagtctcccaaaactgaccttacctttaagatatgagtctgccacaggtatgcgaggaatggtgggaatctttattctgagattgaagaacccagtttcactctactgtgaaggagatatttgtttgctgatgttataggcattagatatgggcattagatacccattccagctattaacatccctgaggtctcacacatttccctctgctctaacgaggctccaggtcattctcccacttgccaggagtcctcttcatttccatacaaatatgcaagcaccaccccaccagtcttgtccacttatttctaacaacagtccctaagcctgggattcacagcctttggggttagccaaatgaaacaaatgagaagtaaacccttcacgtctgtggagtttatggaggccccaggcttgttgccgtcctcctcaggtgccagcatagaattctggaagctttcctacccttgatttttttcctatcatctcctcttcttgctccatgtttctcttttcataaccctgcatacctcttcactgcgtattaagtgccacaccactctctaaatctctgatgatgtgtgtctctctggatagcttatgtgcctttgctaacatggactgtgatcttaatcatatttgtttctagcagagtgctaggcacatcctagggaccgtttgtggaatggatagatggatgaatttaattaaacatttagcttaaaaatctatgaaaacctatgatttataacataagaatatttacttaggtataatgtttatattaggtattatattaggtaaaatacaacaattgtatttttatttacatgaatatattatttgtttcttagccattttgagtacaaaagcttctaaattaaattgccttggacagttagaaaaagcctggaagaaactgtcttgtttctttgttactgtgtccaaaccattatcactgtccacccattcgtgaccatgactttctagagcaacacagcagccattggggaagctggctgtccagtttacccacttaaaatcttggtatggaagccgggcggtggtggcacacgcctttaatcccagcacttgggaggcagagacaggcagatttctgagtttgaggccagcctgggctacaaagtgagttccaggacagccagggctatacagagaaaccctgtcttgaaaaacaaacaaacaaacaaaaatcttggcatggaggctgggaaggtgacctggtgggcaaaagtgtttgccccaaaagcatgaggacttgagttcaaattcccacataaagccaggcagctatctcaaacaaggttgtcctctggcctccacacttacaccacggcatgctgtgcccaagcagacaagtacacacacacacacacacacacacacacgtgcgcgcgcgcacatagcttaaaataatttttaaagatttaattatttattatatgtaagtacactgtagctgtcttcagacaccccagaaaagggcatcagatctcattacaggtggttgtgcaccaccatgtagttgctggaatttgaactcagaaccttcggaagagcagtcagttctcttaaccactaaaccatctcttcagcccaaaataacttaatattgataagtataacaataaaagatcaccatctttcagctccctcttcttcttcaagtcattctttagtgtaagggacttagaagccatcacttcatcttaattaattaaaaaccaaacaacagggctagagagttagctcggtggttaaaagcacttgttgctcctgtataggacccgggatcagtccccagcacctacatggtggctcataactgtgggaagccacatgtgccgttgcagagtggcactgactactgctggccaccacgcataagtttggacaaacaaccaatgtgtacatatgcagtaaagttttttttgcaaagacactgcctggcccgagcatgataatgaggttctgtaaggtactaagagtataaccaatcagatgtgagacatgcaaatgaggtatgataatgaggttctgtaaggtactgagagagagtaaccaatcagatgtgagacatgcaaatgaggtatgataatgaggctctgtgaggtactgagagagagtagccaatcagatgaggaacatgcaaatgaggcatagtgcataaccaatccaggtgtgagacacgcctctcctaggcctataaaagcagcaccagttctgggctcggggtcttttcgcctctgcaatcaagctctcccaataaacatgtgcagaaggattctgttgcagcgtcgttcttgctggtcgagtccggcacgcgcaagacataactatccataattcaagttccatgggatctgatattatcttctaaccttcaaagataccactcatgcatgtattgcacatacatgcatgcatgcaaaacactcagacacaaagcacatctaaaaaagaataaaccaaaacaagttttgtagggagtagggacacagctcaggaggtaaaatgagtgccatgcaagcattataatctgaattgagcccagaacccacataaaaaatccagctgcacaggcacagacttacgatcttgccaccaaagagacagaaacatgtcaatgcccagggctaactggtaacttaggtgtcttagtcagggttttactgctgtgagcagacaccatgaccaaggccagtcttataaaggacaacatttaattggggctggcttacaggttcagaggttcagtccattatcatcaaggcaggaacatgacagcattcaggcaggcatggtgcaggaggagctgagagttctacatcttcatctaaagactgctagcagaatactgacttccaagcagctaggatgaggttcttttttttttttttaagatttatttattatttatatgtaagtacactgtagctgtcttcagacacaccagtagagagcgtcagatgtcattacagatggttgtaagccaccatatggttgctgggatttgaactcaggaccttcagaagaacagtcagtgctcttaaccgctgagccatctctccagccctaggatgagggtcttaaagcccatactcacagtgacacatctactccacacctactccaacagggccataccttctaatagtgccattccatgggtacaaactctaacacaaacacccacattaggcaacttggtaagctttgagctgatgagagaccctgtctcaaaaacaaaaaccaaggtggattgctcctgagaaacaacaccacaattggcctctgacctcattgcacatggacacatagggaatgtacacacagccacatacatacatgtacccacatgaacactatcccacaaggacacatatataaaacacctgccaataacaacaacaaacaaacaaatcacaactctccatgatcatttttaggaaggaagctaaacactcagggtggctaaaagcccaggatccatcttgcttatattcctaatgctctctgggtgctttctatacacagagatcgatagagccgtgggaagaatggaagagccagaggacggggatgagcgctgtgaaatgctttcttcgggacaggatacgttgactgcactcatgagctctctgcagctgtgactccctgcacaaattcaagtcatcattccaacaggtagcacccattggactcagtgggttattagtcggaaaaggagggcattaagcgggaaggaggtgtgtgtcttaggggagaagggaaaaggagttagggcgcacatgatcaaagtgcattgcttccatgtaagaaattgtcaaacatggactaaagatactctgttttcttaaaaagaaagagaaatgattatttggaatcactgttggtatagaaggaattatcggttatttttttaagatttatttatttattttatgtgagtacatagctgttttcagacacaccagaagagggcatcagaccccattacagatggttatgagctaccatgtggttgctgggaattgaactcaggacctctggaagagcaatcggtgctcttaactgcctagccctccagcctggttcttttttttaaaataaacattgaatcctcagactttgctattactcattattggtaccagttttttactgacaatgatgagtcttgaggttttctttgtatgtatgtatgtatgtatgtatgtatgtatacatgtctgtatgtgcacatgtgaaggcatgcatacatgtatgtatgcacatgtgtaaggccagaggttgacaataaatgacttcttcaacagctctccaccttattttttcctacttttccagtgaattttaatttggagtttcatcatgattatcagggtccctgggtaggagccaacatatagccgggtgtattactcagggttctctagggtaatagaacttatagaaatacatatatgatatttattagaatgatttacaggctgtggtccagctaatccaacaaagggtggttaggaacagaaagtctaagaatccagtagtttctcagtcctcgaggctgcgtgtctcagatggtctgcagtgtgtgctggaatcctgaggaatgggccccaatgccagtgaggggatggacttgtttgcatggcaagagcattcaaagaacatgagcctccatgttccatgtccttacacaggcttccagtagaaggcaggcccagcttagatctggattaaagatctgaactaaaggtgtgtcttgctacctcaaggatctgaatgagaggtaggtcttcccccttcagctgtgccttccattttcattaactccagatgtagtcgagttgacaacccaaaataaccacaattccactccttgtcagcttaacatacactcttatcagcttatgtcatgattaatttccaaatgaaagcaataaccagaccataataatgactaaacattataactatcccatgtacaatcacaaatgcattatatatttaaccaggccataactgctcacaccatgatgtaaccaaccagtgtataatcacaagaacattataaagttacaagaggggacaacgtcccttatgggacattcttttagtatctcaaacttaaatgtgacaaccattggtattctcttaacatcagtatgttacatcacgtgataaagaaattgaggccgggaggtggtggtgcacgcctttaatcctaacacttgggaggcagagacaggcagatttctgagttcgaggccagcctggtctaccgagtgagttccaggacagccagggctacacagagaaaccctgtctcgaaaaaccaaaaaaaaaaaaaaaaaaagaaattgaggaaagaaaacacaaatatttgtataaatacatccttaacaatttatgacagaagtatttgtagagagactaccttatgtgtgtatgaacgtggcacctgtcaataataaatatgatggcctatggcttaggcaggaaacaggaggaggaacatccaggaggagaaagaattctgggatagagccaggtgggacattcacccaggaagatgtgatgaggcacatggtccctgagcacaggtacccagccgtgtggcagcatataggttaattgggttacccaagttatgatctagtcagagaagagcctagctatatgaccaaggtatttgtaaatatattttgagtctcagtcttatttctgggaacatggtgcaaggaggaagaacaagaccaaacttgtacaaacactcaaatcaattataatcctcatttttaaacaataaaataaaataaaataaaagccgggcatggtggtgcacgcctttaatcccagcacttgggaggcagaggcaggcgaatttctgagttcaagaccagcctggtctacagagtgagttccaggacagccagggctatatagagaaactctgtcttgaaaaagcaaaacaaaacaaaaaataaaataaaaatataatcctcttttttgcaacaggtctcatggccttagctggtatttataatcaccttctactactcattctgtatatgctccacctcaagcacttcagcagcgttttggctctttgcctggagaagtgattcacaccttcattcctggtaggtcagtgccctttgtcaccctgcctgggtcaggcagctgtagtttcctgttgactttaatcacagaactcactagcaccaagagatttccttaaagtctgcactctagacagaaactgtcttatgtgtgctgtggcgcagcgatccaatttcccctcggtaacctggatctctcattcctcctagtgaaaaacgaaagaccccgagaggagcccctcgctcgagcctcaggataatagcggacccccaagaactcatgagagaccaagcttgatgcaaaccacatgaggctttattcagggaaagccagagctctggggacgactcatatcccacacagtggtagaggagttgaccctgaggggaaaggggtcccagtttttatagccctcaggggggaaaggagaagcggggagtaggggatttccagatctaagcaatgtaaaatgattgatttctcaagaaatgggtatgggagggaaacaaggaaaagagtctaatgcaggtgcagtaactccggattggcaccgggctgtggttgctggggagattttctgactctatcttagcaaccaatatcacaaacacctgacagtgaggtgcggcagtgggcacacacctgggttcaaggaactgtcagaacattggcagacacacggagcattgtgcacctctatttttctaaatcagtgaagctacttctactaacaatgaaatctattttcccaatttcagggcttctgtgactttttacatcctgtcaggatctttcactagcactgttgttcctttcttagcccgttggcttaagggcaccacaggcctgactgaagtggccaggtgaaagtgtgagcttttagttcaatggaatgtttgttgtggctcctgggaggagcaatccctacctctggaactaaagtttctaggccagcagaacttaaggttgcaggagcaggaagcaagaattttcctagtgagtcactaggggtgatagtgagtggaactatttcctttcgcaccccttgattcctggtcccaggaatcctgactatgggagaaactgtaccaaatattggatgctgattcaaagcatatacttactgccttctggagaactcagtcccagactacaggctgtgcacctaattggagcactaactgtctcttcaaaaggccatcccatctttctataaggccagctgcttcgggatggtgaggaacatgggaaggtgggtggattccatgatcgtgggtccacttttgtacttctctggctgtgggccagaagcaatactgtgtggaatactgtaacagtggataagacattctgtaaggccatggatagtaatattggcagaagcattacatgcaggaaaggcaaatccataaccagaaaaaaatatcactccattaaggacagtgtactgtcctttctgtgaaggaagtggcccaacctgccaccagattgctggctgatcaccccagagaaatctgttgtatatccaatatatacaaagagctcaagaagctggactccagaaattcaaataaccccattaaaaatggggtacaaagctaaacaaagaattctcaacagaggaatgctgaatggctgagaaacacctgaaaaaatgttcaacatccttaatcatcagggaaatgcaaatcaaaactaccttgagattccacctcacaccagtcagaatggctaagatcaaaaattcaggtgacagcagatgctggcgaggatgtgaagaaagaggaacactcctccattgctggtggaattgcaagcttgtacaaccactctgaaaggcacataagtatctttacatcctttgcccatttgaagagatctatccacatactttccccccagacttcttttgcaccagttttcccaagtccctgaccatcaggtcaacattggctaacgctcatgaatcagtgaacatctggccatttctctgttggaacaaaacgaatggccatgtatactgcccaaagttctgcccactgtgaaattttcaattctccagtgtctttcacagttttcccagaagacagttgtaatgaagcagctgtccacttctggatggtacctgcatagtgtgtagaaccatcagtaagccagccctagtcttctcttcctcagtcagccaatcacagggcacatccgtcaagctataggtgcatgctttgcagcagacaacattataacaggagtagaaaccatggacatttggggaactctttcatataacttgcttgtgtcttgaggacctcctcagacatggtcacatagataccacttccatttggtaacggattgctactgtgaacatcctagtttatgacttggtgaatcatataatgcccagatcaggatgggcatctcagattgcatggtaattcagtgagccatttaaaaacattcagtgtccattaagacccaatagcaggcccaaagatgtctttttcaaaggaaggataattatctgcagatgatggtagagattgctccaaaatactcaaagtctcttttgtgatttacctctagaaacctgccagaggctccaaatagcatctttatctgccactgatacctcaagtaccactgggtctcctggatcatatggtgctagtggtagagcagctcgtacaacagtctggatctcttgaaaagcctcctgtgccaggtctgactcgtctttctgggtcagtggtaaacgggccggagtaacacaccgaagggaggaaagctgtgtctccagaatccaaatggacctactaaacattgtacttccttcttggtggcaggagggaccagatgcaaaaacttatccttcaccttggaaggaatatctctatatgcctatactactgaactcttaaggattttaatgaggtagatggcccttgaatttttggctggatttgtttcctctgatgcacgtatgtgttaccaaaaagtccaaagtggtgtctacctactgctctcttggtccaatcagcataatatcaacaatatgacgccaccagtatgatattttgtggaagagactgataatcgtgatcccttctggctaagttgtgactcatatctggaaagttaatatattcttgagtcaaaactggaaaggtactactgctggccttgctaactgaaagcaaattgttccttgtggtcttttaagtagatgtagagaaaagggcattagttagatcaatagctgcataccatgtaccaggagatgtgttaatttgctcaagtagggacaccacatcgggtactgcagctgcaatcagagtccctatttgattgactctttcatagtcaactgttattctccatgatccacctgtcttctgtactggctagatagaagggctaaaaggagatgtggtgggaacccccaccccagcatctttctagtccttgatggtggcactaatttctggaattcctccagggatgcaatactggtttggggttactattttccctggcagaggcaactctaaaggcttccatttatcctttctaacaataatagccctcacccacatatgaggggaccagtgtgagaattctgccaacttttaagtctatctatcccagctatacattctggaactaagttgtggaaataaccacagaatgagttcaagaacccatttggacctactgtgagttggagttcagccaaaactctcttagtcacctgatctccataagcccctactttaactggagggccacaatatgttttagtatctcccagaatccgtgttaattaagaactggtatccaatagacctcagaaattctgattgtttactttccccagtatatagaaagttaccctctagccagtgcctatgagtcatgccaccataaagttcacttggactgtgctccagaccgaaagggcaataacaaagctttccaaatgtgccagtgcccctctcaccattttgtgttgaggggcatatcatctggcccttcccattgcagaggattaggctttaagcagcatacccactctggcattgcactttccctgagccttaaaaatcccctcatcaatgataagccataggacaccaggcatctccagctccttttcagagggctgtattttcagaagtgcttcagccaaccattcaaacaaacttttggcacatttttttttaattgtgggagattccatatgaaacctagagtctccaatcagagggcgcacatcattaactcaggctggtctagttttatgtttcctacaccattattttacactcttaaaatccattcccacatgtgttctccagacttctgcttgaatgaggtactcagtaagctccttactaatgtagtgcacctccttatgtaccacactttctacctcccctctaggagcctgctctgccttgagtctggttataggtttagatgcaactattgatgagccccaagggacataaggattgtcttgcccagcatttccttcagggaaaatcatttctggtttagcagacaatgaaggattaatttcctcaaaggtgaaaaaggcaatatttccagggatggagatgatagtagagagactgctccctcgggtcatataaacccttgagaatttgagggctcaaagttctcagcttcaatagagtcctcccacacatgcctatctgtaccggttggttatgtgtgtcaacttgacacaagctggagttatcacagagaaaggagcctcactggaggacaatgcctccatgacacccagctataaggcattgtctcaattagtgatcatgggtgggagggcccattgtgggtggtgccatctctgggcaggtagtcctggattctataaaaaagcaaactgagcaagccagtagcatccctccatggcctctgcatcagctcctgcttcctgacctgcttgagttccagtcctgactttggtgatgtagtaatgtgtaagtgtaagctgaataaacccttttcctgcccaacttgctttttggtcgtgatgttttgtgcaggaatagaaaccctgactaagacagaattgttaccagcatagtagggtatacctgtgacaacctgaccatgttttcaggaggactgtggaaggacttttgaactttgggctagaatagtcgttgggtgttaagagctctgcgggatgttctgtaggagcttgggacagtgcaaacaatggaggcctggcttgtgaaatttcagagggaagattaaagactcttattgtgcccattgctgttttgattgtgaagattctgtggttttggctagctggagctgaataatcagctgtggttaacaaggtaccagtgctactgaattgaaacctttgcattactgggatgattgatgctggtgagctggagctaagaaattaacagtgattaggaagagaccagcatcactaaggtgaaatcttctgggaagtgtttcctgagagcacagagaagctgtgttccagaggcagccttggttgtaccttgtattggcagtcagacttggtaatgtataagagtcacccaggtggtactgtttttgaaatatgaaagggtagctgctgaggcttggcactgtgagaggccaggagaggccattggtgaaggtccaacctcggtggcattgagggcccaggactgaagtagtcatgcagggaagttgaggcttaccaccatggaaagagcctatgagaggctatttgtgaaagtgcagtccagttgcagcagaagacagcagtgttttggagatgccagtatcatgggatgaccaccaagatcagcagcagcagtggagtacaggcagcatgcaggcaggcatggtgcaggaggagctgagagttctatttcttcatctgaaggctgctagcagaatactgacttccaggcagctaggagtagggtattaaagcccacacctacatctactccaagaaggccacacttaatagtgctactacctggcccaagcatagacaaaccatcacaccatcccaagttacaagatccttttttgttttttttcccattgatgtccctactttaagcactgataccctccaaggctgggactcaaagtttccctgtagttcagccaacattataatgagagctttggtttgactttttttgcaacttgggctctgcagatactggagagaagattctcttccagggcacacttagaaacctccagactgtttatgcgtatctggagctggtcaattttatcacagagcttgttgttgctgttcatcatatgctgagatgctagaggttggttaattttattatggacttcgttcctatcctttgtcaattaatccagagacactaaaggcaactgaccagcgtcattattttccttacttttccacaaaactgacaaaagttttataaactttataaagtcaccaaatctgctgccacccacaattggtggatcaggataatcaagagcacttctcacattaaggttgtaaaatagttacaccatgggctttcagcactctccaaacttcagaagaggcttcagtaactgcaggcactgacaaattagagagcctatttcagatacttaaaagatcccttcttccttatgctgtgttactgtagaactacttctggtaccacatctgtattagtctaaagtaacgaaatgtatagaatgaatctctgtctatctatctatccatcaacctgcccacccacaccatccatctgcccgaccgtccatctgtccgttatatactagaatgatgtacaggctgtaatccaaatccaacaaagggtggttaggaacagaaagtctaagaatccagtagtttctcagtccacgaagctgcaagtctcagatggtctgcagtgtgtgctggaatcctgaggaataggccccaatgccagtgaggggatggacttgtttgcatggcaagagcattcaaagaacatgagcctccatgctccatgtccttacacaggcttccagcagaaggcagggcccagcttagatctggattaaagatctgaactaaaggtgtgtctttctacctcaaggatctgaatgagaggtaggtcttcccccttcaaattaagcagcaatccctcacaggtgtgccctccatttgggggttttggttaattccagatgtagttgcatcaacaaccaagactagccattacactggtgtgctcctttcctatctggggaggacagaaggcagaggagaggtggaagagaggcaggtcaggtcttttcaggaaatgtgccttccactgggaggtcatcccaggatatgttgtgtatacatgcgcaggtactgctcacatacagactaagctaccatttgtgctctgtgatcgttgcctgctcacagtggtggaagtccaggtggttctgccaacagttcctggtttaggaagcagctgtcaaagggagcagtcctgtagttcttgattgtagtcgatggtttcagccttgacactaactccttaagacccttagcacaggtgctaacctgtccatctgacttttgggaccacctctctcactgaacctggaactcaccaagtctgctgaactggccgggcagcaagcccctagggaccctgcagtctctgcctcctggcactgagactgtagacatggatcacccctggtgtggtgatttttttaaatttgatttgagagagacaggttttacccctgttgctcaggatggcctcagactcacagagatccatctgcctctatctcctaaatgctgagattaaagctgtgttctcctatactcagttcatcactgacttttaaaaggattgaacaaacactctaccaactgagtcatgtccccaacattcttttcccaccacctattgaccaataattttctttcttctttcctagtctatatcttatatattttccatttcctttcctttggagtctttccagtattcctggcctaagagggcattgttgcatggttcctgattttagcgggaaagaatctagtttttcaccatagtgttatattagttaaagatgttttccccctttcattgttgccccttctccattgacacaggtgctatttagaaatgtgctgtttaatccccgagtatgtgtgaggtttccttataccttccttttgtacagttatacttgaaacacattacgattttataatgtttattctttaagttttgttagtgtacatgttatgacacaaaaagtcgtctctcttagtgagtgctcactgtgtgcctgacaaaaatccacatcctgctttgaagtcttatagatgtgtcggttaggtcctgctggctctctggatctggttgtggaggtcttattttcttccagctgggcttgtttattctgaagagacgggtgttggagtctccaagcagcactggctcctcctttgcagtcctagcaggttctgctccacacagtttactgctcttttgtttggtgtacagtacagacgttagaaactgtaacaccacccttccgctccactcgagccccgaggtaccttgccagcggagtctcgcccaacacctgcaagggctcacacaggattccccacgggatcctaagacctctggtgagtggaacacagcccctgccccaatccaatcgcgcggaacctgagactgcggtaaatagggaagcggactacccgggcctgacctggggcacaagccccttccgctccacttgagccccggggtaccttgccagcggagtcgcccgacactcgcaagggcccacacaggattccacacgggatcctaagacctctagtgagtggaacacaactcctgccaggagtccggttcgaacaccagatatctgggtaccttccctgcaagaagagagcttgcctgcagagaatactctgcccactcaaactaaagagagagctaccctcccaggtctgcttatagaggctaacagagtcacctgaagaacaagctcttaacagagacaactataacagctagcttcagagattaccagatggcgaaaggcaaacgtaagaatcctactaacagaaatcaagaccactcaccatcatcagaacgcagcactcccaccccacctagtcctgggcaccccaacacaaccgaaaatctagacccagatttaaaaacatttctcatgatgatgatagaggacatcaagaaggactttcataagtcacttaaagaattacaggagagcactgctaaagagttacaggcccttaaagaaaagcaggaaaacacaaccaaacaggtagaagtccttaaagaaaaacaggaaaacacatccaaacaggtgatggaaatgaacaaaaccatactagaactaaaaagggaagtagacacaataaagaaaacccaaagcgaggcaacgctggagatagaaaccctaggaaagagatctggaaccatagatgcgagcatcagaaacagaatacaagaaatggaagagagaatctcaggtgcagaagattccatagagaacatcgacacaacagtcaaagaaaatacaaaatgcaaaaggatcctaactcaaaacatccaggaaatccaggacacaatgagaagaccaaacctacggataataggaattgatgagaatgaagattttcaacttaaagggccagctaatatcttcaacaaaataattgaagaaaacttcccaaacataaagaaagagatgcccatgaacatacaagaagcccacagaactccaaatagactggaccagaaaagaaattcctcccgacacataataatcagaacaacaaatgcactaaataaagatagaatattaaaagcagtaagggagaaaggtcaagtaacatataaaggaaggcctatcagaattacaccagacttttcaccagagactatgaaagccagaagagcctggacagatgttatacagacactaagagaacacaaatgccagcccaggctaatatacccggccaaactctcaattaccatagatggagaaaccaaagtattccacgacaaaaccaaattcacacaatatctttccacgaatccagcccttcaaaggataataacagaaaagaagcaatacaaggacggaaatcacgccctagaacaaacaagaaagtaatccctcaacaaaccaaaaagaagacagccacaagaacagaatgccaactctaacaacaaaaataataggaagcaacaattacttttccttaatatctcttaatatcaatggactcaattccccaataaaaagacatagactaacagactggctacacaaacaggacccaacattctgctgcttacaggaaacccatctcagagaaaaagacagacactacctcagagtgaaaggctggaaaacaattttccaagcaaatggtctgaagaaacaggctggagtagccattctaatatcggataaaatcgacttccaacccaaagttatcaaaaaagacaaagagggacacttcatactcatcaaaggtaaaatcctccaagagaaactcttaattctgaatatctacgctccaaatgcaagggcagccacattcattaaagacactttagtaaagctcaaagcacatattgcacctcacacaataatagtgggagacttcaacacaccactttcatcaatggacagatcgtggaaacagaaactaaacagggacacagtgaaactaacagaagttatgaaacaaatggacctgacagatatctacagaatgttttatcctaaaacaaaaggatataccttcttctcagcacctcacgggaccttctccaaaattgaccatataattggtcacaaaacaggcctcaacagatacaaaaatattgaaattgtcccatgtatcctatcagaccaccatggcctaagactgatcttcaataacaacataaataatggaaagccaacattcacgtggaaactgaacaacactcttctcaatgataccttggtcaaggaaggaataaagaaagaaattaaagactttttagagtttaatgaaaatgaagccacaacgtacccaaacctatgggacacaatgaaagcatttctaagagggaaactcatagctctgagtgcctccaagaagaaacgggagagagcacatactagcagcttgacaacacatctaaaagctctagaaaaaggaagcaaattcacccaagaggagtagacggcaggaaataatcaaactcaggggtgaaatcaaccaagtggaaacaagaagaactattcaaagaattaaccaaatgaggagttggttctttgagaaaatcaacaagatagataaacccttagctagacttactagagggcacagggacaaaatcctaattaacaaaatcagaaatgaaaagggagacataacaacagatcctgaagaaatccaaaacaccatcagatccttctacaaaatgctatactcaacaaaactggaaaacctggacgaaatggacaaatttctggacagataccaggtaccaaagttgaatcaggatcaagttgaccttctaaacagtcccatatcccctaaagaaatagaagcagttattaatagtctcccagccaaaaaaaagcccaggaccagacgggtttagtgcagagttctatcagaccttcaaagaagatctaattccagttctgcacaaactatttcacaagataaaagtagaaggtactctaccaaactcattttatgaagccactattactctgatacctaaaccacagaaagatccaacaaagatagagaacttcagaccaatttctcttatgaatatcgatgcaaaaatccttaataaaattctcgctaaccgaatccaagaacacattaaagcaatcatccatcctgaccaagtaggttttattccagggatgcagggatggtttaatatacgaaaatccatcaatgtaatccattatataaacaaactcaaagacaaaaaccacatgataatctcgttagatgcagaaaaagcatttgacaagatccaacacccattcatgataaaagttttggaaagatcaggaattcaaggcccatacctaaacatgataaaagcaatctacagcaaaccagtagccaacatcaaagtaaatggagagaagctggaagcaatcccactaaaatcagggactagacaaggctgcccactttctccctacttttcaacatagtacttaaagtattagccagagcaattcgacaacaaaaggagatcaaggggatacaaattggaaaagaggaagtcaaaatatcactttttgcagatgatatgatagcatatataagtgaccctaaaaattccaccagagaactcctaaacctgataaacagcttcggtgaagtagctggatataaaattatctcaaacaagtcaatggcctttctctacacaaagaataaacaggctgagaaagaaattagggaaacaacacccttctcaatagttacaaataatataaaatatcttggcgtgactctaactaaggaagtgaaagatctgtatgataaaaacttcaagtctctgaagaaagaaattaaagaagatctcagaagatggaaagatctcccatgctcatggattggcaggatcaacattgtaaaaatggctatcttgccaaaagcaatctacagattcaatgcaatccccatcaaaattccaactcaattcttcaacgaattagaaggagcaatttgcaaattcatctggaataacaaaaaacctaggatagcaaaaactcttctcaaggataaaagaacctctggtggaatcaccatgcctgacctaaagctttactacagagcaattgtgataaaaactgcatggtactggtatagagacagacaagtagaccaatggaatagaattgaagacccagaaatgaacccacacacctatggtcacttgatcttcgacaagggagctaaaaccatccagtggaagaaagacagcattttcaacaattggtgctggcacaactggttgttatcatgtagaagaatgcgaatcgatccatacttatctccttgtactaaggtcaaatctaagtggatcaaggaacttcacataaaaccagagacactgaaacttatagaggagaaagtggggaaaagccttgaagatatgggcacaggggaaaaattcctgaacagaacagcaatggcttgtgctgtaagatcgagaattgacaaatgggacctcatgaaactccaaagtttctgcaaggcaaaagacaccgtcaataagacaaaaagaccaccaacagattgggaaaggatctttacctatcctaaatcagataggggactaatatccaacatatataaagaactcaagaaggtggacttcagaaaatcaaataaccccattaaaaaatggggctcagaactgaacaaagaattctcacctgaggaataccgaatggcagagaagcacctgaaaaaatgttcaacatccttaatcatcagggaaatgcaaatcaaaacaaccctgagattccacctcacaccagtcagaatggctaagatcaaaaattcaggtgacagcagatgctggcgtggatgtggagaaagaggaacactcctccattgttggtgggattgcaggcttgtacaaccactctggaaatcagtctggcagttcctcagaaaattggacatagtactaccggaggatccagcaatacctctcctgggcatatatccagaagatgccccaactggtaagaaggacacatgctccactatcttcatagcagccttatttataatagccagaagctggaaagaacccagatgcccctcaacagaggaatggatacagaaaatgtggtacatctacacaatggagtactactcagctagtaaaaagaatgaatttatgaaattcctagccaaatggatggacctggagggcatcatcttgagtgaggtaacacattcacaaaggaactcacacaatatgtactcactgataagtggatattagcccaaaacctaggatactcaagatataagagacaatttcctaaacacatgaaactcaagaaaaatgaagactgaagtgtggacactatgccccttcttagaagtcggaacaaaacacccttggaaggagttacagagacaaagtttggagctgagatgaaaggatggaccatgtagagactgccatatccagggatccaccccacaatcagcatccaaacgctgacaccattgcatacactagcaagattttgctgaaaggacccagatgtagctgtctcttgtgagactatgctggggcctagcaaacacagaagtggatgctcacagtcagctaatggatggatcacagggctcccaatggaggagctagagaaagtacccaaggagctaaagggatctgcaaccctataggtggaacaacattatgaactaaccagtaccccggagctcttgactctagctgcatatgtatcaaaagatggcctagtcggccatcgctggaaagagaggcccattggacacgcaaactttatatgccccagtacaggggaaggccagggccaaaaagggggagtgggtggttaggggagtgggggtgggtggctatgggggacttttggtatagcattggaaatgtaaatgagctaaatacctaataaaaaatggaaaaaaaaaagaaactgtaacacctttgaaaattggcatttctattgtactctttatcctcagtgctcctctttatcctctatcgttttgtctaatctaaagtcttctttgtgagaaattagtgctgctgtttcagttttctggaacagctttggtagaaatgtcttatcatgtgctggagagttggctcagtggttaagagcactgactgctcttctgaaggtcatgagttcaaatcccagcaaccacatgatggctcacaaccatccataatgagatctgataccctcttgtggtgtgtctgaagacagctacactgtacttacatataataaataaataaatctttaaaataaataaataaaaatatctttaaaaaaaagaaatgtcatatcaggtaattaagtattggtgctgattagtctctaaatggggtttgtttgtttgagacatcatatagtagaatattgttttttaattcactctgatactgtctagtaaaaggtatatttagatagcttatgtttaaaaatggtcgttgatatcatcagatttaagtctttgttgttatattccgcttatttcatttggcttttattgcttttgatttctctccttttctgacctttatggtttaataaacaatttatatcaaactgtttatttgtttgtttgtttgcttttcaagatagagtttctctatgtagccctggctatcctggaactcactctgtagaccaggctgcccttgaattcagagatctgcttgcctctacctcctgagtgctgaaattaaaggtgtgtgccactaccactgcccagcttgtgaaactatttttagagatgtatttatttctggaactggagttacagacatttatgacccaccatgtaggtgctgggaattgaacccaagtcctctggaagaacggcaagtgcttttagcatctgagccatctctgcagcccctcctctttttttttttttttttaaattttaaataatactgtctcttcatgatatcagaagtaacttaatttagtatgtggatttcttgatgtgaaagtagattagcgatgggagctaagcaaagataaagaatttaaaataacaaaactgtcagtccataagggtaactcgaccctcaaaagtacttacgtatctaatgacaagcttcatcattttgaatcagaaacggacagaagtagagaggactagacacggccatggctagagactgccatggtttacaagtgactgagagagctagtcaaggaaagaggatgataaaaccatagctgatctaaaacaaaacaaccaacctccccacatagcaaacatttctagaacactctgtccatacagagtatttttttcatgaaggtagaccaaattctgtgcactgaaaactcaatagattgaaaagaattgaaattgtgctctctaattgcaatggaattgagttagaaacagaagcaatagggctggagagatggctcagaggttaagactgctcctcttccagaggtcctaagttcaattgccagcaaccacatggtggctcacaaccatccgtaatgagactgacaccctcttctggagcgtctgaagacagctacagtgtacttacatatatagtaaataaatctaaaaaaaaaaaaaaagaaagaaagaaagaaaaagaaatagaaataatgtatagaaaagacttacacagttctgtcaggggagcaggtaggctgactgcagatcctcaaccctttctctgcttctccagatccaattccccagactcatcgttggctctgtagcaaaacacttactgaagcctccctgcccccactacacccatctccaggggatcacaaaacctccccctccaaaatttaccccccacccctacccccaccccaccccactgctctattccaggctccaactgcaagtaggaactccctagttatatacagagcattatggacagacaagcaagtaggctaactgtaaatcaccacctctctctctctgctcctccaaatccaatccccattactcatgcccaggtccacagcagaccttttactgtggcctcttctcactctttaccaccttttccagtggactgtaaagcagttcctgggggaacaccctgctttcctccctcttcagggccccttcaacagcatccacaacccatccccatccctaagtatcaactcccaatccccagaaacacattttacctggaacccccagtagacacacctatcaggaccccagaagaatttcctaccaagtaatacagccaccacactctccgaagaaacagaaaccaaagagcaaagtacccactcaacaaagacaaggacagatatcagcacctagaatcaataatcttcccaattccactgcctagcactactgtaagaacataaccagtaacaaccagaacagtatgtctccactagagaccagcaaccctaccacagcagcaacctaccacagcagcaacctaccacagcagcaaccctaccacagcagcaaccctaccacagcagcaaccctaccacagcagcaacctaccacagcagcaaccctaccacagcagcaacctaccacagcagcaacctaccacagcagcaaccctaccacagcagcaacctaccacagcagcaaccctaccacagcagcaacctaccacagcagcaacctaccacagcagcaaccctaccacagcagcaacctaccacagcagcaacctaccacagcagcaaccctaccacagcagcaaccctaccacagcagcaaccctaccacagcagcaaccctaccacagcagcaaccctaccacagcagcaaccctaccacagcagcaaccctaccacagcagcaaccctaccacagcagcaacctaccacagcagcaaccctaccacagcagcaaccctaccacagcagcaaccctaccacagcagcagccctaccacagcagcaaccctaccacagcagcaacctaccacagcagcaaccctaccacagcagcaaccctaccacagcagcaaccctaccacagcagcaaccctaccacagcagcaaccctaccacagcagcaaccctaccacagcagcaacctaccacagcagcaaccctaccacagcagcaaccctaccacagcagcaaccctaccacagcagaccctgaggattccgacactgctgaagcataagaaaaagaccctgaaatagcctgaagtatctatgaatatgatagaggtccttaaacaggaaatgaataaataccttaaagaaatctgtgaaaacaccaacagtagaagaaggaaatgaagaaaacagttcaatacctgcaagtggaaatagaaaagctactttcaagaaacacatctcatatcaagaatagatattatctcagggtaacaagttggaaaaaagcaagtggacttaagaagcaagctggcatagccattttaatatctgacaaaatagacctcaaaccaaaactagtcagacgagatagagaaggacactacatacacatcaaaaaaagatctgccaagatggcattgccatttttaacatttatgcatcaaacacaaggactctcaagtttgtaaaggaaacaccactacaatgtaaatcacacaatgatcctcacacagtgatagtgggagacttcaatacccaactttggcaaattgacaggtcattcagacaaaccaaaatagaggaatgctggacctaactacatcataaaccaaatggacctaatagatatttctagtacatttcaccaaaacacaaaggaatatactttctttttagcatctcatagaatggtccctaaaactaaccacttactcagatacaaatcaaggctcaacaaacacaagaaaactgaaataacactctgcagcctgtctaaacatcacagtttaaaacaggttttcagcaacaagagaaaacttacaaactcatggaaactctctactgaatgaaaaatgggtcaaagacagaaattaaagactttctagaattgaatgaaagtgaatacacaacatacccaaacttatggggcacaatgaaggctgttctaagaggcaagttctcagcactaagatcccatactagcaactgaacagcacacctgaaagctctagaacaaaaacaagaagtcacacccaaaaggagtaaatagcaggacattaacaaatctggggctggcaagatggctcactagttaagagcattggttactcttccagagatcctgagttcaattcccagcaaccacatggtggctcacaaccatctataaggggatccaatgccctcttctagcgtgtggctgaacatacggcagagcagtcatacgttaaagaaagaaagaaaattttaaaaagaagaaattaacaaattcagatctgaaatcaataagatagaaacaacaacaaagcaacacaaagaatcgatgaaacagagttgcttctttgaaagaatgaataagagagacaaacctgtgtccaagttaactaaaagactgagagaagatccgaatgaacaaagtcagaaatgaaaggggtacataacaggagacagacaccaaagaaactcagagaatcacaatgacagactttaaaaaacctgcactccaacaaactggaaaatctaaaagaaatggatagttttcttaacacatgcaactttttgaaaaggcaggtattattttttaattaattacacttaccctaacacttgcacagctgtgttacaattctctctgaaacaccttacaaaggtgcgtaatgtgtagttagtagtgggatagatggctcaagtcacattggctggggggaaaatggaacaatgggagagaaatctgacttgtttggacaaaggcactttgactcaagcataaatgcatctcccatgtaaataaagaacagatagtaaaagctggccctttcattgccatccatgacttaaaaataggacagacatgggcctcaccttccagtccatttttttttttctttttttagtttttcgagactgggtttctttgtaaagccttggctgtcctgaaactccctttgtagaccaggctgtccttgaactcagaaatccacctgcctctgcctcctaagtgctgggatttaaaggcgtgcaccaccacatccggcttcccagtccatcttaaagaactcactagggctggtgagatgactcagcggttaagagcactgactgctcttccaaaggtcctgagttcaaatcccagcaaccacatgatggctcacaaccatctgtaatgagatctgatgccctcttctgaagtgtctgaagacagctacagtgtacttacatataataataaaaaaaaaaaaaacaaaaacaaaaacaaaactcactaggacattcttctataagtgctttagctatccccactctgtccacttctaacagtgggttaaggatcagaaagcatttcatataaaaattacaacagtgacttggttttatgttttcccaaatgtatgttccatccgaagcagttgccttttcctctcatttctgtgtggagagagacccatctgttgagtaaatagcactgctcatcctgcagtcctctgtcctcatggagtctgtgagatcttcttgtccgcatcttcgtcctgtgctgaggacctggaggcaggctcttggcaggtcttcaggtggtgagtgacgtggcacttggttagatcgacctttctacattgtttgcagacataatctcgttttcctccgggagaattgagatgcttcttcaagtggtttgttctcaagaacagtttattgcacttcggacgcttggtctggcgttcttgcgggcggatgagcacgggctgcttgaggccctgtctccgcatggacagcttgtcacaggaatcacacttgagattcttctcacccgtgtggatggccatatgagactccaggtgagccttctgcgtgagagacttgtcccacaaagtacacctataattcttctgacctgtatgaatgttgaggtgtgtctataggttgcttggatcaccaaaagtcttgctacaaaaatcacacttgtgggggttcccccatatgacccattaagtgcacgtggggtttggaaggagagatgaaagcctgggggtatagagaacacttcctttccttgctgtggcttggcctgtggctgctgctgtggccctggctagggagatgattatggatgtggcttgtcagatgagctgcgaactctgactaggaattgtactccttgccacagttacagaggtacacatctgggtattcaagaacacttacctgttgagcataattccggctgtaatggaaaagcagctcactttcaggagggatgtcttgtgaggtacgaggatagatttttccatcatggggctaggccaccaaattctgttcttcacggttcctagctttgcgtgcacgcacacacacacaaatcatctaattacacacatttttatcagttgcaatgatgcagaattctaggacaccatcgtggtatatcttccagacatggttaactgcctttgtctgtccactccgctacttccaaggagtgactctgctgaccaattagaggcccgaagcaagtcggcacaggaatggtttctgcagtccatacaccaacatctgttcctacagtggactggcggagaacaacctgcttcaggggggatagtcttgctctgctctctattggtgtgtcaggaacaaaagtcattggtctatgatcagggcaatctgaggggtaggctcagtcacaaagagtgaaccaaattgtcaaacaaggtggccatgttttccttgtttggatcggagtcttccatttgcagtgaagatggtacaaaagacaagctgtctgaggatacatctacatgacctgtccctatggcaaccttctgcgtgacggaagagacagtcacaggctctagactaagaccaacttcacggaggaaaacagattctagggagtcgaggttgtgtgaggtagagagtgccatgtctacagacttggtgctcatggccacggtgtggatggagtcactgagggtactgtcagacatcccattgacccggtttgcaatgtggtcagtctccatgaccataggaagctccagaccattcccatgaatgggcatcacaccaccatgtcctacagtgtctgctgtaaggctgttgctcacagaatccacagagagaggctcatgacttctggagccacttgggatttgggaatgctctcctgtaacaccgtccattgtaagctcctctgccattccatctgtggagattgggctggtaaccctagaaacattctccatagtgattgttgtgtccaatgctacttcatggccttcattaggatgaagactgtgggtaccatgtgtgtttacagagtgagagtctattgaaacaatgtctagttctaatccaacacttccattggcctgatagagatctagtgctgaagggttgttggtgatacataatgctgtatttccatcaacatttatagagttgggatggatatactgaggaggtggtctgtcagctaaataagataaaatgccaggtagaatggttctgaagtatctgctttctaggtgagggtaaggtggtggaagtagggtatagtttctttcaggtaaaccacacattacccacggggagcatcagagacaaggcagaaggcagagagctcagggacagaccccaggtttggaattgccactggaagtcctggggtagggatggcactgtgagaagaagaggcagccaaacccaggtgacttcctgagcctggcagggcattgctcacagaggatgaagacagtagctccatccccactggactcaaattcctgttcttcatcctgcgagttcagggtggggggcgggcgtctgataggtgcgctctggggccgatgtcgcatgctaccacatcctgccattggccaatgccttcccgcaccacctgacgtctccgagggccggcgactccgggctgggcgcccggggctgttttcccagaagctggcagcctgtagggacgtttgagtcagccccggctggggagccctggcccagccccctggctattcagtcggtcagaagtcagccctcccgggccggagcccaagtcaggaccgccttcacagggccgcaccctggaggcaggtttccggcttctcagcctctggggaccgtttcccacacctactacctattaaggttatatcagcctctggggaccgtttcccacacctactacctattaaggttatatcaatatcagataagctctggtgaaatagaagcagccatcaaacaaacaaacaaaccaggaccagatggaattagcacagaattctaccaaacattcaaagaagaattaattccaatactcctcaaattctcaaattagttcacaaatagaaacagaaggaacttttcaccctggtgcataaaccacataaagacctaacaaagaaagaattgcagaacaatttcctttgggaacatagatgcaaaaatactcaaatactttcaaactaagcccaagaacacataaaaagatcatccaccatgatcaagtaggcttcatcccagagatgcaaggatggttcaacatacagaaatcaataaacgtaatttaccatataaaaagccaaaagacaaaaaaaaatacccaaaacatatgattgtttcattacatgcaggaaaggcctttgacaaaatgcaacacctcttcattataaaggtcctggagaggacagcaatatgaggacaccatcaaatacctcaacaaaataaagacagttcagcgagcccatagccaacatcaatgcaaatggagagaaactcaaaacaattccactaaaattaggaacaaggcaagattgtctactcttctcatacctatttaatatagaccttcaagtcttagctagagcaataaggcaactgaaggagatcaaggggatacaaattggaaaggaagaagtgaaagtatctatttgcaaatgatatgatagtatgcatatgtcaccctaaaaattcctccagaaaactcccatagctggtaaatactttcatcaaaatagcaggaaataaaattacgcatgaaaatctgtagtccatctatctacaaatgacaaatggaccaagaaagaaataacacttttacaatagcttcaagtaatataaaatatcttgggggtaactctaaccaagcaaactctaatctataactaggtcataatctatatatacattatatataatatacaaatataacaagatcatacacgatctgaccagtgtgtgaaacacaatcatatttactatgtagatgtagcaagcaatttcaaagtaacagattaacaatagtatccagatgtttcagaaacattttaaaagggtgtgtggcacttgtggtgattatgggagaggaagatgggaaatggtgctgtgggggaggggtgattatacaccagtgctggggatgtaaattaggacaactgtggaggctctgcacaaagtggaaaatagaactcctgaatagccagaagtcttactctcaggcacagactcagatcatcaaaattggtgtttaaaggtaatttggctcctgtccaccctgtaaagagaaggaattctaccattcatcagcgcatggctggaactggaagacagcatgccaggtccgccaaagggaaggaatgcagcatggcctatggccttggttctccaccttcctaacactgccaccctttaatacagttcctcatgttgtggtgatccccacattgttttcaatcacaactgaaattttgctactattatgaattgctgtggaaatatctggtatttcctatggtcttaggtaacccctgagaacagctgacacatggtgttggttacaaaatctccctacctccaccttggcaatagatttgacttctaggggtaatcaaggcagagtgcaacgtcattgtcttgttaatctgggcctgtgtttctggccagctctggccagccccagttacaaacacatccttatacactgtccatctgcctcctcctggctgttttgtacagtgaatgtctcataggactcagaagggagtaatgacttatggctctatctcctaaccctgggagtatagaccaagcacacccaggagagggggtcgtgatctcacaggttgcacatgggccacttacagccccatccagtttccaggtatgtcccatgatacatcagcttttgctcatggactctccctcctctgtggcctcgtgggatctgtgctgagaacctagaaggccagctggccacagtgtctccaagcagcttcgagctgcttcttgtaatgctggcgtcatctgagccaattggggagaactcgggtgattagacagaagttagatttttctttcttttgagacagggtctctattatgtagctgtagctgtcttggaactctctatgcagaccaggcaggccttgaactcacagaggtccaccaatcagaagatacaggttcttaacaaaccgaatactttattttggtactagaaagcttacagaattatgtcaggttttaagcaacttacttctttgaaaatatgcatttcccccctacaaaattttgtttggggttgtggattaagaagtaaactgaggcaaatgtgatgatgtttgttcaatgatattctatactggaaatctggaggcctgaagcatatggaaattcaaactcttgttataattggtttgctttttcaagacagggtttcacaacatagttctggctgtcctggaactcagtatgtagaccaggatggccttgaactcacagagatccacttgcctctacctcctgagtgcagagattagaggcaccagtacacctgcatgtatatgtacgtgtatatatgtgtgtatatattatataatgtgtatatgtgagatatatatgtatatacatatatatatgtgtgtgtataaatgtggagagagagattgattgattgagattgtgaaattaccaaaatgcactgatgtgggtagatgaggtcatctattctttttgtttgtttgtgttttgttggtttaggtgtgtgtgtgtgtgtgtgtgtgtgtgtgtgtgtgtgtgtgtttaaagacatggtttctctgtgtagccctggctgtcctgaaattcactctgtagaccaggctggactctaactcagagaccagcctgcctctgctcgtgctaggattgaagtgctttaccaccacggctaagtgtgttcagtgttccaaacgttacagagacacggattgatttcgcttctgttactggggtgagaccatccattctatcatttccttttctgtgttctcagatactgcctggtagcatacaactgtaacaaaaacaaattcaagaagagg

SEQ ID NO: 107 - DNA, 2744 bp, Mus musculus
tatgttttcttacttttagtgattaaagagtgagttgtatacaatccgcagcctagttacatcactgaatctcatattgcatttgagtgtctgccaaaggagatcaagaggaaatcaagcagtgcgagacagggctctgatgtctgtctgtggttgcctgggttctcgaggcaagggaatccaagagcccttatttgttgatctttagcatgttgatccttattttggaaggtgaggtcccgtacttcaatcttctaatataaggtgtcccaagcaaaggtgtgatttaaaaaatatattgtgtaagtcatttaaataattcccaggctgtcgaagatggctctgcagggataggagattataatcaagtctaatagcctcagttgtactctgggaccctacaggatggcaagaactaattgccctcagacctccactgcaaacacacacacacacacacacacacacacacacacacacacaaacactaaatgtaattaaacccttcttgattccataatgaagccccttgaaggggtagtcagagctaaagtgggcttactttcttttctttattgaagctcacctacagtatgcaaaatcagagaaagaaatttttatggctgtctccaattctcagtcactgggtctaagaattggtgtgccaaaccaaaccaaatcaaccaaccaaacaaacagtcaactgaccaaacaaccaaaaccaaaacaaaacaaaaaaatctagcacccaaagactacttttaaaaattatctttcgaagttcaatctccagaatcacaataaatgaaataaaattgtattgtagtgagctttctccccagagtgagctctggattttgtaggcatgaatgtagcttggaacctcaggtgattctaattttaggaacctgtttgcccactatcctgaaaaaacaccatgtgtgctggctacattctaatgacaacttgacacaagctagagacatctgagaggagacaaactttcattcctaagagctggctgtgggctagcctgtagaacattttcttaagtagtgattgatgggggtggtgggggtgggtgggggcagcccattgtgtgcgatgccatcctgagctggtggtcctggattctataagtgggctgagcgggccatgtgaacaagctagtaacctctccatcaactcttatctgcaggtttgagttcttgttcggcttccttcagtgatgggctacagtgtaagtccaataaacccttttctactcaagttgctttttggttgccatggtgtttcatggtcccaatagaaaccttaagacagagttcttaaacttgaagttccagagaaatctgaattgcaaccaaatgtttatttccgccagtttcactttggaaattgcttcagaaatatgtccttcttttcaaagctgaatttgcactcccttaggtcggtctaaacctaagttgtcccaactaacttatacctaagtatgaataagatcgaaaacgtctttcaaagacttgagcgagtttaaaaactcttcaggtgagcgcttaagtgccccattacactttgatctggaagaattaacctggttcactttctagctcaatgtggttactagatgaccgttttctcccggcctttgtgaagccttccgagtaatcatacccagagggagactcctttatgtcatcattaccctttgcagacgttcaatgattacctaccattcccagtctgggactgcctgccttacttttgtatctccagttctacctaccacgcttagcaaaatgcaggtgctctttaagagaggaatgacctagtgaatgtcaagagcctagacaggagttttaaaaatcagactcagaaacaaaacacggaactgccaagggctggaaggcaggaggtcgaggtaaataagaagaacgaacaatctgaaccattgcaaaatcatcccgaagggatctcctgtcccattttctcaagtggcttttcagccttctcaacttcccgcccactctcccctgctggagacaggtcatgcaggtatcccaacaatgaggctctgattggtcagagatgatttcattgttagggaacatccgggctctttccctccctgcatcacctccccagagccctacgcgcccagttttgcactctcgcgtgcgccccacccgtagttgaagcaaaacaacgcctctctccaggccctttctcgaacctttctgagctcttccttcacagctctatgccaaagagaggcggccacttcttccaatgagggtctaggggcacttctctggccaatcagaagccggctctctccactccgggtgggaccaatttccacctataactggactgcccgttggtttctttatggtgttcgttctccgcgaagtgtagaggtcagaactgcagggtccgcagactcggggcttggccatctacgaatactagccaatcccttttaggatacttttgcgcgttcatttaaaaaaagccgaagtgacggacttggaaattggtttcttgacggacaagtagaggaagccaatagtcggaggatcaggccgccatttgaaccaatcagaaaaggatatcggtcttcgagttggggcgtaatttgactgacggaggactctacctatggctactagggtgggcaggtcggtgacgtcaggagttagggcaaggcggaggtggggctgaataaagtaaatggtaatgaa

SEQ ID NO: 108 - DNA, 5617 bp, Mus musculus
gggtggggcgattcgagacagggtttttctgtataacagaaccctggctgtcctggactcactttgaagatgtgcctgcctttgcctcctgagttctggtattaaaggcacgcacttccatgcccagcacatttctgattattttcttaggataattctttaattggctcaaaaggaaagcaagatttttaagacgtgaattgctcttgtaatgttgctttctagatagctaggcccctttgctctgctgggccacagttccttagtcactagcatgcatctgacattcacacttgtgtagaataaggaccaaagtagagacggccattcctgagccaaaatgactgaggcaggaactgccttaagacctctcctctcaggagctatagctagggcgcgcctttcactggttgctgtatgccctgtaaacatctgcaagaacaggtttctgtgaagatctgttggaagaatgaacaaaggagtccttgcatggacgctgctagtgcaggctggctgaatgggagtgttatgtcacattcacagctgagatgacaatagggttccgcctattttgggcctggaggacacagttgaagtacagaatctgctggagaaatgacttgtcggttgaagcagtgccacttacattgtgtacctcgggcttgctctgtgtcctgaagcccaccatgtccccacagtggcaggtatctgctgagtgagctgcaggaaggaagggggaaggagaggagttgagagcagaggtctagaaatgtggaacaggaagtctctcccaaagtctaactgtgtctccgcttctctagctggaggatctggaagttactgtggctgatcacatccaaaaagtcatgaaagtgaactttgaggcagcctgggatgaggttggggatgaatttgagaaggaggaaacgttcaccctgtctactatcaagacactcgaaggtaaagtgctgctgacgtcatctctgacgatactgtggctggccagtgtgccttcccgcttcccaccaagaatccagagccttaagggatacctagcttgggactgactggggggaggtgggtgggggtgggaagtgcatacttaatgtgttaggcccaggatttcactagcacccaacaaaagcacacaaatactcatatgcctgtggcttaatgttgctgggattttccctacagaggctgtgggcaatattgtgaagttcctgggaatgcatccttgtgagaggtcagacaaagtgccagaaaacaagaacacccacacgctgctgctagctggtaagaaacgtctgtggcctgagtagcttcacggtgggagtgccactgggttttgtctgccgccatccaacttcccccacagcaacacctgtgtgctctcatagtcctggctaggccttgtcctttatcctatgggattggctgcaaagggtgtggcatggtggctctggtcatctgaaagcagtaggtctgtggtctaaggctgaggatccaaatgccatctccccagcccccgatgcacttttaaggtagtttttgcattttgaatgaagtgtcttctattcatatttctttttcagtgacttgtctgatgttcctttatctaagtatcaactttattggggttattttgttgttgttttttgtttactttattagaagagtgggtgtggggcctggcctggtaactcactccataatttcagcatttgagagacagagacaggaacttttgtgtaagttaaagccaagggctacatattgagacagtttccagaaaaacctaagcaaagcaaaacaaaattcccagtacccatagttgacaactgtctgtaattccaattcccctggatccaacaccttcacacagacatgttgcagtaaatttccaaccctaataagcccaggtaatgaaaacacaactcagttcatttgaatacatgctgtgcgcctagtttgggcagatctaccactacactagcatcttccccgtagaaggaaccccttgtaacttgcagtttctcaaggccaggtgcttccgctctaccttacttctccatcctcctcctcatcctctcccctcccctccccctcttcctctcttttccatcaaaaccttcagcttcacctgcccctctttctctgcccaatcaccgtctctagcctttatttataaattaaggtgggaagcaggtttacaggaaatcacctgagtgctgactcattccttgttcacagccactcacaggagaacagaattaacatcaaatacaattagccccagtgccatccacaacacagacatacatgcatgcaaaacacctacataaacgtttttaaaaaataagttaaaaaaaatggctgtctacatttcatcttggaaatttcccaacacatacaaaattaaatggtacatataatgaacactactgcttaattcttgaagcacctgcgcccactcttccctagagtattttcatgcaacttattttgtaattcatatataaatacttgctatcctgtgtttagctcaaaaatggccaaagcttatattgccctagacatttgtggaaatggagctgagaatgaaactcagtgattaaggctaggcagatttctgcagcacaatcttcatgtataaccctaattccttgaacttgtaattctcttgcctcggccttcagtaacccaccacacctgacttttatccctccgcagggctgatggtcagacaaggcaaggctaggcaaagcaagcagtctgttgttgagacacaccgagccttggataggttttgtgtgtgtgtgggtgggtggggatagttattttgggagttgggggctgggtgtgtttacaaacatggttgggaaggcgttctgcttcagtgagtgctcagcagagcactctggccttgatgaagcaactcagtcccctgggtctgtcagacaactgctttgtggtttttttcttatagggctcgccccctcatccacactctcagattcagccactgtctgtgagcctctaatatgaggtataagccttacatacccgagcgttcacttgagcctggcaggaggctcaggtgatgtatagttagtgatgtatgcagtgattgatagttactgcagcactatgtccttaagggttccagagctcagggaagcagtgagagttgtccaggcctcccagttgtgcctcagtgtgtgcggtgggggtggggtggagtggggtggggtgggggtgttgatcatgtgtcactctcagcacagcctccttcagcctcacaaaactctgcttcctctcacttacaggagtattccggggtggtcatgacatccttgtgcgttctcggcttctgcttttggacacagtgacgatgcaggtgacagccagaagctcagaggagctgccagtagatatcatcttggcatccgtgggctagaggtggcctaagccccactcctatcttgtccaacactacgtcgaagccacttcttccctgtgaagccggtggaaacccttccccagaccactgtgttaagaaacaatcaagagtcaatacagatttttttttttaattccatcctatcattcaggaatgctagggtagattttgtcaccatgcctgcaaggagagacaaatgaataaaatgttcagactttctcttaatatttatactcaaagaaaccgtctcatccctatgataagtcagcatgtatttcttgaataactgctgcttctgcaggctcgtgctcagggcctccacttctccctgaggcctcccttcaccaaatggagcgtgtgcatagcccctcgggactgtcagtgccaagcttagggtggggttaaaggctagccgaatgacaacagctagcaggtctggtaagccactcatctacaggcatctgtagatggatgggtgtccaaaggtccttagagggtgtcatgatctgctctgggtctatgagtgggaaaaacagtatctgcattccttttgggctggagtaagaaatcctaggggatgcttcagggcttgggctttaaactcaaatcaggtggtttaaactgttggaaacacttgaagaactggacctcctgtgaggctactcagatggctcagcaggtaaaggtacctatcaggacggactacccacttggtagaaggagaggaccattttgcaatagttgccgcctaacctcatgcacacctgtatactgtatgcacatgcacatgtacacattagaacagaggcctgcacctttaagccgaatcccataacatgaagacatcaggctacacttgagcatcgttaagctgttttagctatggcctatttcatgactggtcctggctccaccatgtacttggtcaggcatgcagtggtgaactaagtaacgtggtgtgaaacttcctaacaggttataaagagatttctcatttggggggttttctcaagtaggtgacctgaaggctgctccctaaagacatccctctgtcccccaccttccatccctctcctggggactgagcagttgctcttgcctggcctctctgcctcattccatccctttatgaaggcctctccaggctttaaaggaaagcctgaccttcaaggccacatcctgcttagcccttcctgactgtattcttcctgcctaataccctccccttctactcccaggcctggtcatagcctggaagccattccattcaaataaacttcattaaagaaattggtgtcagcctccttttgtgaagattacagcttactctagttttatttaaaggcttgcacacaccccacacacaaatgttaaaaaggaaaccaggtggggcttcctgacccttaggggtttgtgggaatagctagagagtctcaattcggatggccttacacattgagggtgggcagcacaggttttctggcttcagattccggcctgggaagggggaccctgaggcctcctggggtgcctgtctcaggtcagtgcattttgtcttgcttcacctagccacacccccacctgtggggagggaaccccgacggcgcgacgtcacgtcgggggcggggcggggttaccgaggagcgggacgggcgtctcttaggcggacgctagctgcgaggaagggtggactagaccctcgggcggtgagaggacgcgggcgcgtggggagggcctcgttgaggggatgaggacggacgggcgggcgggaggagggccgcgctgaggagaagctagcgggcggaagagaggacccggcggaggggacgccggcgggcgggcaggcgaggaccgcccacgttccgagctggagccttggcgccgacaaggccccgcccgggacctgagcgtgtccccgcggggcggtagtgcggtggccgcggcccgcgagtgtcgctggcgtcaaagccgagcgctctcacctttccctgctgcgtccgtgggaaacaacctgggaggagcggctttctttctcgcccgccacccgagggcctgcttggggactgtgggccccgcagtggccgggactggctgacctaacggagcctccgcggaagatgtggcttcgcggggagattggcgtgacctagggag

SEQ ID NO: 109 - DNA, 7220 bp, Mus musculus
tttcacaagaacactgtcccctccaaacgcagtgacttttatcccccgccccttctcccgcctgcctcaccagggcgcacacgctccttggccccggtcggctggctgtgattggcgccggcggccccagcagatgacggaggagacaaagtgatggctgcaggtcgtctgaggtcccaccccggccacgtgcggcttctgtgatgacaggtccagaagggcggggctttggctgactagctaggtacaaccccaaactgaccggatccggaggctggtggcaagctagagctccaggcaaaagctagctctctctctagctctcattctgtctcgcctctgcctctgcctctgcctctgcctctgcctctgcctctgcctctgcctctgcctctgcctctgcctctgcctctgcctctgcctctgcctctgcctctgcctctgcctctgcctctgcctctgcctctgcctctgcctctgcctctgcctctgcctctgcctctgcctctgcctctgcctctgcctctgcctctgcctctgcctctgcctctgcctctgcctctgcctctgcctctgcctctgcctctgcctcctctgcctctgcctcctctgtctgcctctgcctcttctctctcactctctctgtctctgtctctctctctttgccctttccctttcttctcttctcttttcctctaaagggtccctttctactgtaaactggcctctaactcgctcttcttcctctcccttcaaagtgcggaggttcctgagattgtcttgctggtgtgagcaagctacttacttaaggaactcgagcctctgtaaggactactcaatagtaatgtgtatttgtcctaaaggaaatcagtgaggtttgcaacctagagtaaaggaatctcgggggtctgtaaaaagtgggagagtttgaacagtggggtttcaggtttgttaaattatgtggttgcgtctggattcaggaatgggcagaagtatctatttctgttaaggtggctcggggaaatgtgtgaccttgtttcgaaagtgggaggcaagacgcagagtgagaaaaaaattgcaatagatttttctagcagaaagaagactgccaagaataaacaaagagctccaaacaaatagaaaaacacacacacacacaaatgaaaataaacgatgctgttccttgaaatgtaaaagtatcgacatggactatagcgccttacattgatgaagaaaagtattttgccttttaaaggcactgaagaaagtctgtgaagtcaatacttttcagtttaattaggtcttgagtcctctacaggaaatacggaggggcagaaagatgtcctccacataccagtagatggcagcacagtactcttgcagagctaaatgagggaatccaaagacccagtcggggccttcctgttactttgatgaggttggttctgacaaagaagttcatggaggctccggttctttaggatctgtaactttagctaactctgtctgtgtgtgtgtgtgtgtgtgtgtgtgtgtgtgtgtgtgtgtgtgtgtgtgtgtgtgtgtcacagagagccttttgtctcagctgggatgggtggtttctgattaacagaaactgatcagttcaacaccaaaggtatgctacatagcaataaacaaaggaaaaagaaagaaaaaagagctctccacctttaagaaatctacttatgaggtgtggagagatggctctgcagtcaagagcatttgctgctttgcagagactagagctcacaactgcctgtaactccagcttcgggagacttaatggtgggtttagctctctttccttccttccttccttccttccttccttccttccttccttccttccttccttccttccttttggagatttatttatttaccatgtatacaatgttctgcctgcatgcctacacatcagaagagggcattaaatctcattacagatggttgtaagccaccatgtggttgctaggaattgactcaggacctctagaaggacagccagtgctcttaacctctgagccatctctccatccctggttttggcttttcccagcacctgcaggtgcatctgcatagttaaaataaatcttaaaagatatacttagataattatataaatacctatacaattaaagttggaaaggttttatgcagtgaaaaaaaagctaccctctgaattttaggtttttactaactatagatttagataaattgcattttgtttgtagataggatctccctatgaatcccagattgacttcagacctatgatttttgactgtgccaaagttgggcatggtgacataagcctttagtcccagcatttgggagaaggacaggcagatcactctgattctgaggccagtgtgattacatagcaggacagccagggctacataaagagacttagtgtgtgtgtgtgtgtgtgtgtgcacacgtgctcataccacagaacatgtgtaaatatcagaggatagattagttggagtcagtcctctccttccactttgtggggtctagggaccaaactcagctgtcaggtttggaagcaaaggccctttacccagtgagccatttcaccagccctaacaactttttttttctttttttagatttacagaaatcttgtaaaagtaggatagtttccacacataccgcaaaccctgtttctattattattattattattattattatttcagtggtggggattagaccgagggcactgtacatcccaggcaagtggtctaattattaccgggttcctcttattattaatatcatacagcatatggatcatgatttgttatgatcaaaggcacaatgttgatacaatatcactgattaatattaatgtttcatacagtttcttagtttctttctttcctgtgtcaggattccttccaggactgtacattatctgaagtctccttaggctcccttggctgtgacagcttgactgttggtgacctttgaatcccaacagaatctcaatctcagactcctgagaacaggaatcacatgtgtgaccaccgcacctggaatctaagattctccttcagtctgttggagcagaaagctctagaaacctgtaacccctgtcctatggaggtggaggcagggggatagaagaggttaaggccagcccctgctacttaaacctgctgagacaaaccggggttacaggaggccccatcccaaaggggaaaaagtcagcagctgggcagcggctcagtgctttgtaaagtgcttgctgttaaacatggggaccagaatttacatccttagctcttacacaaatgccgggcatgcgccatggctctgccaacatgttaatttttccctgaaagacccacttcccatactgactgaaaataagtatgaaatgacaaatgcgtgtgtgttttaggcatgaggttcttgatttttatttttatttttttaaagacttcttttttttttattatttatatgagcacactgtagctgtcttcagacacaccagaagagggcatcagatcccattacagatggttgtgagccaccatgtggttgctgggtattgaactcaggaccttcagaagagcagtcagtgcttttaaccgctgagccatctctccagcccttgactatttttttgaaatattacatttattttatttggtgtgtgtgtgtgtgtgtgtgtgtgtgtgtgtgtgtgtgtgtgtgtatgtttatgtgtgtgggcacatatgccataactcttcaggagatggcagaagacaaactgtagaatttgtttctctccttcaaccatgtgggtcacaaggattggcttcaggtcatcaggggaggtggcagccacttttacctgatgggctatctcacaggcaccttgatgatttgtcacagcagtaacaggaaactaatatggcctctaacatgcttaagcagagggaactgatatggcaatataaaagcttcaggtacctgttacgcaggaaaactggaaaagtattcttaaaagccctcactgtctgtcaggcgctgctggtgcatccctttaatcccaggaggcagaggtaggtgctgggattcagacccaggacaaacggctgaggagaatattttatgtaccaagtagacctggtttcctgttctcccagcatctctcagtcctacttgttccagggcatggctggcgtaccgcgccctctgccctgagcttcccaggcttctcctcccccggaatttcctccctatagactccagacattttggtctccccctccttctttctgcattttctgctgatttttttcatctattttagcatacatgtggttgtacctccttgaggatttaattcaatttccctgtttgaggcagatctttgtgagtttgaggccagcctggtctacagagctacttctaggacagccaaggctacaacaaacaaactctggtgcaggctggctttgaactctagattcctcttatctcaggcactaaagtgctatgttagaatctagctttagttaagtctttctcttctcttctgggtgtggatggaacccaaggccttgctcatattagctacatgctctaccactatgctagaaccgcaatctctttaatggtgtgttcaatgaacttaagttctcaattgcaatggcatcaaattgttactggaatcaagtctgctctgttctgctggaaacccagaagtcagataccggtgaaaggagcaggctatagggacacatacttgtaatcccagtacctgggaagctgaaacaggagacttgctacaagttggaagcagcctggagtatgtactgtagtatgtagtacttggccagtcagagataagtagcaagattgtctcctaacatcaaccacaaaaaaaatgggtgagaaggacaccggtctaattaagattagcccaggagaaaatggaggagacatttccagtgcaaatttctatcttcaagggcccagaagtgcaaatggcttttatgggatacacatacacacacacacacacacacacacacacacacacacacacacacacacacccatcaaacaaagaaacaataggtgggaaatctggctgaatggggcctttctcttcagagccgtttctttctccttaacatttttttaatttaaattatgtatatatgtgtaggtctgtgtgtaggtctgtgcatgtgaacctaggtgcctgcggagtctagaagagaatggcagatcccctagagctggagctggagctggagttggagttggagttggagttggagttggagctggagctgaagctggaactgtgagcatgtgtggtgtaaaccaaacttgtgtcttgaaaaggcagtagggtgttcccagcccctctccttgaaactggtctgcatgctaacctcctaggacagaatctctctgtgtgtgttgtgtttgtgttttgtttgtttgtttttagatacaccaattcctatgaacttgagagggggagacattacagagaacattctatgaaaaggacagatggtagttggagagctggctcatcccttcagagcactggttgttctttcaaacattgacctgggttcaattgtcagcacctacatggcagctcaaaaatgtaacttcagttccatgtcatccaataccctcttctggctctgtggatactgaaatacacacacacacacacacacacacacacaaaattatattatatatatatgatatataatatatatagattaaagaaaaggataatggttaaaagattagagtgtagccaagtataggggtgaacatctataatcccagtgcttatatggaggtgagagcacaatgatgctgtctaggggtacaggaacagagtcattttctctgccaattaaaatgcaggaaagaagtgttactgaagatcttgggggtggggatgccagcatagctatttcacaatatcagaaaaccggggtcctctcttggggttgtttcagtaataaaataattaaaaatggactcaaacagaagctcaagtccaatttattagagtttaagaagaaaatctcaggggtatgtgaatgaaaagaaaggaataaaaaggaaaaagatgtgactgctcttacatagggtggaggtttattgtaggtatgtgggagagcacactcagagacagggacatctcggggagtccccaggggtcatgaggcccaaagtggctggataatatggggaagaacagcgcagcccctggcctggagagcttaaggtaagggggcagggtgtgccagctaagagggccctgtaataggtagggaccgagggacgcagggagaacctggcatccaggttcactttgatatgttaaataggtacctcagtcctgggctgatacctaacagtaggcaaactgtaaagattatagcatgtccggcagaggagggcggagaagatgagcaaggaggtaaaccactgggtggcaggcagtcccgcctggacaagagctttagcaaacgcgtaagaaagcacggagacaagttagggagtttaaaaatatacttagatgctggccagtatctgagagaaaaagacagagaagaagaaaaagaaatgagtacacttttctaggtcaggcagagccagaagaacctcacgatggctcttagggtcttcaacaggggagggagtgctgggaaggtgggcatatcctctaaaggtgaatctgcagtccaaggggtggcttctagccaggtcttccttctgctccgctggagtaacccttcaaggagacaaaagcacatctccccctagaggtagattctattattacagaaagacaacttgtgggccttagccctcttctcttaactggttcttaggtttgaactcaggccatcaggagtggcagcaagccgttttactccctgagccatctcatcgactttggggttttcttaattacatcatgggaaggcccatcttgaatgtaggtgacactattccttgggctcgggatcctgggctatagaggagtggaaaaagtgagctgcattctcccacacatgcctttttttgctttctgttctaggttatggactaaacagttccctcaagcctctgcaatgtggcctccctgccatgacggactgtaacttggaactgtgatataaaacaaagccatacctaag

SEQ ID NO: 110 - DNA, 6875 bp, Mus musculus
attcggactgcacagtggtgtgcattgccatggaaaatgagcagttttaagagaaggggactttcaccaaagctctcttctcgaccgggaacccggggccacgggatgtggagttcttttgtaagtactaggaagcagaaattgggcgtgtgctgggaccctccactccggggagccgttagttcttgcccaggcaacaagtgtcctttgtgtcattcctgggagctggctagaagcacactgcagtgctgaggatgcagctgagtggcggagtgttcacctagtaggcacagtactgggttctatccccggtcccccaaacctccgcagctccccacaagaagttcatactctcgctccacccagacccactgaacaaagcctctatcttctcagagtttgaaaggcacagtctaaatgctgtgaacatagaaccatcattcccatagaaggcaggcaaagctacacaaattacaagagcgctcattacacaaagcagtgttgaaatccatccggagcgctagacaaccgaaggggccatgtggatccccacccccactataacccacactgggagctctgagaggtggtggttttccaggagagaaagaccacaaggtctccgcactctgtcccagaaaaccacagctctcttcatctgaggtgagaggctcctggctgccactctttgaggaccctcaaaaatccattcccttctctgtgtcctgatctaggttaacatacggtgtaaggcgcagactcagtgactggcccagcctttttggccacacatagatcttaataggctatctcctgccatcctccaccctgttgttttccacctagagttctagcagagtttgggaattccttcctaagcctttggtttatgcaatctgcattctcagaagctgagagttctttgccgctttctcttcacggtcccttggtaaactcctattcatcttctaaagccctgctctgggagtccatcctctgagaagcctttggtggacgcctctgaacttctaaatatatcagattcagccagattccattttacacggcagattctactgttgtaagttgcttaatgagaagtctgtctatagcgaagctgtcactgaacttggtaattgtgactatttttttgcaaggaggtagtatattcgtctggattcccagactgcacacccaaagcttttggctttgaagctattttattttattttattttattttattttattttttaagacagggtttctttgtgtagccttggtagttctggaactcactctgtaaaccaggctggcctggaactcacagagatccttccgcctctgcctcctgaatgctgagattaaaggtgtgggccaccatgcctggcttcagtgttgtactttagtttgttaaagctcttgaaagcatggatgtgcgggacgtgatgatagagctatagtcctttgggtctggctgaaagtgaggtggtatgtgcttaaacccaaaggccagtggagcttaaaccaggaaggacctgggtgtgctctgggaaatcaccagcgttgtttacaatagggaagtggatacaatagggacagttacaagggaatcctggaaaagcattggaatacaggagtcagacaagagaaactgcactcagaaaaaaagttagaaattgcggtagatgaagcagagtcaggaaagaggagttgggtggggtagtcaacaggttgggggagtcagggcacacaacccagaaggttccttaaaatgcactggcctagtgcccatatcgctctgagtgttagatctcaggcccttagctgctggaggaattagcttcaacggagcagaaatccgtgacactggctcactgggtggagggcgtactgactaagggatgcataagaattacttgaatgtgttctgatgacttgaattttctgattaattcagagtttctgaggacgagtccttttatcaatatgaagctgctttttgatttgttttgtttttacaatgactactttcctgttggaagacagaaaaagcgcattaggcttacttttgggtacatgtgtggagcaacacataggtggagagggtgagttttctaacctgttctacaatgacatcttgaaagtcacttaactatcttaggttttagacaccagtctgaaagagacgtcttcctaatgcacagttgataggcatgcactgtggggtatagtggggcacagtgggtgtactggctagttttgtgtcagcttgacacagctggagttatcacagagaaaggagcttcagttgaggaaatgcctccatgagatccaactgtaaggcattttctcaattaatgatcaagggggagaggccccttgtgggtgggaccatctctgggctggtagtcttggttctataagagcaggctgagcaagccaggggaagcaagccagtaaggaacatccctccatggcctctgcatcaactcctgcttcctgacctgctcgagttccagtcctgacttccttggtgatgaacagcactatggaagtgtaagccgaataaaccctttcctccccaacttgtttcttggtcatgatgtttgtgtaggaatagaaaccctgactaagacagtgggatacagtggggcacagtgagacagagtaggggtacagtgggatgcagtggggcacagtgggatgcagtgaggtacaatgggggcacagcgggacacagtgggggcacagtgggatacagtaggcagccactgagaaactgcctagtcatttactgatcacccatgtgttccatacccaacagaacccaaaccccatgcggacaggagcttgtcatgagtgaaacttattcatgcctcttggctgtagggcacagcacaatgatgtgtaactggataaagagtgtgcctggtcccctgtgggacactgtgtagcagtagaaaagaaacaatgtagtttgctctggcatggtgaaactcgaaaacctagagaaataaaacagaagaaatttatacaaatagccataccttcgaggacactgttgctatgaaatgcctaacagatcaacccatagagataaacttgacagaggtcagggatgcaagaactggaacacagagtgactgataatggtccaaggtctctttcagggaaaccagatagtagagatggctgtacaacatcacagaaaactaaaaaaaacccgcagactgtatccctatgaaatggctaagatggtggattttatattatataaatttaatataatgaatttaatataaatgaagtgaaatgtaaaattttaaggcggtgacacaatgaatcctttatagtacacagccaatgttccacatgataaagcaaactaaaagagacattctttgtgatccttaaatagacagagacacccatggagatatttggagcatatgacatctgcaggtccctaaaacaggataaccataaaacaaagccaaagttgaacaaatgcatctaatgtccatatgccggaacacacagctctccagagaaacaaatgcaatgtatatgcatagatctttattctcaattttactgatataaacaatgtatttcacaatccccaagtaggaataaatatttaatactctttactgtaaatttcattgattcttgaacaatgctttcattacctttcacgggaatctagtctctgcagccaagctaggctagggttgcaatcggagtatgagttaaatcgagcagcgtgtcaatcctctctttcctgatacacttacctttgctttaatatgcaatctttaatattatcctagtaagttatttcttaactatgcaaaataataacctgaaatcaggttatttgtcaaggctgtgagcaatttctctgtaaaattagagtatagttcttaattatggagagatgttatctcagagtgtgtgtgtgtttgtgtgtatacaggtgtgcctgtgaattcatgtatgcacatatatacctgctattcacagggtaatggctacagaatgacaggctttaaatctgatatttattgtggtcattttgtggatcatgaccttaaatctagacaatcaacgaaatgatcaattaagcccctggtttcagtatttgctgggttcacagctgatttcagtttccagcacaggatggccgaaagtagagtgggaagagagaattttaaggcggtcccatgtctcagcctctagtaacctctacacagctcaagagtggcaggcactagtgagccaaggagcatggacaacaggaagaatagggatgcattgatgagctctgaatagttattagccttgtccttaacaaattgtattgaaccataacttcatatggtctgactttaataatgacgatgttttttttaatttgttaatttttttaaacatttatttatttattatatgtaagtacactgtagatgtcttcagacactccagaagagggagtcagatctcattacgggtggttgtgagctgggatttgaactccggaccttaggaagagcagtcgggtgctcttacccgctgagccatctcaccagcccatgacgatgtttttaacagcctgctagtaatgttcctgtacaattagcatggactcatataagccagtgtgagctggctccagcacaccagtatctctaactgccatttgtgactcatcatacttttattagtttaacacccaactagaaatgtcataaacatgcttgcctggacactccaactctcctaattgcaaagcctttagctgagcattcttaaccatcatgccaacacttctttcttgcaactctttgtactgatgaagaggggagttgaacacttaaaagagaagcttttagaaatattgtcagaattttctgagttcttgatatgtctgtttgcttggaatcttccagatatcaattagacatcactcaggacatcaattagaaagtgctatctgcttatccgtggactttgaataactgttcacgggggcagcctcagaacctccccatactgcctttcaggttcccatagtaaagaccccactctagcacacctgttccctactgtggccctctgcctgctttcaggtaatctgggttcaatgcacatggctcacctggctttgtctgccttatagaaccaggacaccagctcacacaagacctagaggtcactgcaggacaggcatgcatcacttaaaatgcctttttattttattttcacaggtacagcagatgcagggcggtgtaggagggaagctggtgctggccttccagcaccatcctgtgctgggttgtttccagacccactgcctgctttacccctccttggcttagatcatgggtgggacagaggaagggacatgacacagaaaaggactgtcagatgaccacacaacttctattgccagctcatctgatatgtggatcccaggtgagggacagaagggatggaagacagaggaaagagaaagcaagcctgtgcctcttctcatatctggcaatgtgtctggaagagatatatgtcttcttcattgttctgtccctatggccatcttctcctcagggtctaaactactgccacatgctgtccccttcctgtggcacccactttacaagtgaagtcaacttgctcatggaagacaccatctgcctcagggctttggtccctggtgcatgaacagtctgtgatccaaggcagctggaaagctgaggctcccagaagcacctgtaactccaaaggtctagctctcttactcctcggggtatgatgacccaagctatgttccccagtggctcttgggtacccgaccaggccatggctgagcttggcaatacatcttcccatagacttcctggccacacctggctcgctgccctccatttgtgtccctggcttcactttcctcagagctgctgtgctccaaccttgtctcttgagcttctggaaagccatgtaatctactctctgtattaactgctctccaggactccatctccactcggctcaggcccacctatctaccttctcagagaggaagaagatgcctgcggagtcactgctcctcaaagcatccttcatgtttctctgcagcccattctgaagtgtgggctgtggaggctggcccctcttgcctcagacgtaagactcttggtgctgctcccctactgcgaaaccttctgtaagggctgacatgacacctacctctgtaccctcactgacttgtgctgatttgctttagccaaacttcctggccagaggcagagagaaggtcattgccttcatacctcatggtcctctgttctctgcccatgggcaatggtgacgtgagctgaagatcccagaaaagaaaggcatgtttaagttaaagtgtctacaaggctcattgattagaactttgtgattgtggggaactggaatgttacagatccagagccaaattatcttgggatattcttattcccattgctagctgttcattacctctgtgtctgacttaacttgtgactatgacaggaaatattttgggacatattaactcaacatctcactatattctatgagccctagagccaaggatatcattagacagcatttgaaacatagatcagagatttccctgttctgcggaaaccaccaacctggtgcttctaccaatgcatttggaacaagccttaacttatgtctctttttatcctgtaacacgtataaaagcttcacaaaactgtttccccactggagcacggcatttgtggtaccctgaatctgtgttcctgggccacagtcactcatatttggctccagaataaactttcttatttcctctgt

SEQ ID NO: 111 - DNA, 198590 bp, Mus musculus
agagcgtccgggacaagcgctctgttttgaatctttggcatcttcagggatggatggaatcctacaactgagggagactgcggtcttgggcgtgagcaagtgaggaaaagcgtgctggagcgaccagcagcaaacctcctcagagaggtgacgccagcttcttggttttcaccttaggtctgttcctccaagccggggtgcctttccctcatttacgctcctgagggatgctctgcttgtaaccttccgcagggttcccgcgcgcgctccacacctttcccagttgtggtttacaccccactgacttctctcatcacatccgtgtctccatcaccatcagatacttttctcagtgcgtctgaaaatgatgggaaaggctctcaagcagcctaacgagcacactaccaccagcacccttcacaaactgagcccagaactttcttgaagaaaggatgctgctggtctcccagaccttcctgctcaaaaccataagttggaaacactctgcaacgtgctgcaaaatgtaagttaatcctttgaaaacgcaattattttgttcttgggcaaaccctagtgatacataagtctatttgggttatgaagacttagaatttggaaagactaaatatctcttggaaaccgcctctgatccttgacctgatgcataaaattagtgacttattggaacctcactactaacctgtagcttctcagtgtattattacgcccctcccccaacctaaatatttaatttcccttgaaatcaggagatttgagatatatcattaagagctctcatcagattccctccttggggatccccaatttgattattcaatgtgagtacctaaacagattcttaaatattatttttgtaagtggaggagatcacagtcccccttacaaaccaggaaaaaaaaaaggtggaggttttcttgagaatatggcacatacaaagaaaacgtgtcacttttaaaagttgactcatctgtaactatactcatctgtaaactatggattccctagggctctaaaaatattattgtatatatattttaagtagaaataattaagcacaaaacccaactagatgcttttcttttataaaatggctgctgctttatgcatgttgggaaaaatggcttccttttttttttaattggctttaaaattgttttgttgccatttataagtaaagttctgttggtatttactgtcacagtatttagtttattatctaggactgcttctgcacctgacagacaccatcttagcctttacagaaaaagatctgataattcctggaccaggacatcctttggcactgaattgataatgtcactccccccacaaacatccccccatctagtttttatgtatgtgcctctgtttttaagctttctagtttctcactgtcgattcctgagcatgtataaacaggtcttaaatcactgtaactctaaaagagtagtcagtagggttaactgctctcctagcctccataccaagtatcttccatatgattttaaaaaaatgatcagctcttgagaaatccttcagagactttaattagaattgcagattaatttagaaagaatgagcacccttccttattcagttttattatccatgaacatggtctatctacttttagaaaatgcctcgattgtgaattccacagatacaggacgtagactcatggttgttagagatggatgagaggatggtgtcttagagttttactactgtgaagagacaccatgaccaagataacttttataaggacaacatttaattggtgctggcttacaggttcggaggttcagtccattgtcattatgcaggagcaaggcagtgtccaggcagacacggggtttgaggagctgagaataccaccttttgttctgaaggcagctagcaaaatactggcttccaggcagttaggatgagggtcttaaagtctacacccacagcgacacccttccttcaataaagccacacctactccaacaaggccacacctactccaacaaggctacacctactctgacaaggtcacacctactccaagaaggccacacctccaaatagtgccactccctgggcatatacaagcatatacaaaccatcacaggaaatgagcaccagtgaacatagaatttgttttgggataatgaccattttctggcattagatagtggtgattgtggcatggctatatgaatgctttaacaattactgaattgtacactttaaaaggctacattttacagcatataaattacattttagtaaagccgttttagtgaagtggaaaagtaatattgtaacccagttacgagttagttattcaaaaagcattgttcatagttgcaaaaatataaatgtctgtaagaagactgcctacaaattggttttaaattctcaaataaagaagtatagctaccaaaacaatggtgtgagaggtggtagtgcaatgactcagtgaataagacactcgccaccaaatgttaaggccccgagttcaaacctgggcaacctcatggtggtgaagagaaccgattcatataagttgtcctctgacctctgtaggatcacagtggctagccagctccccccacctctctctctctctctctctctctctctctctctcacacacacacacacacacatacacacacacacacaatgtaaaaaaaattaatggtagagcactgtatatcagtatgatcaatctcatagtatcatactcagagccaacaatgttgcagagttatctataacatgtacagaaagcttaaaatatatggaacattatgtaatttattggaagtataaaatagcataggcttcataaacatcagtttccaagcagtaatgagttggagagataacttatgtagtgtgcacctattagaggtggggtggagtagggaagagagggtgggtattaaggaagatttcatagagtgctttaattacagttggcaggggtcttactctttctttaaattaattgagaaagtgatgctgggggagggctgatttgcatacatgaagccatcatattatttcttaaaaaaaaaaaaaaaagaaagaaatctgtatcctccactgggactacctcagcaagcaaaaatgtaaagaatgatggcctgtaagccatattactaatgtacattttgcatttagaactactctcagatgttaaatcaatgccttatagaggatttttgaatgataacaaatagtctcagagggaggaaacctgaggatgtggagtgtgagggaaagccataagcttatctctcttacatggcatagatgctccgtgtaaaggtgaccacctaggcaggcgtccccgagaagcgcattacagagctggaacaagaggtaatatgagtggtttctagatcataagacaatttattgatattgggtctcagtcttatatcaaggagtgataaagccttgatctctgtcctcatgggggagtagaacttattttaactataatatcaatccctggtttctgagatatgaagggtttttgcaaagtgaggcctttttagaagctgagttggggggtagagttgcttaaaaattgatgggcacagagatgggtgagtccaaggaggaccaaggaatggtcggaaacccagccctgcaggagctttgctgagcttgtgaaatgtagagacattttctgtcgtaggttcatgtccctcaaagatgctttttttaggtccaacccagagtgactgggaccatagtggactaagcttgactccatccctgtagctcagtagttcttaacctgtggatcacaacccctctgagggctgaaagacccatacacagggatcaccccaaaccgtggaaaacacagatattcacattaggattcataacagaagcaacattacagtatgaagtagcaatgaaataataattaattttaaataataataaaataataaaatttaaaaaataataaaatttaaaataatagataattttaggggggggttcaccagaacatgaagaactgtattaaagggttgcagcattaggaaggttgaggaccattgctctagctggtgtttttataagggaaactggatcgagagagggcaggcagatgctgcagccagggagatggtcatggggtgtgtaggcagaacgcagctgttgtagctccgcccaggaaggccaaaggtcacttgcaaccacccgcagctaagagcaaggaaggatattcagacgtgccaagggaaggaaggactgttaccaccttgagtttggacttttagtctctagaatgccaaacagcaaatagattcagttgttttaaaccaggagtttggggtcatttgtgacatggtgaactagtacgtcctcgactgggcgctgcctagctttctatagtaacgggggctaagcaggaagggtaatcatcaccgcaaatcattggtcagttgtccttttggccacactgtgtactggtactgctacaccacagtcaattgttgggcgcaaatcattggtcagttgtccgtttggccacactgtgtgctggtactgctggtactgttgctttttttttttttttttttcttttttaagaatgaacagagtccatggaaggttggcttatataaacaaaacaaaacaaaacaccccacagcacctcaaaaaataccaccctatccccacatgagtaagggaaacaggggttctgttgattcacaagagaatctaaacgtgatacttgcagcctaatgggagactaaatgcagattcagacgttgaacttaagaagcatattctgtgtctcttttacaaataaagatgtgacttctccattattattgtaaacatcgatgtctacttactgcccccctcccctcttgtacattctatggaactcttccactgagccacacgcccagacttcccttctccctctctgtctcctcccctccccttccccctcccctatcaacatttgccatctcatatatttcctgttggtttattgtccttttttcttttcatacctatcacatgtttaaatgcttaatatatattcaggtatcttctttcatgtgcaagtcttgtctgatttaaaagttggctcattcttatagtgaggtacgaagaactttgtccttatgttcagaatctcttctggccattggaaacatgcctttatggcttagctatcatttcaagaaccattttcattttgatgatgtgtagtttatctattcttaaagatcatattttgtttgtgtttatgtgtgtgcgtgcgtgtgtaatggtgtgtttgtgtacatgtgtgctgatgcccacagaggccagaagagaatgtcagtcatagagattttcgagccaccagacataagtctgagacccatctattttcagtggtattcgttttgcttcccaaggagcagttgtctgccctaagtttattgagccttttcccttctggtctatattttatttatttatttttaatggttagattgatggtgatatattttacatcgagttttatgcataggaagaaccaggattcatattttttctcacatggaaacccaaattcattcattctctgcctgtctgtctgtctgtatgtctatctgtctgtctgtgggtgtgcacattggcggtgcttacctgtacctgtaaagactgatgctgggcatcctcttcctcctttgctctccagcttagtttttgaggccgagtctcccagggaacctggagcttgctgtcacagctagaatggctggccatcaaagctcttggatctgcttgtctgcactccaggcgtggtagggttacaggagtgctttacaacgcctggcttttatgtagatgcccagcaagttctttcctcaccgagtcatctccttagcctggaacagccagacttcccattcccggttttccatctccccgttaaattaaaacgacttccgttagtgaaagtgtcctatctattttcacaaccctttctgtgctagcagctatagcctggcagggaaatacagttttatgacttgactacagtggggaataagaaaaacaaacaagaaaagcaggtagaaactgcaggctctggctctggatgggactggttctgggtgagtttcctgtccgtatgacccctttttctggtcacagtgtgtggatcacaggagatatcacatcattcagctaaaacttgaatggaatattagcagagttcttggcatggacaattggattgagaatttgggatagtcccaacagctggaaagagtgcagagagatgacacgtcccaaatggaggaacagcgagttctgtttaaaaaactctctcgtctcttgacctgactgctgaactcgcattagacagctttcaaacagtcctcacaaagctaaaagatctgaagagaggggagataattgggtgcttgacttcctccaagttaattgcctattaagacaaaactattagtgttcttagaagactacagtctacttcataatttctgcaacaccccaagtattcatactatagtaaaatatagacattcaaagaaaaatgtaaaatgtagaaaagacaggagagaagacagtcggtggaatctggccccaagataatctggagtctgaatctctagacaagcattaaaaaataataaacattatgaatgtgcctctacaataacaggataacaggctaataaactaaggaacagaaatctcatcagggaaactattttttaagaaatctagagttgaacagtatatcaccttccaagtgtacctgtttttttttttttttaaataaccccaaatatttgattttagcagtgaagtttcaggagccagatggtggcatgagaatctgctatatcagaatgcagagaaagcagccagctatctttcctaccctgttgacatccctgaggggaaaagcccttttcccttccccatatcatcttaaatacccttcaactccatgtccctcctttctacttcctgtgtcatctcatgttctctccctgccagctggttgctcgctctgcctgttgacctatggttgactctatttgatcctgtttacagaaagttcttgggttaaaggtatgtgctagggctgagccacaccacaacaagaaaccggctttttcagttcacagtcctggggttcacaatgtgatcagatatcctgccatttgtctccccgtacatcacttcttgggaggttaaggcgatagcatctctttagcaaggaggccttggccatccttggcagcatagggattacttgttttggaaaggaagagaaacaacaaatgacaacaaggtatgctatacccaaactgtttaaaagcaagaaaatgaaaaaaaaatctcagggctgacaagttaaggtgtttgctctgcaagcctgaagacctgaccttgatccctggaacccatggaaaggtggaaagagagaaccaacttcacaaagttgacctctgacctctgtgtacactgtggcatgcatgctccaatcttcgctcatacatacacagtatgtctttagaaataaaaaataactttaaggggttggtgagatggctcagcggttaagagcacagactgctcttctgaaggtcctgagttcaattcccagcaaccacatggtagctcacaaccatctgtaatggcatctgatgccctcctctggtgagcatgaagatagtatactcgtacatataaagtaaataaataaataatttatttttgaaaaaataactttaaagctttttaagcaaaatgatgtttttcagtaaagttttaaattcagaggcatttggatatgcagaaaaattagaaagctaatatagagaggtcacacacagtaaaagctatttcccctactactaatgtcttatttcacttaatgaaattatattgattcattattaactgaagaaaggtaatgcagtccccactttattctctccctaagtcccatctaataggccatgttgcaattagaattcatgtctcttcgggcaccttcttggtagtgcctcttatcgtactttgctttttgatgaccttgacattttgaagaaaactggtgaagaatcttgcagaatgtctcattattggggttttccggtttttctgtttttattgggctgctgttctctaggtttgggagaagaacactgaagtaaagtgctgttttcgtcatagtttttacagatatatgctgtcattatctaacccagtcacgtggctgacattggtcatgactctccactgtagagttactctctgtttcctgattttgtgttatagatcatcctgtggaaagtagacactatctacacagctcacatttcaggagcagagagctatggcttacctgcaagggcagaagagatggggacattaattggaagtttccttcataggtctgttttccctcatttatttgatcaccacttattgatatcaatacagaataatgggttactttgttagtatcttaagactgtatctcaggctggactcaactttgctgtatacctgaggatggctttgaactcatcctcttcctgcctctacctcccaagacctgggattacaagtggatattgtcacaactctctcatgtcatggaatatattttttacatctggtaggacactgttttgctaaacagatgtttctagctttggtcattggtggttctcttgtttttctcttagttctgtttgacataatcttcccttgtaggcatttctactaaagtaccccctttaccctctgccttttcaattactatttaaaattttttaaaatattttttattaggtattttcttcatttacatttcaaatgttatcccaacagtcccccatatcctcccccctccactcccctacccacccactcccacttcttggccctggtgttcccttgtactgaggcatataaagtttgcaagaccaaggggcctctcttcccaatgatggccgactaggccatcttctgctacattcaattattttttcacatctatctatctatctatctatctatctatctatctatcatctgtctgtctgtctgtccatccatctgcctgtctacctacctacctacatatctattatgtgtgtatctgtgatgcatttatcacattttccatacaaaaaggatattcaaaatcatgagctttatatggcctaagagaggagagaaagaagataaatcagaagagaagaaagagaagcaggcagctggaggagtctctccattctttatcaactgtatgttgtgtgattttgattttattgaaacttaatcaagagacttttctataatcacaacctacattattgaaacctgattggtgacgatctgctatagtcacaacctaaactacccacctatgagagaattgtgtgatgacagtctcttggtagttgggatgtgttagttgagcagagtgaaatgacgctctgtgcttgtctttcagttttcaactgttatgtagacatactgagtgtttggaaagtatttgcaaagctcttccagctgcctagcacgtaccgagtatatctgtgaaataaaatgaatgaattccaaggcctggtccagttgtttcttacaatatcttgctgtccttgaatgacgattgttaagaggaagtttgttttgtcagatcatgatatagtattcatttagatctatatcacctctgggaaaaaggcataacaaaaggaggaaatgtcaaaatatgaaccataactttgacggtgtgactctttgtagttcttttttcacctgcaatattctcatttttaaaacgttttctcataaaaaatctctttattattagttcatatatttttacaatgtatcataccttggtcatattcacttaaactttattagtccctcccttcctcagtcacccgcttcccacccccccccccatcctagtattgccctttaagagactattttaaaaatagtcttagtttcacagcaaaagcaagcgtagagttcccatgtacccctgctcccgggcatgcgcagttgccttcgttagcgacatcctgcaccagcgtgatacatttgttacaactgatgaatgtccttgacacagtgttatcacccaaagtccataatttacattagagctaacttttgaggttttatagcccattggctttgataaatgtataatggcatctatccatctctttattagcacacagaatagttcaataaccaagaaaccctggacttgatgtattcatctctcctttcccactaatccctggaaatctctgatctttttcctgtgtctagaattttgtcttttctcacatgtggtatcgtcggaatcatacagcatgtagccttttcaaaccgatgtctttcacctagtaatatggtgtaatgttccttcaaggcttttcatggattaacagctaatttaccagccctgaataatactctcctctagtgataacacagcttatccactagcctattgaaagacattttggttgttgccaggttttggcaattagcaataaattacacatgcctgtgatggtctttgtgggcatatttttgactcttttgggtatataccagttagcaagattgccctattatatgataagaatttgtgcagtggtaacttgttttaatttataatcctctaataggatggttaacttctgctgtcagccatgcacaccttaagacttgtctgagagagccttgtcagagaggataatatgagaagactctccctaaattagcaacattttatggcctggagtccttggtagaagaaatggagaaagtgggcagaattccagtgttcacctatctctgcggcccgatgaggtcacgtgactagttggttgcctcaggctcccactttaagccatgagcacaagtgaattctccctccttgatcaagtattttgtcacagtaacaaggagaagccacagattgcaccagagatgcgcacgctgctgagcgtgcttcctggtcctccgagtgccacttgggatgagacagccagcggtagagatgcttttgccaattcagagtgtctgctttgttcttatctactgtggacagttatctgcttagcgttttccccacgttctgcttgtacgtgtatcttgtctctcctaagtctcgattccgtctccatttcctatacagccttagccccctcccctcccctcctctccccgcccctccccactcggcttctcctcagccctacttctggctacaaagatggccacatagtttggttttcttttctccacttgcatgtggtattctatcttaattatgctgtagatggtaatcacagccatttttatgtgggtgggtatattttgactggatgtaggtctatgcgtagtctctatgtgcctggtggctgtaggggacagaggagagtgggggttcctcttcgaaatgtatttgcaggtgcttgagcccctccttgtcaaggcagggaaatgaaccagggtcctttgcaaaagcagtcagtgctcttaacaatgagccgtctcttcagctctttcactccgttttaacatttgatattttgtggaagttgtacggagacatttggatgtaggtgtttgtcactattttatgggaaaatggaatcctgttttcttaaacatgctagtcaaaggcattttaaagtgcacctgtgataactttaatgcatttcccattccttctgtttcctttgttttctttttttgaagtcttatctccttgtaattatgccttacaattgtcaccggaatatttgacattgggtgtgatattttgaggttctagatgatattaactgtttccagaggtggctcatcttttttgctgggtaggtggggtagaaacaacttgatttaatctagtcagcatgtaactcaggttcatttttattgtacagtcttggtttattgctggtacctctcaaacttcacccccagccccaccccaaccccagtctgtggtgctgctcacagctgtacagagcatcttcttagcagatggcttggggagattcatgctaaaaattaagttaatgctttatacttttcctatctcagaacctggttcccttgaatcttggttgcttcagtagctagctcatggctcatagatccatttctgtatccctgtgtattgagtgtgtcccccaaaagtccacactataagcttaattccaaaattaatagtctctgaacatggggtctttagggaacaattagggtaagatatattaatttcttaagaatgatttatatgtctgtgtctgtatttgtgtgattgtatgctacaaatgtgagagcctgtagaggccaggagagggtgtcagacattctgaagttacaggtagctgtgagtaacctgacatgggtgctggaaactgaacttggatcttgggaggagcagtgagtgctcagaactactgagccttcccttgagccccagtgtgggttcatctgaatggggcctctctagttgtattagtgtggctttatatgagaagaatgaccccagatctgttttatcatacaacatctcccactatgtgcttaacactcattctctaggactcttcctaagttaaataaagccctttctattctttatgaattgcctgatctttgttattcaaccatagcaacagaaaacagactgagacacatcctgtgactcactgcagaaaaccattttggtgagtaatagactgcatatataactgttgtcccataaatttatatcacctagtgatgctgcagcagttttaattcgtgtaggaaatgaagctaataaaacattcttcagaatgagctggctaagtgatgcataatggtattttacctttcctttctttcctttcttcatccctccctctccccttccctctctccctccctcctgtctcccgtcctttttcccttcttttctttctttctctactgtttgttttgttttgttttgttttgttttgttttttcgagacagggtttctctgtgtagccctggctgtcctggaactccctttgtggaccaggctggccttgaactgggagcactggtattaaaggcgagtgctaccacacctggctatttacctttctaaatctcattagaaagctcagccctattctccactagtcttccacagtcttcacttctacttttagttaatgtagaatccatttttaaaactgccttccaaatcttctagctcacttacttttagtttgttttgccagagagcgatggttgccgcagtctgcaccaccttgtgcttgtggataattttttttttaacccgttcagatgatgtgagcttgagctgagtttatggggctggtcgattcagtgagaatgccccctgttttcctctgctctgcgtattgccaaggcagtactccttcccatcccaggctccggaaaggagagcctgggctagattttcaaaagatagttgtttttgttctctgtttttcatactaaccctgtctatagcctgagtcacagtggtagcctgtgtatctcaaggcaaaagcagatttaacacccaactcatctttggcatccctgttgtatcaaatatttaatctcaagttctggggtttctgccctgccttggatcgtccagctcccagataaagacaaaaaaatgcttatatttataatagaccttagtcagcaccaaagctgggcagatatcaaacctctgagctgttagaatttacttctacaccaataaccctgagttataacttaccgtgttccatctgggcagctcttcattccagttggtcagtcttcgtggccatattttcaagattactaccccatggcatcttctcctctctctaccttctctcttctttgtggtcccttcctctaaacccaagccaaagggacccaaggaaccaaaaagtccagtctgtttcctgaacagctatacaggctataggcagttttattcaccaaccagggataacttggtggacaaggttacacagtgtcacttgggtctatgagcggattctcttgtccttggtggcacagagatccacctgcctctgccttcctaatgctgggattaacggtgtgtactaacacatccaccatttactattttcttgcatacacacagaggcacatacacacaggtacgtgcatacacaccttgacatgcagacactcttctacttcccttcattgcaggagaaaaggtttgagatgtcttttgtggcctgtaaagttccattcagggtttttattatttgtggcaccttgtagattgtctaaagtgcttacacagttgtcagatggcaatgattaaggttccaccactttatctgccatgtttctataattttaggagttgacttgggttaactaatttcctttaatacctgaggaatagttaaggtgtattaaagtatgcagtccaggccccatccccacccctcagcctgattcccctccccagaattggcattcatcaagtacatacgactctagcagcctgatatttacgtttgtatacttgtgatttcctctttctaaataatttcagaatttactttaaaaaaatatgaattgttgacagagaaggatttgtttttaagaagactttaaaatagctgcattttatgaacaattctttaatcagccctgagtgacagatacattctgtgtcagaacactatctatctttaatgttcttccttggagtttggtttgtaaataaacatgaagagtgatcatctcgtgacattcttttaaaatctttttttcttcttcttcttcttctttcccagaaagtaaataaaaccctcattgtttcctaatcttcatgaataaattctttctggcctcaggtaataggctgtttcaaggctgccctatgcgtctacaggaatgccatttagaccttcgagccgatgtttctgtggaagtgcttataagtcacggaagtgcggatagccagcactgaatttttggatgacttcagttgcagacctcagaatgcagctggcctctgtgtagggtggtggtggggggaaccttgtaagaagcataagcctactgactgtatcttggcccatgttcccttttttccagtaagctgtctgctctacagaggtgtataaccctaatggcttgttgtatgccattaaaaggtattgtacactcataaaagaatgacattttgatcaatgctgttaaaagaattactgtcttgacacagaaaagctttcctgctgcaagtttaaaaatatgcctttaaaagctttttattgaatacctttgcatccctcagaaatatgccgttttggcatgaggttactctgaagtattccacattataacttaagcacaaacctcctatttaccttgagaagtcacagggccaaacaggctatttccctaccaaatggggcatggtagcctgcagtagcgtggtaccattttaagccgttgctgtatgtgttctaaacagaaaagatttgtaaaaagaaatatgaaaactaagctagtccttttttattttgcaaagtaatgatttgtgtgtgtgtgtgtgtgtgtgtgtgtgtgtgtgtgtgtgtgtgtgtgctcatgcgcatgttgtttttaaaagatagaattcctaagtctgaagggaaactagtctggggggccgggcagtggtggcgcacgcctttaatcccagcactcgggaggcagaagcaggcggatttctgagttccaggacagccagggctacacagataaaccctgtcttggaaaacaaacaaacaaacaaacaaacaaacgaaggtttggggataggtcttttttcattatgtggaaactggttctcttaaatggtggtgttagacggagagttttctttctttcctttctgttgtgtttttggttaggcatttagatacacccagtagacagtctcccgaagctgtgtgcttcttctctttatagctagtctttcacagatggacatagtgttatggctataactttagctttgctccacacttctctcactatctaacttacatccttaaagaatggtgaactgagaattctaaaactctagtgccctgaaaaaccacacagttttaaagttgtatgccagtacaggacgagaatcaactttgtgctttctgaattttacgtttaattatgcttattctattatttaaaatgtcatttattgattaaataatcacatgttttcattttcttttctttttgttgttgtttgtttgtttttattttgttttgagagggtcttgttatatgttttagctggcataaaatgtgctctgaagaccaggctggccttgaactcacagagatccaactgcctctgcctccagagtgctgagttctgggattaaaggtgtgcactaccttatccggtcaagatttttgttttatacatggaaaattcttatgtcttagcatgttggaccattctttttcaagaaacatagataccatctatggtagatagttttatgtcaacttgacacaagctaagatcatctgagaggagggaacctcaattgagaaaatgcctccagaagaccaggcagtaggcaagcctggagggcattttcttaatcagtgattgatggagggagggcccatgctattgcaggtgatagcatccataagctggtggtcctggcttctataagagagaaggctgagaaacctatgaggagcaagccagtaagcagcatccctccacagcctctgcatcagctcctgcctccaggttcctgccctgtctagttcctatcctggcttcctttagtgatggaaatgtaagatgaagtcaaccctgtcctccccaagttgcttgggtcatggtgcttcatcccagcaagagtaacgctaactaaggcggcacctgacatttctctggtgtgttaactgctatgtagagttgaatccaaacaaccacctttgaataagttcagtgctatttcatttgggggatcagcttgtcgccctgggcttgaaatactaaacaagcaacacccggcttcccacaaaccctgctcacttttttttttccacaaaagagaagacatattgtattttccaccggcagcccattctcctgactgaacataaagagttctcattttgtcagacaagcacagagtagtacttgaagcccaagcctgagtcttacgtcaatatgatgaaagttcttccatacagttcctctatgggttgtcataaaaccgggtgacccttcgaagtgatgctgacattttctgcaatgtccgcagcctggttcttgagaactgtcttcgtccttgcagtggaagtacccagagaactctgccttgacaaagcctatcagctgccacttctggtctagctctgcgtgtaaggcagacgttttttgttgttagtgatatttattgattgcgtttttagtattcagtaaacactaactaagcggcagatgaatccttttcttccagtgctgggaattgaagttaggtccttatgcatgccaggcaaagactatagcacggagctatggcccttgcaatgaatcaggtcatttagatggagcagggaaacttgttacagcggttacacaggtatttccaaaggcctgaagtagttacctaactgcagagcagggcttctggtgttggtagggcatggctgtgctggctatagacgtgtgcatcttgttctcaggagtgtcataccctagatcaatggttctcgacccgagggtcacgacccctttgtgggatcaaagatacctttcacagggtcgcatatcaagtatcctgtatatcgggtatttacattacacttcatagcagtagcaaaattacttactgttacaaaatagcagcaaaagtaattgatggttggaggggtgtcaccacaatatgaactgtattaaagggttgcagcattaagaaagttaagaacctcttgccctaggtagtattacaaaggagggtcctggagttcagaggcctgtacacaggatatagacagactggaggagtggcagagctgacatttgaagcaggcttcttgtgtctccaaattgtgttctcttcggtgtgataccagttcgtttttctttacccttcttctcatgcccctctctcagcttttgtatgtgaatgcatccaaacatggttattatttaaaaaggttggaagagaaatgtgtggttttcactaatggtttagagagaagcatattgcaaacttaattggactgcgtatcagacgaactgagttctggttgcacctgattctggccatatgatgatattctatttaaaggtctctcaaaatcaaaaatataatttgactcttatctatctatctatctatctatctatctatctatctatctatctatttatttgcatcccaaatgcagctctcttcccatcccctcttcagagtccctccctccatctccctaccctgctcctctgaggtgggccctctgatgtccccccaccttagtgcatcaagtctctgcaggataaggggcatcctctcccactttgattcagtatttacacttgttctttcgagcacaggtacagttttacctcctatagatcaggctgttaaaatacaatgtttcctagcataagggtgaggtgttttgagttttgttcttgtatgattgcatctgatactgaaattcactgaaaaatttcacatagagaactaactactctaattaaaggacactcttgtaagacacacacacagtggtttgatatatttgtgtttctgctgtcgtttgttttttgagacagtgtttctttgtgtatccctggctgtcccagaactcattctgtagaccaggcttggcctcaaactcagagatccacttgcctctgcctcttgaatgctaggattaaaggcgtgtgccaccacctggcaatagtttgctagattttatagtcagaataagtctggaaatctcagtagtataaatgtagataactttttgtgtgcgtgtgtttccactaccaaactcaggagtaggcagctactactttcaaagtacttgtgaattcttgggcttggctacagtggtgatgcctataaacccagttactgtattgagcatatatatatatatatatatatatatatatatatatatgtaatttaatacttgtgaaaacatgagattgatgacattatataatctttttacatactagaaaagagagaattattaaagttaggttacatgctgtttcatggtgacaagacaaagtcaaacctacaaaatacttcaaagagcctcctctctccagaatggaaatactgtaagagatttcctataaagttgcttagtgatacaaatttgtcttcaagaagtcttttaaatgggaaaatggctcttctgagttatgacagaaaaatttcaagtgttcaaatttgcttactgccagccattaaatattttttatatattaataaactaaacagtagctggtacgttgttttatagcaccacttattgtctggacagttaataaactcacagtatacttaaaacattgaaatttggagtgaatatagctaagtgtgtactgtacatgcatgcgtgtgtgtgtgtgtgtgtgtgtgtgtgtgtgtgtgcatgggttggaattggagattagggtatcggtcccactttgtctaggcttgagtttctaggccatagaactttctctctctgtgtgtgtacaaacttgtgtgtgcatgtgtgcatgtgtacacatacgtatgtgcgtgtgaaagagtgctaatggttgtgttacagggactcagatttttctgacagttgaacagctctgaattcagtgcctggactgatacttgtctattttattagtaggaggctcagtctctcatgtctccccccccccccatttaggtcaccttttcttgccagctaagaaattaatgtctttgttgggatcattgcacgtcgacttgataacagcagtgctgttattgaggcagctgacacagtgattggctaaataccgcctcttcagcagaggcaaagccattattgattcctggtggattctgggaacctgttgcactctctagtcttttgtccttagaaagcttccatttgtacaccttggtacggaactctttgtggtgggaacattttccacaggtattttcatatcatacaaacctcctagttttctggcacacagttgaaactctagaaagttagctacgtgaatttggtggggtttgacttattcttggcagttttatatatgacttatgtagttaattcaagttctggctatccagaaatagtaggctggcaacaaatatatgtgactattctgtgaatcctctggctagtgttagagactagccgaaatgaactctgggaagtttattttgtgccgtgacatgcgaagagaaaaatgtgcaaatcctgcatggtgagtggttagaatcacgaggcatttacactctcctttaaatcaaagcttaaaactgaactcagtcactcctctttctcagaacgttgatctgcttttagactattgagcatgaagggatgctccttttgagtaaagtgtcccctctcatggaattagatttctaactattgctatgtaagcagaaacaagtactggcctttgattatttggtgggtgttggttggggtctgccatttggataaaatagtcattaagaacaagaataaagagaatctgtgacttttgctttttaccttacaaaacgtgccacttgttaattgcttcagccttatatggtaacgatcactaccagcaagctgtgcatataaaattgcacatgggaatatttgctattaaacctctcaaccttcttttttttgaaaatttctttctttccacaattgatccgtaagagcaggaggatcatttcctagttgtgatcgaagtaaactaagctaatactgggatccccccctcaaaaacaaaacaaaacaaacaccttacctggctaagaagccagtaaagaagtctcagcaataaactaaacttcaaaggactgttatcttttacctaggcatagtgatgcatgcctttacatcccagcactcaggaggcagatttatgtgagttcaaggctagcctggattacatactgagttccaggccagccagagctacacagtaagaatttatttcaaaagaccaaaacaacaacaacaacaacaacaaaaacatctgtatcttttaaattctaacagtgacctcagtcagatatcagaaaattagatttcacatgtgggtctcttttttttttctttctaccattgagataataattggtagatgttagctctacctctgtattaaatatttcagttgtccctattattgattattgcacatagccttagtttttgtttttgttctttaatctcactgactttgtggctattgaagcctatgatgtgtggttggtagacctttttcgggaacaaagcatgactaccagaactgttagaaatactccctgagtcatcagaagaggggtctccttgttataaacgtgaggtagttcacgcaggtattatgaaatgtatttcatggctctaatttttctaattggaggctatctttctacaacttagttgggaacactgaaaatcgagtttgaagctcgatcaaataggaatttgatactattgcttttctaagcaattaaatttatgaggcagttcaatagaggagatagtgtttccttagtcacaaggctttgtaagtgtacagcttaataaatcttcataacctaaattgcctgcatagttgcagtctgattagagacttgacttagtagcccatgctagatctgaacttggcagtctctggctttttcttcttgggtactgaggtcgcaggtagatgtcacacacctgattctgttgcttctatcttcttcaagtagcagaatatacttttatctcacactccatcttaatgccatacataaacaaaacatcaaactatgtcccgtggatttttcacttgaatattatgtagataccctgacttaaatttaaatattgaatcaagataccgtaatatctgtgcaaattatacaaattattttcacctttggctattgtctggcttcctgggctacctttgtgatgttaaataaggttttaaactgattctgggtatgatcttggtatttctggatagccacattgcctggattggcactccaagctgatttggttggttcccaaagtttctttgttttgagttgctgggatcacaaaactcaaacatatatgaagagtttgccatttggatagacagctctgtcaggtcagttggtgcaattaccatgtatgctgcattagcctctgtctgtctgtctgtctgtctgtctgtctctctctctcacacacacacggatgctgtgctgctatcttgattagtttctctcttgaggttcaagtcacatggaaatgctgagctgttctggtcagagccccaaactattgtttttggctgatgtttttgccagagagacagagatcccctttgatgagattgaaataagtagtagtctttcaacactgttgtcaaatggctttcatcgtccatcggaaatccaacaaactacaactgccagctcaaaagaaagaatgatttttctgttgtctggaaggatcttcaggatgtgggcttgaatcctgtgggcattgaaacagtagcaacccagtcttgacaaatttctagatagtttatatatttctttgtaaaaatgtttgtacctaatattaaaggttcccagtttcaactgtaattggtgagattcccacccctcagggtttttttttcataattttggaaaaatgaataataaaaactatttgttatagttttacatcaggaactgaattatgctgttacttctgtaaggtcaaatttacattcctacttaagaacaagggaattctataaaacagtactcagcagcgtaggttttctgtagattgatcttcttgacccaccatcttcttacacatataattagcatgccacgataaaagaataaattatactatgagaattcgtatattacagtattgtaaacttttggttccatggagaacctggcttattaaacacattatatccaagagtcaggtttccagtctcgggtcttggttgttatgaggatggggagtgagccttagcttgctcatgcagagaagtagctagaccattttgtccatgcttgcctgagcaggactccatgctgaggtcagaggaaccctggttagtggtcttagatcatgctatttatttactaaacatctttaatgtgtccactttttatttaaaagttctttctgaaatagtttgttatgaggggggggggacctttttaggggctaatattagatagttattttctagtcaactataaaacagctaggacatcttattgactgcctaatttgcacgagagcatgtaataatccctgccaatcagttttcatgttgctacagcatttggaaaacagaggattgatgcttctgagaaagaggatgcatgtaaggtgtagccagcgagtcactccacagaccactggactcgctacaggaccttgtacggatgagaggtgtaaaatagaaccaaagggcattgtctattaaagtgtgaactttgtacaagtagaaactagttctttgaaattgacacaggagtccgagtgtgccaggcagcaccctccagccccactgttaaggaacatggaatgatttaaggcacacagagcccaagaggaacagcaacagagcaggaccagcgtgtgctgatccccttgtccataccacttgctattaggaagcattcgaagttaacgcagagtcacgttctgtgtgaattgtaattgatttagtttgttgtgtatgtcacagtatgtatagtaattaattaataaactaaaagaatagctggaagtgtagaagattgctgttttccccaagatataataataataacaacaacaagatagatagatagatagacagacagacagacagacagacagatagatagatagatagatagatagtaggagaatgagggggaagtggtaggggctgaagaagagaacttcctaggaccatgtgtgcactacagagtgagttccaagacagccagggatatacagaaaaaccctgtcttggaaaaacaaaagactgtgtgtgagatccctggtttgtctcccagtgagtatccatgtttaaccatatctgtttctgtttgccatctttttgggacccaggctttcaatgttttttgctgagataaagctcacactccctccggtttgcagtgtgcattgagtccgtgcgcgggtgcggccacgccgtttagaacactttcctcctttccatattcgtcagcgatcatcgagttctcctcccaaatactctaggcccagccagttacacagatcatctgtgtgatcgcagttctgaaacctgttgatgtgaaactccctgctgctttccaaggacactctccctcaaactactcaattgcttagtcagagaggactggagggagggcggcggcggaggtgggggtggggtagggggggtgggatccatggctattctctttgttaatgtaagtcttgtaaatcaaagtaagtgacgtataactatattcttacatgtatctaattaaatatagctccttaaacatgatttttcaaaggtggttttttttttatcatagctattcagctattaaatgtacctcctccctccctccctcctgactctctgatccttaaatttaaagattcagagtattgatcttgtcggactaagagattctgactcattctgacagcactcacaggaaagtaatgtataacccagaataccaattattcaatacagtgtaaaacatattttccctggggactaggtataggaccttctgagctgcacgttcccttcttataagtaagctacaagacaggctaaaatattatgagttaattgtcttgtacatgtagaaccagagcaagacaaatagttggttcaaacactgagtggcttggctgtcttttactcaaatggaaggatgaaataattgcctcctattccataacgcccgtgtcccagtcctgagtatctattaccttacgtagcacataaggagctatgcagatgtgattaacttgaggtggtaagtttaggcgggttctctgagtggactgagtttaattacttgtaagtctaaaaccccttgtatcgggaagctgaagagactgtgggaggacccaagggaaaacaggcagcattaacgacccagttgacccttgccagccttcaaggtctagaaaggcaccctgagccaaggaacgctggtgtccttcagaagctgggaaaggaagcgggtagattctgttctgtagcttcccgtagggaaaacagctctactggtaggtatcctgacgtcagtccagcaagacccattgtcggtccgtaacctatagaactgtaagaagatagatttgtctcgtcattaaagtcagcggccacttgtgtgttggcaggagaaaactagtacacttacttagagttccccaactgggcccagttggagagcccagtgcaaggatactctcttctacacagtgggtaatgggagtcttgcctggtcttttgcttctgtggctctctttttcataccttcagagcctttttggaagtgctttcttgaatgaatccctctgttaagcacatttaatatgaacatgttcttaagagttagatagaaaagcttaggtgttagatctggctttactattttataaatcggagtgtcagggcaggtgataatgttctaaggccccgccctccactcttcaggaaaacagtgggattgatagtacttgcccttgagggggtgctttgaggataaaatgcaataacatgtgtatggcaccatgtttcctacagactgggcacctaataaaggattgttattatctcttaaggctaaaagtaagagttgccagtggcttacattgtaacccttgcttggatacaaatatattaagaactattggtaccccggttggattcagcagatggttacacagaaggttcctcatggccctctggctgttatgttgaggcagtttatttaaaagggagacactgccagcagcagtgtaatcattagtgagcccacaaggtttggatggtgtgttccagacccacagtcacgtgatggccccggttaaacaataccacaaaagaaaagagggctggagaggactggaaagagaagaggaagggctgcggctgagagccatgcccatgcattatacaccggtgtgaaaacttcagagacccaagttaacaaaaaagttacaataaacaatgagtgctaaaattataacttaaaaagaagttaataaataataaagtaattatatttgctgttttttataagatttttttgctgggtatgttttactttatttctaggaccggggaagcagagacaggcatatctctgtgacctggggtctagcctagtctacatagggagctctgggccactcatagctacatagtgagaccttgtcttgaaacaaaaccaacaaatgaacaggtgttttatattgtttgtttttgagacaagatttttgtgtgtagaccatgttggtttcaaacttggtagtaattctcctgcctctatgtccgaaagtgctgccattacaaacctacaccaccatacccaactgaaaaggcttatgttataaagtcttaatgggtagattagacccattttcaaagcatgatacactatctctcagcctctaatatttcttttcttaagctggtgtgatatagtctctattaaggaaaccccggaattctgtatttatatagaatttttgaaacttcccaacaactgggattatgtttcagtatcatttagtttttaaatttagttgaattaattttacatgtgtgggtattgcgtttgcatgtatgtctgcgtagtagttgagtgtctgttgtccatgaggccagaagaatctagaactgaataatctagaactggagttacggagagttgtgtgctgctgtgttggtgctgggaatcgaaccctggtcctctggaatagcagccaggctctttgatgcaagacctctctacagcacctctttatcactttaaattcacaatgcctgggcacagatgatgggccgggcagcagtacatgtttattgaactgaggtaaggcgagttcttggaggccattcccacatagccagctttgggttcactcttgctgccgccctgattcggccatggctctcacttctagtcagcggcgacactcttgaactgctgtgctttttgccaggtggcttttctggactcggccagtgctccatggtgccacctagcttgggcaaaggccgctgtacttcatatcctcttccacttaatctctgtctacccctttgcccattaacaaccatattattgagcccattgcttcttaacctttacggtattgtatatgtagaaaattactgttttgttatttttttttgagacagatttccatgtagttgaggctggacctgaacttcttgttcccctgtctccacctctccagtccttggataacaactgtttaccgccacacctggccagaaagtgtcttctgtatggcactgtcaggtagtacaccggtcagcttggtacccaggggctcagggctcctctgcagcttaatattcctgtcacccagtgttggcatagcggtataccttacacaccttttgggaaatgccacttgatctgcatttgaaactggctatgactagaatctgccctagcttctacagagatgccttacaagctcctactgtatactgtagttcccccaagctctgtgtacacaggaattcagaatgctaaatcagttatttttcccgaggaagccgtggtctccagcagacacagatctgtgttttcccctcagtgagtggtttgtatttccttcagacctcagctcatgtctttattgtttgtttgtttgttttaaacacttacatcatcatcatttttctccttgactccttctctaattctgctaaactatggcagcttcacatattgtattattaaccattttattagaccacagaccgcccagtttttatagagcctgtgttaactcatgtatttctatgtttctggactgatacataaaaccatacatcctggattctttacagtgattccaattcagttagttttattcttgtcaattttcctgatctatcttcctattgttgctgtcattgtttgtagccgtctatcacgttatttacctgacttcctctccctacagattctataaattcagacaaatagctgatacttgtacaataaatataaaatgttggttgggcagctagctatattatcaaaatcaaatgtggtcttatactttgaataagtgttgttctaacatatattattagaacatatataacatatactgtaaagcatattatatgttataatttatgatatacaataaaatatattatataatatatattctatctatagatattctaatatatatatgaactagaaggtatatgatatatatatgatacattacttaagtttaagaacagcctcttaagtaaaaagtcttaaatctctgtattgcaaatgtcgaaactacactatagataattaacttccccaaatcagcacagtattaaatagcaatcggcatggttgaactgtaatcagcaatgctgagcagttttgacatgtgaataccgacagccatcctcacacactgctatgacgaaaccaggttaacagctgcaggtgtagctctatggtagaacacttgcttagtgtagacttctagttcagtccctagaggtagaaaaaggttacgtgtgggtggggtgatcagactagtagtaggttataatcggaaatgctatttcctcctaggtaaaataagccactgtatgggggtaacagggattgcgtgatacggaaaatggagtaccaagagtatgatgaaccattagcagaaagtgtccagcacttaagaaaaataaaagttgataaggatatggacatgactatgcgcctgtaatcccagccacttaggagacccggggcagaaaatacacatgttctaagcctgccttgacaacatttgaccctgtcacaagagagaagggttagcactatgtgtgcaacatctgtggagtgagctaagaaatgaaaactgggctgtatatgctatctgattgaagccttactacccagcatttactgttatccctgttttacaattgatggaaacaaatctcaggtagattcagtaatgggctccagggatgctaagcccggaaacccagaaactagaaaagtgaggttgaaacttggacatgtccacccaggctttttttttttttaagtgggctgcactgcctctgataatagggtaccagagagggagagtattaaaggagagctagaaggccatagataagccatgaggaaagccagagcagcccttcccagataactgcttcattctcagaaaacaccaggagcaacagtagggaggcacagcgggtgggcgtctagacaggaccagtggaggagaggggaaatcttggggaacctataaaatgcccacgctagcatctgtttaacagatttctggccttaggcttctccagtgtactggggggtaactttctctttgtctgcagcattcggtacttccccagacaaccatcgacacccccattgtggtgtggaacaggcttttaggggattgcaagaatgtagttagatctgtgcttgtttgtgggaaatatatttgataatgcatatttgccctgctgattagtgtttggggaaagagtttagatagcattctggaataagtccaacagagccactatttatggttgctaagccatcaccttatgatgccgacggcttctctttgtggtttagtcagttctaccgtctacatcgtgtacatgataaataactatctatttatatcctgagatgtcttacaatgctaggtggaatgtagtcccctgcaagtaagtgttgcggaaatactaattctacttcttagtctggacattgacattcgatatcgcgtgttttactttatatcattatactttgctttgtcttttttttttcccttcccttctacactgacaaagacatttgctctcagagagctcactctgaggatgacaactcttctatctctgtggctggcgcttccacgttctctcctgtctttaattaaacttgttttctcggtgtgttgtagctggaagccctgtgttgacacaactccgtcttgtaaagaacagattaaaatgtcagcgttctaatgttctcatctgtgggaaaaggaaaacatttggggcattttatttataactttttaaagactcctctgtgggggaggattagttggcacagggaaagcatctgacagttaaagggacagagctccatttcagtctgatgtgaagtggggaagggtggaagacttgcagaaactctcctttccaaaactgcagccggtctttttcctctctttcttaatttttccatcactgtagctcttaattcccacgcggtctgctttctctctccagatgcaccatctatggaacaatggccgtttcctcaaaaggtagccggccagttaaagtaagcacacgtgctatgtggagtcaaggggaaggaagaggatgcgttaagccttgacccttcaactcgtgtgtcaatgcacctgtttttcgcaactgggtcattgagctctgctagctatttattagtgagtggacccacacacccgacacatcacagttggggatgcttttgcattcccgaggcgttcacagtggtcagggcactgagctctcaggcatcagacagatgggttcctacaaactggctaggtagatatatagggcagttacagtgtgtctttatctcttgagtgttcggtttccacagctcaggatggataacatctcatttttatacatgaggaagctgtggcccagacatgtgaaggaacttgtccggagggacacagaaagttgaaaaagcaggatgcgaaccggtagcttattggattagagtttcctgaaaggttttgcactactttcggcttccttttatttgtcttgagatagggtctttatgtagctcagactgactttatactcaggatcctcctgctgtagctccctggtgttggtatttcaggcatgcacagccacaccacctagatttactctgggattgccttagctcaagccttgagcccttgaggagcatggttaatcaatatttactattgtacagatgaaatgataaatactaaagcaatatgcgggaatttccccgtatgttcctgttaggagatggtagtcagacagagcgcctgctccactttgggcaaatcttaattggcaaaagtattattacatgttctgtcttgctcatgtgagaagcaaagtgagtttcttagaagggcagaagtttgcgtgcccaccctgtactccggcttcagggggctagctctccccttgcagaatgtctgcctttcagaccttatttagagctttgccgggcttgagttgtcccttgggttgacagctgtggagtctgtatttcttcggcattccgtctcgtatgtaaattgcagttgttctccagtgccccttcggacagcttttgggagtgagggaagaaagaagcctctttctttgctttgctttttaagggctctaccatggcttctcgatgggcggcaatggctccctccagccttgaatctgactccctgcagcttggctgctctgggatcaatttgttggccagggttattcaaacacgagtagaatttgtgtcctctttagattaatgtgccgaggccaacgataacaattttcgtgtgggaactagtgcttgatatccagatcagaccatacttaatgctctataatttacttgagatttaaaatatgcatttgaggagcgactgggtctttttcccagccgctgttagtttgcttacattttcttttccttttaaattgtgtacttgaaatgaggcatctagcaaagttcttgtaacaaaaattaacatttgtactaaggtagataccttactgttaagcaaacttaactgaagaatatagcttgagatttcccgctcttctctctctctctctctctctctctctctctctctctctctctctctcatgtgtgcacctgtgcacatgtgctgtgagagattgagcccacagccatgtccattgtaaaatgtaatgtattttacatgtttttactctgttctttctcttcagttcttttagcccatgtaagtataggagagacaggcctacgtgattctgaagtctcttcccagaggctgggtgtgtggaatctaacctcagctgcaccctagaccgatgaggcgaggcggcttttcctgttaccattcagcttccgtttctcagtggttattcggaccgtggctgacactgccagggtcgcttccttactgtctccagattgacttttagcgtttgtgacactgagtgcatctgggctgtttccacccccgccccgccctgagtccttccccagcacttaggaagagtgcgaatattaatcttccatctctctcctgtctaatgctgttgcttctgtccctttctgttttcagcaaccgtcctgccgtttagccctttctcctttatccacggcattgtcttatttccttaccatatgtctgattgaaacctctctgctataataagacaggatgattcaaacttcacctctgccctgtgcctccacctcatggccaggcttcctgacttgggctgttttccagctgttctttcattctttcaccctctttagttgtagcttagacggctacttgtctttcctctaaggctttgtcaaaattgccagagccttttgccaaattcagtagacatttctgtgtcattttctctgacgttctatttttctgtgtcctccttcctcaggctcctttggtaatttcggttgctctctccatccttgtctgagggagtctcccatcattccgcccttgtttgtacttatttctgctttccagctacatgcacaaggttccccttggccccctatgtactaatcctgtcatatgctaagcttccttcagtcccccgctccacagatctgactttgggcttaacagctggatttgggggagtgtcacgggaatatatgataacttacatccttgtgtttcttcagcataccttccacccagattaattctgctttctttttttttattatttttttaaaaatattttttattaggtattttcctcatttacatttccagtgctatcccaaaagtctcccataccctcccccccactcccctacccatccactcccactttttggccctggcgttcccctgtactgctttctttattgcgtactctttgatggttatatgtgtcctctttgataagctctaggtttggggggttcaaagctggaaagaacgttatccactaagttctccagtgtggatcacaggctgatggagaagacaaccacttagaaaatcattttattgtacaatgtagaagatagactgataagggtaaatatcttgtgcattcctagtgcaaaaagaggggactctaaattcatgttgttggattaagaaaactttattggggaagataatactgtagaggattctgccaaaggcagaacttctggggattcctcccctttcccctccccttctcctccattactgcagagtctcattaattctacactcctaatactttacaaatgggttccatctttgccacccctaccagtagtcaatacatcttcaaattaacacagtgatcttttagtggcatgttgctctctgcttgcatgactttcccagcatctgtgatccatactgcgattataatgatctttatttatagattaatcatgcccttcataggctaaactctcccactggcacccagctgctttggaaatgtaaccctttagcatcgcaggctggtcacatgacctgctggccctgcttcctgcctcacttctcatttgttttattgtttatcattatcattttattggcatgtagtcattgtgtggaaagtcctgggtttcaaaggatgttttcatgcacgtgtgtgatgtatttgatccgtgatatgttgttactttaatggcttcattgagtgtaactcatatgccacataattgacctatttaaagtgtgtgattcagtagtgtttagtatgttcacagaattggtaaccagaaccagaagtcaattttagaatcttttcatctgcttagaaagaagtcctatatccactcgtagtcactctgtctcaccctacctgtaacttcatgctgtcatacaatctgtggtgttttgtgattggcttctttcactaagcacactattttcaagacaaatccatgatgtagcctgtattagtacttgctttgtatggctgtgtatttcatcatatgtgtagtggatggacatttaggtagcttctggttttgatattatgaataattctacttaaaagttcacatagacgtttttgtgtgggattgcgttttcatttctcttgggcgtatgggtcatgtggttactttgccttcaactttttgaggaattgccacactttttttcaaagcacatgtgaccacattaaatccaaaccaaccatgaatacagattttattaccctatattcttggtaataatttcggtttctttttgtttgtttgtttgtttattttttgttttaggtttttgttccatattttttatatatatatgtaaatatatgtatatatatgtatatatacatatacatatatacacacatatatatgtatacatatgtatgtatgtgtgtatatatatatatatatatacactgtccatactcagatgtataaatagtttatcatggtagatttgatttgatattcagttacagctctttgagtatttacatattttcttagaagaaatactttttgtttttaccccttgaagaataaaatgttcacaagtcccaaagtatttctgtatttcttttcttctctatgtgtttcagtgccatatctaagaatcagttttcaaccaaaggtcaacaattttactcctaactcttcttctaaaggagttttgtcatttgagcttttgtgttaccgcctgtgagctatgtggagttgactttttcatgtatgatgtgagaagggactctgacttcattgctttgcaaatgtttcagggcggtttgttgaggtatttccctgtcctcgagatactttaaggtgaatctaaattaacttaaaacccatacagtgaaagtatgtgtgtaaatttgacaccacctgtgttttaaaaaatcaactctaaatgtaaaagttatcttatggcttacttagtgtcactcggggtgatctgtatgtatcatttgcactaataccatgtgtccccttctgctgtaaaattgagatatgtgactcttctcagttaaggattttgttggtttggttttaaatccaactagttttatctgttctgtaccacttggtttttaataagaattttaggaaagttaaggatgggattttgataagagatttcgctggatctgaatcaacttgaagagtatttacctctcggtactaagttatccagtctacaaactgagggtttttttttttttttttgagtttttcaacagtgttttgtagtttcatttaataggcatcctgtcttttattggtaagttcgatgtttgtttgttgagtgtttttcttggagtctctcttagtcatagtttattaatttatattggagtgtcataaactttgacttttacacaaaggattctggagtttacagtttgtttcattgatacatttcataacttgattttgcaacgctaatccattcctgtatgtctagggtgtatttcacatgactgtccccggatagtcctttctatgcccagttcgttacagcgcaaactagtttcaagagaaaggagttgagccaggcactgtgtaggcaagcatgtccgtgtggtgcatcatgtccaggcatgcgtgtccaggtggcacgtatctgtaacctagctctcagaaggcagaggcaagaactcttacataggaagatgtcacagggggggggggcggggagagagagagagaaggggaaagagaaggaaagagggatctgtaattgttttgtttgtttttcatcatacgattttcttagaagaaattgagacatgctagtggattaattttctcttcttgatccagtgtcaaaaagtagcttttctttctaggaaggcttccattttatccaggttatctagtttgttgacatggaaccggattttgtagttttaaattctttttatttccttatggtcactagtagtacctcctctttcatgtctactttcgataatttaattttttattctctcgcttttttttttctggctagtttagtaaatggttttcccattttgttaacttttactccgaagcaaattttaattttgctcattttttttcctgatgcgtctatttatactattcattatcctctttaaattactattaattttagtagtaattatttatttatttattatttatttatttatgttttttttttaaagacagggtttctctgtgtatccctggctgtcctgcaactcactctgtagaccaggctggcctccaactcagaaatccgcctgcctctgcctcccaagtgctgggatcaaaggcgtgtgccaccaccgcctggctgagtgttttatttaatgtcggcattacagttctaagcgtccatacgagccttgttatgtctacgttccacgacactctttgttttgttttcattgacccaaaaggattttctaatctcctttgtaatcgcatcactgtttaattggtttttaagatcgcactctttttaaatactcacaaacctcctaaactttcttccattattggttcctaattgcagcacacacagttggatttagtcacttttaattaatcgtgactatgtcctcacacagatcttgttctagagagcacaccatgtacccaggctgggaggttgggtagtcacgtgttagagcctgctagctgacagcgctgctactgtctgttcatcttcttcctagttctatcactcctgaaagcagagactggaaatcttttttaaaaaacatctatttctctctttctgtcttagttacctttcagttgctgtgacaaaacaccatgaccaaggcaacttaaagaagaaagaggtttggttttttttgggggggggtggcttgcagtttcagagaatgaacccatgactatcatagcagggactgtggtagcagacagataggcaggtatggtactgcagtagctgagagcttacatctgatctacaaggagaggcagggaggatcgagggaggaaaggctatcagggataccatgagacattgaaacctcaaagaccaccctggtgagacacctccctcaaggccacgtctcttaaaacttcccaaacagtcctaccaactggggactgaggctacaaatacatgaatctgtgtgggctgttctcattcaaactgccacgctcacacttggtctgttttgtctgagtactcggtggctttctgttagaagtatgtgtgttcgtcattgtgacatcaccctgatggacttagtgttttactgttgaatatttttcatctctttatatattcttatgctttaaaatgttttgtctggttttctatgctgttcctgcttttttatggttactgtatagatagatgatctgccctttttcattttttccccttcaacctattgtaagggaccttgtgtagaaagcatataattggatgacctttttttttttttttgtatgttgtcttagttagagctttactgctgtgaacagacactgtgaccaatgcaagtcttataaaggacaacatttaattggcgctggcttacaggttcagaggttcagaccattatcattaaggtaggagcatggcagcgtccaggcaggcatggtgcaggaggagctgaaagttctatatatacatcttcacctgaaggctactagtggaagactgacttccaggcagctagggtgagggtcttaagcccacacccacagtgacacacctactccaagaagaccacacctcctaacagtttcactccctcggctgagcatatacaaaccatcacatatgtgaagctcaaaccaaggccctgtaagtgtgccaaacaagcactataccactgacctgcagccccagaaggagacctgttttaactagtccagcatctataatcccatggttcatgactgtccacttgcgggaagatcattggtggggctccctcacctaagcagcccccgaatatgctggtgtttatacaaacttcaagatgagtactttctaaactccctattcctgtccctagcctaacattttagatgatcactttgttccagatcaaaagcaacgtgcctcatgtcagagaggttgaccagccaaaaaagcaccctaattatagctttgaaaagcagagaattaggggtcagagttgttggatcccattctttcaaggcaatagagtatagcatttaaatgaatccgagtagggtcatttttttttctgtagaagacacgtcttttctaattccagcaatattaaagctatagttttagctttgggggttaccagaaataacttcgtcggacaattagcctccaagtagcagagcaatgtgatttatttccatcctatggtaataatggaatggttactctgttattttttaagctccatcatccccatagttgggtttgtcttaataacgggcaggcttttcctcggtagctcaaggtcctataaggagagctgcttcttcatggagagcttgtaactcaggtgcccagcgctgtcattgcccagcccggggggttctctaggatgccgtgcgaagagagaacagctcagaggcatggatgggttggtccggtgtttgcccactgaaacttagtccctggggagaagttggttctaaagccccgctgccttcctgtcttgtaaacatggctgttacgagcatggcagtcaccgggtaacggcacatgctgcatagtacaactggggatttgaacagagagagggcattaggagtagaatatcattaaaggaatcttatgtgtcatgcttatatagtgacataacaagacatagaaaagagaagagaggtgaggcccctacttcacttttattttgtttgttgggaatatttgatatgttataattttcttcattttttttcctaagtaaatggcacagatagttcaaattgtgactcataggagtgtctccaatttgatcttatattattatgaaactcactgttttctttatgcttacgtgaattacaaagtctaatgtaaaacccactaaacattttgtggtttttatgagcagttcccactatttttatatatggtgaaatactatttagcgtcaaggagaaaaatctcccattaatcactttgttctatctcgtgttggtgacaatgcatcttcctttttttccaggtagactatagcagcttccatatgatcacattttaaaagtttgctggttggccctaattaatctttgcctataatggttttatgttaactccatatataaaatgggaatgtctcacaaaagatggtcatttagtgtactaacacatcccattatacccaaacttaccttaggtcacccatgcaaagtgccccaggtgcttctctaccgtgttgattctatgtaactgtcttgtgctactgtgtgggttctttcttctacccttctctacccttttccttccactctttcaacccccaacactagataagagagaagaaagtatagagaggaaaggaaagcgatccttgaatacagtcagaggtcagaaagggagtgatgttactgtcaaactacttcctgctggttagcagtgttgagttccttgggacaagtttgatcttcaccatcaggatgtctaatttcttgtttcttctttgtgcatgactgtttaacaaatggcaaccaacatctaccaacaacccactctgcctcttgggactttagtgtttatatgccctctaaaaagtccccagaattacaaacatcacacaatcacagaaactatctgcagctgtcaaaatcacacccctgctagagcacgaggaagttcatagttagctgctgtggacaatcagaagcagccctattcccacacctggaattaaaatgaaaatgtagtcttataatatttctgtgttttctaaagaaaccaaagcctccaaattctcattacagttctataaggtatgttagtctacagagtgttgactaaggtcagtggcttttgaaagtggcagaagaatgcaagggtgggacttcaggagagtgtgaactgtcccctgaagagttctctcacttgactgacttaaaagaactgtttggaaacaggactcggggaagcttttgatatttcatttttctttctttcttttttttaagatttatttattttatatgtgtgagcacactgtagctgtcttcagacacatcagaagagggcatccaatctcattacagatggttgtaagtcaccatgtagatgctgggatttgaactcaggacctctggaagagcagacaatgctcttaatagctgagccatctccccagccccccttattttaaattttaatttattttttacactccatattccattccatgccccccatccaccctctgactgctccccatcccacacctcctccctatcctatcccatctccacatggataccccaaacccccaacccccccctgacctctaaactccctggggcctcctgtctctagagggttaggtgctgtcactggaccttcttttccttaggctcttctccatttcaatccctgtaattctttcagacaagaacaattatggatcagagatgtgactgtgggatggcaaccctaaccctcacttgatgtcctgtcttcctgctggaggtgggctctaaatatgtggttcatttacacaatggaataatactcagctagtaagaacgaggtcatcctgagttttgtaggcaaatggatggaactagaaaatatcatcctgtgtgaggtaactcagtcccaaaagggcattcactaataagtggatatccactaataaaccaaaaaacaacaacaacaaaaaaaaaaacaaaaaaaccccaaaatgtacagaatacccaagatacagtccacaaaactcaaaaaactcaacaagctgaagtgcccaaatggggagagagaagaaggcaatcaccagtcgggagggagggaggaagggatctgggagggaaagtggagggggttggtgggggaaggggggagtaggggacagagaagaacctagtctggtactgggtgagggaaaaggactgaagccctgagggccaacaaaaagaatataaacaggcaaccttaggaaataggaggttggggacccctccccccccagaatgcaccagagacctgggatgtgagagactcccaggacacaaagggagggaccttagatggaagcccacctccagcagggagacaggcctttgatatttctatattggtcagccagtctttggggaaggaacctgacgtgactgcaggaaaggatgccaggatggttccatgctctccactctcccagaagctgggcaggaaaccttttataaaacccagggaatatgaacaggtctccccactttctcccatactgcagtgaactttccagctttgaagcccacagttcttttattcaagcagaaaagagaaaagcagagtcagaaacaataaaaccaacagcagttaaatactagaaatcctataatgtacttatttaaacgttaccataacggtgtttttaaagtgtcttttcagctttattcattcgaggcagcttggctgcctagcaagctacactctctctgcccatggcaggagcaggcttacctagcactgcagaagaccaagcctaagatactcgctttcctgacactttgacagagatccagagatgcatgtggctcacttcatcttcacaagctgtaaggataccgagttaccttacatttgacaaatttagagggaacctaagttcagtttttaattaacagatactatgccacgaacactctaccaaagggttattagtctgcttcgttcaagggtctgaatgggaggctttgggtgccttggagttttagtgagtgtcagtgtatcttggaagatgccaaaagaatatatttttcctactctgcttagtctactaaaagtcaggcagtttgtctttctgtatgtaaatctgtaaagacaaaccctgtataacacagtattcagatgtgagaaccttgccccaggccctatgtttcttcagctgatgtccaatatatctttaactcacttattcctctccattgagaatagacatcggcttacttgaagcatcacttttcatatatatatacatacacacacacatatatatatatatacacacacatatgcatgtatatatacttaagtatatattcaatttataaacatatcgtataatataaattatatatatttataaaaatttatgatgcagttttattctcacatggaaatacaatggataaattttgaagtaggaaaaacagttgtctcataaatgtatgctatgactatgcaatggtctattattgctttaaatgattaagtaaatgttgacattttttatttgtttaatttccatgattataactattaatggtgtagccctaaatctgaagtcctcaacaggcattccaagtccacagtctgagagccactggaaaaagacaagcagcagtcgttctggatctaaattcatccagcctgacccatggcaggcacttagagagtctcacttctaattactgcagcttcccttccatttttctcagagttacaccatgtttaggtgagccagaggcccgggtaagaatgcttccatctataaggaggcaaccaggagacttgggaaatctcatcacatctcttttaggcttctgaaataaatactcattagtggcacatttcaagcctaggcaaagtagaatattttgaatatattaatgttttgtattcacttaatattttacatcatttaaaataatgtgggtgttttttttttaaacgttggtgatgcattttctgtagaaaccttgagagaaatgattccacttctgtgatttgttttgctacttagatgggaatggtgtttagcatttttaaaaagggagatggctgtactgataccactgccttctgttcaagctaagttgagaagcatgaaacagtgctctagagggagagggagaaatgatttttgttgtcaagtgtcactgctggttgggagagtacgtgagatacggaaaatgccctcggtaacatgcggacttccgttatttagtcctgcactgattataaatttgtcttgtggaaacagcgatgaacatttttatatcttacccacactgccgacctcttattcttttcatgagtctgagactcaggggcgtcagaaaaatcttaggagtgaagttagctttgaaagaggaaaaggcgtgagaggtggtagctttagctattctgtggtaccgtatgagaccgtcaaagtgatttaaaaccattataggttctaggtggtaaccaacaaatagataacgcaaaagatctctactcttggccacctggttggttccttcccttgtttcctattgatgactgagtacctaggcagctttgagatttagattatattaactgtgtctcaaatatcagtttgttttccttcagctttttaaaataaactttaacttgacgttaacttagactagagaaaacttgcaaagatgatataccatgctccgtattctcaagcacccgctcttgtcacgagcatggtcctctgatctcccctgggctccttagcacttatgatctcaactggaagagtttgaagagacacacagaacagcacaggcaatggggtaccttatagagtaaagcagggcatcctgaagggtgagaataggcagtggccagaggcaccagggtgtaaaggaaacactcgcacggagtgagagtggacagtagtctcaggaaccattgtgtaggaaaacacgttcgtgggtagaggtggacagtagccccagagaacattgtacaacttaggcctctctccctctctctctctctctctctctctctctctctctctctctctctctctccctccctctccctctctctctctcttcctctgtctctttctctccctccccctcctcctcttcctcctccttctccttctcctcctccttcatttcttaacactactaaaaatttatttatttattcactttacatcctgattgaagtcccagtcccaacctcaaaacctgttttccctttaccccctccccttcttctcagagataaagaagccctcccccacaccacaggtaccaatctgacctggcacatcaagttgcagtaggactaagagcatcctctcccactgagacctggccatgcagtccagctaggggaaagaatgacagttcccactctaattgttaggtgatccatgtgaagaccaagctgtacagctgctacaaacatatagggggcctaggtccagcccctgcatgctctttggctggtggtttagtttctgtgcgcccccatcagtcagggttagctgactctggaggtcttcttgtggtgttgttgacccctccagttccttccccaactcttatacaagactctccaagctctgcctaatgtttggctatagctcctaacattacttctgggggatataatctcacagtaactatctgaccctctttggctcttataatcttcatcatttcccccccccccccaaatgttccctgatctttaggtatgggagggttttgtagatatttcctttggcactgggctccacaactctaccttttgattggtgtggttttctgttgcgggctccatctgttgcagagggaagtttcctgatgaatggtgacgactcactacagttgtctgttggtataaagacacatggttatagatcgttgttaggtattctgctggtttagtaaattagtggctgtagagtctcctccaatgactatacttcactagcactgggcagttagctaggtgtctggcaccaatcatgggttttcctcttgttgaggcaggcttaattctgatcagagaggtgttggttaccattaagatatgtgtgccactagtgtaaccttagggttatctttccatgctggtcattgatgtggttcatagctaggtaggatttgtgattgtgtcatatcttttgaagcgttcatggcactgtctggtatcatgaaagcttttcattcctcagggaaggacattcagggcagcctcaaatattttaaaccttatggaggagtagttgtaatacctcttccttctatgacattattttcagtttataaaattagagtattatcaggaatacaggagggtagggaccaatggggtgaaggaggagtccaccctcatgagcttcaagcctgctaatttctaacagttcgctaatacatgacagtggctaatatctaacagttttattttcccctcttatcattagcatgtattacttcttggtttccttaataccagaaacaaacctttaaaagaatctactgttactttgtttctcatcggaaagaacttgagccccagggtaggaaataattaacctgttcatttaacaaagatctgagggcataatgtgacacttgttttagagtagccatggcaatacattgttaaagtgatacgcctgcctttgtggagttgtaatagatagaaactggagggactttctggggagtttacattatgtggaaataggattttcatcattgaaagctctttgggttccattttcagtgtggagtatcagcgtctgaaactcctgtcaagcatcgaaaggcattaaataactagcccactgcaccttgaagaaactgctgctcttcctgggttagtcggtgccctttgcttcccctgtagagacggagaaatgccttccatgataaattagcctcagagaaacaaaagaatcaccagaacagttgcaagcaaaggaagctgtgaaagaatggaaacgtgagccccgtgtaccagggacccctgctgctctctattttcagtgtggcaaagcaaaccaggcccccatggactctaatactgaagaatgaattatagtcttgaatagtaatgcggtactgctaatgatttcatcagtgaccatagcctctctctctctctctctctctctctctctctctctgtgtgtgtgtgtgtgtgtatacatgaatttatcaagtaactatttggtttaagtataaattgtaggtttaaaaagaatagtgtactcatcatgaatttaacagtgtgaaaaatgcattaatatactcttgtatttgtatgtatgtatgtatttatgcaagcttactgggagaataaatgagcaagtttcagccttagctttttagtttgtctcatatacctaccgctattagcctagttgtggttttctgtcagactctagaaccatcttcaaattaattcatccaaaccggaagtttttacttttcttcctaaattagtttttccatttttcttctaccttgtttttgtccattctctatgtaatagtttttaattaccatgtagatacagtcagacttcagtgtgcatatgtgtgcacatgtgtttgtgcatgcgtgcacgtgtgtgtgtgtgtgtctgtctcacaaatctaattttgtttttaatactaagaatggaacccaaagccttgcatgtgctagtcaagtactatatcaccacgctatgcccctagttccagtcttagattgtaattctgatatgtttaactatgtgttttatagaagttataatttcccataaactcacagttatcttttgttaaagtcatgtaactgttaaggctagagagtgtaataagtgttttcctaggcgtctatgtatttgacttccagactaatgcaaaagctttgatacaacagtaagtgtagctccagaagtgcttagcctgttctacctccgcatcctaaatattctgatgagtttgcatgccttccacgccgccttcctacccaacttgtatggcatgtcctcagagctgtgttagtatttcattggctttcccggattttattctgctggctttagagttatctgaggttgctctgtgggatctttgagacattcagaatcattgttcacctaagtacagtggtgtttgcttataattcccaaacactaagagtctgagggggaggcaggaaggttatgagtccaggacctgtctaggctacatagtgagattgcctataaataaatgaatggatagatagatagatagttggatagatagatagagagagacagagacagagagacagagagatagatggatagaatcattattcaatctacccttcagtatatgaaaacattccagggaagacaaatgaattatctctttgttctaatataagaatccatttcattttcttcctgttgctgtgtataccatgttataaataatcagacagctagagtacagtactgtactgcattgtatggagaatgaagatcagtggctgtcctggggtttcatgcatattggtgagagaaatatacgtggaagagatggacaccctcaaagaatgtctcttctacctacgggtctatctttgtcactgacagtaagtagcaacttggaattggttttgtgcagccctacatgaagtggagcattgataattacctgtgaatctggattgttgtctggatcacttgggacaccagtcagttctatatcacctactacggggtcatggcccttgtgcaagtgacagaatttgcatccctgttaagcttgacttacaagatataccaccaccaaataaaggtctctcgctgagacttcccattgtcttttctgctgaacgtctctcactgagtttagcttgccaatttctatctgatagttttgtctttagaaatccctaaagctaatagttctgccgccatcttccttaagtgcatgcgggcctttcaaatatttggtcggaagcagaagattgtccctgtctggctcatcttggtaaaactcatttactgtttttccttttaaactgttagctcaagtgaccttacacacaagtcccagctgtgcattagcattgcttggggatgtgtttgtatcttttgtctaaaaatacccagccggtaggattcatgatccatgaaagctaattgaaacaatttctcttcaagttttggcaagcgaagcatgcattataagcattaatatctataaattgaattgttaatgaatctagacactaataatgaatgcaattttgcaggcttaactagaaacactaaaattatcaggatctggagcagaattttcaatcatttttgcttattaaatagcaaagctatgcttttaataagctaatcatttttatttgcccccacaggagtagctcagttgattagaaacaggtttctaagtgcaaagtgatgttgtttttctcttactgctttaaccaccaaagcactgaaattttaaggtggcgatttatctcacagccggtgtctctgagcacgttggtgcatgcatacgctccctgacacttccactcattccatttctcccccatacagtgtctgtctcatttgtacttatatgctatacgtttttaaaaccgtcattatcaccattggtttaaataagtggtctcatttcacatgcaggccatttagaagattgtacatcaccagagtgaaaaacaaaatgggtctcaggacccattttgtttttctttttttctgattcctattatttttagacttggcgactcctttggcatctgtttcgatcaaaatactcgtccccatgcaaaaacatggtgtggctctagctctagttacaaagctcggagcatccagaaagcgatgctgagcagccgtgctgtttcctgtctagggcggaagtgcctgagataggcaagctgggagcttaggtgcgcaattggtgctttcagtagtctcttccctcacagttgcagagtatcctgagagagccagtgtgcctttctatggctggccccttactgcctagggatgccgtaggctctaaggagagtttggagtaatgaaggtgtatgcggcttctcttaaattcaaagtgcattatctgattatttctttttcttcagtctgaagcatattgagacttacttagctttgaatgatagagagactgaggcgctgaagcctaggtgtagactctggtagacaatatggagttttgcatccgagactgcatgctggcattgcggtgggagggaagaagggtcgggggaggggttggattccttggtattatttatttcagccttgttgcatattgcttttgactaccaggtttgacagtctataacctttttagaaggatgaaattgttaatttatgtataacacatggtgcagaataccccagtaatatggtgtatatgcatcgcattatcaattacgaaatggtttgaaggattgcccaacatagatgtactttatcttactgttaggtaaaaatattttcacagacacgcgttgtttttctgatgacagtttactaacctcaagcttctactttaattctcaagaaaatagctttatcaaagcggcggtctagtgatctttcaagcttcccctgccgcttccctctaagtgacagaagagtccagggaaagccggccgatcacaaaacctatggaaaacaaacagaaagacaaaaagctttccccaacgtgtttttgaagcactcgtttcttagctaataaactttttactagtttctgggattgtttttttaaaatcaattctaaagttttccttttttcaagttagccttaaacaacaacaacaacaacaaaaacaaaacaacaataaactttgggtgactgtcgtttttctgctccataaatctgattaagtgagtccctgaattgtgtctctcatagatttgattaattttttgtttgtttgttttcgagacagagtttctctgtgtagcccttggctgtcctggaactcactctgtagaccaggctggcctcgaactcagaaatccacctgcctctgcctcccaaatactgggatcaaaggtgtgcgccaccaccgcctggctagattaattatttttttttccattttttattaggtatttagctcatttacatttccaatgctataccaaaagtcccccatacccacccacccccactcccctacccacccactccccctttttggccctggcgttcccctgtactggggcatataaagtttgcatgtccaatgggcctctctttccagtgatggccgactaggccatcttttgatacatatgcagctagagtcaagagctccggggtactggttagttcataatgttgttccacctatagggttgcagatccctttagctccttgggtactttctctacctcctccattgggagccctgtgatccatccattagctgactgtgagcatccacttctgtgtttgctaggccccggcatagtctcacaagagtcagctacatctgggtcctttcaataaaatcttgctagtgtatgcaatggtgtcagcgtttggatgctgattatggggtggatccctggatatggcagtctctacatggtccatcctttcatctcagctccaaactttgtctttgtaactccttccaagggtgttttgttcccaattctaaggaggggcatagtgtccacacttcagtcttcattcttcttgagtttcatgtgtttagcaaattgtatcttatatcttgggtatcctaggtttggggctaatatccacttatcagtgagtacatattgtgtgagttcctttgcgaatgtgttacctcactcaggatgatgccctccaggtccatccatttgcctaggaatttcataaattcattctttttaatagctgagtagtactccattgtgtagatgtaccacattttctgtatccattcctctgttgaggggcatctgggttctttccagcttctggctattataaataaggctgctatgaacatagtggagcatgtgtccttcttaccagttggggcatcttctggatatatgcccgggagaggtattgctggatcctccggtagtactatgtccaattttctgaggaaccaccagactgatttccagagtggttgtacaagcctgcaatcccaccaacaatggaggagtgttcctctttctccacatccacgccagcatctgctgtcacctgaatttttgatcttagccattctgactggtgtgaggtggaatctcagggttgttttgatttgcatttccctgatgattaaggatgttgaacattttttcaggtgcttctctgccattcggtattcttcaggtgagaattctttgttcagttctgagccccattttttaatggggttatttgattttctgaagtccaccttcttgagttctttatatatgttggatattagtcccctatctgatttaggataggtaaagatcctttcccaatctgttggtggtctttttgtcttattgatggtgtcttttgccttgcagaaactttggagtttcattaggtcccatttgtcaattctcgatcttacagcacaagccattgctgttctgttcaggaatttttcccctgtgcccatatcttcaaggcttttccccactttctcctctataagtttcagtgtctctggttttatgtgaagttccttgatccacttagatttgaccttagtgcaaggagataagtatggatcgattcgcattcttctacatgttaacaaccagttgtgccagcaccattttttgaaaatgctgtctttcttccactggatggttttagctcccttgtcgaagatcaagtgaccataggtgtgtgggttcatttctgggtcttcaattctattccattggtctacttgtctgtctctataccagtaccatgcagtttttatcacaattgctctgtagtaaagctttaggtctggcatggtgattccaccagaagttcttttatccttgagaagacttttgctatcctaggttttttgttattccagacgaatttgcaaattgctccttccaattcgttgaagaattgagttggaattttgatggggattgcattgaatctgtagattgcttttggcaagatagccatttttacaatgttgatcctgccaatccatgagcatgggagatctttccatcttctgagatcttctttaatttctttcttcagagatttgaagtttttatcatacagatctttcacttccttagttagagtcacaccaagatattttatattatttgtgactattgagaagggtgttgtttccctaatttctttctcagcctgtttattctttgtatagagaaaggccattgacttgtttgagtttattttatatccagctacttcaccgaagctgtttatcaggtttaggagttctctggtagaatttttagggtcacttatatatactatcatatcatctgcaaaaagtgatattttgacttcctcttttccaatttgtatccccttgatctccttttgttgtcgaattgctctggctaatacttcaagtactatgttgaaaaggtagggagaaagtgggcagccttgtctagtccctgattttagtgggattgcttccagcttcttaccatttactttgatgttggctactggtttgctgtagattgcttttatcatgtttaggtatgggccttgaattcctgatctttccaacacttttatcatgaatgggtgttggatcttgtcaaatgctttttctgcatctaacgagatgatcatgtggtttttgtctttgagtttgtttatataatggattacattgatggattttcgtatattaaaccatccctgcatccctggaataaaacctacttggtcaggatggatgattgctttaatgtgttcttggattcagttagcgagaattttattgaggatttttgcatcgatattcataagagaaattggtctgaagttctctatctttgttgggtctttctgtggtttaggtatcagagtaatagtggcttcataaaatgagttgggtagagtaccttctacttctattttgtgaaatagtttgtgcagaactggaattagatcttctttgaaggtctgatagaactctgcactaaacccgtctggtcctgggctttttttggctgggagactattaataactgcttctatttctttaggtgatatgggactgtttagatggtcaacttgatcctgattcaactttggtacctggtatctgtccagaaatttgtccatttcgtccaggttttccagttttgttgagtatagccttttgtagaaggatctgatggtgttttggatttcttcaggatctgttgttatgtctcccttttcatttctgattttgttaagtaggattttgtccctgtgccctttagtgagtctagctaagggtttatctatcttgttgattttctcaaagaaccaactcctcgtttggttaattctttgaatagttcttcttgtttccacttggttgatttcacccctgagtttgattatttcctgccatctactcctcttgggtgaatttgcttccttttttctagagcttttagatgtgttgtcaagctgctagtatgtgctctttcccgtttcttcttggaggcactcagagctatgagtttccctcttagaaatgctttcattgtgtcccataggtttgggtacgttgtggcttcattttcattaaactctaaaaagtctttaatttctttctttattccttccttgaccaaggtatcattgagaagagtgttattcagtttccacgtgaatgttggctttccattatttatgttgttattgaagatcagtcttaggccatcgtggtctgataggatacatgggacaatttcaatatttttgtatctgttgaggcctgttttgtgaccaattatatggtcaattttggagaaggtcccgtgaggtgctgagaagaaggtatatccttttgttttaggataaaatgttctgtagatatctgtcaggtccatttgtttcataacttctgttagtttcactgtgtccctgtttagtttctgtttccacgatttgtccattgaagaaagtggtgtgttgaagtctcccactattattgtgtgaggtgcaatgtgtgctttgagctttactaaagtgtctttaatgaatgtggctgcccttgcatttggtgcgtagatattcagaattgagagttcctcttggaggattttacctttgatgagtatgaagtgtccctccttgtcttttttgataactttgggttggaagtcgattttatccgatattaaaatggctactccagcttgtttcttcagtccatttgcttggaaaattgttttccagcctttcactctgaggtagtgtctgtctttttccctgagatgggtttcctgtaagcagcagaatgttgggtcctgtttgtgtaaccagtctgttagtctatgtctttttattggggaattgagtccactgatattaagagatattaaggaaaagaaattgttgcttccttttatttttgttgttagagttggcattctgttcttgtggctgtcttctttttggtttgttgagtgattactttcttgcttgttctagggcgtgatttccgtccttgtattgcttcttttctgttattatcctttgaagggctggattcgtggaaagatattgtgtgaatttggttttgtcgtggaatactttggtttctccatctatggtaattgagagtttggccaggtatagtagcctgggctggcatttgtgttctcttagtgtctgtataacatctgtccaggctcttctggctttcatagtctctggtgactctgcttttaatatcctatctttatttagtgcatttgttgttctgattattatgtgtcgggaggaatttcttttctggtccagtctatttggagttctgtaggcttcttgtatgatcatgggcatctctttctttatgtttgggaagttttcttctattattttattgaagatattagctggccctttaagttgaaaatcttcattctcatcaattcctattatccgtaggtttggtcttctcattgtgtcctggattacctggatgttttgagttaggatctttttgcattttgtattttctttgactgttgtgtctatgttctctatggaatcttctgcacctgagattctctcttccatttcttgtattctgttgctgatgctcgcatctatggttccagatctctttcctagggtttctatctccagcgttgcctcgctttgggttttctttattgtgtctacttccctttttagttctagtatggttttgttcatttccattacctgtttggatgtgttttcctgtttttctttaatgatttctacctgtttggctgtgttttcctgctttttttttttttttttggttttttgagacagggtttctctgtatagccctggctgtcctggagctcactttgtagaccaggctggcctcgaactcagaaatccacctgcctctgcctcccgagtgctgggattaaaggcgtgcgccaccacgccgggcttcctgcttttctttaagggcctgtaactctttagcagtgctctcctgtaattctttaagtgacttatgaaagtccttcttgatgtcctctatcatcatcatgagaaatgtttttaaatctgtgtctagattttcggttgtgttggggtgcccaggactagttggggtgggagtgctgcgttctgatgatggtgagtggtcttgatttctgttagtaggattcttacatttgcctttcgccatctggtaatctctgaagctagctgttttagttgtcactgttaagagcttgttcttcaggtgactctgttagcctctataagcagacctggagggtagcactctccttagtttcagtgggcagagtattctctgcaggcaagctctcttcttgcagggaaggtacccagatatctggtgttcaaaccagactcctggcagaagttgtgttccactcactagaggtcttaggatcccgtgtggaatcctgtgtggacccttgtgggtgtcaggcgactccgctggcaaggtagcccggggctcaagtggagcggaaggggcttgtgccccagatcaggcccgggtagcctgcttccctatgtaccgcagtctcaggttccgtgcgattggattggggcaggcgctgtgttccactcaccagaggtcttaggatcccgtggggagtcctgtgtgggcccttgcgggtgttgggcaagactctgctggcaaggtagcccggggctcgagtggagcagaaggggcttgtctagattaattattttatcaacacattgtttttgtcaaacccttctccagaagtgctgcgttgattgctgattgtctatccctgctacctggaacactggaataacagagtggttttgcttctgtttgctcgtttggaaaattgttggcgattttcatgtgtgtcaattatacaggcagctttccctgtttttgaacttgtcctctgacacttttatgcatgtatatcctgacatgactatgcatgtatatatttctttcgctcttcccccatctcctctttgtctaagtactttccccatattcctattgttaggcttggactcactaattttatcccgtgccatctttgtcctcatgagtttggagctatccatgggtgagctcgccattgggcacacaatggaagacaaaagtcttgttaggtaatttcaacgggttgtgagtatgattgctgctatagttatcacagttaactttttcttatataagtatgcgacaagagtgcctatgctatgctatgctatgtggtagtttagaaaaccagctcactctccttaagaagatatcgactcagtcagaagacgtagtaccatgatcattattctcctttatcttaccatagcactgttatgtaaaaatattttctttatagttgtagttttgtgaataaatgtaccaaaatatgttactccgaaaggcacctcattccaggcttggcctgacccctgttcttctggtctcctccttccaagtgctgcaatacagggtcaccgacaacacccagcttgaaagagtattcttagcacaaatgttttctacttgttatgcctgtcttgggaagatgacaccttgaagatgaaattaagaatgattaaatcagagtgtaagaaccgttcttattgtgagcttaattcttgactacagtcttaaaacacttattcctttcagttaaagtagtattgaaggctttgtgattattctgcaactcttaatataaaattataatgttgagagagagagtggaagagagagagtggaagagaagggaagggaaggggaaaaagaagaggagaagagagagaagagaggagtaagaagaagaggagagaggagaagagaggagagaggagaagagaagagaggggaggggaggggaggggaggggaggggaggggaggagaggagaggagaggagaggagaggagaggagaggagagaagagaagagaagagaagagaagagaagagaagagaagatatctggtgtgacactaagtcaaatatgtattctctgcccctctatatttgaggacagatggtatagctgatctcagtcacctcgatggaaccaaataagcagggttgttttgatatggaggcagggcagtggcctatttcatctatgctgtggtctgagttgagtctagtaaaatccagatagtggtgaaactatcaattgtatttggcaactgggaaagacttaagtgttctgtagaatagatctctgtgacttctgtgtggtagcagactttgtgtaaagaagcagatcaataggtgtacgaagtaatgttcatgatgtctcttccccccataactgttcatcttctacccagttaatgaaactatttgataagttgtgcagaccggaaagtaaatggccattcctcattcgtatctcttcagccaccagatgttccttcatgttctgtatagcaagtctgttcaactgaaatcttatgggatgtctctctcctctaaaggtgttaggttacctctccatcattacctgtggcccatcctggtcctgatgctgcatgcctgtgttcttgcagcatccccttcgctcatctgcatttaccccttcttgcccgctaccgtccatgtaacacacagggaccttatttaaccatttccccatctgaaactccagaagtttccaactgaaatcagattaaaacccagacaccatactgaggcctgtggcaatcaggtgtctgccccatggtctttatttccagctctttttgctcctgaatagaaagtttgtttgcattgttgcccttgaacactcagttcttcgctagaattgtaatgtcccagatgcacttaggactgtgagcagatatacttaggacttgagcagacactcctatgagtgtctatgagaccagagccaagcataagaccacccttgtccattggctgaataaacgcatactctatttgttctgacatgcagacttcccaaaacagtcaaagagacagacacttaacgtgtaaataggttaagatacccaaagctttataactgatggctaagaacgataaaataaagatgaatcacaaggctagatgctgatatggagggagatccatttagtggaatctttttaacccaaaggaaggccctgtgtgtttgaaatgaagctcattatgcacaaagtacaaggctgagcccactcaccatcctttaggcatttgagtaggtgcttgcagggcttataatgtggtaggaaggagatgatttccgacaaaagcaattcattgcaaagtattgtaagacctatgtcttaatgttgaacatttaaataatacagaaattaaaagaatgtcattaagttgaataacttccagtcatgaaccaagcaaatcagaccaagtttagtcatgctctcttgctactcttgttccaagagacggagagaaattactaatcagctcatgaaccacgggcttcatatctcatcctgaccaagggtcttcctagtcacatccaaaatgggtttcttctgtctatcttctgctagataatattactggaaagaagagcttacttaggacaggaaaataatttttgcaaagactctgtcattcattatattctatttgaatatccaaagaaggcagccacgacgaactttttgaacagtgccaagattaaagttcttagtgtcttttaagatattctaacctagcatctcattagttctccgaggatgtcttgcagtgtgttttgattgtgctcaccccactcctcccttcttttcagatttttaacaaatgctcaactcatctgaaagtcacagctgcctttctctgggccctgcattttttcttctcttgttaatgtattaaaattgacagttgattagaaaggcaaaaaatatgactcatatttctcagatgtcattattgttctttgatcgagttattgactttaattgtagtttgaaagacacctgtgattcatattcaaacccacacagtctgggttcagagtctaagctcttacccacactgaactggtttatcatagaagtttccagcacaaatccttgccatgcttcttatatttactaattatatcatattatctctttattataattaatcagtaaatattcatattcaactaccttagcatgttaatatctttgataattgtgactttgttcactcttattcttggatttgattttcttcctattaatgcctagcctaattattgctctcaatgaaagctgcaagactctgtttttacgtctggaaatagcttttccctccttacataataagaattgtaagtctaaaagtttctctttctctctgcattctggtctttttttttttcctgttatttaagaaaaaaaaaatctgtgctcagttttacttttttatacagataatgaatttcctagaaactgtgttagtttgctttgttttgggatgatgttctctgtgtattctaggaagtgaactcactacgtaggccaggctggcctttaacttacagtagttttcttgcctcatcctccagaaaactagaactacaggtgtggataccacaccgagctgaaaggtattatttcttaatgattgtttatttcatcgtgacttggatctaaattcttgaagtattccagaaaggcctttatgatttgaccgtttgtgattcttgttttaatggtaaattttgagtcattatctgcccaggtatcacatctggatgtacatcttcagtttccctactttcttctagggtttcctctcattggacatctctgttcctgtccactgcttctaccaacttgtctttgtgtctctgtttgctacattttcctgaacctcttggacatttcttcaactttccttgtcatttgctaattctcccactagctttgcctagggaactatctccctctgcaaatggagtttagaacatgctatccctataacctctcctaagtgtgacctcacggcatttaagaacagcagatcaggggtttctctctgatgtttggttgctacctccagcaggtagaacgtgggggaggcagtttatctccgtctttctttgggaaggactctggatcttgggaaggcttcatcctttggagccctctttcgggagtcttttatccaatggttaagttacagacggatgattgacttgggctctggttttgggttacttgcctttagttaagaagaaaaggtaaataatgtagtagtcaagggtatttaccgtatctgatggcaagatatttgaaaggacatttaaaaatctgaagcgttctatagtcagaactcagctcactacagaacggaagctgatatttagtgtgtgtgtgtgtgtgtgtgtgtgtgtgtagggctttcttgttctttcacaggagcccatttctccctcaggaacctcccaatagaaaccccacttgcaagtgtgctaataatctaacctctaccagttgtgactatgtccctcttgtgaggattcactggtctcctcggggaactaagacccctgaaaagctccctctgaccttggttttccatttgcctctgctcttccttctcaaccagcacagatgttccacccactgggctcccttcagtcccttcagtcttggtgtggcctcttgtcatgtagttctgactgtttgggttacagcaatgaatgcagctgtcacgtcatgtccactgctgtagggcaattctgttagtcaaattagcatctgctacaaacgatgccacccagaagattcttgtgcatgtgagcctggatgcacacacatctatgctgtattggatgcactatgtccatctggcaacagacgtacgacatcagagaatatgcgcatgctcagctttactggaaaaaccagatttgctggtcagtgtacctagagtgctttcactttcactcacagtatacttgaattcctcttattgtacattctgatagtacatgttggtacttaaaaatagttgtcagtattgtctgtctgaaatgataccattcaatccacgcacttcactacctgagctagctcccactgctgcttcacgtcctctttataactgttggtatttgaaagaggatttggggttgtacattagactcatatacacacacaacagcaatcttagtggcatcatcatttacaccaatgagaaatgcagcaggttgtaatatacctaatggagttgatgcctctcctatagcagtgaccatggaaatcaaatggcagttgcatgcattgccatgacagcacaaacgcatcacaagaggccaccttaagacctccatcttgactccagtaattggtggtgtttgaaggaggatctggggcagggcacattccctggagttagttcttcacgagagtactggctattcttcttctagcaaagccctacctcctaaccctacacagatcgtgccaccagctcaggacccaggtacctgagactgtgagaggggtggcactcaggacccaagtactcaaaagcctgagactatgagaggggtggcttctctctcattcaacccacatttgtcaagttcaagaaaggggcttatcattaagtgtttaaaaatatataaattcgagggagaattactctacataaaatatagaaccattctgtccttagatatgcatttatacctttccattcttttatattgttcttaatgcatttaaataaaagcttatttttcatggtatttttatatttactgcacatactttaaagcaagaggggctgggcatatggctcagtggaggaacacaatctaggatgcacaactgtggggttttctgttttcttctgtgcggctggagctagaatgctgtgtaagctcatcggttaaagtatgttggaattgagggaagatttctgagatgcagagcagggactggtatgtgttctttctgtacttgaaggagtatgtgctgtggcgggtgtggagtctgctcctgtggagctctgattagcctcactggtcccattctgcctctccatctgtctttctcctgattctgcctcttgtcttcttccttggcctataaaactgcagctttgtaccctctgactcatatcctctccttagccctcgtcacctgtaaccatactgatctactctctgtctctttgcatttcaaatgtacatgtattttagaagccacataaaatgagatcatatagtcatataatagttttcattctgtttctggtttatttcattggttggatgtcctaaaaggttcatctgtgtgataaatgtgttataatttcagttaacatgtgctgggattattgttttaaagacacgaggttgggagtggctagagaggtggggggggggctagatctaggaggaatcaagggaaggtgaatatccaaaatatattgcatgacattctcaaataattaaagatacattttaaaacatcgaagcacttaataaggaaacagatcataaaatctcacttttcaaggataattgatgtcttacaattcctttgttcaaccatccattgacagatacttcgtttgcctctgtgtcttagctgttatgaagagtgtaagtgcttttgtacaatggtagtttatttgcttttggagtttttcaagtaatgcgccgttatatcatgtagggctttgaatctctgccattcccattttcattgtactttggtttcagttttatcataaactgactgtctaatgtttaaagaaagggagccctgaaagcaggtgtgttctttatcatcatattcatcctgtccgcttcattttttcctcctcttataggtttgaatctgcatctgctgacaaattctccaagtttctgcttgtcggaattaagaaattcttagcaaacttatctgatcacactgtaaattttagacaccaccacagatgctttcagattggcctctggttaacttctgggttagcttgcaagctgtggagttttggcatgacatctttgtgcaaggttccaggtttattgagaagtgcgtcctcgctttcctcaccactcttcttctagccgaatgattgatgtgtaaagtgtaaggggactactgtacatcatcagtgttcggcatgtcaatcagccaggtctcttcactcacacctgcctgcctcctcctcacagtgtcatggaatgccagtttacatcagcattgatggaagcaacctgttaaactccccagtttcaggaactgaagaaatctggtatggtgctttccgtttcttcattttgctttagcccttttaaagaagaacctggtggggatgcacacgagccctgtgtacgctgcctcagtttaaccttgatgttaaggtgtctttcttggatgtagcagggaagtggaccctgttttgttttttgttttttgttttttgttttgttttgttttgttttccattctattagtctctgtctttttattgtggtactgaaaccactaatgttgggagacatcgatgatcagtgttttgttttgtggtatgtgtatctgtgtgcatttcaattctttttaattgctgtctgaaattttttattctttatgttttcttgggtgtggttagcctttttaggttggagatttccttctacaccttccatagagtataaataaatattggttaatttttttttatcctggaatgccttatttttcatctattgtgatagaatgttttgctgggtatagtggtctgtgctggcttgtagaatctccactgaagagccaagtgttagtctaatcaatatgctttaatatattacttggtctttttcccttgcagcttttaatatttctttatttgttctgtgcttttattgttttgattactatgtgcaaagggacagtctttttttggtgtagtctgtttgggtgttttgtatgcttcttgtactctgagaggcatcccttccttaagttagggaattttcatctataatttgttaaaaatattttctgtgcctttgacccgggtttctttttctttctctatttttattattcttagatttagtcttttcatagtagtctagatttcctggattttttttttttttttttttttttttgcttcagctatgttgcagtactcagggcctgctctggtaggattgctgggctctaatggaggcatattgtcccagctcttattgtgtttctacgttggcacttaggcatctgtgtttggaaaaattgtaattcttggtgctggtgctgatatcttcttttctttgttgggtagctggatgctttgttccttggctcctgttgccttctctggtttatggtagagtatggtagctatatattgcctagtggagaattcttccgggatcccgataggcgtggccactggcggattcccggtagaatatgtttctggatattgggagacacataggcatggggacaggccaggaggactgtagggatccacaggagggagaagagaagggggtgttccagcaggatctgcttagtcccctgggagtgggaacacagagtgaggggaggccgaagctcatggtctctgacagaactgagctgagactgggggattgggcttgaggaatggagggagaagtgaaggtctccagttagcctacttgcttccctggccagtgtggcttgtgggttcctagggagtgcctgcaggacttggaggctgggatggtgcaatggtcagtgatcgggaagaagggaccttagaggggaagattggtgcgattcacagaaggggaggaggaagaggaggccgtagcaggtgttttcctgcagatgtggcgactggaggactggatttggaggatcgtagagagaggtgaagattcaaagttagcctacctgcttccctggctggggtgcttaatagaacatctttattttttcagaagaaattatggaaatatataagttgataagtagagatgcaataattttagttaaagccatcttacttaaacttgaattattttatttatctcttgtttcaggatgtcatgtctgtgtgtttatagcagataataaggttagtggtaatggcaccaggctctagttcactgtttaaaacctcggactagaacatacattagatcatgtgactcaatgctagctccgtccccaggcatggaacatctactgctgatggaaaaaagctgcccgagctttccgtctctattgtaaccagcattttgtgatggttgaatattgtactggctggttctgtgggtcaacttgacacaagtcagagctatcacagagaaaggagcttcccttgaggaaatgtctccatgagatccagctgtaaggcattttctcaattagtgatcaagggtgggagggccctagtgggtggtgccatctctggactggcagtcttgggttctataagaaagcaagctgagcaagccagtaagtaacatccttccatggcctctgcatcagctcctgcttcctgacctgcttgagttctggtcttgacctcatttggtgatgaacagcagtgtggaagtgtaagctgaatagaccctttcctccccaacttgcttcttggtcatgatgtttgtgcaggaatagaagccctgactaagaaaactaccaaatgaacattacagaagaaagcttgtaaatagtatcatcaattgaactttaagaacaatacagcagaagtcctctggttttgtcctcttgctgatgatcagacacaagacctagactactactctcttctgctctctggttcttaaagaagagaacagtatggaggatgactgcctaacttggtctttctctgctctcataagtgttggcttcttaaggacttataaatgaaatagtgaacaggcttataagctagtctccataactaacaaaacaaaatgtaaaagattcagctttgcagttaaccaaaagccaaagcacacattttctctgactcagtgcacagggtgagtaagagttttggggatggctgacttatgactacactctgaaattaatagtcaacccaggagtctatgccacagactactccacccagaatatcctctccagtccttcgatgctcttatttccaccaagacaatcccagagagagaccagccgatcctagtaagctggtctcttcaagatggtgaatttctagttcagtaagagagtctgtttcaagacagtaagacagagagcgatagagaaaggcgtttaaagtcaccctgtggcctcatgtgcacgtgcacccacacccacatgggcatggactacaaacactcatgtgtatgcacgtgcacacacatttcaaagtaaggtcgatggctcttgacaaatgatgtgagagactgagctcacacacaagcctctcctcttcttccccctctctcccctctccatccccctctctgcctctcttgtctctctcacacgtacactataaaacaatattacaatttacattcagactgaactgaataaaaacttactcttcccattaatgatcgtatgacatcgaaaagcaatttttcttatatacgacaaaaggttgttctgagggtttctatacaaagtatcttctgcaaaggtggatcagttggcccatgtctgtcctctcagcactcaggaggctgaggcagaaggtatattaggagttcaaagacaatgtagtaagactttgtgtcaaaaaaaaaagtaaaataaagcaggtgattttagtttccttaacattatttttgccctgtctcttattgtatctcccctagtcatgaacaagtactttcagtcttaagactagatttagaggacttaaaaatctcgaactcttgggttatgtgcttgtttgtctggttttgctgattatgtttcccatgcatcctgtaaacctgtaaaatgtgtgtcctatgggagacacactgcatctaattgaaactcctttcacagccttgccctcctacactggccctgctgaccattagttggttactggctctttgctcatagagaaaaccagatgctatcagttatgaatatcgttaactttcttgattgcgggctccctaacacatgggggtggggagagggagagggagggggagggggagagggagagggagagagagaaagagagagaatatctttggttgacatctgggcatgttgtataggattctagacactacagtaagtaatattaatgtatagaaataggcgagtctcttctgttaggctcttagaatagtcagtccagtcagaaagagctaggtttaggttttgaagtttggctcccttgggtttttctagcattgtcttgtgttgaagattagtgctggtttgcctgaatggttattccatccatctgttcatatatcagtgccgaccgatactctctactcaaggccagagtctttccttcatgcttttatcgcagagagaacaaagagtttctctccacttcattccaatggtcgattcatttgatgcttgctagcctggcaaggtatagaaagacgagtccagtgtcctggtttcattccagggttaggcaggtccttttgtcctaagatgcatggcattgggatatccctaacattagagatacggggtaatttgctgccttcttggggtggcttaattatagcttctgttctacaagaaggagtctgggtatttctgaagcatgacctcttgcttcttctaggcctgggttataaagggaagctttctctagtctccctcccagcctggaatctgacacttaaacaatacgtattcacgtacacaaattttcttgagtccttgtctctcagggtggaggttctcagaactttcatttggcctaccttgtttgttgacaacaactttaaccagaacattcttgctcatttctttatgttctgttagtgttcagacccaggtacgtcagtgctgacaccccatgtcttcgtggagacatttgcctgtccttcaatgtcaagttagtttccttttcttgtatcttcagttgtgacaagtgcaaaagggctgtgtgtgatggtttacatagcatttaggtgtttttcttagtttggtagtgatgctgattttggtgttttcttccctttctcttttttaaggcaggtctcatgtcaaaatctgacatgtataaattcattgtatagttgaaaatggccttgagcttttgatccacgtgtctctatggggattacaggtgtataccaccatgtctggtttaagacacacacacacacacacacacacacacacacacagagggattaagctcagggttttgtgcatgctaagccagctctctacccactgacttacctctccagacttatttcatacatctttatatggttactatttatggggggaggaaggagtcagtctttgaccattaggtaattgttggctgtaaaccatctccacgctttttgtttgataagtaaggatgttagacagacatttcatcactgggaaaaaaaaataaccgacaccactcagcaggaggaattatttattttggctgtgtccatggtctgacttcgttagttcttgataaaactcgatgaagccgaataccatgcagcaggaacatgtgacagaggctactcacctcatggtggatggcaaacagtaagtgatgagacccaattctgggtcttcaaagatccatgtccagtgatctactttctctgcctaagttctcccacctcctaagctgggtaccaagggtctaaaacctgggcttgtcaagtagattccattttcagatgatagtgttctgctcttagcccggaaaggtttatggccacctcacaatacaaattgtacatagactgtccccaagagtaccccaaatattgacagttccaatgttgttcagaagtccaaggcccaagccttttctgagactcaatgcagatgtttagctgggagcccctgtgaaatgaaaaggtagttataatcttctgagataaaatggccatgaaataaatataccatctgggaaagagaacaacagaagagtagcaaagaggaatctgatgaagacaagactgaacgggagaggcgatccctgaacacttggcctccatgactttgcacctttgtgagctcccatagggtaacccccactgtctggcctggccgtttgtagcccacatgggctcttttgggcaccggccccactcgttgcctgtggctatcctcagaagtgatttctcatttttggtgttttctctatccaagcatctccatttcagctcccgccatacccccagctttacacattgcccgcagagccctgcaggggctccaactctgcatactacctagcctttcaggatttcctttaaaatcttggtgaaatccttcatgacctttagcgcttataatttgcatgcccgaaagaccagcatcatacagacaacataaaagtctgccatcagctagagcacctgacagaccatggaccaaggccactgaacactgggcagttgagcacagtgagagaaatgctagttagtctgtgtagaaggggcaccctagagcctctcttttctcaggagaatgtcttctaagtttatctactctttaatatccttgagcgtgtcctggaagatatctggacaattcaagaaagaccctcacagcagccttcctgtcaattcagtacatagtgcttggcagattttaatagtgctaaccttttcagaaaccacaccttccttagctccagccatacagtcttctgagatcatctgaaggtttgtcaggtcttcctatcttgcatgttttttctactattcacaccataaatctgactaatagcagccctccattattatgcagtccgaatactggagtgccttaaagaatttcctctactagattaactaacccaccacctttcaactctggcagactcaggcacagtgaaaatgggaacaacttgttactggttttagatcttacaatgatgatatttactcacgttcccatgagtctttgctcccttctgaaacctcaccagcatagtccgctgtccactctctggccttcaaaacccattaagctttgcttacaatggttgagtcgttctctcacccacttctccacacatggctaaaatttccccaaagtccagacatcagtgatgtccagacaacagctcagtgatcccactcctctgagaccagttttctgtgttgggtctttcggcaccatggcttaggggcactgtttgttttgaatggaaatttcaggggtatcagtccacagtctttggctgaagtaatcctcagcttttgattttaggtgttaattaacggcagcatcagcacacggcagaggccatgtccttccctcagagttgacaagaagcaatgagagagactggggtggtggtgatgggaaaacaacaggcaggggagatgctgtgtgaaggcatgtgccaaggccctacttttattcagatccatcttctaaaatttctaccacctcctaaagctagggaccccagccagggaccaagtaattaaagcataagcctgtgaaagatactttatatttaaatttcaacagtacatttctttcattttcagttttctggactttttttcatgaaaatgtcttattttgatttttttctctgttgtaattagtatgatcatgtagattttcttctttagagtattaatttggaagataacattacatcagttttcaaatatcaaatcagctttgcagactttcaataactattactttgttgtatatgtttctacatatgtatacatatatatactcatacatacctatgtctatatacatatatagttgaatatgacatgctaatattttgtcaaagacttttaagtgactttatgggagatgcccatatataattgtattgtaattgattagtttttataaccttgagctaatgggccagttgtattacctaatacagctgtcatcaggtagcctaaacctagtatagaatctgtgctttgtaccttactcaatagagatagtcttccacatcatatagataagagctatttcccaagtgtgcatctaattggaagaagtatacaaagccttagaatcttcaaaattataatatatatataacatattgcctttctatttagagcaggtaccccagcatatcctgtgtgaccctgaaatcttcatcatgatgtcaggactttctgtttatgggcattttatcttacctcatagagtacatttctcttatgaagacatcccattttgtttaattagatttggtgaatataatccatcaacaaagtgggccagtgtggtgtcatgtggaatgtccagtcagttcagctctctttgggtgtcttgtgacatagatcataactgacgcagtctgatgagcaaggccgtgcctgccttcactgtagctgtgagccattacagtcgcagtatgcttcacagtggactgtagatcttcttgctgaaatttgttgaaaaacattgtgttgatcactcagggtcataatagctacaacagaatatgtgataccaagtactcattgcagtgttcctaagttataggaaagcaatggttagaaaagatagaaattttgcaattatctcattaagtcaaatttcttaaccaaaaaatcaaatgaaaacaaagctgccctagagtcaattttgcgaaacctctcttagctaagcaaggtaaataatttattggtagttattttgttgcagtagaggaaagtatttgtactaagaaaatcaacaacttcaaaattattagcttgccaattagagacattgagaatagtatctatagtgacttttaaaataaggctaactagaaaagaagggaaaattactttcttatgtcatgagttgttgtttaagaaacagaataaaacattagtataacgtgtagtgggatccactaagatgtgggttgatgaatagtacagtgtgtggagaagagaaagccttttctagacaaacctctgagagtcaatggtaaagacttcctggaatgacttcccagcagatacttggtggaaaatatttgggtctgtcatgtgttttaagccaggactgttaaccatgaactccatcattctcagagacttaaacattatccaccctgttagttttgggggcagatagacagacagagactgagggacagagactgaaccaaagtatcccaatttttttttacatacaacagattggtggctttgcagttataaagttgtgtttgtgaaattttgagcatagtattaaaatgcaaacttttccaatgagaagagctcattcaaccaccatgattgagagaatggctttggaaatgtgtttaatgaagagcacactcttcaattagttcaatattaaaccacacttacacatgatatactgagttgtttcagtacaacagtatttgctttgtacatgcttaacaaaacaagaactagactatccattgccatgcaagctcgaaccagttctgggaaagtttttagaccttgattcaagtacaaagaaatattccatattttaaaagccattaactgtataattgaagagcttctacctaactttcatttggaactgattaatgtgcaatgtaatgaagtgctaaactgcaattatcataaaaataatttgctataattctataaatgccttccaattgttgaatatcaattaataccatatgcccccgactaacatcagtatttggtagttcctatttaaaagaaaatctgaaagagtaaatatgtaaatctcactacagatctgccttaactggtgtaccttaaaattaaatttaataattgacaacactaacattgtacctcctatttaaacaagatgtcatctctacaatttttctgttattaagaggcttctgtttgtaaaagaaacatattaaattactttaatgtgctttaaatttcaccaacaaagagctgcagaagcttgagtctgttttgtcaggtgctattgtaatatccttccctgaggttctcctcattgatactctaagcagagaaaccttttacaattcctgctgtgtattggtttttctgtcccacctcaacataggccttccattggttcttttgggttactacctactaaaattaatacaatatctagggctagaaatgtaactcggtggtatagtgcttgcttagcatgcacgaagccctagatttgttctccagtactgcctaacccagttgtggtataatcccagcactggggaggatcagaggctcaaagtcatccttcaatacaaaaggagttctaggccagtcttggatccatgagactattaaattgtacaaaagcaggtataccttaatacaatgtaaataagaaggtaatcttcagatcagtaggcatatcatgtatcagaaggcatgttaacatttattagtaaaggcacccatctggtgcaaagctctttgggggctactactttggttatgttactgtaatttactatcttctgctgtagctactccatttgtgtgagaatctgacaagcaatgtcatgtgtctaccatcttgtattcattattgttccaaagaagcagaaccaataagctgcttttatagatggaaagagacttaaggaaccgtctcatgccattgtggaggcttgtccattgagatgtctgatggggatgcctagcaggctagagacaaagcaaactgttgaagtttgaggccagaaataatctactgtagaatcagaaagagtacacaagagtaaatgtggctgatcaaaccaaaggcaatctgattgattcttgcttgggggaagttgaggtaatactcctgttcgttatctattgtatgaagcctgtcgacattatagaggtgccaaggaccagcctcagcttggtcaggggtcttgaggaagcagtgtttggaagcattgaacaaatgactcagagtcagtgatggatgcaagttggcagctctatgctctgctcgagaaagctctctctccagataactttctgcttgagatcttgcagaccaaatcccagccttttattttacataaggtacttccttagaaattgcatatcaattcaatcatttaccccaggttctcttttgattatcccagaagtcagcattttatgtcagagccccttgactttatagacagagccacaagctgccaagttctactgcttgttggagctggaacatggccccattgttctcttatgttatctacagctttctgttttccaactcctttgctgcctaagcttggctgtcttggaacttggtctgtagactgaccttgaatttagagagctgtgtcttgtgaatgctgggttaaaggcatgtacaatttaaaccctaagcccttcttcacctagtgcctgctctgtcacaggctgactttgaactcagaaatctgcttacctttgtttcctgggattaatggtgtctaccactttgtccagtcctaagattttcagggttagggttagattttcagggccactattcctcaagatctggatcaaaacgctgtatattccagcctcaagatctggatcacaagtgtgccctccattactggattgtagttcatttcagattaaaaggccaaactattacctgttcaatggcaaacataaacaataagctcagctgggtgggatattgccttgagatcaattgtcactccctaaatctctttatctccttccttaatatctttctgacaaagctggctcgttaatagcttcctctgttctttcagctccatgaagcccttcatataattcatattgcatccttatattttgcatagttgagaaatcttgtaaagaactgttctcactgatttacgtattcttgaactcatgttttcagagttctttccaacagccttaagggttgtcctgaaggtctcagtgttacagagatatagtcttgcttctcagaatcgtgctgtttctgattatcatggaatcattaaccttagcagggagaacatttcttgaaagaggaacataaagtaaaatatatttttattaacattattatacaaacaaaccttattcctacagcaactgtcagcactcgagaagtcccatgttgtgttggctctgctcctggacaggaaaccatgtcatactgttctttctgtggccatgccgaatctggcacagagggaaatatacattagtaagaggtgtggaatgtggagcagtcgagggtggatggtgggggtgtggaatggaatattgaatgtaaaaaataaattaaagaagaaaaaagaagtatctaaaactgaccaaaagcattatggttaggaaaagctgacaataaaattaaccctttgtattctgttctttaactttttaaaagataaggctgagctttgtgtagtccctgtagaaacacaatacttttaacttattttcctcacttgctaatggatagagtatagagtattttatggaactttgttgtgtatgataacttttgttccataggtcagggaaccaatgtgagaggtcttctaactgctaacatatctagttttatctctttatttagaagcagggaaactatgcttgggctcacttgccttctattatgtgaaacacttgcatggtgactaagacattttatatgaaatgttttcatttatttattttgctatgaaaatgatccagagataaatgtttttgaattttacgttaaaaaaaaaaaaaacctagttagccaggtagagtggcacgcacctttaacatcagtactcaggaagcagaggcaggtggatctctgtgagttcgaggccagcctggtctacaaagtgagttcagtatagccagggctatttcacagagaaaccctgtctcaaaaacataaaaacaaaactagaaaaaaaaatctacttaaaaaaaatcacatgtgtacaagagtcctcagagatcagaatctgggttgatctgaaactggagttacaggtggttgtgagctgccttgtgggtgctgggaaccaaacctggatcctctgctagagctacaagtgctcttaactgctaagtcatctcttcattgtctcctacattgttttaaattggtaattagttactccaatcccatcattcctccctccatgttctcgttagttcatataacaaccatcctattccataatatttctgtttgtctttatttgtctcctgaaactacagcacatgccaattagagttgttttttgttttttttttttaatatgtgtcccattctagtccccaattgaattccataacagttgtactgcagtagcttgcctccaaccagagaccactaatttggaatcctcactggcatctgacaagtggtgtattctaaactctccccccttcctgtctactgctgacacaactctcaagttgtgccccttcagatcagttcaaagtagggagtcttgtgcaatgtcttattgagggaatgctcacagaagatagggaagcagaaaggggttggggaagaagctaagccaagatgtcatttcaaagtctggaatcggattcatccagtgagatgctctgagagtaaatgataccccagaaattcttctctttatatggaatgacatgtcttttataactgcttgccactaaagtatcactgggtacccacaagttgcttgacatttaaatctcaggtcttagagggcagagagactctcactgagaaactaaattggcacttgccaatttcagtgaagtttatagcacttttatgtactattgagctaggttacagttatccagttccctaataattcgtcattttgattgtttctggttttttttttcctactacaaaccatgtggcgatgactctctttctccaaatgtgtattactgacacatgtacctttaaagcaatggtaagatagctgataaaatacaaatgagtcctagctttgttagcgttttattgtataatagccatattcaatggtgaaaaccaagataagctttgacttaaaaacagaaatgtgttagattgctgcatgcatctggaaatgagaaatagaaaataaattgaaatagtaacagcaaagggactatgcaaatacagatttgataacctaaaaatagggggtatttaattttttgaggaaataaatgtagacttttatatttaggtgcccatatatttagccttttaacaaataaaatgaaatatgagaattggctgaaaaaactaggttaagggttcctcttattgacttagtgcaatcagatgtattttccataattagaccattaatatgctcttaaaatatgtatctacctacaaatgagaaaaaggcagctcaaattcctagctcaagttccaagacacatggtaaggctaagggtttaagagaagaaacgctggtatgtagagctaacactggggatttaggtgaggaacttctgaggacaagaatttcaagattattagaaacagatggcaagatgttcatgcaggaaaatagaaaacacatagggaaaaaataattaactcatatgaaatggaaactaataacccaaagcatccaagatattcaatgtttgaagcattgctgcctggctgtgggattacatggataaattataatttcataaagctcataccaagggttgcccctatgggaaagaagaggcttttcttataaaatacgtgttatcttttccttttatatttagcgtgtgtatgttttatgtatgtgtaagggtgcacgcaacaggatacctgtagaagttcgagaacaagctctaggaatcaactctaattctagggaacaaagtcagatcatcatgcctggtggtaagcacgttgacccattaagaccccaaatttatatgtgtgtgtgtgtgtgtgtgtgtgtgtgtgtgtgtgtgtatgtgtatgtgtatatgtatgtatgtgtgtgtatatatatatatatggagagagagagagagagagagagagagagagagagagagtgtgtgtgtgtctcactttgtagcccctgctgccctgctgatctggaactctctacgtagaccaggcccgccttgagatccacctgcttttttctcctgagtttaggactgaaggtgtgtattactacgcccaattcaaggctaaagtttaaaagtagtttttagaatagcagaggatttaaaaataactgacaaaataaaaagaaacagcagctataaatgaaaaaaacaatgaaacacttattttctaggaaccgttcatcttgattcagcttactgattccaaatagttgaaatgaaaacattttttcttttcttttctttttttttaatggcagaatggtattactgtaaattgtgatacaagattaaaatagctccctgcacagtaaaatttgtcctgaagattcttttgacaattttatgtcaccatgtggtatgagaccactgatgaaaaatgtagcaattatgagggacagaggactgtaagtaaaacctcatcttgttcaacaataaagataattttacactaatactcaagaaggaaatagcagctctgagctttatctgtgttagtctgccattcgcaagtaaaacaacgtattatatggcggaagtgctatagtcttaagaaaacatgaggacgacaaacattaagtaggatcagattaaaaaaccaaattgtagagaaacttcattaatgatttatacgagagggtacacatcatgttaatttaatttacagacgatggtgaatcggatggtgttgacaaaaccagagagggcacataaaagagacctaaagtggttagaaatatgggcaggaaatgaaatgtgattcaacctggaaaaatgcagctagaaagtacatctggagagaataaacagaaacacagtcattctgttggcagcctagacggtgcttggcaagtcgtactgccaagggacttgattcgtgatgatagtgtcagcaaattatgtatggtctcgcaacacggtcctcggtgagatcagtcagtgagattttagtatgtacatctaagagctccgcatcacatcgctggaagctaagttcttttactagcactgccgagatcacaatgagaataccagtttgtggccccacacttgattcagttaagcaaattgcctaatgttcaaactagaaaataaatgtagggcaagcttcagactttaacttacaccgaaagattaaaggaaaacatgttgttcgttcattttttctattacgtccagttacagcacttcacaaatattcaaaagacgtaaacatcatggaagtcaagtcactttaaaggtaggttaagaggctttatggttaagtactgggatgaaattaagtaacggaaatttaagacggaatccgggaaatgttttctgacagtgaaatctattagtctctggaatggagtccccagagagctggggggaagttccattctctagtcattggactggatcaaggcttggacaaaaatcattattaacaaaacaaaatgaaaagacagaagaagaaccagtttcagcattttgtatcagcagagatgtgcacacacagtgacgccatcagatcccatctgattatcttctccttagacgtctctgatgggccgtggtctatcattaaggaaccacctattattatttttttaatgaatgctttttaaaagatcaaattcatattttccagctcatagacttcaatttcctggattattatttctttcttccaagtcataggaaagctagaaacggaaacagccttccttcccctggtgatgagatacggccttaaatattccagacctttgaatcagatctcacgaggtctctgagctctgaagccccacttatattattgcattagaaacatattgtgattgcagttttgcaaccacaactatggaataaatgaaaattcctttacttccttttccggcttggtccaaagagagaccctcaccagatggcgtgctcggagttgctacttacttttagcaaagcaattgaacgaggtttaaacaacataaagcatgcagttcatcaaacataagacattttgccaactgggcctttaaatcacctcggataactttgtttataattgcgtttagtaccctaacttttaaggataaaagaacaaagaagatgaatactttgatataaaaatccattttaatacaagtgtgatttgtttaaataaaaacaaatacattaaaatatatgttaggttttaggtgagatgtaaatgtatttatttaatatgtatatgtatcatatgtacatatgtaaatatatacaaatacatacattcaatcttaaacttcataagttatattttgcattatcggtcatctttgttatttcttttgaggcaaataagcaggtgttttgttctagtactgaacatcccagctggtgagaaatgtgagctaagaaaatataggcagtatagataaatatcaatttttaaataccatttttttagtttttgagattaaaattatatcatcttccccttacctttttttcttccaaaccctccaaggtactccatgccttgttctctttcaaatagataatctctttttatatattgttatgtaatacatgtgtaacagcaagtaaagatatatatgtgtatgtgtgtgtatctaatacatacacatcaattttgatagaaggatttagataatttcataaaatttgttgatataataaaaattatctagaaagtggtattaagagttagagtggccgggcatggtggtgcatgcctttaatcccagcacttgggaggcagaggcaggcagatttctgagtttggggtcagcctggtctacggagtgagctccaggacagccagggctacatagagaaaccctgtctcagaaaaacaaaaacaagagttagagtggacagattattaatcaaggttttcaagagatagtccatgtacatgcacatacacaaacacccccaaaaaactatggagtgtgaatttctgcaaagcaggcgtccctgactaagtctgagagctgaacattgctgtagagagccatgaagagcaggagaattttctctgtctgaggaacataggctttttgctatgctcaggcctttggtgggttgcgtatggccctcttacatgatccatgttattcagtcgactgatttaaatgctgatctcaaccaaaacacctttgatagaacagagtaatgtttgatcaaatatttggacatcctgtggttctgtgggtacacacacacacacacacacacacacacacacacaccctaactgtcagaaatctagaagagtttgaaccagataacatttttaagtgagaaaataacagtagaaatgatctatgaaactcttcgaatacaataaagaggaaaaactagggataacaaacttggcccaagaaaagtgagtggctgtggaaaaggctgtcaggaaccaggggttatcttgtgttaacttgtttctgaggttggcaagagtatgtgtctgttgtgagcatagagaggccaagttataaggatagcaggccagggtgagagttgtgcagttgcaatgaggggagttggggagattattttactttaactgaaaaataagattcctttttgtgtcacatagaaatcacacaagaataccatttttattccacttgactcttgaatattgtaagaatatgctatgcctttttgagacagatcttgctaggtaacctgtactgacattggacctgtagactctcctgccttcacctccagagtggatggtgtatgggcatttgccaacatgtgcaggtaaaactactttggatgctgggcacagtgacgtactcctgtagtcttagagacttacccggagaagactttgtaggaatttacaaccctctgaataacacagtagaaccctctacccttaaatatttgttttgtgcttatgtctttacctgcttgagtcatgtgtactgcaagcattcagatacccgccgacaccgaggaggggttggatcctctagaactagaattacggatggttgtaagccaccatgcaggtgttgagaaccaaacccaggccctatgggagaacagtaaatgtccttatctgttgtgccatctctccagcccccaaatgtatatttggaatgaatcaaaggatcaggtttatatcccatgcaataacagcatatccattttaagtgttagtgagtcattcaagaagaatgtgtggttgtttaactatctgggagttaacagctacccactttcaatgaaaatgaatatctatcaggcctatgtttaatggcaaagagatgcacctgtatcacacatgtatacagtctcctccaccctgaccaggatagatgccctgctctttccccctcagccggacgcaactcacatttcccatatgttctgcaatcatgccttctttagtgtggtggtaggctgctgttcaaatgccagttttagctgggggatagagcgacctagtcccagctcataaggaaccttcctgtaaacaagcactgagatggatgtaagggctttcctcggcagaggcaaggttggggtgttagttcagttagctcactgggagaactggtatctgcataatccttactcactgagcccttgagttgcccgttatcatcctccgcagctggaggtgtctgcttccaagtaagtagaagatgggaaagccacgtgtaatccaggtgcaccaatggctggagtcactctgtacagctggatcaaggatagtgatggaaaattgcccccagccaccttcaggttgacttgtatatcacccgtgttttctaggaagagagtagttggtgacaggagaaaaacgtgggaaaagtcaccatgcagggcataaaaaataaattttatcctgagcatggtgctagaagggagggggagacatctgtagaagtggggtgtgcagcacaagacaagtggctcccctttttttcttacccattgatcagagagaggagatcttttggcatcacagaatcaaggcgcctccttgcaaatttggggatgtttttattgttaacctcatccagcaggtgaacttcaaacctcacataaactagaggtgagatcttggcttcagaccgcttttactcttataaataatgagtgctaaatgtaattacagatgcagaattcaagttgacacaccattcaaatgttctcgtattcggtgacaaaaattctgatctatcgtcccgtgagagcctgctagcaggaagtgcttcaacttgcagtgtttgtttttatttactgttattttttcacttcctaatataattttcaagatgtaccccctcaaagcatgcgaaggttccttagtgagggaagctgatgtaacccactctgcaccagccacagagctctggatggtgtgtgtgccttgttgatcccaggaagccttctcttctgtgtatccctaaaattttcttaaaacttaattttattacacgtcaccattaaatagattgagatatgtttgtcaaaaaagggcagggaacatcactcagttgatagagtcctggactagcactctcgaagtcctgggtgtggcgccacacacctgcattctcagcttgggaacagatgatcagactggcaaggttatccctgactacacagggagttcatcctgggttttgtgaattgttatcttgggaaaaaggaaggaagagagagagagaaaaagagaaagagagagagagagagagagagagagagagagagagagagagagagagagagagagagagaaagggggagagagagagagagagaaggagggagagagaaggagggagagaggatggaggaggaaccgtatctggatagagtgatagatacactcaggttagtgtgttatgggatcatcttaagttcaagaccagcatgagctacatagtacaggaacctgtctcaaataataagataaagaaaagtggtgtgtgtgtgtgtaaatgcatatcttagcaattttattatctatatttaggatcctttataaccataagactataactacacttttaaaaaaatctattattgttgggctagagagatggctcagtggttaagagcatcgactgctctttcaaaggtcctgagttcaattcccagcaaccacatggtggctcatggtggtaaagggatctgataacccctatctagtgtgtctggaaacagctacagtgtactcatataaataaaataaatctttttaaaaaaatctgtattatggaaatataatttgcatatcatgctgtccattcatttgaaagatacacgtcttattattttcacatgaatttgtaagcctagtcagttcttctaaatctagaaagctctctccactcctcccagctctccaaatctaggcagctgctaatgtgcttgtctatattggtttatttaagatgcttcatattaactgaaccccatgggagctggagagctgctttagtagttaaatgtatttgctgcacttgcttaggacccaggtctggttcccagcatccacacggcagctcacagccacctagaacaccagtttcagaggttgcagtatctttttctggccccttttgatcccctccacacaagtggtacacatgcatacatgcaggtaaaatactcttagacataaacacgtataaataaacagaattacataatagtatgttctttttaaccagcttctttaacttagcataatgttttgagattcatctatatgccatgaatcagtactttttagattttataatatcctcttggatgcatacatctcattttacggcttcacttgactatattgaattttttagaaacacatcatgagcaagtctagatgctcaccccatataccaaggaaaatatttggttcattccaatgtgattactaagaacacggaaatatgccagtcatttgaagatgataaaacaattatcttaagaaaggggatgataacagaaaagtgtctgaagatactatgcacgtgatgtttaagtactatcaggaatagttatttcttagtaaatattgtacaccgccgaagacaaatttattctccttcaagaccaatgtctacagtgtagttgccaactctttaggtaccgcttgtgacttgtagctgtccttttgaacagcacagagagcagttccatcatggtggaaagttctgctcaccattattatgtgctggacgcctctacagaacaagaactggagttccaaggagtgatttagatgataagatgtagcaaactgagatctcctcctcctgtggtaaggaaggctcagaagatgtgtcttgtcttgtggggctagtctagattgaataaagagtttcattcagtccccatgagctatgtccccaaccccaaaagatgcttccggtgttagaccttagagtagtatctacacagagaaagcatccatttatagcagcagagaacaacccaaaagttcaggctatataagtaaaggcacacgttatataggactgagaatggtgagagcaatgtattgaaattaaagagctatctatcttacaaggttttctttgtatcaagtgtcttatgtttcattactttcgcattgcaagtcctgagctttgagagggggaaacatgtattgggaagtttgatagaatagttacagtggacagacactggaagaaacatttagagtgtgttactgcaggctgggataaagttgtcatcatggccagactcaaatatattaatagtggcaaccggaaggaaagcttaaaacttgtagaagcatcagaccatttaatattccaacatttgtcaacttcacacttgagaactatacaagtgaggtacaaaaaagaaatcacaaagcatctcataatgttttaagtaatttgggggtaatttaaaggtgtccttagcttccagagccacgggttgggcatgctccgaagagtcacgtgactagaatggaagcctccatgattgaatgggactcggataaccagtagaagagggatctgataaaggtcggagtatagaacctgtaagaatccagcagtaataggaccaggttagcgtgaaatgccacgtgaccaattttagagagagagaaataattaaaaccggaaagataactagttactttgtttcaaagagaaatgacgacattctccaaaaggacagcttagttgtcagagacggactgcttgaatgcctagcaggtatcacgcagtgtgtgtgcacccagtatgtttatccttcttaatattcatacatttctggaaagataagtgcatactgattatccatgtggtcgcaggggttcctgaaaggaaagccgccgtccactaagagcctgccccttgcttcgttattggcacagtcccaactctgaaacacttcttttttaaaaaattcacttttatttatatgagtacactgtagctatcttcagatacacacaccagaagagtgtatcagatcccattacagatggttgtgagctaccatgtggttgctgggaattgaactcaggacctctggaagagcagtcagtgctcttaaccgctgagccatctctccagccctctgaaaagcttcttgaaacctgttgattataaatttgtaaccagattgcttccatcctccgaactgggccttgccgtgtcctctttcccaggccccccaccactgccaggatgtgtacttgctatttgaaaaccactgtgtctcgttactcccgtcttctgatggctagatgcagtaagttcccccagtatctctacctatcatctgagttgtgtgtcattctccatccagtctccgaatagtattcaactaaattcagcctggactctgaattgtgaagcccagagtaggcttgggtgttcagatgtagtttgatcactatagaattttaatggtacatttttttttctcttagtagaaatttagaatctgtattcaattattcatccatttatctattatgtatttcccatttaccatacagtaggtaatttgtagttatttagaacagaacaagtaacagtaattgatcataggagttaattttaaagactttgcatgcatatttctaaacataaataatgtgagatattttacacacaaaacctttgtatcaagtacagatctggatacagaaatgctacatagtatctttctttgaggagaacggaaggatgctgggttttttaatgaagcgggcatgcaagcaaggacactaaagaattcaaaggggggggcaaatatttaagtatctaaaactcatcgaggcaagaatggcttacgaaaaaatgaaacagcagtggtatttaatttaataataatctccattatcttttagattagtgaaagtataaccaatctttcaaaaaattaaagttgttgcatgaaaagaagggaaatgggtgaagaatataggaagcagatggagtatttcctaggtaaacttgagcatcaggaaacgtgccttcgttggttatttgaagtagtaattaattaataatcaggataattccttccaagtagcatgaggagaagaggatggccctacttaaatattaaaacttaagagtattgatttagagttgtgtggaaagaatacttgactatgaaggttgataaccagaagaaaaaaaagaatatttattaaatgtgaggctggaaactagtgtgggaaaaatagatattcattaataaattatatgtattcatcggttagtcatcagtatacaaaaaatgttgcatacattcttgttcatttgttctgttttggtgttttgaaatagggtctctcaccatgttgcctaggaagatctggaactcactgtgtagcccagggtttcttcaaactcataattctcctgccttttaaccccgagttcttgaattacagtcttatactaacacaacaagtcagactgttgtattcctgtcttataatgtacaaccaaaaattcaaatggaacaaaaataatgtaatcttggaaaataaaaacacaaaactgctagatgaaactgaaagggttttgtttgcttgcttgcttctaaagcaagatacagtgtcattattatgcattttggggggctgggactttttatgtaaattctctatcctgatgccttattattattgttattattactccatgagtagagtgtttcttctaagaattcaaaactaaaatgctgtatggaaagactaactcattttactaaataatactataaccaccatggtcaaaaactcttaagactattctataggaaggccatcatatagaagcagctaacctaacagatggatggaaatctaacatatgaacacaagaaatataaaaatccagataacataatacctataaaatgtttaacttttagcaattgaatccaaagatattgatatggttggaatgcaaaagaatttaaaagtgtacttttataaatgaccagtggactcaaatacaattctgataagcctatgaataaaacaaacatgtcactttaagactcgggcaagaagctcaagaacttgaatgagaaattcaacaacttagaatgaaaaaaaaaaacagcaaagagagatcatggagaaaagacaactatacgaataaaaagccccatatgtaatattaaaaccaaacagcattcattggctagaccaggcagaataaagaatattggagattggagattgttgaggattgattgtcctcagcaatagtaatcttgaccatagcatttgtggcctgtggaatatagtgcatacctaatttttcatttagaagaagaaactgaaatacagacttaaaagcatagaatgacacttcaatgaaaaattgattcagtgaaactaaaccattcaacttcccattgaatgaagtaagagaatgttctttttttaaagatttatatttgtttatttgtttgtttatttgtttatttatttatttatttatttattatatgtgagtacactgtagctgtcttcagaaactccagaagaggacatcagatctcattacaaatggttgtgagccaccatgtggttgctgggagttgaactcaggaccttttggaagagcagtcagtctcttaactactgagccatttctccagctcaagtgaatgtccaattctaagaagcatttataatcccaggctatgaaaaccaggccagaaagaatcccaaaagctacaaaagagaaatgctaagtcacttacaaaggaaaacctatcaaaataaaagcagacaccgccaaaaaatcttttttgttaattattaatttattcttttacactccatattttattccccccatgcaccctctgactgttttatatctcataccttccccccaccctctgtccccatcccccaccccatccgacctctaaactccctccggcctccagtctcccaagggttaggtgcaaagtattggagagatcaggaattcaaggcccatacctaaacataataaaagcaatttactgcaaaccaacagccaatatcaaaatggagacatacttgaagcaatcccactgaaatcagggacaagacaaggatgtccactctccccatatctattcactatggtattgaaagttttaggtagaataataagacaacaaaaagagatcaaggggatacatactggtaaagaagaaataaaagtatcactatttgcagataatatgatagtatacataagtgaccccaaaaattctaccagagaacttccccagctgataaacaacttcagcaaagtggccagatataaaattaactcaaataaatcagtagccttcctttatacaaatgagaaagaaattaaggaaataaatcccttcacaatagccacaaataatataaaatatcttggggaaactctaatcaaacaagtgaaagacctgtatgacaataacttcgagtctctcaagaaagaaattgaagatctcacaaaaatggatctcccatgctcatggattggcagaattaacatagtaaaaatggccatcctaccaaaggcaatctatagattcaatgcaatccccatcaaactcccaacacaattttttcaaagacatggaaagaacaattctcacattcatctggaaaggaaaaaaaaaaccagaatagcgaaaacaattcttaacaaaaaaagaacaacttggggaatcaccatctttgacctcaagctttactacagagcagtagtgataaaaactacatggtattggtacagagatagacacattgatcaatggaataaaattgaagacccagaaataaaaccacacacttacggtcacttgatctttaacacagatgccaaaaatatacaatggaaaaaagaaagaaagaatcttcaataaatagtgctggtctaactggatgtctgtatgtagaagaatgaaaatagacccatatttgtcaccttgtacaaggttcaagtccaagtggatcaaagacctctacataaaaccagatacattgaatctaatagaagagaaagtgggaaagagccttgaactcattggcacagggggaaatttcctaaacagaacttcaatggcttaggctctaagatcaaaaattgataaatggaacctcatgaaactggaaagcttctgaaaaaggacatagtcaataagacaaatcagcaacctacagattgggaaaaaaaaaatcttcactaatcccacacctgatagagggctaatatccaaaatatataaagaactcaagaagttaatcaccaaaacaccaaacaacccaatcaaaaaaatggggtatagaactaaactgagaattcacagctgaggaatctcgaatggctgagaagcacctaaagagatgtgcaaagtccttaatgagcagagaaatacaaatcaaaattactctgagattccacctgacaccaatcagaatggctaagatcaaatcctcaagtgacagcacctgttggagagaatgtggaggaaaaggaacactcctccattgctggtgggattgcaaactggtacaaccactctggaaatcaatctggaggttcctcagaaaattggaaataaatctacctgaagtcccagctataccactcttgggaatataccaaaagatgcccgaccatgccacaggggcaagtgttccattgtgttcatagcggtcttatttgtgatagtcagaagctggaaacaactcagatgtcccatgacagaagaatggatatagaaaatgtggttcatttacacaatggaatactactcatctattaagaacgagggcatccacaaaaactctaaataggagagcatatactggtatacatcaagctcccaaaagagatgatagaattaccatattgacaaagttaccattttaaacaaggagaaatgaaggcttccaatgagaggtattaagctaaagcaattcataacaagccagcattggggaagacacataaagaagtactatacacagaagaagaaagatacatgcaatcattacagtgataaaataatttcaatattaaaatagataaatgaaagcattaattcagtgaacctgtaagatttagaaggcaaaactttccaataaaaattctaaaaatatctaactatgctattaaaaagaatagagcctctatggattaaaaaaacaatatccagctgtttgctgtcttcaagaaactcacttagtgtcagagatgtacaaacatagtgaaaggacagagaatgatgtttcaagtgaacggaacctcaaacaagcagtgatagcagtcctaatatcccaacaagaaaatcatcagaagtgaagaaattaattacatgttagagaaagaaacaatcaatcaagacaatataattattgtaaatgtttgtatatcacatgttggcaaagccagcctcataaaataaactgtactagacataaagagacaggtaagtcgggaatagtgggtgactttaatacatcactgtcttcgaatagatagatattgcaaaggaaaaaatcaatacatttcatagttaagatgcatcatatctgagacagacataatggacatccacataatagtccatccaacattcctagaacatacattctcctccacaaactaatctccaaaacacattatattttaggccatatagcaataagttatacaaacacactttgtattgaacacacactttggaacagtcagagattcatgaaaggaatcaggaagaaactgaaataaaaatcaaatgaaaattaagacaaccagaaactgcaacacaacagaggcagttttaaagtttatagcttctagcacctacattaaaaacagctaaaaagatattctgcaacccagtgatacacttcaaattcatagccaagccccaaattagtagatgtaggcatatagttttcttaacctactttaaaagggttcaaccttctctctagctcccaccataggtagtagaaaagaaaagttattagcataccggggttccaatcttcactgtccatactccagtccactagcaaacaccaaacataaatcagcagctgcagtgcagtccactttgcagacaccacacgggaaccagcagctgcagttcaatccagaaaaaactgtgatgccaactggcctgtctgcagaagttgcaagaagccccaggaacctcaggagaagttctttagggcatttctctcagtgatgtcaccacaagtgaagcttagcaatacaatgcaaggcgaaccaatacatgcctgtcgtcagcaaacctagcaaggcagagcaatgcaaaccaatgcttgaactcctcctgtctgtggggtcatgtttatatcccctctaggcatcatgcatcctttcacatgtctgatatagcaaaacatccttttctttcacctgtatgcccagcaaaacatcatttgacatagctgacttgccaaagaaaccagaagttttcacttcaaggagctgtaaagcaataatcaagatcacaatggaaatgaatgtaatgaaaactgtaaaacaatgcagagaatactaccaagtgttaaagaaacaagattgccaaacccttagctgaactaaccaaaggggcagggggtggggtggggagagaggatctgaattaataaaattagacataaaatggagatatgactgttatcactgaaatgtgataaatcacgaggaagatttttgaaaataaaaaaaaaaactagagaaaatggataaatttctaaatacacatgacctagcaaaaattaaccagaaggatataaacaacctaaaatctgcaataaaagtgaaattaaaacaacaataaatcatcatttaacatagaaaattccatgactggttggctttgattctgaatcttgctagatctttcaagagcctcaaactataaaaagaaaggcaagaaatacctgtaaatttattctaaaatgccattattaatattatataaaaaccaatacaaatttccttgatgaaaataagccagaaaaataccttaataaaacactaacttattttaacaatacattataaagatgatgtacctggcataagactttaatttcagcattcaagttactgaggctggagtatcattacaagctgaaggccagcctggttttcatagtgagttctaggctagtcagagctgcataaacagatttcattccaggcatggaagaacagttcaaattaatccacgtgagtaaaaagtaaagtatataaatagaatcaaagaaaaagtagcatgatcattgtatcggtgactgcaggaaatgtctttaaaagaattcagtacttattcatgatatactccaaagaaactgataatagaaggaacaacataattaaggccatatacaagtatggccaatgttgtactaaataccgaagaaaagaaagcatttcctctaaaattagaaatgtaataatgatatttttcaccactattaaccaacataatgctcaaactcttagctagaaaagcaaagctagagaaataaaattgggtgcacataagaaggaagaagtcaaatatattacagatgttgtaatgagcatcttagtgctagaccctgcagaccccacaaggaaattctcagatctggtaaactgaaagtaccaggttaacataaaaaaaaaaaagcatttttctgtatatcaatgatgtgcctgctgagaaagtaatcagaaaaatattcccatttatgattgcccaaataaaagaatttctaacaagaaatgtaaccaaggagagaagatgctagaagattaaagacttctcatgttcatggatcaacgaattaataatattgttcaaggaatctgtcttactcaaagcaatctacaaactcaacataatccctatcaaaattctattgacatttttcacagaagtaggaaaaataatcctataaatcttttagaagtgtgcacgcacgcgcgtgcgcgcgcgcacacacacacacacacacacacacacacacacatacagggggagtggcaggccctgaaccaaaaggaacagtgttggaactactaaaacattgactttgaattattctacagaaccaacagaacaaaaatcagactggcattgacacaaaaccagaaatacaaaccaatggaatagaatacagaactaagattgttggcaaaaaacaaaacaaacaaacaaacaaacaaaaaacccaacaaaactaaaaaccaacaaacaacaacaacaacaaaaaaaaaaccaaagacagccgacagcctgtgttgtcttcctgcagtttgagtgtttctggttttgcacttccatctctgatccattagtctttgtgcaaggtagcagatatgggtctaattttattcttctatgtgttgacacgcagttttcccagcatcatttgttgaagatgccttttctctttctctagcttatgttttggacatcttcatcaaatattaagcagcagtagtagtacacttaaccttggcagtaaccaacagtccttgaattggatttaagacatgctcaccaagagggaaagtatgctgtgtactagaaaactaaccaactgcccagagcttgtgaagtcaagtgtcttgacgaagaacctacaagtcaccattttactgaaccagcacaatcagacaagtgacgtatgtaacgattcctgatgagacaatcaatttttttggaagggataaaaagatataaatttatacatcagatggacatattttaacagtgctgttagtatgaatagggagtgacttctttacattgctatgtgggagctaaaattgggaatccccccgaggaagcaattggtttgtagtaatattctctttgtgtatgtgtatgttcttcccttcccctcatgcatgtgtgctgttgtatctatgttgaggccagaagtcaactttgggtatcattcatgaggaaagatacgttttacctcttgagacagtctctaacttgatttataactccctgattagtataggtttgatggccagtgagcttctggaattctcctctctctgtccccagggctgggattacagcacaagctaccatatctggctttattccatggctcctgaggatttaactcaggccttcatgtttgcacatcaagtattgtaccaactgagatacagcactagcccctggagttttgctttttgcccccaaagattctggttttattactatatcccaaagatagaccattgatatgcaaagtgtgttgtatatgcaagaatattcctggcaacattgctgaaaatatagaaagagtgcaaatgaggactatttaaagaaacagtaatataattttatgcataattcatgagtagaaagttttgtcattataacacagaagtcatggaaattcccgtatctgattttcctcaacatgttaatgttttccatcaactaacagtgatttcaagtgctttttattctgtgatctccctcggaagatgattacatttttttcaacactgcgggggagtctcctaccatatttagttaacatctgttccatatgctggaaggtgagaatagggtaccacaatttagctcccagagaacattgatctgtggtttgataccaatcaaatggtagaagcatgcaggagaaaaacaagcaggactcagaaggtggcttggtgggccacgtgcttgctgtgcaagtttgagaacctgagcctcaatctctaggaagatagggtggcacatgtctctaatctcagtgctgagggtgtggaggtgggtggaacccaggggcttctggccagcagtgtagtcaaaatggccaactccaagtttaacaagagagactctgtttcaaaaaatatgatacataataatccaagaagacaaccctgacctttctttacacacaggcaagcaaacggacatatatcccatacacatgcacccagaaacaccctaaacaagcaaatatgtaacgacaactacaagagacaaaggaaggaatgggtgactggaaaagggtaaaatatcaaacaaggcatgcgttagttccaggaaacagtaggaaacagatgtcataagttcatctatacaaggacatagatgtttctgctccagttgccatcagtattggttgagaatttaagagctttactactttttgttttattttaaagtttgcctccatctccagcctagggtgcacagaggaggaattaccagagagaaagcctcccagcttggctaagccctcaactcacgcagaaacaggagggcggatgtgagctgaggcagagggataaaattcactcctgtgagcctcaggagaggatggagtctgctattagctctaaggctcaacgccaaagtcaagagccataggggaaggacagccatctccaagattgtaagttccactgttcttctcagcagtctgatttttacagaaactgaggaatgtttaggtctgtcctcacaaaatgtccctatttatagtagatttcctggctaattaaaacagatagcttcttagttcgtacagaaatgcctgtattgtttagctgtaaaaaggaaaaaaaaagggggtggggttaaactggtcatctctgtataaactattaactttgttaaaacaaattcgttggtaaaacaaagtgcaccatggagtaaaactgtcaaaatatgtaaggcgtggttattctccagaggtctgtgtgctcttccttacggctgagtttgtgctaagctggaaacggattctctaaactcatgtgtatctgtttcattatttatgtctctctctctgtctctgtgtctatatctctgtctctgtctctctctctctgtgtgtgtgtgtgtgtgtgcgtgagtgagagagagagagagagagagagagagagagagagagagagagaaacagctcgtaggagaaagtcctatcttctaccttgtgggtcctggggattaaactaaggtcattaggcttagtggcaggcactatacccagagaaccatttcattggccccaatcctgcatctaaattgacactagaattatataatatattcagaatatgtacagaagtgatctgtcttataacttctgtataaataaacactgaaaaattactcattactattagctaattagagaaaaccacagtgatgtttcattcctactatacatgatttttaaaatataagtattgacaagggtatagactaattagagacctcatatatcactattgggaatgtaaaatggtataatcactttggaaagcagtttggaaaagcggttgtttgtttttatttatttattttttaaacaaggattcatagaaatgcttaggctggcctcaagcttgctatgtagctgaggctggccttgaagtcctgagtatcccacaactgccttcttagtgctgggcctaccggtatgtgccacaatgcccagggatatgatatgtatagtaatatctgagtccaagcgtctgtgaccacacgttcacatagtaacaggcacagcagcgctcccaacagcagttttcatagtacttaaaaggggcattttactagggggtagagcatgaagcaagcctaaatggatattgggaggcttcgaggcattcccacgaactggcagagccagatattatttctgagtagtggacaacgtaatgaggacaacgttggaggcagtccaaagggaaacctggtgtctgcaaacacaggaagacttgagaagacttgacatttttttctagattgtgcatttaagggaatttcttcttgtagtatgaatgattagtctctttgcttttaagaagactcgttacatttatttacttacttattgcatgcctcagtgtgtatatggaagtcgaagggcaactggtgggaacccttctcccaccttgagggccctagagattgaactcaagttgtcagcttggtgacaagaacccttgcctgtcaaatgttcttactgttcccacttccactactgtttaacagacacacacacacacacacacacacacacacacacacacacacacacatgcacagagtgcccacatgctagaagacatctagttttgtttcttgactggaacagactctgaacctctaaaaacctgttcaataggttggaaagagacagttcagtagactacttcacttgtgtgtgtaaggccctggattcattgttcattcctcagcaacacacacaaacacatacacacacacacacacacacacacacacacacacacacacatctagtagcagattataagacataaaataatgcctgaaaatgcttcagtttaaggctaatttactcagtctacttagtctcagtaattctggattactaattttacctactattcataagctcaatactggcaatattttgtctcccacagaaatattactacatatatcccagatgacgtaaatatattgttgaagaactaaagatacagacaaactaagccctgaaaagtcaaaatatacatcatcatttgatcaattatatctaaaaatcaaatccctagatatttagtgaaacagttcaaaaagcatatgaaagagcaggtagctgcttggtagagtttgggctgtgtgtactgcaataaggcatgaagcctatggttccatgcatggcagacagatatcagccatgagctgtgatctgagaccttctacctctttccctccctgtcccacccctgtgtgtgtgtgtgtgtcacacatttgtgcatatgtgtctgtctgtatgtgacatccagagggcaaaagaggaagtaaagtctcttcatgtgtcagtcaccttaaatattggcagaatttctctccacgcctagagctcagtgtctcaggaagacaagctgcccagtaagctcctgcagtctgccttagcccccaccccacccccacatgtcctagacatgtgcagctgtgcctggcctttacacgggtgctaggatctaaactcagctctctccccgttgatccatcttcccagcccccctcaacgctttaaacgcaagggggaaaaaatggaaaatgaaggagaagagaatcacactttaaggaaaataagttggtaaacaactttgagtaagtaagaaaaaaattccaaggaacttcagaagttttacaactatgaattattttagctaaaaataacaaaatatcttcgttaccttttaaatatttttctaaattaacgagttcattgcatctgatatacccaagacaaagaatcattttttactgaaagtatttaattcttgctgtcggtctttttcaggctctcccgattaattttcacctcagagcgtaaacattcactgtaaggccatttttttctgaagatattaaagctatgcgcttattttaaatcttactactaaactgagaatagggtttcccctacctttcaacatctacaaaatcataaatagtcttgccagttttataggtgttaccagtcccactcgccaagtgctcccattgtaattcttaggtaaaatcctggagaattttcttacttaatacttctagcaaagtctttctttttctttttttaaagtgaaaaaaaaaaaaaaaaaaaaaaaacaagcactcaaagtttcatcattgaaacagtcaaatgagatgaagccagagagtaaattagtgtttggccaggaaaaggtatggaatggtagtgttggtacgggctgaaaagattcggatgtcaagacgccagagaaagaaaatcaccacaaggagcgtacaccacgtttatatgaaaggctcagaagaggcaaaacaacacaaattttaaatttgttccttcgatggctcatgttttttcccaccagccctactgccagctcatatttattgttctagttgtaaaactccctcttaaattttttactggttattttatttatttatgtttcagatgttatccctctttccagtttcccctacgcaaaccctcgatcgccacccctccccctgcttgtatgagggtgctcccccacccacccgcccactcctggctccccttcactccttcagtccttagttagggaaaaatccctcttactaaaccccaacacattcttatttctgatggtatgtgctagtatttaaattttatgtaaatcatttgagaaaaaaaaactttcatatcctgaaacataaaagaaatatggtgagcttttcttgtctctgttaatagacataacaccaacctggcagatattggctcatctgtcaccttccatttctttaagtaatctacctacggctctgctggcacacccagatgtcctgaaactttcccgagtgtgttcggagcagccacttggaatcatccagagtctgccttctacatgagacctgtctgtctcacctggtaagagtgcatatgcaattttactgcggtaaatgctaatggaacacatagggtcttcggttgtctttggctcctcgtatttctttaaggagagggtcaacaaggggtaatctgtaccgcttcccatacccaaatgatacattttctgaaaagtcaagcctgcataaagcagtaatagttgtggattgttagatttctatgtttccctgcaacctggggggggggggggaatctcattttgtgtttcactttttgcccacccctctgctctcaaaaccataagacgtcattcattagtggatcaggaaagaagctaccaatttctgtggcgtattggcgaaacggcatccttttttctcgtttctgatgttttccttaaagcattcagctttgcaggaagaggctgtggcactgtaaatattaaacttgcatcgtttgtatccgtgatgagcagaatagccatggatggccagagggcagacgtgccacgtgcttacctgtcctatgcagtacccatgtaaaaacggaaagtggaaggatttctcttagtgctaaagttcataaggttagaaatgattctattctgactcaaaactcataggtaatttttaaagaagtatttaattacagttgtcatttctatggtttctaaggagtgaacagtggggagagacccccctcatgccccctcacccttgaataaatgttatgttcttgaaacagtgaccttatctggtgacagcagtggggaggtcagagagcatccgattctcaaagtgtttcagttcatgcacaataagttcacctttgaaattttatagcgttctgaagtgagtccttctgcttttagtagtaatttaatgctaacctaaatgagtaatatttgccctcgatgggttgatttcaaagcagaagcgtctttgctaggagtggtggcacactcctttaatcccagtactctggagtcagaggcaggtggatctctgtgagtttgaggccacccgggtctacagagcaagttctaggacagccagggctacacagagaaaccctgtctcaaaacaacaacaagaagaagaaagtagaaatgcctttttgggagactttgctgctccatttttgtattaaaatatatttcaaacatctcaaagaaagagcagagactaatacaaacaatatgcatgtgccattgcatgggttaacacacgaccagtttgacaagactactgcgtactttaaataataatagtgatatacataacattcatgccatcatattctattacctttcttactgtaacaccttggttttaattccccagaaatttttacattattatatcattatgtatccaaacagcattttgagtgataagtcatataattccatgtatgttggtcctatagtttattttttcttcaactcgtgcgttttttttttattttgtgttttgtttattttgttttgttttgttttgttttagtacttgggatgaagtctccatatgccaggtaagcactactccacttttaagctgtttcttggccctctgcactctttctattggtgtgtcccaaggcatttcatttataaaatgatgccctaacttgcttacgcactcatttcttcatagacaaattgtttcaatttctcacgtattacaagtaatagcacagtgagcattcttgtgcccatctctttgtgcacatgtgtgaggttttgtctggttagatacctgtgagtggaactgcccagcctgtgcatggatcagctatgctaaatgttgcccagttgatctttgacgcatctgtggctgtttacataccaagccctcgccactgtaaactttatggagatataatttatatgtcataaatatacatcacttgtaatgatattcagtagggtttagcatatttatagagttttacaactgttacctaaatatgaccttataacagttcaatttcatcacacatccccaagcaaaaacatgggacccactgggtatattcaaggaaaatacaaacatctacaaagataatattgttcacagtagtcagaacatccatcaaatgatgactgaataaacaaaacatagtgatttcagtcatcaagagagtggagaagggaattaagtactggtaggagatataatatacatgaaactccaaagcaccccactggtaagtggaatccgacatttatgaaagcataaatatgataacgtatgataacgttcagaatgggcaaatgcatggagacagaaagcagagtcgtcgtcagatttgactgagaaaggaagggaaaactagacacatgacttccctcaaacactgtctttgtcacatagtagtttgtttattggttgattttgtatttcgctttttgaggtcttaaagaatgtaggcggtagtccgctgtctgccacatagtttgctaagaattttgccccaatatctaagtggcctctttgctctgctcctttcctgtgtagaagatctgaaatttcctagattgtctttgccgcattggatgggcagacaattttttcttttctttgctgtttgagccctttccatacagttcttgcttctcctacctcttgacatgttttgcctttatttttatttagcaaaggtctcccccctgtccttcaaaatgtctcttctttcaagcttgctttattatataccaagtagatacaatttagcatcatcacggtctgaacaccattttaatgattgttggacatcttttcacatgtttttatcatttctttttttcctttcccttttaaaatatattattattattattattttggaggtggatggtgaaacagggtctcactatgtaggtagccctcactgacatggatcatgttatgtagaccaggctggccttgaactcacagagctccacctgcctctcccaggtactagaattaaaagtatatatgctaccgtgcccagcttatttctgtattttcttcggaaaaaaaattccatctttattctttggcaattttcaaattggatctcagtcttcatttccttattgagctgcacgtgtcctttacccaccacaaagacgagtttcttactggatatataacctgcagacagtttctctcgaggtcagcattttatcttcttgatagtctccaaagagcaaacgtttgtttcagttttggtgttgttttagcccagcgtggtaatggttgtttatatctaattccagcactggcaagaccaagccaggaggacaccaagtgaagtccgacttagggtacatagtgagactctgtctgtttgagaaatgatgacgcctgggacatccatcctttctattatagctcagagtgcccaaggagtcacacccaaggcaaagccaagactatctacctctctggttttctcatcggtgcttttagcccttaagtttgaatctttgctctgttgccatggaattgcacatacattgggaggtgaaactgcttcattgttttgcatgtggatgtgtcttttgtcaaagttctttttttttttttttttttttaaacctcttcagacttgctgaaaaacagctgagaaatataagggtgtattttaaaatccgaattctctttccatttactggggagtttaaaattttgagtttcctctgtccaatggtgttctcttaattttagttgtaaacctgcacttctgttgttacatttattcacaggtgttttctttttttaattgatgctatcacaaatgctatcacttaatttgtttttaaattttattgatatattggtagggtatagagaactgggtaactttagatgttggtatcttagtctgatatcttgatgaactcatttaacatatttaagtttttaaaatctactcctcaagacctaaatgtcgttgccagatggtttcaataaaaccaattttgtgtggattgcattaattttctgacagttggtttgttgattgttttgaatacctttgttagtatcccattcatgggatctttggaatgcggttcgttccttgctatgatagtctttcagtggcctgtgtctggcttccttcagtaaaactgcaggtcttgggctagcatttgggtgttcagcacagagtaatatgaaggcgttggtacaatcaaccttggccatatcctttaactaaggagcctaccccaggtcccaacatcaaactacagtgctccccaccacgtctccatgtctgtgaaatccatttaatctttctcactacaccagaacctaactactggtttcctctagagttcagcctgtagcagctcagacctgcacggtgttgtgtgtttctgtttctgaagcatgtatgcctgtaatgtcagtcagataaaagcagctcagcgaaggacgaaggacgagtttgttttggctcacggtttcagagtacaggatgtgatggtgcacacggaatggcagcaggagtgtgaggcagctggtcacactgcatccatagcccgaaagcaggaagccggaagccgagagaactggagaatggtgctctgttcacatttccctttgtatgcagtctaggatgtgagcccctgggatagtactgtctgcatccggaggtgattctcagttagagctccacgggacccctcttactgacacactaagtgtgtctcctagatgattctaaatctatagagtacagtaaccattaccagtggccgtctgatttgattttcttacccaattcaagaaactagtataattttaacagtatttaaagtagtgaataataagaaattatagaagagactaaatggtcttgctatcacttcagagctccagctattgcttattgtagtgtaagttttcagaatatatttcaagaacattccctaatgtggtagaattctccctggtaaattctatggtttattgacatttatttaccatgttttcatttcattactttaattctataaggttattttcacaggcttatatttaaaattatacagcttggagaactttttattgaattattttttaacttaaaatataattacatcattccccttgtctttccttgctccaaccattcccttatacccctcttgttctctctcaaatacatgctctctatgtgtgtttatgtgtatatatacatatacatcatatacatacacatacatatacatatatatgcctatacatccctaaatatacaaatacaacctgctcagtccccatagtgttacttgtacgtacatgatttcagagatggccacacagtgttggatcactgatctgtggtttctccagttctcatcatcccttagttaactgcagtcctttgactagactgaggcctaatgagatttctccttctcttggtcgtgtctatcgacgttgtccttgttcagagtttgtttaggtatccgtgctgatgagatttcctgggtttatcttctctggtattcctaatagtaaaatctcacagcaaacttatggtaatctggctcatgactaccttttctctcatctttcctggttcatcttgatcaggagccatctttcctctcatctttgctggtgtagatggatgggttgggactgggcagcccgtgctcacttgctctctgcattttatgtagttgtgactttctgcagtcatgtctgactgttgcaaggaaatgcttctttgatgagagatgagactaagatatgcataaaaggatagagatttaggatgtagttattgattatgctgatttatatcctctgagttatatccttggccatatatttatatggcttatatatgtggctatatttaagtggtgggttttaggttctcctcgcagattagtgactttatcagccttggggagctggctaggtctccagtaccaggcgtgggtttcttcatgttgagaggatcttaagtccaatttgacagctgttggttatcaccaagttgtgtgtgcccctattgcaaattgtgccatggcggtcattgttttagtttggagccatagagcagggtagggctatcagttgcttggaagcctgtgtggagccttctgataccacgagaactagttctcagggactttaaaaaagtaaaatatgccgggcgtgatggcacacgcctttaatcccagcactcgggaggcagagacaggcagatttctgagttcgaggccagcctggtctacaaagtgaattccaggacagccaaagctatacagagaaaccctgtctcaaaaaaccaaataaataaataaatacataaaaaagtaaaatatactattataattgtatgttctaaagggaaatctattttatgattcaaagaatagaacacaagcctcattccaggaaaataagtgttgacattacattaattgatggtttggcatcctctaacactttggaagtaggattttcataatagacatctgaaaacaacaattcttattcagtaagaatttcctttttggagattggtagacccaaaagaaagagaaaaagtagaagtctttaacccattcgagaaacttgaactcaaggatgctgggtaaggatggctggggaggagtaccaagcagatttgaatctgtaagaaatcaaggatgaaggtagcagagaacaggaatgaggtgtgccgtgcagcactcaagtaggtgaccgaccgtaagaacctgggtgctcatctgggaggacggactgccgaagccggattccggcgggcattttagggccgtgttaaggtgagaagaagaaagtagttcttcgtgccctgcaactatctaataatacgctgccatagctgtcttctaattgtaggaggtgctttattggaaatctcaagtttgaactcctcagactctgtccgtctcctatccctctagggccagctcagcccttcatcctgtcagagcgcataaaacagaacagcttacaatttgctatgaaggggtcttcgggatgaagcatcttaatgtctggaaagattagacgggatcttcatgcttaaagactcccatgaaacatttcaaatcacacggatgtgtctcggtgccctttgccaaaattaatagatttaggctgtggagttagaagaaggctaagtatccatacccacctatcatccaataacatttactatttttaaatcttcttatagctcctgtactcttaaactgagaatatattaagtcagaaaggctacctattttagactcctgtaagttaacacataggggcaatttcgatgtatagtgacattctagaaataaatatcacacacaatgacctagagactacaccatgttgatcgcatgcggctgtttttacttgcttgcttgtttgtaattttgactatttatcagtctgaggttgacccgcctttctggtttcaaatagctattccaagagccctgataaagaatggcacagagggaccatggcgtaataaaccaccaagtgagctactttgaattcctctcatgttctgagaacgagaatgtcttaagctttgatagaacagggcaattttatattttccgtctgactactttaaaaggttcattgtcttttaattaaactacggtggggggggggctgctgggggagagagcagagattaaaagctgtcgtgctgtaaacggggtggcttttagcaactagtagatgagtgaagccaccacctcaagcaagatgaactacagcaacaagttctgtgcctcgaagcttctccttgtctgactgtagcagtaatttggagttaatttgtgtggcttccgcagtaaaaaaaaaaaaaaaagactgtgttctatgtcgtctgactcttcctagcatggcttcgcagctgttaggtcccctttgtatggtccagcaccgaaccaccaccacaggtgaaagccaggtgagcaggttagatgggcatcttggaccaggcttagtgttcaccacgtgttgtttactctccacaaaatgcctgcgtggatcagcctctgcctccattctcccacttcctgccttcaccaacaaacggagggccactctcctctgggcaagtcacactgttaggttgggcgaatgtctgggtttctctgggagttttattgcctggcacattgtcttgttttcctttgtctgcgtgaacactttttttccccttctttgtgtctgtttttctccctttgcctcctactccccacttgtccccaaatccttgaagccaatgaggctgtggtgacaccttctgggcagtgctgggagtgaattacagccaggagtgagcttcctggtggtggtagctcacccacatacagtgaataataggatgtatggtttgcttcatcaaagaaactgatacaacatcctacttgttcttgggatttctagcactgctaagtaccaaatgccgtaagtttcttgcaaacaagcacagatttgcagttagtgaaataaaaaaaaataaataaattgacaaccaaggccctacctgcttactttcctagtggtggttctgagtcaggcttgaaaatgaatgtcaacaaaataaaggaaagcaattacgtgggactagaatatcaacaccagacgctgctgcacgtgtttttgcaaggatgtgtgtgtgcatgtatgtggtgagacacggcagtatcccgttacatgccagtgccttctagcagtaaggacgtgtcccatgaacagtcctggtgaaggcagtgacatccatctcagctgcccactgcctggccgtgtaggatacaggtcgcctggtgctgtttctgtgcacccatgtctctcagcaggtttcacagacaggctatggatctactctgtacagcctcaactggagtcttttttttttttttttctgaacagactccatcattcccacctctccttccatgctgatttaattgttatatttaacatttttaaatggtttcttttttttttttttcatactgtatggaaatgatacaagcttacaggtaccaatttctctctctctctctctctctctctctctctctctctctctctctcttcctttcctccccctcccttcctcctctctttctttccttttccccttttcttatttttttttctatcactactgacttacacttggaccctgaagagactcaaaggtacagcttctaggaaaaaaaaaaatcacatggcagctctagcaaagttgatgttactatctcatcaggagaatattaaaagagcctatggagtctgttgaataatctctgccctcctcataactctctgtcatcatcactgactgaatagcaaatacagaggtaacagacaacaaaggtacaccgggcagccattgcagctgtgaagctgcccgtctttgcagtaactgcacaccttaggacgccgtcactaggacactgagcccaggacactaagcctggctgttgtgggtgactggagcagttgcatctgcaacctttaaaggaccaccacatgcctcatcttcactttctacgccgttcttcagtgaaatattgcttattgggtgtataatataagcatttatgtgtggtacagaacccgatattttttacaagtcctaaataatcaaatcaaagcctagccacattactttccaattctgatttgcaaacagtggtagtccgcttgagggcggggggaggacaataatgaaaatgggggtgaggctttcctgaaattaaaagaaagctggaaataccgagggtgtgaataagtaacaaagtgtcgtgtggtaactgtcgcgtggtaactgcggggatgatggttttatttgaagtggggggcggggggagggagaaccagaaggaggcaaaaacacaatttggtctaaaattgaatttctctgataaggcatttcagaagcggcttgtcttattcactcagcagcaaaataatcatatgcgctttaataatctttattttacaggagtgtgttgccagggtaacagagtgtaagcaggggaacagcaccttccagatcacaaaggcaaatctgtggaaagaaatttctctccgttcctctctcccttaccactgtaataaagactctgttttttttctgcactatttaataattgcccataaacatcctcttctcctttcccatttccatatctgctaaaacatggacaatggcttaagtctggaactgccaagctcagtgggctaagcaaaaagacagatgtggtatctttagcatttttatataattattttttattactattttaccccgtctccattccttccctctgactgtattcttatttccttctctctttaaccagcccgatggtagtataccaaggaaagggggctcgaggtgggagtctatattcggctacattaatcaaaatttattagccaagcttgcctgcatggagatttgaaggaagcaaggagtgcagctgaagaggataaattgaattattgcaaatggagtgacaagcattcagacctaaagctacagaaacaatcatttctttatactcatgaacatagagggtgggtaagggggagaaggagataagtagattggggtgggggggggggagacagagagacagaaagagaaagaaacaaagagacagagagagaatccgagacagagtgcgtcatcagggtcattcagtttttcatgggccctgcttctgggagatcagcagatttgaaatgaacaaagtgagagatcccaatgccttggcagcagaagagatgctcaaaactggcaatgagaatgtaccaactggtcatttgataaggttcaattcatgacagactgtgtattttcagtaattacccctaattgttttagccagggctctagcctttgagggtaaatttcgtggggtcagggcacgtctcgagattagatagaaaaatactccaaagagtctgtgttcacatgactgttgaaggtgtgactgtagtgaagaattttcaggttaaggacatgtaggttgcttaacaccactggtaacaggattcaacctgtttgtggtagcagaggccttaagacaaaggacttcgaggtgagagatgaagacacactctggtgcgtgggaaaccaaaccaaaacaaaccataaaggaccgagagagtggaccataagcaaagggccgttttttagggagttttcgccttgcaaattctccttgtcatccctgtaaagggaagaaacgggtgcatttcaaggccatcacttgaatgacccagataggacctactctccgaatgcctgagctatccaaagagcatacacctagctagctggccagccgctttgaaggtgaaatgccagtgagcaggagatttccttcttagtgttggttggaacaagtgttgcactgtgtacatcttgagtcagagatgggccgtgtgaataagaaatgagatacaaagttgtcttagctcccatggacttcctggagtgttctagtgatagtaacatcaagtgagcagccagccacgctctccagtactacaacagagagaaacagtacctccacttaatgaaaggtctgaaacccagattcgggaacacgctacaaaagccagcccactgcaagaaggacctgggacagcaaagtcccttgtaactttagaactcattggtttttgtactattctagactaagtatatcagtatctccatactttgtttaaaataaactaaaacatgatatttgccttaaattttatgtacaggcatgacaagtcagggaaagaatagattgtgtgtaaaatgatttttaaaactatttcaaaattagttttaaaatagaaaaaagatatatgcttaaagtaaaaaaaaattctgtattcccacttaaagtcattcaacttccataacacgtagattttaatagacagagaaacgatggttagagacgacctgcacacatcggaaaaagaaatgggatttctcacactgggcacatttctttggatcccttatttgttttctctgtccactctgctcatgccatccatacgagttcatgtgaaggtactataaagccacacagaacttgaattgcttgggaaggtttgaacaggtttcctttttcatccctgtgatggtacctcttccccctccctcacacctccccaatccacctacagatctccttgctttaggacatggcgactttgtttcctttcctcagacttccagcatgggtgttgaaatcaagaggccttaatcagaaacgccatcatgtattgcaaagcacatgaaagctaatggtagtatttgtacaatgatcaaattaacttcttaatgcagtttttaaaaatacagtgaggcattgtatgataatgttatgtttctaaaggctaacatgccagtctttcatgacttttaaatatataaaaagaacttcttaaacatttttcaaatctatattttataatttttgctttttttttttcttctgggaatactctgaagtttggcagggccatcttggactatagctattctcctaccttataaaaatgtctccaccatgttgggctccctcagactgttcacaaatgaataataaggaagaaagggtaaagagtgaaagctagccaggatgatggcacaggcctgtactcccacaacatgggaggtagaggcaaggggattacaagttcaaaatcaacctggtcttcagtggactcccaggccagccaggactacatttcaaggtctggggggaaaggaagatctcaaaggaaaattgttatgataatagctacaaaataataataataataataataataataataataataatatattagaaaatgtattaatatctctaccaactaacctttgtagtaagtataattctgtgcttgtataaaacatacacaaatataaaaataacagaacctactggggatcttacagaagagaagcagctgtcaatgtgggtgccccgtgcatgaccacacatgatgctatgaatgttgccctgtgtaaattcagcctcacctaatatgccatgattcaataagctgggaatggtggaatacacctctaacagcagttgagcgacagaggcagaggtaggtgagtgcaaggccagcctggcctacaaagtgagttccagaccagctatagttcgaccacagagttcgaccctgtcactaaagaccaagccaccaaacaaagagaaacctcaatgagatgccagaatactttcttcagaaaactattcttttcccttgaccttaccttaggttatagaattcacattcaaaagccaaaataccttctaaagtaacacgtataaaaaggagaaatataattgattttatgcgtttatacttatactttctattagttgaagaagattctgcctatagtttacaatttgacttatgttgcagtctacgaaaatggcccatgactttttttatcctgaaattcatgttttatacaagtgcagaactatacttgctacaagggttagttgttagaagtattaataaaagtcatattgaaacatataatcaaggaagccaactccttattgatgatttaatagtagctaggtgtgtgtttttgccactgtcatgcataaagaagtaatgcctgatttgttcaggtcttggttctgccacttagctctttttgggtatcttccttacctctatatagtaataggatttcctgtttaaatgttgcagttattgtaaagatcaaggggaaataaatccatagatgtagatatatgtatgtcttcgcaattatggtattttcttgtaaaaagggttatataaaatatgaacgtgcattgatatgtagctatctataaaccctgcaacattatattacaaatagattctttcatgtcgttttcaacatctaaaggtattcagttctgcttgctgagtcttatttgttgaatgaaagtgtaatgtattttcaggcaacaggaagactcattgggtctaaactactgaagacaattgatggatttgagggtaaatttgagaattttagtagttttggttcatttaatacactgttattaggtcataggaaagagtggtcttactctttcagaagaaagctgaatgacctaaaaggaacattatggcatattccattcacatcctttaccttgcatttttgctactcagtgatggatattattatctcagtggtaaataaagcaaaatgcctaaacaagaggcattcactttggtcatctctgttaaaataaagagtacatagcgtccataagcgaatactgtaatccatcacagatagaatacgcaaattcttaaaaggcaagctaggctctagggctaagctttgtttatttacaccacagtggaaataaatgtctaaaacttgggtaatattattgatcctccatctcccagttccccacatcttgattttttcctttctctctcctgcaccaccctgggatcctaagcatttgaacatatttgaatattttgatgttaggaaagacagtttccacacccatgtctaccttggccatggtatcatgtagccaaccgagtgtgttcctttgaagcatagctcaagtcagagatattttctgcccagccaggactaagagatttcctgaagtagaagtaagcgctggtgatgcacttcgcctaattgttaagaacaagtgaggtgaagccagaaggccaagagcctttgacatgatattcttgtccataaacatatctctacaaaacgtgtcgcgtattttctccctttagagattgcttgtttaacacatcttcccctgtagagcctctgcttgccaagcctcttgcagggccctcacgtgcaggctcctggggaagggcagacttgagctctctccgggtctgccattgtgataacacttaacaacatcctttatatgaggcatatagaagacatttttttttcaacaagtaaaaataaatatgttttcaatttgcaacttaggaaaagatttctatgtttcatttgagtgaaagaaatccccttccttaatgtctttaccttggattaacgattttttgcctctattttgtaatcagaatctatataatggactgagataaataaaagttctatcgtactgttaaaatgcttatgttaaactttgatgatatgaactatgtacttatttttaaaactgactaagtaattagtagagctacccagaaatctggatttcaactttggtttcctgattctcgggacactagaaatacacttgtaataatcagaaggggtttgtggctattgtgtttgaaatgtttgctgacttgtatcgcacctctagacatttgaaggtggatttggtatggcctacttcactgtaattcctattagtaactccactgaagtgttaagtgataaatcccctctcaaattttttccttaggtaatctgaacttaactatattatgaaaatagaagtagctctctaaggaggggtgtgtgtgtgtgtgtgtgtgtgagagagagagagagagagagagagagagagagcgccctcatcactctaaagagcgcatacagatgtgttgggctcccctttgtctccaagaatgtcctttaaagctgccattgccattttcctccatcacgcagggatttatgaaaatgccttttcatttcaaggcgtgtaggtaggactcaaatataatcacgagacttaaaataaatggtccagattcctacactaaaacagagtaacaacacatctttatccaccacaaagcaccatgatgagagcagggtattccaactgtgataaaccttgtcagtaatgaaatagattatccctaaatattaagtatatttacggctagaatatctgatagtagtattgactgctcatgtaagaggccgactcctgtcctccagtgaaagtaaagacaaccgtgcgtctgtgttaattcccagccgctgaactcaaggatgctttggacatcattagagctaagaaaggaataaagaaggactacagagaggactgtacagaggaaacagattcctgggagcgtcataactaagcttgaccacttccctcttcctccccacccccacccccacctctgtctctgcagcttcccatttctggggaaggagtgggtatctcaagggctttcattttctaatcaggaagcattgtctcctaagcgagtagtgaggtgataacccagatgcacaaattccatcatgtgtggatcagagctgtgctgcctgtcgagggtctgctgtctccgttcacaatcccgttagcagggaaggaaggcactcgtctaatgtacatctaaggtacatccgatgtaccttaattttcactagtaaaagggagaggttgtttttatttaaagaaatctagatatttccaacagctaaaattagatgatttccatttcccaatcatacttctgcggattatccctccttttgaaatggaaactgttctaaccctgtaacctcaacatcactgcaagtaaaactctttctaattatgtgactgtgtggtaggctcattagcattgctaatcagctgactgcggagggctcctgtcttcagttttaatgttcatacactcgccattgacatgattgcagtttttttttatatatataagtacttagatgctactgtattgaaaagcaaaaatatgaatttttcagtacatactgccaaaatttcgggggaaaacatacataattttactaatgagtcttcatataattttatgtcactaaattgagtttccatacagcactatttgtctaaaatgttcatggtccctaatactattggacgccaaagctttactttcgaaatgagaaaaggcttcctcttggtttggctttatttttatttcttctgtgactgaaaggcaatcatttccagaggaaggttttttttaaatctacagaaaagaatagctgatgatttctgaaaatcaccttcaaaagccctgtgtgagatcaccatgattgtcacaaatgaatatttattaaatgtccactgggctcttgacattatactaggttttttttttttaaagggattttgctgaaggcagacaataaaaagagagaagcttcatatgactataattttatatacatataaggaaattattgcataattggattatatattgcagtaaatacacagacgttcctaatgcacgtaaacatagtagaaatattatatatatatataatgatggttatttgaaacagtttctgtattttctggtacttatgtaaatcttcaagttagtaggttatcaaaaaagaagcacctagaacagcagggaatgattaggaagaatcacaggctgatgtcatcccacactgccttactcagtagaacatgcaatagaacttagtgttgaacctctcaaagaacaaaggagtttaacgaggatatgagtcaaaatgaggtctctggaaagcccttggcagtaaaaggacacaacaagaatgtcatggtgaaaaggatgcttaattgataaacgcggggccaagagaacgatctggatgcagaatcgccgccatgtgtcgtctaagagtcagtgtgagggaatcatgttcctctaaatgaagtacataaaatatgtactccacaaattcataatgaatgatctgtggaataaaagctcgagaaaagtgaataaatgaaggaaaagaagtataacttattcaatcagtcactcatcacatctattatatattttgttctgacagaagtgctgggggctatgtgaagaataagagttttgtaaggaaattcttggatagagaacttagtattaacttgaaaagtctcccacggcttgacatatagaaacccaggcaaactgaaaagttattgttttgggtgaatacccatgcttctgagaaactagggggaaaatgtcaatacctaaaaaaaaggaaaagcatggtagccatgttttctagcttgggaaggaaggtgaaggagggatgttctggcccatggatgtaaactgaacctccagctaagaccgggacccaagatttggagcatccatgatcagaagacttgcaactgaatcagcagcattaagcaacaactctgggaatgttatgtaacgactaggacttttagagtctgctctctagcaagcaacaagatgaagaaatgatttgggattttggttttttggattttgctttgttttgttttcctcaccctgggcttgtgactaaataggagcgacaacttcccctgcgaatttctaattatcacaggcaagccgttttaagacatttgaggtttccatgtgaactcctgcctggtgtatcttccagcagacaacatgaagagagttacagagagagccctggtgttcttcacattcagaactgaactggaaactgttgtaggacgtatgcccctacctcaggctacactacaccccttcaggaaactacaccacttagcatggctttagtttctacacgtcagaaaacagtcaaggaagtagctaaagtgggcaagagttagcacaccctagtgcacaccaaagtgagcttctgatacagacaactgaaagggaccacgagcaggaaagaatgaaaatacttttcaaacattaaaagtgagagaatggcttaagctgaaaaaaaaaaaaagagcagtatcgagcaaattaacatctggaatatagagctaaggaaattaacctgaaggcaatacagcgatccaggaaaaaaaaaaaaagactaggaaactgcatgtggcaggaaggaaggaaggaaggaagggagggagggagggaggggagagggagggaggggggggggaggggagggagggagggagggaggggggaggggaggggagggagggagggagaaaaccatggaaggatgaaagagattgtttaatgatcaagtgcctgagagttcccctgacatttcttgttggcttggcttggcttggcttggttggctatcttgttctgttcttttcctttgtgtctatgtgtgtcaatgcgtgtgttctccatacctgttcttcagtgtggatacacccttgagcatgtgcgtacatgcacatagaagccaggaggtgacatgcagttccaaggttgcttttgacctgatacttttgagacagggcctcttattgaacccagagtcaattaatttaggtgaccaatatccagggatctgcctgcctcaaccctaaccttaccccaagagtttcaaaaatattttatcatttccgactttctatgtgtgtgccgagtagccagacatgggtgtttattcttatgttgactcactaagctgtcttcccagcttcccccaccccccaaagtttgtacatgcctaaatttttagagtaaattatttttaactttaacagtccctggttgatccatggttctgcctaacctatcactcaagaatgaagcttgttataaagatgttttcatagcaaacttctttatagtctgtgagcgaataactggagaatatcctccaagtgctggaaataaaagcctcacactaaggacaaagccaacagcagaaagccacatgaagtgtggctctgtacagtagcctcagaatgatacagttatagttacatgatacaattacagtaaacacaagtgactgccgggaagtgaggctggagaagagagaggaaggccgggctgactgttaatgagtactatcagaaagaatttgtcttaattgcattggagcttatgataaattttatggaatgtgtgataaaatggtatgcattcagaaatttcaatgggacttctcagaaaaggatagtggcagagggttgtttaaaataaactaaactttacgtcaactaaaagaaagaggagagtggaagctaaagccactaactgcacaaatagttttaactcaaaaaaaaaaaaagataaaagataaaacctttctaactgtgtataataagaggaaaacctgacaggactataaggggagagagggacaaatctgccaacctctttggaattttggaatttacttagcatatctccatgaattttggagagggagggaagataggctgaggaggtggagggagggagggggaggcagagagactgagatacattgaatatgtataagaaaatggaccatctagtgattgccatatccagagatccatcccgtgatcagcttccaaacgctgacaccattgcatacactagcaagattttgctgaaaggacccagatatagctgtctcttgtgagactatgccagggcctagcaaacacagaagtggatgatcacagtcagctattggatggaacacagggcccccaatggaggaactagagaaagcacccaaggaactaaagggaactgcaaccctataggtggaacaacaatatgaactaagcagtaccccggagctcttgtctctagctgtatatgtatcaaaagatggcctaggtcatcactgcaaagagaggcccattggacttgcaaactttatatgccccagtacaggggaacgccagggccaaaaagggggagtgggtgggtaggggagtggggggggtatgggggacttttagtatagcattggaaatgtaaatgagctaaatacctaataaaaatggaaaaaaaagaaaagaaaattcctaaaaatgaaaaactgaagcaaaaagattgttagtatatcaaaagagggagtactgtgagcagcgtgtctatgtcctatgcctagggacaaagcaaaaatagttaaagaaataaagccgggcggtggtggcgcacgcctttaatcccagcactagggaggcagaggcaggcggatttttgagttcgaggccagcctggtctacagagtgagttccaggacagtcagagctatacagagaaaccctgtctagaaaaaataaaaataaaaaaagaaataaacactacttcttatattcctaaagtttgacctttccataaaatataaatggaaaacaataaaaattatatagagaatggattcactaagtgagatgcaaatgttaaatgttaatgcaatttattacaaagatacacgtatataatactctaattttaccaggttaaaaaataacgctagactaaaaatatatccaaaatctacctataaagggtgtgcttataattactaggatgcagagagatttagaaattaaaagagcttgaggcaaatgctaataataagattaatatatgttgatattaaatctaatattgttgaagacaaaagctttattaaagagatgcaagactacatattgtagaatgaaaatttctaaaagtcacacacaagaaagcatgcatgtgcttgttagcaaaaccaaaaactaatatagcaaaaattgacagcatttggcgagtaaatggcaaatccgctctcctaatgagacaaataaaccctcgcctaaagacctgctcaagacacagatcactgggacagggaaaggatttcaacaacacacttgtaccttgggatcctacaggtagatgtggcggtaaatcctatgattaacagatgtgcttttcaaataaatggatagcatttaggagaacgtggtatgtgccagctcacagagaggatcccaacaaatgctgttaaaggggcatttgcatactaacttctgaccacgatacagtaaaattagcaaccagaacaaaagatgacgccaaacatctttaggcatgggaattttcagaacactctcctaaactcacaagatagaaataaaattataataggatttgaaaatgatgcttaaaatagagcaaaattaatatataatttcaaagcttgtgaagtcaagaagctattgtatttagaggaaattctatagttgaatgtttagagggggaaaaaaaaaacccaaactaaagaaaatcaaaacaaataaaagacacaaagtgttcaattaaagtatcaaattagagggttactctttaaatcattaacgcaattgacaaacatgaatccaaagtggtaggaagaaatctacaaatagaaatgataaaggagaagggggctacctataattaatgactttacgatataagagaatataatttacctagctccgttttcccaggaccctgttgtctgaatgtgatttgtgtttatgaaacaccattgctaggttaacagtagtgacattttgtgattaaattgcattcagctggaagactggaaataagattataagtggatagaagttatagttttaaacttcccaaagagcagtgaccagaagctatgccctgcagagttaacctgggatatatcagtgacttttgcatacccacagtgtgattttgttccctcacatctgagattagctccgtagtggttaggatcagataacccccactggatgactaccctgactcaagagagacacccgatcttgctatgtcaacgtgttctgtagctgtgtgtcctgacctttattctacatgtgcctgtaatagttacatgaatgtaattgctgagctaaaaaagcatccttagtgggcataatgactttatgccaataagctgaaaaatcccagctgtgacagttgccctgaaaaataaaacacttttcaaatgtattcaggaataatgagaaaaccaagccaaccagggtcacataagaacttgtctcaaacaagcaaacacacccatatacaaaaacacaagcagaactacaactctacttatgtgcctatacattttaaattaatttattttcgttggaaggcaaaattggtcttgttacttgtcttgttgctataacaaaacaaaacaaaacaaaaatcaaacaacgataaagaacaaaggacttattttggctcatacttccaaggggtgctgtcaatcatggcggggaaggtgtggccacaggcgctggaggtagctgctcccattgtgtctgcagtctggaggtatggagccattgtactcctgctcagtgtattttcttttcgtcattcagtccaggaccccagcccagagagtggcaccaccaaaattaagatgagtctttccactacaattaacctagtcttgagaatccctcactaacatgcccagagactcatctctttggtggttctagatctagtcaagttgacagccttttccattcacagcataaacagtaaaaatacagtcagagactgagaagtcatttcagtaccacatattgagggcaaaaatgttcataccctacaatagagtgaatataattttagccattacgctcaggaaattgtcatatttgtgtgtagagacatgggagagttaggatcgttgtaggaattagtgatcacaaacatatactcatgaaaaggagaactgacaaataccctagaaatgattagtaccagaggatgtcacacagttggttaataagtgagctatgttttacatcaacatgactataacataaaccatgtagaacaaagcagaccgttaacaaaatatagcaacatggaagcgtggagtcattaatgttaaattatgaatgcctctatgcagtgacgtataaatacagccatgtgtagaatagtgattccttgtgctgggggaggggtcaggttgtggaagatgattacatttccacaatgtcttgaatgtttgcagctagttaacttttctgaatcattgactattttatttaaggagagatgcctaaggtataatatcattcttaaagtgcttactttccagtaagggccccgtgataacaagtcattgtagtagagattctaccgaatcactctaggagtagagagcaagcaccgtacagtttcaggcaggggcatgataccttctaggccagagaggtagatattcttttctgaatgaaactctagaacccagtgttcagggttgtatattgtccattctccctcgtcctgtccttaatgaaatccccgtggcatgtctttaaagaaccatggttaggaaggctcagattgggcctggaggtagaccaagtagagtgacatggtcaatggagtttcgaagccaacatacaggtaaagggttgtaataggtctgaaatatcaggtgtagcaaattcactgtattctttaggttgcggggggtgggggggagagtttgtcacaaaaggtcatgctgccttgggtaaccgttgtcccaagaaaatgaagagcagctgtctgagtgtaagtaagtgtgtgaatgtgtgtcgtgtgtgttagagggatgacctgtacagatagtcccagcaacttgagcttgaggcaagaggatcgagagttcaaggcaagaccaagcagcagaaatcctgtctcaaaaagagaagagcgtgcatgtaaattagctttttaaaccaagtatgaaaatgtctccaaaaagatttcagatataagaggactcagggtaaaactgcacgttaggctagacataaaaatcttagctatgcaaatgtgcttagaagagaactggggagggggagcttttggattcagaaagccaggaacctccaacaaagtgggagatgtggcatccgggatttatcctgaagtagctgaatttccacggtacattgtgaaagggacagattgtgaaccggatttgaagttaatggttggaatttatgtaatgaaaatttacaaataattactgcaggaatcaaagcatttactaaaggacttgtgctctaaatatgagatactggtatagcttagagcaagcaatctgtaaattaatggcagcatggaaaccagtagttacacaggaagtacagagacacccatgcttattggctaagggcaaataaagagtaagaggacccagggtaaaaccacacattaggcagacgtggttctggaggaacccagagttacacaccttgattcacaggcagcagaaggggactttcttttataggcagctaggagcagactctctgattccacactgggtataacttgaacttatatatgagacctcagaaacccacctacacagtgacaaacttccttcaacaaggttacgcctactccaacaagaccacacctactccacacctaatagtaccactccctacaggtcaagcattcaaacacatgaatctgtgggtggccaaacctattcaaccaccacctagacccccatgggcttgcagccataatataatacaaaatgagtgttccacttaactatttgtgactaaatatatttcccttggatattggaacatagggctaaaactgtagccatatcattggagtcttggcctctgtcccttacatcaaatgtctcttcgtatctccaataaggacacttgtatcctgatttgtggcacagttttttaatcttaaggctcttgattatgtatagaaagaactaataggttctacaaaataggacttgaaagtatgtttttgggagccactgtttaactacacaactgtaaactcttcgatgtttaaaaatctgtatttcgttgcaataagtgctctggttgatttcatgtttttatgaaattctctctttgtaaagaaaatgttggtcctttttttctttctttatttcttcttagagaaaatgttggtcttctttttcaaaatgactgtgctgtttgatagttggccagcgatgtgtggtcagtccagtttctgtgtttcccaagtagaatttgggggactcttgcattttaggaattacaatagtgtcttagtcagggtttctattcctgcacaaacatcatgaccaagaaacaagttggggaggaaagggtttattcggcttacacttccattctgctgttcatcaccaaggaagtcaggactggaactcaagcaggtcaggaagcaggagctgatgcagaagccacggagggatgttgtttactggcttgtttcccctggcttgctcagcttgctctcttatagaacccaaaactaccagcccagagatggtcccacccacaaggggcctttcccccttgatcactaattgagaaaatgccttacagttggatctcatggaggcatttcctcaactgaagttcctttctctgtgataactccagctgtgtcaagttgacacaaagctagccagtacaaataggtatctagtgatgtcttggtgtggttttaacatgcattttccaaggaaggagctttgaatgtgatgccagccatctttttgtgtgtctattcactatctgagtgccttctttggtggaactatatctgtagttcatgttcaatggacttgtgtgccgcttcactgttggccctccattatacaaagtctaaacagtagttcttcatcagaaggcctgccttcctagcttgccgtttttcatttccttggcctggttattttcaaagcaaaaggttttatttttgaaatgacctgggagaatattttttttttcatacgtaatgtcctcaagcctaaggcctctttgcctagccctacctctagaaggggacacatttagcgtgccatgtttatagcttgtaattaaattaacttttgtataaggcctgacacctagatcaaggccttacatgtggatgtctaatttgtccagcttcatctgctgataagtcattgtttcttcaagtgctgtgttcaagccttagaaggaaaacattgagcctgtgatagttaagcgtaccattagctgaacctttcataggccctcctgatcaagttgagaaagctgtcctttattcccatgaggccattatcatgggtgcttagtgaccttcttgatgctttctttgtagcagttgataagatcataggacccaactttttttttttttttcaagacagggtttctctgtataaccctggctgtcctggaaatcactttgtagaccagcctggcctcgaactcagaaattcgcttgtctctgcctccctagttctgggattaaaggtgtgcaccaccactacccagcaggacccaactttttaataataatgaaaaatactgatctattttctaatgcttaataagctgtgcatctctgcagtaagtccagctgtgttctctgaatatattattcttctgtgctgttgacttatatttgctaatttgttattcattttgcctctatttttaagcagaaccttagtctataatttcattccctcctttattgtgtcttcttcttccttttttttttttttttctatttttgttgaatttactgtcaatatactgctggattcatcgagtgaaccaagaagtatttcttcttctgtgttctgaaataatggggcttgatataaatttcatttaaagtttggataaaattctccaataaaacagtctggcctggcgatcccttctgtggtagttttcaatcatggattcaattgcttttatatttccagagctggtcacatgacctgtgtcctactgagtgagtgatactttgggattttgattgtaagaactggtctgttttatctaagtcatgatactctcatgtgcagagttatttgtaatcctttttccattattcttttgatttatatgtggataaagcaatatttctatttcattactaataccactaattgctggagatgtgttaatttatcaatgttttctaaagagaaagaaagaagttctttgctagattgttgatgtggaccttcagccccacctgctgaggcactgaggtaggaggaccccaagttcaaggccaggttgggcaatgtaaggagacactatgtccaaaaaacaaaccgggtctccatcacattgatttttgtcaactgtctcactcttttcaacgtcaacaaattctgcttgtctcgatcatttctcccatcctgcttgcctccaatttactttgctctcctttttcaaagttcctgaaagtcaaacttagattactgactcatgtcttttttttttcctaatgcacataattagtgctataaatcgattatctgccgggtattgccatggaagaaaatgaaggtttgaaaaattccatttatgacaataaagactatcaatcaataggaataaatcaatagggggaaatacataatctaaccgagtaaatgatgaaccttactgaaagctggaaaagatctggataaatgtacaggagaactctgttaacaggaagacccaggatcatgaaggccacactgtccttaacatcagctctacccattgtgatgagagtcaagtactgtgcagcttcaagacctgggctggtgagatgcggccatggatgtgggcacttgccacccagcctgacctccagagattgatccgcagtgctcacagtgtaaaagagaaccggctcctgcaggtttccctatgacctctatatgcatgccatggcgcacgggcacatacatacacatacacacacaccataaataaataaatgtctaaataatacatatttactacagatactatttcactctcatccgcttaacacaaatcgaatggaaaatatctatcaacacagacacaagaaaataacctaatctcaaaatctacaggtggtactctaaagagctgctgtcactgtgtggcttgtggtcattacttttctagctattcagggtttgatggtatttaggagagctgaaaatactcgtatatgctttgtaaactctcgtatatcacaagaagggaaaaatgaacgcttgttgctatattgtaaatacttgtggatcattgacaaagcctaactgtggtggtaagacaaaggatgagtagattcgagggtattcattcaggaaagcacagagaaatgcagtaaacaatgagagccgtgcctagacgtatcactgggaatcaaactctaaaataagtgttgtcagacatgagaaaatgttatagcacatcacagtgtgatacaatgtgaacttcttatgccttcagacatgcatgggaatggtggacttcaaatcctgggtgcagttcacatttcaggaaacaaaagcagtggaattaggaaggacttcccacaaagctcaaatggtaaccgtgacaccctactccttcgaagtctacctgatagattttgaaaattgccatggctttccattccaacaggatcaaccaactagagaagaattttttttcagtcagcaattatacttaattaaacccttctaaggtgattttctcactagaaggtatgtttttgctaggagagataagtactgtagagacagataaggtgaagggttccaagacggccttaggttcaaacagatttgctcttttaccgtgtgtgggcagaatgagtttgtttctggaaaaagactgttttacttggaagggaggagtcgttaaaaggacctgaaacagaagcatgtgtaacgcaggggaggggcaaggacaccaggagactcaagtagtgtgaaggacgaaagaaatagtagggagagaaagtgaaggctaggttcgaagagaatttaagccagctatggccaggtattgacaatgactttgaacaagataggaagcttctgaatggttttgatcagaagagggatctaatcttaacgaaagttttaaaagaaccacgttgactgcagggaagagatgcaccactagccgttccttctttacagtctggagactgtgaggagaaaaataataagtatggactattttatatggtatttttatgatgttcatgagtttggttctcaatgatcacaattagatacgattgcatctccaattttaccaatgaagaaaagcgaagtaaactgcccaaggccacccaggcatttatctgagagatcctgagttcaaatccaagcagtctaagttttgcacacctagtcgtgttctgctgcctcttgcactgcaggcggtactttgaaaaatgtatggaagccgatctgagtgtgttgcatctttacaggatgaaattgtattagatgcagaaaaccactgctggaagtgcaaagagcagaatcacattggaagtcacttacgtgcatagctttagaggtaatgatagaatccatggttgattactgactttagaggcaaaaatggcttagaaaaaaatatctgaagatattttgttgttgtttttaatcaaaggaaccttaaatgctcaaagatacaaaagagttaacagccacttgccagcatgtaggctgggtgagccgtgattgttcccaggtaatattagatgtaaatacattcaggcatcaaaaagaacttcaagaggtgtgtgtgtgtgtgtgtgtgtgtgtgtgtgtgttggtttcttttgttttgttttgattttggttttttcagtctttttgtttggttgattttgctgttgttgcacagaaaactgtcctgctgacacgccactgtgttctcagtgtctacccgagtcactctttgccattgtgctgaactgaactgggtttcacagattggttccatttgggaagaaggtatttctgcttgtggtttgagattccctccttccctgttcagattttacactgactcctcccatttggaatcaccacgtcacattttctaacttccattcctcccaagaagcagtagccgggagagacaccgtgatggacattagtggccgagtgcgcggttacaaaaatcaataagccacaggatgcttcagattcttaaacagttttttaaaagtgtgaggacactcggtggaatccgcagaagagtaattgtctaaagttggcactcagaatgtaaggactcgactcataattaaaactccttgtccggtgtgagatccttcttttacacatgcatcttgaaaaacacccatcccttgaccatctctgagtgtttcacaaaatgaatgtttttccaaacaatgttgccgttttgtgaaggaacaaatattgtctcttatggaaattataattgcaacaatgttcaacagccttgtgggcagagtaagggaagcctccaggcttagatttttaagacttgaaaccagttcattctggcctctcgcgatgacatcaagtatcacaacctcagaaagaactgcttagtgtatgtagtttgaatttttattaaagttctttcttgcccctggcttgtttcttttcccccagttcattttaatatcttccatctttcattgcataactccaagtgataaacatttattgagtgtcagctctctaattgtccctttaattgaacagagaagacctggactctgtgaattctagattaagtaaacaaaagagaaacctggggaatcctgacaatgcgcatgccccctgtatttatgacttccattcagtttttatctacacacagctgatggagttagcctatatagacacttagaataaaagccagcattcacaaacaaaacttaaacccgttctacacaacgtagaatgagatacagaacatgtatgactgacagcaggcatgaaacagcggactgaaccagagacatcagccggctttaggtgaacggcattggggagactttaaatcaaacaactggaagtatagctagctgtcccttcgatacatttgatagggggtagctctccagcttcctacacacactaatgtttgctgagcgctagctgcagacctaaagggcctttgttttgccaactttctcagtcctcacaactgcaagagggcgttagttatcattatttcctccactttagagagaagcaatggagacctggaagatagaaatcagctgaccaagttgatttgcatgtacccatctcagagcctatgcctcctgtcactaggctaaagcagtttttaacatagcaatcctgtctcagggtcctatagaaaagttcaaaagtgtttttgcttccatcttttgaaatgttagtatccactctatttattggaggtctttcccattctgcacccacttgtggaggtgagagaacatggttggagagtagtcaggtctctccgttgacataaaggtggatcgtgtggttggaatacaggtccttgggcgtgttcaggaagcatttttacctgctgcgccatcttgctcattccctgcacatatctcagatgaggactccttaaaggagaggatatgacaagatagggacctagcaagcatgcaacattagctttctgattcgggatccatatcggattcaccaagaaaaaaaagaatagtttcatttcacacattcaaataaatttcctaattactatgctttgtcattttaaaaactacagaagctattttcaaaatttatctttataagaagtttgggaaaagcctagaaaaaaatagaaagttgtatgctggtaaaataaatcatttaaactatggagctatttactataaagaaaatatgagaatgtaaatttttgaggattgcctgcaacaaatttaaatgctagcaatcactgtctttgcgtgggggactgtgaattattttgtaccttctttatgcttttttttttatttccaactttccccctgctaacttgtttcttgcattataatagaagtcattttttaaggcttcatgaacttgagtgaaaaaaattaattaaagatgaatcccaaagttgatttataattttttaaaagggagtgcttattttactggattataaatctatccagggtagagaatatatcttctacctctttatcgtttcctaaaatacttcttgcagatggtagtaacctaagatgctgttactaacaaaagcccttactgtagacatcctgaaagtagaattaaacatagaaattttagaatttccaaaaagctgtacagagaagggcaggctaggaaacagtgagccacgaaccttctggaagtagaatgtaagaagttcctgtctcagagcgccctgctctgttttcccagcactgcagctgcctgtctaaagcagctcagagcatccactaggctttcaagaagcataaagaagatggtagaaaccaaacgaggatgcaggcagaacagaaagctacaagctagtctttctcgtaatcattctatttttaaaaaatcaaaatttcaccaagccgaatttattaacatatagaaattattgcaaatgatgcttgggtgtggtattctagaaatgcccgagtggcttagcatttccaagtcagtataatgtaccatgtcagccaaaggagagatgggagtcacatgatcatcttgccagatttttccctccaaatcttcaataaactttaatacaaatttgtaataaaaaccagggatagaaaggaatttttacttgattaaggatatctgccaaattatgtagcagaattgaaagcaagattagggtgactagtcttccccagggataagcctgctaattggttatccaataccaagtggttaccccaaaatcatatacatatgcacaacagtaagtgaactcaacatattatatgcatacacacacacacacacacacacacttacacagacacacgcacaaacattcacatacagagacacacagatacatattcacgaacatacacagagacacattcatgcacacacacacacacactcacatgcgtgcacacacatacatacacacagacgcacgcataaacacacgcgggttggggttgaactttgtacccacagatcagtgcaatgcccaaccatcatcagggaaggtgcttcttgcagtaggtggtaatcaacacaaacatccatagctggtcagcatgtaaagaataagagactgaaatgctgagccctaagtgggctatctgcatcacaccaatccctgaaggctcagagatgatggtggaaaaaggtcagaaggattgttaagagcaacggtggtgaaagactccaggaaacagcattttctggacacaaccagccagacgcacaagccagaactcaccaagactgcaacagcccacacaagccttgcacaaactcaagctcaagctaaacaaaattccagtgtgcaggaggatatctgctcctataacacacagggagaatgcaaatcgaaacacctggatgaacaagactaacaagagctaacaagagaaccgcagctcaggttattgtctactgccgatgggactgtgaatcaattcaatggcacttatagaaaactgattgtcagtaaatgcccagagagtacatgtaacctgtgcctagcaggaccattgttctctgtatgtatatctttaccaaagacactttctagaatgtttatgccctatttcttttaacaacccaaatgtcttttaacagtagagggtaaataaattgtgtacagtcacacaatggaacacttgaaggagggagtataaactttctctggaaatgaccagattgtcaatgtgctagtctttgggatctgacttgctgtcccagctgctcatttccttttgttacggcatgagagcagcctggcactgccacactcccccacccattttatttccaacttctcaagttcaatgtttttttggttttgttttttatattgcatatatagcaaaagttattattttggtttttaaaaacaatttcaaaacagaaacatcttactcagctcacaggccatacaaaagcaaaggaccaggtttgaagctctggcgagagtttgctgatccccgctctgtgtgtgtgaaaatgaataaattataactatgttgatacatcaacatgcattagacttatataactttgaataaaaggagatagacacacggggtgcacgttggattatcccgtttctgtgatggtcaaaggtaggcagaattcgtctatgttgtcagaacagcaagatagagggccacccttatagagttgggaaggatcgaaaagtacagggggcttctgggacactgacaaatgctggcccttgtggatgctatctatgcaaatgtttgttcctagtgaaaactgatagcatactttttttttttattgcttcacttttcagtgtgttctttgaacaaaaactttcttaaaatcgagatatagattatgtggagtggaagagaaagggaagggggcaataggaaaacactgttatttttaacttctaaaaagggagagagaaaaatgagttgaaaaaaatcaatggtagatacttctcaaagattactaaaagcgttttagataattttatcaaaaataatggggccgaagagatggctcaggggttcagagcactggctgctcttccagagggcctgggtgtgattcccagcagccacatggtggctcacagctgtatgtaattctagttgcaggggctcctctgcctcttctggactctgtgggctccaggcacacaatgggcacagacatacatgctggataaataacccctacacatttttcaaaataacttaaaaacaaacgataagcagaacccccaaaaccaaactagttaactacatacagtacttttatggagtggctgggaattttaactcttttaataacctacaagttaattcctctgtctcttaaaaataatgacgtagatatctgggctttcctgctgcggaagcgcccaggttactgtttgccttgctaagacccggcatcttctagcatttctatgcctgctctctccaggtcccatggtacagcacttaccatctggccatacttgggcaaccttgagaaaatgggcctttgtactgttaggctatggacatgcagctcaattttcacctttatgcccaaagattacaaaaccattttattaataagctgcatactcacatgtatggtgatttagggtccaagggggttgctactcatgatcctggggtacctgtggggtgtgggtaagagattgcttagctttctgcttctgcaaccagggctgctctatgggattttccactggagaatatagaaggccaaacaagctatttcagaactagatatttcagaactagaacctgatgcaaattttctcttcccatatctcactgaggttgggaataggagaaatgtaatctttataaacacggacatattcgcaaaatgcaacgtatttgtttcccggttgctttttttgtaattcaccttcactgtggcgttcctgagaacggttttaaccggcatcctttgtttgaaacctcctctgtacgtagatgtctcaccatctggaattatcatcttcttccataccccagcacataaggaccattccaagctgatttctaggatttttttccgatactaaaagcaagtatggccacagctgctgtggctttgatacctggtgttatttatgggttttcataaaagggaggggtgaaaaggaaaaatatgctactgtctggcctctctctaccttctccttctctacccccaccccaacccccctaccccctctccacagcggagtttaattttaaatgataaatgtggaaattagagaccatcgagaaaatccaatttggtgaggagttttaaaaatcccataataaacgcggagtgaaatgtatgatttaatgcagggcgccaatggctgctattatgggctattagcaaatcggggctgagagtgaatctttatcacttggtgagtgcggactggtcctgcctctccctctgctattgatttgtagccgcttgtcataatgacactgggaagcaatgaatggaagatgtgcttttgataggattcaggggggtcctgggggggggggagagaaaattcagcaagttttctatctcttctgcctgattagatttttttccttctttttagagctttcacattccaataaaaatgctaaatcagctttgtggcagaattgttagggtgtaaatagccggtcacagttaacgaagggaaagatgcagcgcccaccacccaggctctgcagcgctgggtggatggaactcaacagaaatggggttgcacaatgtatgcaggtgtggccagaagaccacagtaggaagaaatgcgagggcataatgcagattgcaatccttatataaaaatgcacctgcattgcgtgtagtatgcacgcatgtgtatctagtagcttggtgacactatgtcatggaaggtgacctggcttcccatacatgtgtccatctgacaaaaaagatcctttttgcttttgttccacgtgcagcttgataaagggcatctagagaggctacatgcatgattatagagtacattaaatcctgcaaatttgagcattcctcaacatggtcggcatagaaaaagcatacgactcgaggacaaagacaatcacgaggtaatcccactgggaatggaggagattcctgtaaggaaaattgtacattaaaatctttcagaatgaattgtctttggttattcaggaatagttggttaaaggctcaatatgtaaacatgtctcttccatgttttagagcaagcaatagatttttttttctccaaggttctctattctgagaaaatacgccaagtgtccatgtctttgcatggaaaagtgcatgcctgcaggcggcctgatgttagagctctggatgcagttaatgcaggcatggagagacaagaacagccagggaacgtgcagcacgactttgttctgtcaagtgacaaacctgccttctcagtgcgcctcctttctcaggcaactgtgagggagactccattaaaaactaactaactaataaataaataaataaataaataaataaataaatagcatagtattgtgtagaaagcagattaccactgttcaagactggctaaatgcatgtgctggtaaggtctccatcttcactagctaaggaagactatggaaaatcctaaaatagaagaccatatgccagaagaatctttgcttcttctcctctattgtagtggttctcagacttcctaatgctttgaccctttaatacagttcttcatgatatagtgaaaccccaatcataaaattaatttcactgctagtttataactgtggttttgctcctggtatggtttgtaatgtaaatacttgatatgcaggatatgatttgatatctgtgaaagtgtttactcccccagggttgtgacccacaggttgagaactgccctgtaccatgaaaaatgtccacaggctgtcttagaacttagcatctgggaaccaaataacaccggctttaaaaaccctccaaactaaccagacctagtggcacaggcctgtcttcctgctattctgaggactagggcagaaggatcataagctcaagatgtgctacagagttggatgcaaggctcccttagccaacttcctaagacccccatgtcaacttaaacagtcaacagaagcagatggggaaatggtgccttggtagcacacttgacctagtgtgctcctgaggaggctcagtccctagcattgagaaaagaaaacaaaagaagggagtgtgtgtgtgtagggggggcttttaaatgtcagggtgcttgtcacatcttttacatgaaaaagagctgtgttgtgtactgggtgttaattggggtggggagagagaacagaggctattaacatgtgctgtaaagaacctacaggccctgagtcatggattacctggaaggaccttaggaaaccatgcacatttccagacttcaagcgcattaccctccaacagaaagccccacgggctgtacaaacagctgccacagttcctacatccccgcccccatgcaaggactgtgcctaaactgtgactaattaggatgttgccacttattatgtatcatttattaaaaactaattagaggcagaaagaggcctttctccatttttcagtggggggtttgctttattcccatgtagtaagtgattattgttcggtccgcacatggctgtttcgtaccacaatgaattacctgtatcgaagccataataccatatgttcacttcgcctttgttctaatgtaaaagcataattaatcattcccagcgtacaatgaggcagtagtttccatatcgtatgtatatattaagtgatttctactattatccaaccagaagtaatagcgttaagttgtgaagcattttttttcttaccctgcagttttctaacataaaaaagtatatccatctataagctgaaataaataaatattttataacaggaaaatggctgatgcctcgaaacctttatatagtaggatatcagtgaaaagtgctaacattcttgttggttcattatataccagggtcatttctccttttaaagtggcaggatggaatttttcctaccgttgaaaagtttacctgcttagagcttgtcaagtaagatacataagtccagcaacatcgaggcaggcagcggaaggaaaacaaaagatttttgcctacaaatatactgaggaactcaagactaagtaagtccttcttccatgtaaacaaaaacagaaatgcaaggaaacttatatgatagaagaagagttcgaaatacctaggcataaaagagtcaataaatacggtaataaacatgtgctgcaggaacaaacaagatggctggaaatgtaacgccaagtagaattttaaccctctgctgtgcacatcacgtgctttttaggcttttgtggggctgcctttcccaaagtgtccgcggcacggtcaaactccaaagggctctgcacaccctcacattagctcactcaccgtggacacactgtccttgtgcggctgcgaagcagaatcgggcagatgctgacttagccagggtcggttccgagtcggggacactcagagccggaggggggacactcaataacgcaaaatatctgtttgcgttattgtccactgaataccaggattacaggtcctgtcgccttctcgtacccgtttctctgtggtcctgggtttgctggagccctttccaagtttataaagcagggttttgatgacacgcggactagagaaactgtgcttcagtgctaaagagcacccgagtttagaagctctgcaatacacaccgccccttatttatacactttagttttggcttgacgctttgaatacgctcctttgaatcaccgttttttccctgagattatgcacattcgactaaatacctttcttcctctcaagactacaagcaaaaggggaacaaaatctaataaataaatgaattctaatccttcctcttaccgtgactgtgtccttattaccaaagtatgtttcagacattctgtatttacccatgatttggaacaaaatgtttggtgactttaattgttaagttaaatgatattaatacgtaaacatgcatacgtaatatatatacatatatatagcatagctacatattcattagcatgcttattcagctttttgaatatttagattttctagtctgtttcttatgttgcagttcactgtgtacagactcttccaaaaggtgagcaccttaaacccagcactctagaggaagaagcaggcagatctccacgagtccaaaaccagcctggtctgcaagaagagttgcaggccaaccagggctccatagttagagactttcagataggggacagcaggttttattctagccttggtagcatgtgaatttaattcaagatactccgaaggccgagacaacagaaaaatttaatcctgacagtggtaggctagcctgggcaacactgcaatgtccgtatctctcaaaaataaaacacaaggaaaaacacttattctcaaggtaaagtggacgttgacagagttaccattctcagagttgagattctttggtgtctaccagacagtgagggcactaggtcccttcactcctttaaacatgtccgtgctgaagtcgtccgtggctaagggctcgctcactctccttcagtgttgcctgcagagaagcttgtgcttctcccttcctggagtctaaagacacactcaccaagtaactgtcaccatacacaccgtcttaagtatttggattctgccaccctaagtaataagtggccagagactgagaaatcaagaaaggcgcgtcactgctaactttccttttgaggctatgtaacacaggctgacaatcaaaccagcaatcctcctgtagctgcccagcgcccacattacaactgtgaaccaatgacacccatgttgtactttttccctcaaaaaataaaatcgtgttttcctaatgactgtgaaatatattgatgctttatacaaattgttttctctaaaacccagcctttgaatagcagatacatttttatacattagaaacaaaaccaaaatcctcctccagctaatatgctgtcgttttgcttagctggcatttcaaactgctaatcttcttaaactttagaacaattattattattttagaatcgtaaatggtgcttagccttctctgtgggctactctgccaaagacagcctgagggtcagtatgagcagaaccacccatgaagaaaaggatgagcctgtgccacacacaagacagccagtaccagagggagttctgtgtacagattgcaaggcagggtcttttccaactgacaccaaaacctgtctttgagatggaggtagagtttggggaaccacgggggaagttaactgtcctataccctcttataagttcttctcttctgaaaaggtgcagaaggtgggggaacagctagagaatgtgactgtcaatggtaccacgtctctcatagcctggtctcagagtccccactaagcacgcttttcccagagactgtggtttcttgcttctatacgtgctcctgttcacactggttaagtgtgacatgtgttgctccattgtgtatttgaggtaaatagttaaggactgtgttcctcatatttgcttttaaactaatattctgtttgacaaaacataactactgcaatcacttttgatgtttcatttttaaaaagtgtatatccccattcattttatgaagttgaaaaagttgaaattaaatgaacatttttgtcctctccaataaacatttttccctttttatgtcaccatagatgtattttctttttcactccaggtcacactaagcctctttgcattctgctctgttctccatgcccttcattttacctcagtcctcaaaggggacagggtctccaattcatatgtttataatctttgccttttttcctcccattttttctcttgcattttcatttccatttcttaagagactatgatcaaagactgtagaaacacatactctaaagatgactaattttttttctagcatacagaatctatatggacagctgacagttggcattgaaatgtccgcctatcggcagatcaccaacagggaacacttacagctgagaagcaaggtacagcaattataagcacaagcttccaagttagagcaacttgccttcctatgactatgctaattcaaatgattttgtaagtcttagcttctctactcatagaaacaagatgaataatgctaatatattaactcagaatagagatgcaacatttccatatgtgtatccacagtcaacactagatagtgataatactttaacttagaatagagatacaacatttccatatgtgtatccacaataaacactaaataatgataatactttaacttagaatagagatacatttccatatgtgtatccatagtaaacactaaataatgatactactttaacttagactagagatacatttccatatgtgcatctacagtaaacactagaagcatgggcgtggttactcatcatttggatgtggtctagatttttgatgattaatattaatctacttatttcaagatacagtctttaaattaagtatttgatttttgttatgttgtgagtaacaactaaacagtgaaaacagacgtggcatgccctttgacccagaagaactttgagagtaagatgacactagggaggggctaggaaggtggtttgctactaaactggaaacagtctgcccctttgaccttgcctttcactcctatgactggaaatacagtttctcctttaattgggcaacctaggcacttatttctctttctctgaattgctctccatcggggaggtgtacctacatttggaaagaaggttaggttttgggggggttctcttgccagtttgtacatttatctctgaccattcctgtttctcaacactcctttggttagagctagaaacacttcctctcatcattgctctcattttgactttgctgccacaactcgctgagccacaactcactgagcagtgattctatgcatacagcgcaagcataaagggaaagtatgaactaaggtttcttagttagataaccagggccaatgtcgtgctctctccatatactactggaaatgcgtgacgtcatcttgggttcacagtgccatcaaaacacgttacctactaccacagctagccttcatcttttcaaaggcttagtgtcttcataagtaacatggagccagtgacagaacctatccatggaacgattgccatagtcagttaaggtcaagcggctgattgacatttgaggtcagaaggctcctgagactttggttaaactgtggtcttggttccaaaggccttgatattacactgttctttcaactcagaacttagtggccattagacaaaagctatgtcactgacctataacactaaacctcaaatattttattgaaaacagatacttcttataaaatatattctggtgatggttttaacactccaaaatcatccttatatgcccacctacccaaaatccacgtgctttatttatttctctaaatagactacaaaaagacaccttaaaagtaggaacaagataaaattaataaactaatcagaatagaacaaaacaaacaaacaggggaggggagccaaagaaaaagcgtaagaaatacatacaaatgcagaagcacgtttacacacacagaaatgccataaaaacgcaattagaaaccataatctataggcaaaagagatctgcagggttaaagaagttaacagagaaacctttatatgagacaaaagcctccaaaagtaccattggattcattttattggccacctacttctgagcatggggtctgcccttaagagtagttggtatccccagggagactccattgagacaactcatttttcctttgcaagcagtcatcagttggaaatagattctatcttagtggagacttgtttcccttcctctttcagcattgggactccatcgggcttagacttgtgtgggccctgtgaatgatgccatcgtctctttgagtttgtatgtgcatcagtctcactgtgtacagaaggccttgatcactgaatactctctcacctagatgccatcccaacccgggctttagcctttgagatttaagttcccatctactttgaacccatttggcatctctaaacatagatcaaaattcaccacattcagaacaatcaaacactctctcaaaaagcatcactgtgaacaaatatctgaccagatgcaatctaaggtaggctagggttattttatcatgggagataagacccatcgtggcagaaaggcatggccacatgtggcagttcgagagtgtctcagtgacttgtttacatcttagcaggaccaagctagagacctcaagacttctgccagcagccaagttctctatctaggacctacctctaaacacttccatgatcatggtacagttatctgggaacctagtgtttgaacacccaagcctgtaggagaaagtcttacaccgaagtcctaacagttacctaggtaggaaatgagaagaaaggttactcagtgtagaagaaaatgcttgcctacagaccatgtttatttgggatatgattgggatgataaggggaagtatgttatgtaatgaggttggagcatttaagtccagattaagctcggcttagaatgaagtcttaggggtggcaaatcttcctcttgggacaaatagaaaaccttgaagagttttgtgagcaggaggcaaggtatcaaacttttaaaatatcaccttggttttggtacagaagaatgactgtcagagaaaagagtggatgccaggaaaataagagactcctgctcttgtgagctagtaagagatgacagcgatttggcctgtggcattagaatggtcacagacagaagtgatccggtgtgtaaggtacctggtaacatatctgaacagcaaaagtggtaagacttgataaagtgaggatggaagggagattgccaataatgattctttgtggtaactactatccttttacttctagatataggactccctgaaccatgtcctgcgaggccagtctagtagaggtgagttccttcatctttaactttcatgtgagaaactttgttccacttatctcggaggacagctttcccaaacgtcatattcttgactggaagtgtggtttgtaggttgttgggtttttttcatgtttgtttttgtttgtttggtttggtttatttcagtacctgggatgtattggattgacttcttgtctcctggcccatcagctttctgctgagaaataaggtgtcggtctgtgggaattcctttaaagggatttgcatgccccattcttattttgagaagtatgctgttcccttttgacagtgtgatacagcgtgccctatactgtcttgggttgagtctgtttggaggcctttaaattgtctgcatcatccaaggcttgctgagttttctctctcatcttattaagctgctattctgtgtcctttcttatctccccatccaaaggcaaagaattgtctcaaagttagacctggtgatacacaattatactctcagctcttaggaagctgaggcaagaggatcactataagttcaaggatatcctgagctatacacccatgaccctgtcccgctccccccccccaaaaaaaaatcagaaaaaagttatctcagctttttaaaaattgttttttctaatataacattttaggttggtggctttttttagtacattaaataggtcaaatattgtcttccagcttatgccattttgggtaagtagtccactgtgattttgatttttgctttctccgcaataattttcttctctgccgtcttcagtattttattcatgtttctcagctgttcaaatatgatgtccttatgagcatgtgtatgtcctttgtcctacgtggagttctgtttcgtttgaatgagactgtcccccataggctcatatgtttgaatgcttggaccctagttggtagaactgtttgggaaggattcagaggtgtggccttgctagaggtgtgtcactggggggcgggctttgaggtttccaaagacgcacccagtattctctctgcctcctgcctggagatcaagatccaagctcttagctgttcctggcaccatgtctttgctccaccatcatgggatcaaaccttctgaggccataagcctaagtaaacactttcttcctaagttgtgttggtcgtggtgttttctcgcagaaacagaaaagtgactgagacacattctcttccacttgtgctgtttggtctcatttgtggaaagcacttttctatcttgggatttgttccttctccttttctcctccttggtcttgggcaggtgtgtatgaatgaacctgctggaggctgtgccagggtttgaagatgtcctgtcaggcttgtaccccccattctggttgccctttgcttttcactcggccgagtttctaaggccttaccttgaggttcactgatggcttttgccttgtgtgtgtgatgccagttgataagctctgtcatgcccatggaattctcaacatcgctgtcatctcttaatctagttcagttaaaggattccctctctgaaaagctcttcccttgaatttaaatgttttgcagtttattgacttacaggcatcgcgtgtagtgtagtagagagtgataatcatctcacatgacttccgcctgcctcaaaggactgaactctccattctgattgatacaggaagtctctttgtttctacctcttctccagaagcagggtttttccccctaaatcgtaagggagagtttcttgccctgtgaccacatttttatccaagaaaaggacctgagaaataactgatttcatacctccaggaacctgggataggggaggcttccgggagtcaatgctggtgaccttagctgttgttaggcaacagtggggacatggaacctgaagaggccacctcctagagccagacaggacccccagtggaagaatagggacagcaacccaccaacaaaacttttgatccaaaatttgtcctgtctaaaagaaatgtggggatagagcagagacctaaggaaaggccaaccaaaaaccgacccaacttgaaacccatcccatggacaagcaccaatccctgacattattaatggcattctattatgcttgcagacaggaggccagcataactgtcctctgagaggctttccccagcagcagactgatacagaagcagatacccacagccaagtgttaggcagaggtctgggacacttaatggaagaactgggtggggggggggagaaatgaaggccctagagtagataagaaccccacaggttatttaggtgtttatggaattcctttaaatgaagtctctagtctaattctcagagaaacacatgaggactatatttttctcccatcttactagaaaaccagttgaaattttacaaaggtagcttacatttaaatctgactctaaacccagtagagtaacttctgagatttaaagttgaaactagggcattgtctcttgaacagtgtttaccaagaacatactctactccaggcacagctctgggcgtcagaggatacagcagtaaataaaatggccaaactctctacagggtgggcattatccaagcaagaaacagaaaggagtaattacagaagtaagtcatagtccagctaggcaagtacttgggacaaaaagaaatcagcaaggaagtgttaaaaaaaagacttctaaagtggagatgttgtcaggaaaagcaacattgaaaaggttaaggacatgaagtacaaaccatcagacagtctagtggcacaacagaaagaaagtagggcacaagaaagctccagctcctaggggggttgtgcatggcaggtccaaggaggccagcatgtgagagttgagtatgtaaaggagagagcagtggcaagccagatagaaagcctgatcaaggtcactctgagtgtgggaggctgacggagttaagtagtagcattttgatgagaagatagatagcaggtagatagatagatacatagatagatacacagaggatttagatagatagataggtagatagacagacagacagatagacagacagggaaggaaaataaatagatgaacccacacagtgagtagtctggggtgggtaaaaatgaggagactagttagaaaactactgcaagaagatggacaaaccctgacagtagcataaggaaaacacttcttgttacagtatgtattttgagtgtcatttgtattaactttcttaaattacaccttcctcatcatctgtcacctgtgagtaatttagataatgcttgagatcccctatgtcacatttatttccgtctttgttaatattttatagatcaaatgtatttgaaagtaaacagtcacatctgaaatgttctcttctaccatcttctgtgagcagttactcacacactggtgctcaagttccacgtaagccattttggctgatgcactcgccccatggaacccattgttcattgtttgcaaacactgcctgaggagccctatctttttctgaggattaactctatgaagcacagcttgtctcgtcttactgcgcatacgtgggaattatgtgccttaaagcagagtaactttctctaagaccctatggggaatgagacaccaccacccccaaacccctgctcagcattggtggtcattcctcagaaacaattgctttatcctgatatctaatttttcctagggacaaatagcctttccttaaagggcaaaatggagaagagagagagaaaagaaaagaaaacaaagaaaaaagtctgtggccttcagttagccctggacttttggcttatccagttgttaacggttggttttgagagcttataataacaactcctagaattacagtttggtctgtgcttttcatcttcgcagaagtgaattcatctttgtcataccgggttgaaaacgccgaagacacaagcaattggttctcagacctactaatttactggcttcatcaacacatctttcataacggctcttcgcactttgggcagagatgcccaaaagagctggttttcaatcctgacactgattaggagtttatctgagggaacttcacaaagatgagttttagttgtagctatggtttggaagtgtgaaatacagaaaccaggtcctcatcagtccttcagagtgatacaaaatagcaagaccaatttagttgttcctcaataatttaacttagtcttttggcagagtttttagcactgttggtttgctgttcagtccgtaagaacccatgatcttagatttccatttgtttaatgatgctcgtttttttcccccagatacgttttaataaaagtcaattaaatggacttcattttgcttacattcttcattgaaagttaaggaagactgcaagagaacattctaacaacatatgggagtcacacagataatctccaagcattctaacgttactgtcttctttgctatggatcaaagcacaccctaccttccctatgatacactgtgaatctagcattcattcgtcctggtggctttttaaagctcactttcttgtttgtgaaataacaacttctgaaatgttgttagatcagatcatcttgctttattgtatttaatcatatgcagcccatgtttgccaccctcaagctctgagaaagatccttcttccgtgatcgaataagtcagtttacctgtgaagaatcgccattaatcttgcctttttagactgatgtgtcccagtcatttctttttccctctctgtatgctgctactccaaattttagtggcctttaataggatactattaaagttctaggtcagatttgcacataaattttaaccattgtcgtccatctaataaatttctttctaagttcattcttatgcatcatgttttctcccttggtgtcagaattttaatatttaattataattgtggctgttgcgttccagccctcaagaagaaaatagccattaacttcataataccttgcctctgtttttttttttttaattccagttaccatctttcttcattttgctacattcaccttgtctctgttagttacagaagttggtcgagaaagaagctaacacaaagttaaattgtaagcttcatcaggaggaagggccttgcaagcaagggagccctgatggggtttgtggggagagagaagcagaaagggacagaacattatagtagatacagaagttgggacttaaagggaagaagagacttctgttagaacccttgactggagtgttcctgaaaggaatagctcaaattaagaggaagagagagatagccaccatggacaggcaatagagaaggactatgagaacttccacacacaatgggaaatatcagacttttataacctttcaagggatggcaggagttgcacatgtcatgacttatttcaaagtagcccatatgacaaagagtatgtgagagccaggtaggaccataaaaccacagaacaacatattaatgagaggcaggaggtagagaggaaaaggagggaagacagacacgactgtggaatctggccttttagaattaccgatctcttaaagggtcaggcccaagttctaacagtcacttcagctaagaaaattaagctttgaactttttttttctcccttatctaatcattttgattaactgggcagataaaacagactcctggtatccaccaacccaaaagacaacaacaacaacaacaaattacggaacactagggaggtagcagcaaagtagaagtaggtaggccttatgcatccataattaatttggttcaagaaatttactgaatgggtgaaaaaaaaagtctaattttatgctatctacaaacaatgtccctacccacacaggcttgtaacggaccctctccaatcgggtaggatttttcttccccaagggaaggcaaagaaactctaatttcccccctgtcctttatattgcagttggtcataaagaatggctgtgaccaagccttgtatggtcactgtcctcattccaaagatgcatgcccagtggaaggaatggggcacagcagggcccacccagtctgctcagtgacatctccatatgaaacctcaaggtactggattggggaagcttccagacagctgacctcaggaaggttcctggagggtggaggggcacctgaagagcccatgcaagctctgtacctaagccccatgaggaagtgcttccatgaattctcggagtccctcaagcaaatgaatcaaagccaaagggcttatgggtaccacgattcattgccagtcagaaacagaaatgcaacagccaggggcttgtgattggcatctgctatgggaggagctgagccttccatctatagcgtggcctcttccttcaaggcagagagtgtcagatctgaactgggtcagaggacacttcgccagtctgtcgtttgctaccactggtgctttctgaaagggagaagtactcacaccttctgagcttgcaggactcttctgtgtggttgtggtgtggaagcggaggaggcaggcgggaagcaggggaaggcagaatggttttgtttatatgacaggtaggtagacgatgtgagcactgtgtgtttatatggcatgtatgtgtacaccgtgaattataaaaacactgatgaaggccattaaactagactaaaaagaatggaccatggtcatagttggggaaaatgaaaactattaaaatacctatactacgggctagagagatggctcagcagttaagagcactgactgctcttccagaggtcctgagttcaaattctcaacaactacatggtagctcacaaccatctgtaatgggatcccatgccctcttctagtgtctgaagacagcgagagtgtactcatacataagataaataaatcattttttaaaaaaaactacagtactcattacagtttgaaccttgaatttccccaaaggcctgtgtgttgaaggcttggatttcagggtatcactgggaggtggctgaacctctgtgaagtgaggccttatgggtggaagacccttgaaggggattctgtggacactggttccttttcggttcttttgctcttgggctcttggcatgagcagtttcattccaccatatactcctgccacaacgtactgcttggtataggcccagagcagtggagccaattgatattagattaatatcttaaaaataaggacccccgaatacacttctccataactccgtcatcttggaggtttcattattgcaggaaaaaaatgttcacattactcaaagacagtctaaaagttgaatgcaacccctataaaaattgaatggccttttctcacatcactagaaggtcaatcctcagattcatatggaaggcctgtgtagtgacatcaaccttggacaaaaagaatagaactaaatttaagttttatactcactgattccaaattatattacaagacatatgtaagtggaatagaatggagagcccagaaataaacctgtaacttactaaacaactcactttcagcaggcgtaccaggaatgcccgggggcttgggggggggggggaggatggtactttagttcatagcagagcaacacagagtatacacatgcaaacgaataaaaacaagtgttcctaccacacacaaaacttagcatggattaaaaacttaaacataagacctgaagccacaaaagtccaagaaaatttacgataaaatttctctgtctttggttagctgcaacttaaggaacttatattacttaaaagggagagagggagaaaaggagagaaagagacagagacacctgtcttggaaaatcaagaaagtaactaaatagacatttcatcaaaaaagaaaaaagctaccagacatatgaaacagtattattattatccaaggttaatcattaccagatggctacaagcaaaaatatagtgagatagcctctcacacctcttaggaaaactgtaatttaaaagataagagacaagtgctggcagggaagtacaagaagggagctacatctgtgtgagttgttactgttgttagggacaatgataccaaaagattaaaaacaatgagctgtacggtgacctgaatttggggcatgtttagaacagaaaagagacgggtgtcttgaagagacatttgtacttccatgttcatttaacactagccaccatagccaagatatggaaacaatctaatgattcatcaaaaggatgaaaatactgtggtatgtccatataatggaatattaatcagttttgaaattttttaccatttatggcaacatgaatggataccaagttcttgatgctaaataacataatccaggtacagaaaaatacataccatattatctgacatgtatcatctaaaaaaaaaaaatactgaactcatagaaattaaacctcgaacagtagccaccatagaaggaagaagtgtgatgtttcaaggcacagaacttcagttagattggaaaaagaaagttgagtgatttaccattctacatagtactatagctgacagtattagctacttaaaatgagccatacaagtgttcttactatagacctacaacaaacgtacagccaagcaaaggaaacttaggagcataaatgtttgtgatcttcacaatgctgggtatttctcgggtgagcacttgaactcactaagagctgtatatcaaaacatgtgggctgtttgcccattaattatacctctcaataagatagtttttttttcctttagaagaagcaagtatgcaatataatcataggttgtgtgtgttagatataattttatgacagattcaaatagcaaagtagtttgtgcagagagcagctcctggctttttctagacaagccagtgtgttagctgttgtataggcaccaaggatgtatacttgacttggtgaacccaaatgactgaatgtgaaggcctggaaaagaaagaagtctacactagtgtatacagaacatgtagaagctcgtgactttcacaaagcatagaacaataactttctggcacttgaaattataaagagcttaaggtcctggacagtcgtgctcacaaaggcgagaaacaacgctcttcctgtgtattcagccatgggagaaagaaaggccctatcattagtcgcgtcaagagagcgccagcgtttccctagcagcgtcctgttcgctccagctgttgaacaacctgagaggcaggctgtgtccttgtgtttcagagactgtacacacttgtgtccgccttaaagccctcgtcctcataaaactctcatccaagcatagctgaactgcaatcttgtttgagaaagtgcatctggccctacgtgggctctgcgcattccatccgaggttctcacgcttcagtgttgggcccgatctcctgggctctcttccccattcctagcactcgctaacactaacatgagatattttatgggtcgaaagaaagaattctgcttttaaaagggggttgaggaaaagtgatcctgtggaaagaatgtggctttaacgcgtaagagacacggattttagcttccattctgttattaactagccatgtgaccttgcgtggatcacgttgcccctttaaatctcaaatgattcttctttaaagtcaaagaattaggctcggctatctgatctctctgtcggttctgtaaagaagggagagcttgctttgttttatgtattaaatgggcatctagattaatatttattagcttggaaaggggcgtccataaagcctttgcagattgctgtgcctagcagtcctttctctgctctgcatggactcacgggatcaaagaatcactttgggttcactgaaggcttttggcatatagatcagcacaaaaatggtgtgacattgctgccaactgctccccgttctgctaggctggaaatacatagctaacgcagggattttgtaaagcttctgcactggccattgtttatccatcattgttttagaacgtacttctcagcaagccgtttgcggctcatcgcctgccttcctttgtaagccataaatatttaattctttaataaactgcttatatgtaatatagaatgactgatgctcgtctcccccgctgcctcttttaatagtgctactatttgcaaaaacaagtcttatttctctctaagcagcagcagtgcttcatagatgcttggctcttttcctaagtagcagtttattctgggatgtagaggaagcgacaggcagaaatgcagacccttgctctagggaacacactttaactcttccctggttggtgcccttggccaaactgcaaaccagtcgggtaaaggagatgcactctggagttaggtgggacaacagttacctcgctagagagcagcgtcaaaaactgttcaaacctctagaccaaatgagtaattacaagagtaaacgtgccccccctcccatgttctgacgttccttatcatttataaatgacagtcgggaatagtgcaccaacaccacagtatccctctctcttttatagctttatgctataatatcgaacatcaggtaagttgctttctgtggcatggttttcaatatttaaagactcacttttaaaaccaggtcggttgggtatttactgggcacagtgtgtgtgcctggaacagttgtcaggttgtttacaagcaagctagtgttgcttttctaggatatttcagtatagttcatgtcaatagagctctgcaaatcgtgaactcccccaggggagggcagaaaggatgaagtggaaaggccaggacagatggcttttcagtgtcagatacatttggaaaaagcagtgtttctattttctatcttgatttacatgctgcatgcatgcaccctgaacgggctctgacttcatgcctttaacctgccttttcatatctccccgtttacacagacatctagcatacagtaggtcctcaaaataccatcaactccctacctacacgtccactgtgaagatcatcgagacaaaataaaaatgaccagacatgatctgcaaggatgccttctgtcttttgtaagcaggcgtttaatagtggtggcgtactgctttaagaaatacacacttacatgtgaggctctctgtttaactaacatatttctatgaggagtctcatcagtatctttccttataagttacattcctgatctttttttttttttttttttttttttttttttttttttttttttttgagacagggtttctctatatagccctgggctgtcctggaactcactctgtagaccaggctggcctcgaactcagagatccacctgcctctgcttcccgagtgctgggatgggattaaaggcgtgcgccaccacacccagattcttctttttttttttttttttttttttttttaggttcttgatcttaacagagctgattttcttgtatccatgtagggaacgcagtctcatggtctttgtgccccacctacctttatatgaaaccactgcttaattcataaaggatctcagtttttccttcatccatcagtcacataaatattctcccattgcattctaccccaagcataacggcctctgacacccatagtacagctttctacactgagcactggaactggaaaaggacttgagtgtaagcccaggttttcctggccactccatttcccatggctacactgcctagcttgcctctgaccccagcttcttgctctcttcctgacttaatctgtaacattggaccagccttcatctcttatttaattcattagtttttatacaaaatttcactaagatgttttagtcagtgaaaaataatagataactttacttacaagaactttattatattgtttctgagttcttgctaattctggatattgccttgagattcttaatttttcctcctcttaatagagctctgaggggccaggatttctaattgaagaagaaaatgaagcatatacaagttaagttgcttgtcttatctcacctagctatcgtgtaagtgaaactgagacgccaatacagctcctactatttcacagcatgtagttcgccatgttgcattgagagaaaggaagaaaggaaggaaggagggaaggaaggaaggcaggcaggcaaggagggaggaaggaaagggggagggaaggaggaagcagagagattcattgtagaatttaaaaatgatagtcattatttctttgttcatttaaaaagtagcactgttgcagccttcgggatagggaaagaatgagtcttagcagctacatatccaacagagggctaatgtccaaaatatataaagaactaaaaaaaaaaaaaaaacccaaaataacccaattaaaaatggggcacagatcaacacaaagaattctcaaaagagggaactccaatggctgacaaacacgtaaagaaatgtccgacacccttagtcatcagggaaatacagagaaaaactacttagagatttcatctgacacctaccaaactgtctgaggtcaataaatgccactgagaatatggagtaattgttggtgggagtgcaaacttggacagccactgatgaaatcagtgtgggggttccttaggaaactgggaagagatccacctcgagaaccagctataccacccttgggcacctaaccacaggatgcttcatcccaccacagacatacttgctcagccgtggtcattgctgcttccttcatgatagccagaacttagaaacaacctacatgtccctcaacagaaagaaaaatacattttaaaaaatggtacatttacacaatggaatattactcagctatttaaaaggaagaaatcatgaaattcacaaataaatgggtggaactagggaaaaaaaaaccatcctgagtgaggtaactcagcccccaaaaagacaaatatggtatgtatttgtttatatgtggatattagctattacctcaatgataagcacgctacagtccatagcatcacagaggttagagataatttgagggacaggtgtgtccccaggaaaaggaaatgtactagataattgtggatggacaaggtggagaacgggaacaaaagaatcaaacaggtgaaggagagagaagatgggggacataggagggaatacagagagagagacagttaaaattgagggccatcagaggggtaatatggagacctaacaccgtagaagcttcctaaaatagaggcatgtataaagatgatctaaataaaatcaccaaataacaggtgagacagacccccaactggacatctcttgtcaccagaacaagtgttcagtaccaggattgggttatacctaattgagttgttggcaaaagtgataccatgggaacccccaaacagcccaggctgttgcgaaggctataggttgctctccgtgaactgaaggcaaggttctgtggctgacacaacccctccacagcttactgagcacaggggagtcaagctggtgcctacacagaaccttccccctttcaggaaggtgctctgcatgctaccaagtgagaaacgcaaacaccaaccacgcagccccaatcccttcgatctacaacagcgaccttcatgggagacacagtaagggcaatagaggcagttgtgggggtaaccagccaatacctgatttgacttaaaggccattccagagatgaaactcatactctaaatggctttggtgaccatgaacctgcctgcatagtccagggtcctaggttagaaccaaacactaatgttctttaaaaaaaaaaaaggggggggtacctataaaatgactgctaatggcattctgctaaactcccaggtccctcccttgcccggtcatcaccagagtcatcatcattcctcctgcagcagatggggacaaagacagacaaccacagcctgaccctgtgcagaaagtgagcggccattcttggattagaatatataaacttaagttttaatttaatgatactaagtagccactccttgtagaaaaattaaagcgaaattatttcaaataacttacgctccccaagctcaaattggcttccttaataacatacatttgattatcttctctatttctccctaagataaaatcgcctacccacaccccctggtcaggcttaaggttctaataatatttttgtcatagttttatgtgttttcatcttgtgtgttggctcgccattggactagcatttcattctttcaatctccgtgttttcaaagtataacctattcatactggctcaatcaattactttaaacaatccgtacgcacatccccctgtttttttttttaattatctcctaaagagcacacatgacttttctacatcaaacatgtatcagacataataaatgataaacccacagttcaaatttattggcaaataaaaataaaaataaaagccacttgaaaaacatgcatgtaaaaacagtagcactgttcatgcgggaaaacaatttagtgtcggtgcatagtcttgtgatgcctttctctgaaatatatgtatatattatatatacatatacatataatatatatatatatatatgaaagtgctctgtacagtggaagtcttaggcaaatacagattgtaattataattatggtaaggaatttgaagcacctttattataaccctgctaattgtcatggactttaaatcctacgtacaagtatgtcatgccaatttaaaaattactattttaaatgcacaaaggcattgttaattctggataaggcctgtaacaaggcaaagaattgatttataatatgactaattccctaactgtggttcgagtctttattttataatcattagaccttctcaaaggaatgcattcttaaacaatgctgactgatacctctaattgcttaaaacattttttttaaagtcatcatggaaaaaaaaaacttctaacttatttttgagaattgaagccatcattactagagctatacaacacagaatctctgtgtcattatcaatttaaagcctgaagtattttccctttacactgatgaaaatggacaaccagacagttcattagaaaaaaaaaaatgtgtccatctgtaaatcattccctattcacgtagtcacaaaacatactaattttatagtattcaagtttggaagctctcggggacatctatgttacctaatattctccatctcctcttatttattgtcaaataaggtaacatctgattccattaagatattattttctgtcttctttacagagaacaatggaaactttaagatattctttggcagtcgattcttagtacaggacagtcttcagcttacagattccttatatatcctttaagcctaggcctattaaccccttgttttaactttctggaaatgctatcattgcttcatacaaagtttgaaatatagtatgcatgtatctgtaaacagaagcacacataagcactgtgacagttaaaaaagaaaacattttttttaatcccaaagttgactatttagttacattttcttctgtagattatattcttgactgggaaataatattcattaatgactgtaatagcaataaggggcagaatttatgtggataaacattggaaagcaactgaatgaacattaaaataaggatcataagtagttgccttagagagatagtcaataatttgccaggccaaataaatgatacggtcagcttctataactctgagttctacatgcatggatttaaacaatgaaagtttaaaatacgcaaaaatttgtgacttcactaaacatgtacaggattattttttgtcattccttattcaatagggtataacatgacaaacctatagtcaatattgtattaaagaggaaagacttaaagcaattcctgtagaattaataaatcaaagataatcactgttgccactcttatttaatacagtatttgaagtctcagccagagcaataagctaaggaaatgtaattaaagaagtacaaagcagtaaggataaagtagaattattcttatttccagataatatgatcctataccaggaatagtctaccaaaccttaaatctgattacacttgtaataaggtggcaaaccacaaaggcaacataaatgcagttgttttccatcctacaagtcataaataggtttggaaagaaattaacttagattaaaaaaaaaaaagacacgaggcaggaagcagggtctgagtgggtgaaagactttgacaatgaaaactttaaaatactgataaagtcatagaggacttgagaagatagacaaacctcttatactcatgggtcagaaaaaaaaattgtggaaaacaattgccaagacaataacccagatttgatgcaattcccatcaaaattcaaacattgtcacagaattagacatcatgagacacaatttcacattatactagagactcacagtaacaaaccagcatgatactagcatgaactgaacatatgtatcaggggaatataacagaggacctagagatagtcttgcatagctacagccatctaatttttcaaaaaacaatgatgaaaacatatcggaggaacggacatccttctaactagtgattctgggaaaactggatacgcacacagagactcatgcaactaaatttcagtcactcaccctgtataaaaatcaaagtttaccaaagactttaaagagatacctgaaactcccaaatactagaggagaatttagggaaaacattttaagctaaaaccatagtgactatctcttctaatgccagaaggtgctgtgcaggctcttctaaggagaagagtgtgtttgtggccttacccaacctggaccctgcatgctataacatcccaggcaaggtgtgctcactggtgcgactgtaaatgttacaaagagtaaccaactgcattctgactgcatttgaagcctcccccacaggaaagaatccattcctaaaactgtagccaaaaccaagactaaggaggttatgggctagaaaaaaagaacccactctcattgttttactgaatgataatattgtcaaacagtcttctagatatttatgattatacccataagttaggactattatcaattttggtcagtggaacttcttttttttgcagtggacagcagtttgtgaagagagtcataactggtcaaagagccaagaaataaaacttgactctgtgttcattcctgaatgggatatctgtattaacctcccacccagggctcaggaaatatcacaaaagatggggaagagagtaagaaggagaaggggggtggggaaggagtgccatgagaagctgtgttctggagctggtgtaacagtgcactcagggactcatcaagccagtcagcactccatcctgggtggaggaggtgctcacaggaccccagcactacctgaagagctagtgccagttgatggccgatgcaactgtgatccatggtaggctgcccatgccctgatggaagcctcagatccctgtacttgttggcagtactaaaggactcaatgagttacactaacaagaaagaacaggaaggtgagaggggcgacatgttgggaggtgtcgggaaggatgagtgagcgtggatacaatcgagatacactataaacatgggtgaaattgccaacagaataaagacatccagcagttacagacgtaggcagggacttcattaacaagattccattagttcaagaaataattgcaagtattgacatctaagcttatagaaattaaaagacttctgcaagccaggcgtggtggcacacgcctttaattccagcactcgggaggcagaggcaggcagatttctgagttcgaggccagcctggtctacaaagtgagttccaggacagccagggctatacagagaaaccctgtctcaaaaaaaaaaaaaaaaaaaaaaagaaagaaagaaagaaagaaagaaagaaagaaagaaagaaagaaagaaagaaagacttctgcaaaccaatgggggtggcggaaaatcaacagaatggagagacagtattgccagctattcatctgataggatattaacattaaaaatacataaagcgggctggagagatggctcagcggttaagagcactgacggttcttccaaaggtcccgagttcaattcccagcaatcacatggtggcttacaaccatctgtaatgggatccaatgccctcttctggtgtgtctgaagatagctacattgtactaacatatataaaataaataaataaatatttcttaaaagtacataaagaactaaaagaattaacaccaaaagagaattagccaaccaataagcaggaaaatactcagaacccacttcctaaaggaagtgcaatacatactgggaaattttccagcacttgtagcaatgagggaaatgaaaaccaaaggttactgaggtcccatctcactcaagtcgtgatggccttcatcaagaaagtaagtaacgccaagtactggtacagactagtgtgtaaaagtagcgcttatatgccatcgacagaactataaattatctagccagtttgtaaatcagtaagggaattccaaaaaagaaaaaagctaaaactagagcttatatgatccaaatttagcactccagagtatatgcctcccaataattaaagtcagcatatcattaaaatgcagcacccccatggctatcactgttctgtgtataacaaaggtgtggaatcaacttaagtgcattgcaacagatgacttttaaaactcagcacgcacaggcatacacacatgtgtgcatgcacacatacgcacatgcatacacaagccccattcaccacagaaaagcgtaaaaccattttatctgctgaaacaatgatggtattagaaatcatcacattaaacaaaatcagccagactcagtcagacaagcgtcccatgtctttgctagtgtgttgaacgtaaagacaaaaaggcatgaacgtagacgtagaaagtgggtcagggggtggagcaggggtaaaagagaatgatgtgggctggatattgataccacagtatatgcacgacaatgtcataatgattcttatcatcttatacaatcaacatgctttaaaaagggagggagagagagggagaaaggaaggaaggaaggaaggaaggaaggaaggaaggaaggaaggaaggaaggaagggagaaaggaaaagaggaagggaagaaaggagggaatgaaagaagaatggggtcagagagggctgaaggaaggaaaaggatggaaggcaggaagccagaaggcaggaagcagacctatagctaaccagatgcttgagttactatataaggtcttttaaatggcaccagggtgtcatttcgaaaaacacaatatgtcttaaagatgagagagtgtatggttatgaagtgttgagtggatattctagaattaaaaactacagtaacataaattgaatcactggaaatagatgaagaaaggatcattgagcttattaatagagcaataaaaatattcaagccaaagcatgagtaatggaaggatgcataacaaaaaaacataagatctataaagtacacaaagctcctaacacgtgcatgtttggaatcttacaagtaaaaaagagactcctgtagagtccatattcaaattgataatgataaacaattatatagtggaggaaagatctccatctgtaaaaatcctatgtgcaataaacaaacaaaagcacaactagttacatcaataaaactaccaaagataaacaatggagagaaaattcttaagcagaggcagagacagatgtattaccccaaagtcagcaatacaaccgacagcctacttctgcagagcaatgatgtgcctaagagacaatggaacgccatcttttaaagggcagaaggaggatagctaccactgtagaactctgcactcttggaaaacatccttcagaactggaggtgagacaactttaaagacaaacagaaagtagagcaacttaccaaaatagatctgacttaaatacgattataagttgtcagggagaaaaggcaatttcaggaggaaatatgaatataaagaaagaaacaaaacacacgcatgtcgatgagactcagttaatcttagccgcataatggaagaccatagtctcttatgaagttaaaaatagctgagctgtaaagtgcttgtcagtaataacacaaaaagtggggaaaggtgaaccggacactgcctagggtgcaattggttttttggtgtgttctgaaagtacaagttgaccacaggctgcaatagatgatgcatgctatatttagagtgacatttaacatgttactgtcacactaggaaaaacaattaaacaaaaaatccgcattctcctttcttatttcttatttggtcctgaggatcaaatctaaagcttcctccagtactacaaaagctggtcttggtggtacactcctctaatcccagtatcaagaaagaagcgatgggaggctcaggagtcccaggtcatccccagctatgcagagttcaaggccaacctctgctttatgagactctgtattagttttttttaaataaacaaaatctcacatatactagcggattttagggtcactgaaccacacccctaggctgtgaaaaagaaatattgatcctaaataatgcaaaaaaaaataatggaaggacataaatatgatcgagtaaacagaagaaatgataaggtaatttgtattaaatataaatgaatgcagtgtaccaatcaaaaggcataattgtctgactggataaaagatccatttagcaaagagtataactaatgaaaagaaatgatcatttttaaaatccagctatatcagaatataatacaactatattagcctttaaaaatagacttgaagacaagaaataataacagtatagttagcactgttaacccaagaaaggaaacaatcacttgaaatctatgggtatttactttttaaaaatagcattaaaacatataaaacaaaactgaaaaactaaaaaactaaacatcatatacagattcacattgtattgagagccttcagcaaatctttttggtagccaaaagaaaaattatcactaatgtaggtgagctggcatggctcctgacgtaaactgtctataacccagcaatcacaagataaattctttccactaaatatttacccataagctagtgtcaagattaatgaaaagattgaaattgttcagggagtcttgtgaccacagagatctggaaagttattttaagacaccagaaatcaataaataggcaaaggagtcagctaacttccacaggctaatccttgagccccacacaggtcccatgacaggcacacaccacaaacacacacacaggccacacatacacacacacactaataagtctaaaaactttttgaaaaatgtgtgaggcacaactaaagcaattattggaggtaagtggatagctttgtgtatctatgttagaaaagaaaactataactgatactgttatctaacactgtaccttgtaaacatagaaaaaggacacggttagtagaagtcaagagaaaagcatcagcaagatttgattctttgaaaagactagtgagattgtttttttttttttaaataaatcaatgatgaaaaggagaaaatataaatcatgaatatagcaaatgaaagaataacgtctctgaagttttcatgaatgaaaaacaattgcataccatgacattataataaacattatcccaattgtcttgataactaagataaaataaccaattggggatgggggtccatagcttaccaaaattgacaaaagaaataaaaaatatatatagtcctagacacttttttaaaaaatgagttagtaattaagattgtctgggcctaatagctacattggtgaattgcatccaatatttaaagagaactcctaacaatcttactcgaagtttcagaatatactggagaaggaattctcaccaacccattttacgaagccagcagtaccctggtaacagtaccaaaatcattacaagaaaaatcatatactaatatctctcattcgcattgatttacaaatccttaacgaaatgctaacaagtcatgcatcatactatgtaaaggataagtacatcgtagcaaagtgacatttgtcctaggattgcagggctcgtttaacagtgaaaatcaatcatcataatttgctgtgctaacagctttatttaagctcttacttgtttcagtggaagcaagatcatttcacaaagcttagcaatcactcgtgatttaaaaagggaaaaaaaaaaacaacactcttggtgacgaggaacacaaggaaacccaacgtagagcatgtgtcttagtggcgagaaatgaaagcctacagtaagtcatcaaacaagcaatggtgtcccctaacaccggaaacaaagcaagcgttctcgccccccccacacacacacccattcagtttctgcagagttgagctgcatggcctcattcatgaggtaagctaaatgagaaagaacgaatgtgtgtgattgctgggaatgaagataacagccgtgcagagatggatggattgtgtttacagaaaattataaggaatctgtaaaaactataatttgcatttttaaaagtatgctaatatattaaaatctgagcaagctattaccatctgggaagctgaacaggaagtcagtagcagtcattacagatttgtgaataaggtttatgaagagtctgggggtgaaagagactatccctttatgaattatttaggtatggataactgaacatagttaatgtccttactattttgagtagaacttctttttttaagactgacttggtcagcgccttatcagtgggatcaaatgttgaccatgtctcagtcctgtgcccttctcacaaactagggtagaactcttatcagaccacagatgtcaccaacatgactggcatatatattcatttgagaggagtaaagtaaataccacataaatgatctgcagtcggaagtcagactgaagctcatacccacgtatgccagggcagcatttactctatgtgcctagttaatctttctcacgataccttgtatagctaagaagtaaacatttcccttttcttttaactctctcaaatactaaacgatacaccaaaatagcaacaatagcaataacaaaatttaccatgtatttaagatgtgttatttacagactctgcaccaagtcctttacgtgcattatttccaaatttaacacccacaattctggcaatggagaaataagaggttagaggctagaataattaagattaaatagaaattttccaaagagccttaattctccattctttgtactttgctatactgtaacaacacttacatgccatgatagctgaagagtgtgtgtgtgtgtgtgtgtgtgtgtgtgtgtgtgtgtgtgtgtgtgtgtgtgtgtgtgatggaaattatggagattgtaggtgaaaaatcacaatttataacataattacaattggacctgttctaggccagccttaagtagaaaagttgtgcagatatacagatcaaatttagactttgttcagataatttaaacaaaagatataaatttaacccgtttatcaaagtactttggactatccacctggccaagaaaatcaacaaaatcttccatctaacttcttgcttcaccctctgctacccctttgaaacctgagaagtggtacaaatatgttactagctctgaatccacccaacagactcagtcgctgtctgcctacctctgtctatcgtaaacatgcactgaatggagactcctaatgccagcactccgaaatgtcagagaagcccagaagacatcattaccctgagaaccaaccagcaccgcaattatcaggcctccttaagcagcggatgatgccgtctgctctttagcaacgcactcttcgatagcaccaagatattccttcttccacaaatacctggaccaggaggcaatctactgcatcccaaaggagtagctgtgcttttggcttctgggctgaagaccactgagggggtaggggggtaggcaccgagccgctgctgctgttgccgctttcctctgcctcagacctacaagggcccgctcagtgttcatcttggtgaaccctgatggctctctggatctggagcccacacctgggaccagtggagcaaagatggcttctgacagcttcctgtgctaccaaaagcctcgcagtggctgagtagcctcctcttcgtgggttctctcttctcccctcccttccacatccaagcccttgtttagtcccaggttccattagaaatgctatttgggcagcaaatttcacagattggatccatctcaatgctctcatgcaaagaaggcacatctgtctgactcttcgtttaaactaaggggaaaaaaaaaatcaaaataccaaaatgccgtagccgctcagagctgtctcctaatgaacctgtttgtcccatgagctgtagtgaggcgcttgtcctcggtaagaattctttgtgcatattaatattatgcatgttttccatgtgactcctcacttgccctcaccccatcctttgaattcatttaaataaaaataatttatgtggacattccttcagtcaggattttctctttctctttcttaaagacatccataacactcagttgatgctttgcatccaaaccaagtcgttatgcctttgcatgtcattagagctttataaagaacaacagcgacatctgcatgtgccgaggtgccaggagataggagaaaaaaaataccgaaaacaaaactccacactagcttggaggctctttctccccagcagcgcctgccaccactgtggataggagtaattgtacagtgtaatcacatcatgtctcatctgaatattcatagcagagacaaagctttggaggataagggaggagtggagataatttaaatataagccagtgtctcatttccaaatcaagttgtgcagttatgccgtgcaccaggattcaatattaaaccaacaccgtttcacagttcgaaaataggacacgaagaagacggaaggggcatggtaaagaaagagcggtattacattctccttcttggctacggacaaaacaaaaatggacggcaacagaataaaaaatcgttaaagtgatatttgaagagtcaccaacagtggctaaccagctgctggtttaccaagaatgaaatagcctattgagggaactttaaaagccctcaattaatatgttgagcatgtataagatccacaaagaactcactgtatttcccacttccccccagacatccccagtactcacaactccccgaaccaccacctttcttttctgtcaggtgtggggtgggggaaagatcagagctacacaataactggttaacctcttcaaaactgcgacagcaccggtcttcacaattaaaggacaaaaacaaacacaaataaaaagggtgacttcattaatgaggggataaattaccaatgacttcttcactctctttagcttattaccccccaaacaaaacaaatataatccacatgttaaaatctcttgtcttctttctttgtttttggtatgacgttctttattatgattttttttaagtgttggtatttgtagaagctcctgccactgtgttccccaaagagctactagtctcagcccactggagtttatattcctttaattgtctagtgcagggacattgctgccgatcttaaaaatataccgctctgcaggaattagaggaatccaaggttgtatccaacttcaaaggtttccaagtcataatgattttagaaaggcagaagacacatcatggaaggaacaagcccccgtttgaagataagcatcatagggaatctctttttccttccctgtcttcccaactttgtgctcctctcggctctgggtgccccctcgctaacgtagtttaatgatatgcaaatgaaatatgcataaaaccatcctactgtatgatgattaaacactggagacattaacagcggaggctttactctgtataataatccttcccgaccatccacttcgattgcggagttatggaaacccatagcagttggcagagagaggggaaagagagaaggaagaagagatgcaggggcacatctcccactcggtgcttctcccactcccaaggagctcccccaacctttgtactgcactagtgctgtcttttgtaatccatccatgcagtcgcaccagagcgattaacggggggaaaaaacctcttttctcttaatgtttcaaagctcattagccaaacgattattcctcattaacagcgaaagcttattcattaaaaggaaggatatgcccaaaagatgccagcgcagttaatcctgagtcccgtaactggactgtaaatcccaaactacttgtatattccatgcgaaaggggcacgcgccaatccacaattaaaagaaaaaaaaaaaaagaaaaagaacaaaaatgaaaacagtttgtgtgttttgtaaaatccacaagagcagcaattaatattcccattgaattgactttaatttttgtgtgtgtgtctcccttttgtttccagcgcctgcccctggctcagcgcccggtgccaacagaacaccttcaggattcacagcaacgcagaaaccgtgagtaccagccgcttccctcagacccttttgcaggatgtcttttttttttttttttttccttaagcacctaaaacatagagacaaggctcttttcccttctgctcctcagcatcatgccaccagggtttgcctggtagccccttccaaatctctctgccttcaagtttgtacttgtgtgtgtggcatccctcctcctcctcctcctcctcctcctcctcctcctcctccactcccatagtggatcttgtaaaggggcttcagacgaccccattcatctccccggtgatagcagcgaatgtagataaatctctggctgcctgcttgctgctccagtatgatttttattttgtcttctgtgtgtacctgggttagagagtgggatgcatacacacacacatacaagtacatactcagatctcccagtctttcctctgccatcctctcccacttctcagacatgcatacaccaccccacacacgtgtaagtgcaaaccatatacacctatatacgtacccatacctatagcatgaaaatatatacatagctaagcattcagtttgtcagagagtctgtgtatttgtatacacgcagagccttacacacatctctatatgcactcgatggttgcctgttttcacgtctacccatctagatagctccttttaaacattccctcttttctctcagcagaggctgtgtgccatttccatccaggattgggaaagcagtattccttccttagaatttctatctgtagacctttatgtttccttctctgccttcttcggagctataaaattggcatctttccctgaggttttccgaatggcaagtggtaccggctgtggcatgcattcatgccgattcctcaggcatttctcttccgatgtctgcctttcctctttgttgttgacttggctgaacggtgtgttgttgttgttgtttttttaagttaattataaacgaagttgagtagcaaataagccagtagcttgccctctcaaaaaaaaattaatgaaaaaacaaaaatagcccacacaagtgccttctgctgcaacagatgcccacatcacccttggcatgggcaacggacaaacagtttgggtggttgatgattttctctgactgtcgctgtatctgttgtttgttttccttgtttctttttgatttttcaagatgtccaggaccccggcctctgcttggaacggaatggtgtcatggcggagacaacggcctttgtcttgctgggtgtgaaaacatccgccgtgctggctcttccactgcggcagaatcaagtttaaatgaaaaaagtgattaaagtcagctttgtgcttctttggtgtggaagaccccaaaaccccaagtagccgattcccagggtccaaggaagggctcatagttggagcagcctgggctgtaatcctggcacttgcgccttgcgttgctgcttgctgttcgctcctgggggtctggataatctcccttggctttaccgcactgtctggcccgcatacagggcccggtaacatatacccgctgctgctatcacacgaaactgtggcgttgcccctgaatggatggcaccgtgccaactcttctgccatccgcccttgcagcttttttttcttttctcccgccctccccttcttctcctcctcccgtcgacttgacgttaattaacacacgggttaattgattttaaaagccgaagaattacagttaacttttcccacagggtacagacgccagccgcttggcacactctgccttccgcactggtgcagggggggcagggaaagcccgcagcaaaactagcaactgctgagggaacgttgtctgcttattggagtagagcgatagaagtcagcgtggcactgcctcatcctgtacagtatatggagccattatagattttgtcaaataatcaaacacaaccccgtctttcctcttcccaactagacaaccccttcagaagttcttcgagagatgagataagcccctcccaagaccgcttctatcctccctaaaatgtttcttttctaggagtaagaaaatgatggtgcttttgagattttttttttttgaattgctatgtctcagtttcacaaagggaagagtgggtactcctaccctacacagcacaagtacaggttccataaagttcttctctgtgtctgttttgttttgcttccactcctcttggccagatgaggttattttgggtaatggatttcagtgaggaagtacatagtataattaagaacaaaactcctagccaggctctttgttattttgtatgagtgtgtgtatctttgttgcccaccccctttctcagagcctctgtccaaaataaaagcagtttgctcttgctgttgggaaggagtcgggcaaggctgggaaccggtgctctcaccttttcatgcttgccttctatttcattttggggttttttgttttttgttttgttttgttttgttttttttaaagcacacagcaagtgaagcgacaagaggaatccattatgcaaatcatgtcactttgcataatgtctcatgactggaatatgcaaatgagctgtataatttatgagtgccagtgtctgtctaaaagtgtttcacataatttacaaagtgagcttgagacagagtggacgcagctccgtccaagtcctttgccaggaaaagctgccttttccagtaaatgccattcatgcttccattcatgctttcagcaggagctgtgccagagatcccaagtgttcaagaaaggcaaagaactctccttgcctaaaagtttgcaagatacttcaactctagtggcacagtccttacattccagcacaacggctagattccatctggggaagaaactggtaaagccaaatgtggcatttgtatgtaggttttcttttggggatgcagaaatatctgagaggtgtgcatccctactctccatgtctgggtatagggaggcaggagaacacgagtttgcattccacttggctttatgtgttctgttctaggcagcattttatgaattataggctcttagacatcggacagtgatacacaaggcctagcacgtggttgtcttatgaagatagacggtaacctcaaagatgccttcaaaggagaacttgctaaaacctaggattgagtaggcacattaggcaatcactctacatcagccttgttaaaaagtattcctttgagaagttgactcaactctttgagaagtagtaatacctttaataatctgatataatctggtcttatattttcattattattacatagtccatagagataccaggcactcatggcagtgcatatctaaggacctgatccttggcaggcatgccaaaaagacttcccgatgaagatgagtccaagtcagctcttagagttgaagagaaatcaaacaaaaacaacagggaagtatttctcgcagagaagcattgatcagcaaatatatacattcacttgctagtgtctgatttcttagattgtacgtattttatacaatttagcccataatgaaacctacaattaactattaaaacactttctatataagatcccaaatcactcaaaactcatacactgaatcatcaaaggtcccatgtgaagcatttcttcttttaataatcatttaagaaaataactgagagtctggagggggagaaagctgtggttgggttgtaatatatgatagaagaaagaaagaaagaaagaaagaaagaaagaaagaaagaaagaaagaaagaaagaaagaaagaaagaaagagaaagagagagaaagaggaagaaagaaggaaaaataataggaaaaatgatatacccaacaagaacagagcaccgagcctttacgagcataatggaacaataagatgtattgtcctgtggtctacaaaaaaaaaatgaaatctggaaatattcaagctggaaaaaaaaattatctggttcctcccccctcccaaaaataagaaataaagacagctggactacaaagcactatcaatgctccctggaagaccttgcatgtcaaatcaaatgtttctacatggcatgcatttgagaggcagtgggaaattagaaaatgtgttaatggaatgcaaatggaaacacattaaaaatgtctaagatgcagttatgatgtgcttggagggaaaaaagggggtttttgtgatttactttagaagcctggaaagtttggggtcattaagtacccacttgagaggaaagaaacctgaaccaaacataaaaaagaaaagtcagacttcatcaaaactgaaaatatttgctacttgaattgaataaaataatgaaaaaaaaatcacatactggagaaaatatttgccactgatgataaagtttttttgtttgtttgtttgcttgttttttgtttttttgttaaagccacaaaaactaatgaacctaaaccagactgaaaaatgacacaggagaaatctctcaacagtaaaagagaaatgtagacttcagaatatatacaagcagaatgaactgtcaggaaaagacatatgctgtaagaaatgttaaagactgctgtccaaataagtgggaagttacaccatgtaaataaaaagcattggaaatgataactgtcattgccaggtttcaaaacttataatactcaaatgtatttaaagataaattagtctaaagaaaaagtaacaatcattacttttataacaaatataacttgtgatgaaagctgttgaaaagaaaaatggaagaattctgccctaaagttctctatgtggtctctaatgagttttagttgcatatcctaaaaacagaaagcttaagtgacagccatggttaataagctaaaagatttttaaaaatggtcactaagtatatccatttaataaaggactaggcaatagacttaatcttcattaattacattaaatgtaaatggcctaaatattctaaatgacaagatatggcagattgcatagaaaaccaatatgatccaaattaatgcatctgtctttgcattctacttcctcttctccagaaccttcagtgtttattcccaaacacactctgctacttcctacagaacatttgaggcagatgctgccagaaactctgggcatcaatgtcagctcccttattaacaggccaagatttccccatggctttatgcaagatttaacagtagttgttgttctggtggctaacaggtgaaattatttaggttctgaaaacagaaagcattttgtaaggcatcagccttccctgaagcctttgtatggtcagaggcatggcacagtccctgtctcccaagaaggaagaaaagtccttctcattggcccaaaagatttgaagtaatctttttcaagcttagggtagtggagatggctataatgaaaggtcagccttctcttagatgaaggacacatttgagtctttaactgtatacacataactgtgtcaaatgacttttaatcttttctgtaggttgttgcctaatcaaccaaacccaccattctctttcttcattaaataattggtgctcagcagctgcagtggaccatttcaatggccctagcactctcatcagcattactctgaagagccagagacattacatgacaaattccttctctccatctctcttattcacataggactctgatagccaatcaagcattcagcagtttttttccagactatgcctcatgtgatcactcctaatgaaaactaccctacgtatgaactactcaatacacagacacatttcttcttttaataatcatttaagaaaataacagagtctggagggtgagggagagctgtggttgggttgtaatatatgagagcagaaaggaaagaaagaaagaaagaaagaaagaaagaaagaaagaaagaaagaaagaaagaaagaaagaaggaaagaaagagagaaaaaggaaaagtaataataatgataataataataataggggaaattatatacccaacaagaacagagcaccaagcctttactagtagagtagaacattaagatgtattgtcctgaggtctacttcaataaaacagaaaccaaaacttgttctttctctagggaatttctgtaaggaaggacatgaaatgggatgagactaaagttttgcaaatatgtagctgatagtagaaacctagcctcatcttaagcgtgtagagcattcaggagtgtgtgttgtccaccccctccccaaacaaaaacccagctagcctgttgtaccccaactttcttcagccactgactttgggcttctactggtgaggctgtacattctagacattccaaacaaaatgccccccttagggtagtatggttttgatcagccaatcccatttctctaagagtcaagtgtaagatatcaccatgattcagcagttgaaggatagagtttgttctgctgaagatctgggtagagccatggcagctacaataaccatgaacctaataaatatgaaagtatttcctatcctaaaattaaaatacaccacgatgtgttcagtggaaagaaaatatacactcagcatctatgtgtaagattctaaaaggtctagtagaagttactcaacacctgcgtgttttctgattctgtccattattgaaagaggtgctaacatcttataaatagaaaccttctcgtctgccttaacttctttttcatgtatttcaaggttccgttcgtaggcacacacacttaaaactgcagtgcattgttacaaaaatgagcctgaatcactgtgaaatatgttttcagtaatacttgttttgaagtttactttgtataatgttaatagactaactggataatcatttccctataatatctttcccccctaaaatccaatatttcaatggcaaatttattagaagcagcagcaagtacataagccaaaagctgaaggtatggatttaggacaggtgcaagagaaaggtcataacatgatgtttgcctttctgtcctaagaaatatatttttgcatgtgaatggtcgcaacacagttgtctgtctgctttattggttcatatgtttttatagatggtttataattgataatggaaaaagccttaagtaaaaaagtattcatcataatatgcattcaagagatttttttcaccaaaacttaaccacatatgttgttaaaaagaaaatctcagataaccaaaaggtgataattgttccagttgtatttttttcagcaacacataatcatattagagatcaaccataaaagtatttttacatctcatgtgaatagaatatacaatataatcgaataaaaagtatagaatcaaatatgtacctgtcaatcttcactgacataaaaaacttaagtagatgcaagcaaaaggacaactcctcacagtaaagttctagtgagcaaatgggggaagataataataaaattagaaaatcacccggtaaacatcagaaaagcaaccacagtcagtcatcataaatgaatcctaaaattagtgaattccttcttttataccacctcaaggtactgttctttggaatggggacgatgagagatatccaattgggaaggtagagaaaaaggaagtaagaaggttaaataataataaggatgtctgaaaaagttataaggaatcagactattaactacctacttaaaatgcctataacatgcataagccagtgtgtgactatatatatatatatatatatatacttgaaatgaaattctgacatctaagctgacaatgctcccttcaagagccgtagaccatctaacaaaaatcccaataccagacatgggaagctctttcttgtgttgttggtcagggatgtccaagaggctcccaaaacactgtcaaccactaatgtgacctttctgttgcccaccagaggtgggaagtaagcccctagtgctataggcaccacacatgcacttcagacacaaggcttgggtctctcaagctgaatctaacctgaaagcctccaccctgagcactagttttcatggtaccaggaggtaccacgcaagcttctgaaggagggaagccaccaacagtcctgcccagctgccacatctgtgaaactacaatagtgacaaccatgacataataatcctaaaggttcagtagtggaacacatggcttggcattaaccaacagctttctaattggacttaagatccactgaacaaaagaaaggtcatgtctggtcctagctacctaaccaactactcaaggcttgtgaaatcatggatcgtggagaaaaacctacaattgccacattactaaaccagcaccatcgctaactatattctaaatgtttgtccttctagccacaggtaagtatagttctcaccaaagaaacttacctttgcagcaaaatccattccataaaaccacaagcaatcaaaattcagagatgtagaactcagtcccagcagatacatctgcaacacagttcctgcatcagcggcttggcgatcatagcggaagagggggccgaaagattgtcagaaccagagaaacagtttgctttgagaccatttctcctagaaacatcagagctacatccacgaagtctcatcagcatgagtgctaaacatgacctgatcaaggataccagtagaaatgctaacacagacaggaaaaaatccatgtggtcgaaatccgaggcagagaactacaagcaaatagcctttccctgggaaaagcaggagatccaagaccaaatgatcagccctgaaaacatgtacatacaaataacattgtgtggaccaagcaggttgtatgtatatatttaggaatatatatatatatatatatatatatatatatatatatatatatatatatatatacatatacacacacacataaagatatctaatgacaagaaaaaagagatcatgaatttgatagaagggggttatatgggagggttttgatggaggagggggaaggggtgatatatttataatctcagaataaaatatttttaaaaaaatatctccctgtaagatatagcttaattacagagaaaaaaatagtggctttaacatgtaaaccttggtaaacaatttaactctgtattcagagataatatcatctgcttctgggatatgagagatgtcaagatagttcacattctcacctgtcgtcctgagctcaacatcatttggcaataatgcataatatcattcccatcatgaaaaaatttcagacaattctatactaagagactgtgtgtacacagtaataactttccagtgctcttcagaactgtgaaggtcatggcaaacaaagaaagtctaggacttaaggattggtgaaggatagggaggcatcatgacgaaggcagtcccttccctctacacgcatagctcaaataagggcttgtccctgcattaactgcttattaaatctaatcgaagatgcactataaagatgctaacagttatgccagtcatgccagtgcccacaacactgtggcaaggatttctctgttgctggctgttcttaaatccactgccatgttttctccacttactcggacagctcctgactggagagacaacagaactacaacaacactattagaaatgtagcgaccagccaggcgtggtggcacatgcctttaatcccagcacttgggaggcagaggcaggcagatttctgagttcgaggccagcctggtctacaaagtgagttccagaacagccagggctacacaaagaaaccctgtctcgaaaaaccaagaaaagaaatgtagcgaccaacaaaccccaatcaacctagttttcatgaacatgaagaaacacacatcacatgtaaaagagaaaaaatctacaaaatgaacaagaatcagtaagggaaaaaatgagttactgactccagaaataaagatgctacaaaaaaaaaaaaaaaaaaaaaaagaaaagaaaaagaaaaagataaaaacgttaaggtacacagaaagactgacacaggaggattgtagtaatgacagggcgccactcagactgcctagcaaatccagtgacactctagcccaaggaagcagtcacacaaaaaccatggaaaggagaaaagagcaggaatccctaaaggttaaaacgtgagttgatgacatggcttagtcaaataaagcacttacctcacaaacatgagaaccgagttcagatccctgggacacatgttaaaaatctagtcatggtgacagatgcttataatcccaacaatgtcaagataggcggcagagacacagccacaggagccgccgggctggctaacctgtgtggggaagtcctctgtcagtgagaggtcctgtctcaaagaaagacaaaacaccctggagggtgacacgggagggtgccttctgaccttcacaaggatgctgtgcactcgtgagcacacaagagcgtgggttcttacatacacacacacacacacatgcacacaaaaaaagttaagtaatgcttaaaacatcaactgaataccttgaaattccttatgggcccaaaaaggattaaaaatacgaacggaggagctgggctgtagtgaccgacgctaattgcattgctagtttctttttgttttaaagcacttccttagacttccgaagccactttagtttgaaacgtgttttccttcgctgtttctccacttccttcagaagtcatgagccttgaatgttaatgataccccaaatctttaagctctgctataaagtggcttttgcgtggcccaagacttctctgggttcttccattgggattgcccaggttaaaggttgcttatttggaaaaggacaaattattttaagagaatgagccctaaagagaatatgctccagtcctctctacccacctgctaatcttcaggggaaaccttcactgacaacctgccgatcctgcgcaagcgcagttacacacctatgagccgctcaatgtggttaggatcaaattacttttccacactcttgtttttgtttttgtttttgttttgttttgttttgttttgttttgttttgttttgttttgtttttgtctagctcaataataaaattatgggatttcatttgtgactatatctatatatgtgccccccttttaacaattttgtggaatttcatactgtgaacccttcatagtggaagcgtcctccacgagcctgttttcattgtatcaattacaagctgttaggacgattgagacttccttcacatcggttacgccccgtcctgctaacctctgctgttttctttgattcgcttttgttggtgtgctctttctccttttcagagtgcttttcaggacataatttcttctgtgtattctcttctgtgttcactgtgattctcaatgcttaatctgtaaggttaggtacaactagaaatctacggagtctaacaaacggctggtgttttcctgtggtccaatggtaggaaagctgacatccaaagcctcggtgctctgcagctgaggaggcagcctcaagatttacaagagtacctgactaatgactggtccaacctgagacccaccccatgggagagattcaggccctgcctgactattttaatgatagtctgctatgcttgtagacaggactgtagcctaactatcatccgagacttcttccagcatctggtggaaacgtgcagggacccacagacaaacaccaggtagagctcagggaggcttgtggaggagtcaagagacagattaaaggacctggaggggacaaggacacctacagagccaactaacctgagccccattgggggctcacagagactgaaccaccaacgaaagagcatgcatgggctggacctaggtcctctacacattggtagcagatgtgcaacttggtcttaatatgagtgccctgacagatggagtagctcggagctgtgtctgactctgttgcctgcctttggatctctttttcctgcctgggctgcctcttctggccttgatgggagactagtcctggtgagatgatgtgccagggcaggttgctacctctagggggtggggggcttctctgcagagaattggagggattagtgggggaaaggtatgtgagaatggaactgggagaagaggagggatgggggctgtgattagaatgcaaagttaattaattaatgggggaaaaaaagattaacagagtaggatctctctaaagtcatagacctaggacttgtaaatggacttgttactttcaaaagttggttttaaccaggactagcaaaatgtcaatcttaaaagctttttctttctttggaacataaaactgtgttcattcaccagtctttataaagttgctaacattccccccccccaagaaacaggtaattaagtggtattctgaatactgtcacatacacacacacacacacatcacatcacattaaatgcatggttgtatggttttctgttctgattcctttggtgataaaaaaagaaaagaaaagctgatttgaatgaaaactacctctccacgttcaccatggctcctctcgcccttttctgggtcccaggcacggtgttcaggctaccgattaccactcggttgggcccgtaccaaccccagctcagcctgctgctgctttggtaggttctgtttcttctctcacacgtgtcttatcatgccctgtgtctctgggacccacgtatgaggtataaataacactgaagatgtaaacagaactaactgatcctcatctttgataatttttcctgcttacctggaagacagatcaggccatactgaagaacagcatcttcattagcaatgagctttcagctggagggatatcagccgcagttctaaagagagagcagagagcccagggcaactgaatcacgtaagtggcatcagccaagttaattcctaccgtgcatcaccatccaaggagttcagctaacgaactagcagctccgggacaagggaggttaaggggaagtttgtgtggctaacactggttattttaaagtatgaacttcatattgaacacacttcgtctttatcgttattatattagaaaattgattttcgtcaccagtatctattcccgtcattgggacctggtggttgaggctgaatttaatagtataaaccttggcttatgctcatgaatactggtgatttataacttgcctaaaactaagcgtgcattttattctcccttcaaacaataaatacaacttacctgaaaccgaccttaaatctgtttgtattttccaaagtatttttgaagattccatttggcagcaaaacttaagtcaagaaataaatttccagttttttttttcttcttcttaatacggtaaatcagttctaggctctcccctcagtggtcatgggacaatgcagtaaaagcgcggagatcatttctccaaacacccagcttcctggccttgcacactgcctaagggttcaataagtaggttaatgcttccttcagggttggcctgagggttaaagttcctgaggagccaactgaagcttgcgagaatggagaggccatgtggatacagcgtgtgtgtgtgtgtgtgtgtgtgtgtgtgtgtgtgtgtgtgtgtatttgcatgagtgtgctgtgctgtgcctgcatgaatgactgagggaccgaacaaccattgacatgcatccaccttcacacacaaggcctgcaggccgcatgatcattgcatctgcatccatattcaagatcaggctttgttttttaattatttctcagccctattattataatgctctttcagcatccatccttgattattataaaaccaactcctaatattttcattcagttgtttcattggaaattttagactatattcctctataagtttgcatttactcaaaacccagttctgttttacctgttcatgaataagcacaatggtggggggggggatgggggggggacactcatgataatatctaaaaccttgtatttatctgattaaatattttttgtgacatctgtaaaggctgggaagatgacccctacacctaatgtgttcttacatactatatacattaatagttatcccccactaaaaactcactttacattttactacagagatacaaacaggctgtttggatttaagtaacttgagcagtgtcaggcggctagtgagcaggagaagggattaagatagacttccacctgagttggagactctccgggcatcctcttatgataagtgtttgttccccaaatgcttcctgtgtgtttattgtgtgttgagtattgtccagggcactggagattgttttgcagggtgaaaatcctgctactctagtgagccttcactcttgtggaaattggagagagagacagtgcactaattaataagagtgtgatagaatcttgttaggaagggctgtgtcccccacaggtggggtgtggaggcaggatgactcttgatgacttcaggatgaatccatgttcaagggcaacatggattccccgacaccctgcctcaaaagcagaagtgatgggtagtgttaagacagttttgcaactggtacaaccactctggaaatcaatttggtggttcctcagaaaattggacatagtactacctgaggacccagctataccactcctgagtatacacccagaagatgcctcaacatggaataaggatacgtgctccactatgttcatagcagccttatttataagagccagaagctggaaagaacccagatgcccctcaacagaggaatggatacagaaaatgtggtacatttacacaatggaatactactcatgaatgatgaattcatgaaattcttaggcaaatggatggaactagaaaatatcttgagtgagttaacccaatcacaaaagatcacacgtggtattcactcactgataagtggatattagcccagaagctcagaatacccaagatataatttacagaccaaatgaagctcaagaaggagaaagaccatagtatggatactttggtccttcttagaagggggaacaaaatacttatgggaggagatacaaagtgtggagcagagactgaaggaaaggccatccagagactgccccacctggggatccatcccatatacagtcaccaaacccagacactattgtggatgacaacaagtgtttgctgacattagcctgatatagctgtctcctgagaggctctactagtgcctgacaaatacagaggtggatgcttgcagccaaccattgaactgagcacaaggtcctcaatggaggagctagagaaagaaccgaagaagctgaaggagcttgaagccttaattggaggaacaacaatatgaactaaccagtatccccagagctctcaggactcaaccaccaaccaaagagtacacatggagggactcatggctccagccgcatatatagcagaggatggccttgttggacatcagtgggaggagaggcccttggtcctgagaagactcgatgccccagtgtaggggaatgccaggacagggaagtgggaatgagtgggttagtgagcagggggaggggggctgggataaggagttttcagaggggaaaccaggaaagagttaacattagaaatgtaaagaaaatatctaatttttaaaaaacagtttgcagtctcatctctttgatctagtttaacacaatgatattgttaattattgtagggccctcctagagcaaacacagacacatggtttaagagcaatgctttactgcattttcttatacttgctagagaatacaaaaaaagaaagaaaagaaaagaaatgcagttttaaacttaaaaatcaaggtggttcagaaaggattaactcagaataaagcattggttaacaaaagcactgcatgcaacatcggtgtgtacttccttcaatctgaaatagacaccatctgatgagcccctacctgtgtattcacggacatattgctttgaaatagttcctggatattaaatgccctgcttcaaattccattagattttctaatgaatatttagaggacaggaatattccaacttctctccaggggaagtggcactattaggaggtgtggccttgttggactaggtagggccttattgaaggaagtgagtcactgtgtaggcgggctttgaagtcttttcctatgttcaggctccgtccagtgtggtgatgacttcctccctctggctgcctgcagagaagagtctccactggtttccttaggatcaagtcatagaactttcagctcctccagtatcatgtctgcctgcacactgccatgcttcctgccatgacgacaatggcctgaaactctaaagtggtaagccatccccaattaaatgttatcctttataaaggttaccttggtcgtggtatctgttcacagtaattcaaccctaactaagacgctctcaaatagctaacaaaaatttttttaaagatagaccctcaagccagatgtagtgctggactcacagcactcaagagtcaagaaatgtagtgggaattttggtttctttaaaaacgtggaaataaaaaatgtttttgttttaaccccaggtgtggggctgcttcggattgtccacagcagctgattgtgatttgcctcgtgctctagcaggggcatggttttgccagctgcagatagtttctgcagctgtgtgacatttggaattctagggacccatcagagggtatacaaatgctagagcccagtagaagaggctgttggttgggggagagggtggctttgttttgttgtttgttttttgaggtttgtcaagtactcttgtacaaagagatgagaagaagaaactagatatcctgacagcaaagatcagacttgccccaagaaactcgacaccgatacccgtaactagaaggaaagagtctgataataacatcacccttccccacccccactcactctctctctctctctctctctctcactcacacacacacacacacaagtcctttttctttcctacctagtgttaggagattgagagggtggaagaatgaaagaacccacaaaacagccaaaagcctggttacaaagaaggataataatgtgaaggccaacctgggctatgtggcaagacccccatcaatcaataaataagcaaccaaatactcaaagaatatctccaagcaagactttataaagtatatgtttgattatactgtggtagtaaacaactcttttatattattaaaacttttaaaaatatttttttagaaaaggtagcttattttggacactatcaggagaggggcaggtaggcagcaacagacaaacccagccttacgttttcattacagtcatttatgtctgtgtgtatatgtgtgcaagaacacagccagtgagcatatggagtacaactttttgagtgttttttttctagtacatgggtcctctggcttggactcgagtggcctggtttggtagaaagtacctaatgagccatccttccagtctgatttttaaatttaacttaaatatagacagaaatcgctcattttgtacagcatcctctataaaaggctgatgtttctattaataatgttagtatttaaaaatagaaacattgaagtctgaaacccaatctgaagaaacatcatccaacattaaacccaacagcaatgtcagtaaataaaataatttagtgtggcctcctaagacgaacttgcttccatgtttctcacctgttgcccgagcctgtgccgttgatcctgcaccaccttaccgccaaaccctaaggacaagtagggtcagacatacggcagtccagggcacaggcagctgttgcggtaaatctccaacccaaataagccccggcaatgaaaacacaactcgttaacatgattacatgctgtgcgcctagattgggcagatctaccactacactaccatcttccacattatgagaccccttagaacttgtggtttctccaagccctgtgcttctgctctgcttttcttcttcttcctcctcctctgcgtcttctccctctcccattttctccttctctctccttctgctccatcttccctttatctgcccaatcatcagctctctttattttacgaattaagatgggaagtaggtttacaggaaatcacctgagtgctgacctatttcttgtttgcaacccctcacaggagcatggaattaacaacaaatataattagtagccccaaggctattcacaacaggcagcagatgaatttttctaacatgtcccttcaagccttcttttactttaaattatcttgtttaaataatgttttataattatatttaagtttttatctgtttagttgttttgttggctgagggttatactatgtagccttagtagaccaggctagctttaaactcacggagacccacctgtctccagtgttgggattgaaggcatatactgccgtgcctggttctgtttttaggttttaaatatgtcttcgttttgtaagaatactgcttaatacctaattctatgagcttgtgtttgcgcatgtttaggtaatttaaaattaaaattctgttggatttccttttatgatctatatatttcttgtgtttcagaagtactatggtgtgaaatgtatttgataaacaatttatttggatacctttaaagcagccactttcacttttcctattagattgctaaattgtcatctggcagagtgccttctatagaaaatctaatccatccttccaaccccatttgtatactgtcaaaagcagtggtttttcgagctgtaagttatgttcagattgagtcaatattttagtaggaactatttagtcatataatttagtcttcttgtgctgccctcatcacagaaagtcttaccactctatgctttggtctgttttgtgttgccatcattataatcctaaatccccagcttcaaacaggaactctgaaacttgattgaggctgttttaattgaccccacttggaggtggggttgagaggtggactcagcgcggagttctgaacaatttctgtatcagccatcgctgttctttaaatgtctcaggcaccgctcacatgagtgatgctaaaactgatgaattgtgtgcatgatttaaagtaaagtgtggtcgtgagctatagctctacaaagccattgttttagaagccgggaccttgctggactccatttaccatcttccccactgtgatatataatttccatctggattagaagcgctagctcgatctcaatattactttatttccgttaatctctcacactctttctcatggtaagaaaggggacagaagtccttcatccttgacgaggtagttgccattttagattttctcccttctgcctatatacatccccaggcaaactacctctgcctgggggatttcctgtgtgtttctttagtgtaactgctgataacaaggtttcctaaatttaatgttacagcaagtatgtttttatgttatgtttaaagttatttttcctgaccacatagttcagatgttacagttttagttcctttagcagttatggaataccccatctattctttccccattaatcctgaccaaaaaagtaacaatttccatcattgtttctcggtttataaagggattttattccccctgcctgctcccaggtgtagctttcttcatagttatcttgagtacattaatctttggaggttttgaaatttgtttttcaacaatgtaggaaaaatttgactttcccctttaataatatttttatttactctttgaaattttcatatgtctatacaatgtatttggatcttagccatcccttgcctttttccctccaactcttcccaaatgcccaccaccccatctcccttctgcctccatgtcttttattcttaccattattattaataaccctgagttcagttagtactgcccacatgcccatgggtgaaggaagggccatccactcagatatgggaaacctaacagcagccatgtcttcctccatcagccatcaactgccaatagcttctgctaggatggcaagctgggagtgttgggagggtggctgagagggtccgcccccgccccgccccaccccgccaccccccacccccctgtgctgggattttgactgacctgatcttgtgcaggtaaccatatttgctgtatgtaacagctgtgtcatgcctacaagttagcatttcacggctctcctccccatccaccagatatccttacacaatgttccctgggcttaaatagacggttacagcgctcaattgcacattctcagaactttggctaacacgagtctctgcaccaaccacaacaactaccaaaaaataaataaataaataagtaaaagagtcttttttttttcttttagattgagagcagcataaaactgtgtatataaacaaatattttgatggtttaaaaccctactgtacagcaggcctcaaaactgatcagaaagttgttggttaccttcaaaccatcgtgccactattgcatgagcacaggttgcctggcaagtcagtattgtagcatgcagggtccatggctaggtggagtcattgaagtcttttatccctgagaaccacgaatgacatcgtccagccctgtgaatgctatgaatgctgaccctgccctatgaacactgaaaccctacccccatccccacccccaccctgggagagtttcctcttgatcactgttttcttacatgctctttctgcctattttctcctttccaaaaataaagttaaataagtataaaccatttaactcttcagatgtttttttctttatgccttttattatcaattttctctcccatcttctgacccaatattcctgctgatttatctcccaattcattgctccctttctttgtttgcctatctattgcttaccctgttcaccaaccagtctttctaacacgttgaatagttttaattgtttaatttactatctaaataagtttaaatattttagatatcgccatctaaatagtttttattctagtgagcgactcgaatggctggtcgtctcttccctgagcgaaaatcttcaaccgttgctttctgtcagtttctccaagccgtgtgtgatcaaagctacctgagtattcttgggaatgtgtgtacatatcttgctcctcttgacccttagttttctcctttttgaaaattttctcatctttttctacaggtttctcaaatctcaaacctttccttctgaatctccaatcacttgagactgagttttgttttgtttttttctgcgtgagttccacgcactccctacagtgcacatttgcagaacctttctgtgaaaagctacataaacgcccactctttacccgagagtgtgatcttaatttttatttctgtttttaaaaaatgatctttaatctttttttttacagtacagtcagtatccctctcctcatcctattctttccccccccacccctcccaaccctgttcccaagtggatgcccccgcaccccctcacccccaccccgccaggcttccccactcctgggagcctcaagtctgtcagggtttaggcatctctttcactgaggccagaccaggaagtcctcagctgtatatgtgtctgggcctcgtaccacaatgtgatctttagacaaaggttgattgggccactggcaagagtgtttattctgtatctgtacaaaaatctattaaaacacaggatccccctttcaaaaaaaaaatcccctttatttgtaaaacttgtaactctgaaacagcgggaaacctgaaccaaataattcaagatagagggatagaaaaggacttcgtgaatggaagtccagtaccacaggaaattatcctaagaattgaatgatgggtctgcatggcattaaaaagcttctagacggcaaagcaaagactatccagagtactatgaagtgggagagctctttgtcaactttatttgtacctgaggattaatatctagaacctataaagaactccaaaaatcagacaccaaaccatccaatcagtaaataagtaaataaactgagaagacaattccctgagagaacaaatacacatggccaatatacttggggggggggagagtgtttaatatttttagctgtcagtgaaatgcaaactaaaaccacattgagattccatttcactccagtctgaatggctatcgtcaagaaaaaaaaccaaacaccaaatgagaatatggagaaagaggagctctcacgttgtactggtgggaatgttaggtagctactatggaaaccagcctaccatacgacctaacagtgacaatctgagtatcctagagaatgtcaaggcacccttacttgaagtacaacctttgtgtggtttttaagaacactacttaagcacagaatgctttatttgctgtttagacagagtcttgatagctcgcccagactaaccttgaatgtttctcctgcctcttcgagggctgggatttcagtcccataccactaggctttgctagaatgttcttcatttataacctttgatcttgctggcgaatacaatcaggatgtttcctaatttatcaaaagatattaagtatatgtcttacaaggttattttctgctttttcttttctttattttttattggatattttctttatttacatttcaaacgttttcccctttccaggtctccccttcagaaacgccctatcccatccctctccccctgcctctttgagggtgctcccctacccacccaggagacagccagatcagccttcccggcaagcacttcccgacatccacaatagcgtccaggtttggtggctgtgtatgggatagattcccaggtagggcagtctgtggatggcctttccttcagtctctgctccacactttgtctccctatttcctcctgtgagtaatttgttcatccttctaagaagcactgaagcatccacattttgagcttcctgcatcttagatttcatatggtctgtgaattgaatcgtgggtattccgaacttttgggctaatatacacttgtcagtgagtacacaccatgtgtgttcttttgtgactgagttacctcactcagattgatattttcaagtaccatccatttgcctgcgaatttcatgaagtcattgtttttaatagctgagtagtattccattgtgtaaatgtatccattcttctgttgaggaacatctgggttgtttccagcttctggcaattataaatatgcctttttctctttaatgatctggattttaaaaattgttttcaatatatcaaggatgaaaccttaattaaatacctgtttctttactacccaaatgagtatgtatggtactaacagataacaaagctatcttgaatgtaaacatgaattgtatctgctgttgccaatatgactcaaaatggttattttgttgtggctctccaaatattagtgtgtatataatttataatagtcggtttctccaggagggtttttataagctttaagtgagcttgactgtaatcagtgggggctggagttgatatggtcaccctttacataggttttctctgtctgtttttaaaatgaaaatgcagtctttcagcaatgcctgatgtttcagttcagagccctacttaatcttgtaccttataaagtgactctttaatctctatgaataagggagaaggcagtccttcaagtctatggttggtttggaaagactttagactttccgccgatgttggccatctgtctttgccccagccctgatccacgtccttatgtgattctatggtacaaattgaattgtctttgaattttccctttaaaaaaaataaaaagtgtttaaaagc

SEQ ID NO: 112 - DNA, 11302 bp, Mus musculus
caaaatgtaatcatgcaagccaccagacagtttttagaaagcattttaaaaacttcgcccagctttgggttagaggactagggatggagaaggttcctgaccattcgtagcgtgctgtcagctcttccatggcagagacaacaggaaaggtcctgcttcctttcctgtgtcctctttccaggtcctgtgattcacaagcctgagagtcctctggggtcggatgcctgtgagtcgatctggatctgctctttgactttctaaaagccatttcctctaagcgtcaagtggtgctgtgactgcctgtctgcttctagcacgaagtcctctggcaactctcgtcggccttccctcctcgtctatgcctacgtctgttcaacgcgtcaggtttgggctgggatctgagctaaagagcaagcatgtgaggacgtggagaagggaagaaagttagctcagaacctagattgacttcccagaagatggagaagggtttgtagtcctttaacacgttgtattacaaactacaaaagtggcatagcataatgcaagagcagtgtagctgccggagactgtggggctcgggattccaacgccacattcctgcctggccacctctgctcagctcagctctcgtcttcccccttgagatgttcccatacaaccccgataccaaaagaacaccaaataggaagaaatgtttccggttggaaacggctgaaagataaaaggctgtctcttagaaatatctgttaaaaacaaacaaacaaatttaacagctggcgatcctttaatcccagaactctggaggcagagacagacacgtctctgcttttgagaccaggctggtctacaagagtgagttccaggacagccaggaccacccagacaaatcctgtcttgaaaaccctaaaaccaaaccaaaccaaatagcaataacaaaattattataatgtgccagtcctaacacacacacacacacacacacacacacacacacacacacacactgttagatatttgtgtctcctgacaattctatgagagagatgttgtcatgagtttgaaagaggatttcccaccgaaaataaatggatctgatttactatgttttcctgaataagtccacaaacaggccaagagcttagggaagctggagagcgtctacagcaaaccttctctggaactatccgaggggcatcggctaggaaagcaccacgacctagcttaatgactgctggcgtgaaggaagggacagccacactgcttgggaagatgtgagccttgtgacttggctgcttgtcaactcaattatttcttggtctttggccaacacgacaccatacttcctctacataagtaaataaggtacacacgtgtgtgttgtggctatgcagctatgtataaaggccataaacttcacacgtgtgtgtgtgtgtgtgtgtgtgtgtgtgtgtgtgtgtgtgtgtgtgtgtagtggctgcgcaggaggtgtaagggccaccatcagacataccttccattcttgactgaaatccctgtctataaggaagagagtatgtgcttgttttagtcactcttcctgaagaggctcagggaggtggcttagaacctggctagaacttaatctgtttagtgtgggtataggaccaagcttaaagataggcaggctatagacagttctgtgccactgggtgttggtaaaagtgacaccgggggggctggcgagatggctcagtggggtaagggaacggactgctcttccgaaggtcctgagttcaactcccagcaaacacatggtggctcaccaccacccataatgagatctgacgccctcttctggtgctcttgaagactgctacagtgtacttgtgtataataacaaataaatctttggtccggagcaagcaggggctgagcgagtggagttgaccagagcgagcagggcctctggattgagtgaggttgatcggagcaagcagaggtcctaaaattcaattcctaacaaccacacgaaggctcacaaatctgtacagcaacagcgtactcatatacataaaataataaataaataaatgaatctttaaaaacaaaaaacaaaaaaaaaaggtgacaccaggaacatccattcagacaactaactctttagagagaggactacaagaaaaacaaccagttttacctgccctaactttttttttaaagaattatttatgtatatgagtacagtgtagctgtcttcagacacaccagaagagggcaccatatcccactacagacggttgtttgagggctctcacccttccttccaggcaggcaggcaaaccttggggcttagaatctaaatggtcccctgggttcttgttgttttgtttgtttccaggtgcaatgggcaggattagctatgacctactcaacataattaccaaggctcagtcctgtgtttctccatctcctgaccccttcccctcctccccaacccttctgcctaccttttcccttctgatactcttgtgtgatcacccaaggcccccctcacatcgtaaattctgacccaaaggcctttcggtccagtcaaggaaaatgaaaacctgcctaacgacctgatcagtgataaggaacccagaggctgcaggtctgaggtgaaggaggtgaaagacaggggaagcaaatcaccagacccctgactatgggccttccttccataaagctaggtgggcacagtgattcacctcatttccactgagggctactacacagggcccttcccagagtccccattcacatgacattaaaaaaagggggggggggcggggggagagaaaaactaaaagaaaaaggaaaagaaaaaggaaaagaaaaagaaaaagaaaaggaaaaggaaaaggaaaaagaaaaagaaaaaggaaaaggaaaagaaaaagaaaagaaaaagaaaaagaaaaagaaaaagaaaaagaaaaagaaaaagaaaaagaaaaaaagcccactactatctgctgtcctggaactccctctagaccaggctgtcctggaacttgagatccgcctgcctctgcctcccaagtgctgggattaaaggtgtgtgcctccacctctgagcctagaaatcactttctctcatttatatgatggaattaaaatccccatatcaactgccaaagtcactactggctagaataagccatggggctctggcctggggcacactacccctataattacataggcaaggacagcagtttagggaataccagagaactcaggcctgccatgatggggcgtgaacacttacaaaacatactgaaacctggactgctttgaaatggtgtgttttggctttaatataaaaaacaattaaaatgcttggtggggagaggtactgggacttaaacccaaggcgtgtgctttgctctatcactaagatcctcccctcctctccaaatgcatttttagtaataaaacccccaaacccagtgctcgttctaaaaaaaaaaaaaaggctcgacatactgggggttttgttgttgttttgttaaagatttatttacttattaggtatacagcattttgattgcacatatgcctgcaggacagaagagggcaccagacttcattatagatggttgtgagccaccatgtggttgctgggaattgaactcaggacctctgcaagagtagaagtgttcttaacctccgagccatcctctaggccttgaagtgaaaaactgggctgtaggaatgataataatcctacggtgcaataaaatcaactaagctgaaatgatgttaaagtccgtactttgctgctcttccagaagacccaggttctatttccagctcatgaccacctgtaactccagtctatggaatctgatgcccctttctggcctccatgggtaccaggcacacaggtacctctctctatatataaggacatatatagagaggcaaatcgcaaatacacatactttttttattattaaggtttactaattttattcattatcccactaagaactacaattagctctgaagtctagagctttccttgtccccaacaaagagaccccaagctgcaactccaagggacaaacaggccagcattttgacgtgtttgggaaacctctgctaaagttcacaccactcaccgaccttcctgcccagtgtgcccatcatgacgccccccccccccatccaggaaaaaaaaaagaacctctccatttctcattctttctgagctcttgtcagtaaatgacacaggtatattagtcagaaaaacaacctacaccctgggccattccggcatctccaaactcaacagtcattcaggagcattgcctgtttctatgttagcaaaaataataaaagaaagtttccaaatgtggccatggttatctctcaaaagaaatgccccatttaagaaaaatgcagaaaaatgttctgatgtgctatttatagattaaacctctgctccttccccaccttacacttctttaagtgacaaaagatttgaaatgcccctctaatgaaaatatttctccctgcctgcccaggattcttagctctagatgtgcattaccaggtttggttctgcgaaagaagaagtcgttgcagaaagcagctgccccccagacaatgaagttacccgcactcaagcatttccagtgggcagggacaatgctggcagaattctcaacctgttgctatagtagcaggaagaatgtgattcgggcagctctgtggagatccagatccaaatccctgcagctcccagagagaacattaacccttccctgcccctgcgcaggggcagaaatacttgggaagaaccctgcttacctgagtgcggtcctcttggcatctcatcatgccacccacccagtgcccgccgggttacacatccttatgtgggtcctgtgttttcatggaaaacaggctaggcctggcctttggtgttaagcatgaaggaggaggtggaggttaagttattgctaaaaccacaacacattatgcagtatcggcaaaggcaacaccagagaacagtctatgcgagatgatcatcgcagtctccattagttaacagtagatgctgtatgcgctgggcgagggcaatggtttgataacttgccagctttcattcgacaaacaacaacactagaaatttccactccaaagctctcatgcctcccacaaattagtttaaacacatcatttatttaaatgaagcttttgatttacaacattaataaaattgaagttatgatgtaacgacaaaaaataactttatggtggtggtggggggggtcaccacaacatgaactgtattaaagggtcctagcattaggaaggttgagagccagtcactgtcctagagaatggtgtcacacaatcgttgaacctgaggccatgtccctcatttatagtccccggcaacagaaacgccaggtagttctctgaaaatacacaaaaaagccgtgtccaggccctctgaaatagttcccacaccccaggtcatttctggggtcaaggtaccagctttagaaaacacaccttagagatggcctaagtctaatccagccttctttccttacactgtgagtggaaatctcatgttgtcagacacacctccttgctcaacttcctcatttcccatggagcccagacatgggaaattggagtttctcaggaggctagacgccatagtaggtaatgctatcccttaagctatcggtgacaggacagcagcaatcagactgccaagcaaaagagctgagaggagaggggattgggggactgtttgctgggtgagcaaaagaagagctttgattcctgtcagaggccttgtctcaaaaactaaggtggagtggaacaagccatcccttgggaggcagaggcagatctctgtgagttcagtgccagctagagctacatagtgagacactgctccgagctgactactacatgatatcctttgcatcttagttgtgctggcctgtgaggtaaatctgacaaaacacatggaagcaaaagcacagaatgtcacaggcgaagcttaccggctagcagcctgaaccaaaatcctcgggccaaggacctcatctggtagccaactcggagaagggtctaactatgtcgctatagctggcattggaccactgatctcctacctcaactggaggctcaggctaccgttaaagacggggagattggctcccaggaaaggacactcatccaaacatcttaaccatagtgtctgagtcgggatctggtgaaagagcccaagaaccagggtagatagaaactggtcactttttacccagacataacaaaaatgacgaggaaggaatgtcataggacctggggtaatgatgtcacctcctgctactctcctggagttggagaagagacagctaaaggaatgacctgcacacttatgactgagaagacaatgagggtggagatggaggcattccatagagatttcagccagttctctgcagcactcctttcttatgaaagctcatctgaaagacagatcccaatggagtctgatgtgacttccatgttaccaggagtaagaagattcgctccaaaggcggaccttggctgcctcttggctgccaggggattcaacaatggctccttgatcctttccaaagaaggaaatggtatggtttcttcacatgccctttccccacagaaggttgaggaaatgggtattattgtatgccacagggatccgtcagtttgtgtgcttgtgcgtatgtgtgtgtgtgtgttttatatctatctatctatctatctatctatctatctatctatctatctatctattgtgcgtatgtgtgtgtgtgtgttttatatctatctatctatctatctatctatctatctatctatatgtctatgtatatatttgagtcagtgtttctttatgtagccctggaacttgttatgtagacaagactggcctcaaactcacaggtagctgcgattaaatatgggattaaaggtatacctagcctgtagttgtttgtggcaacaactggtatatccagcacagtaagagtccacctgtagttaagagataaatagtgtttgcttttccttagcatgtaataaaaataagagagcttgatagttctcctcactataccatagatctagactcctattcccttcttaatgccaaacattcctgtgacctcagctccagggaacacaggggaaatattacacaggggaaatattactcaggggaaatattacacaggggaaatattacacaggggaaatattacacaggggaaatatacacaactctaattatcaatctggatctgtgatttttttttcccatcaagcatcagggccaatgtgctttccctgaagacaacaataaagtacatttctatagctaaaattagagtcactatcagagttggaaacaccaaatgccactgtcttaagtactggacaaactggaattattgtatttgcagtaatgacaagccagtggattggcaaaaccacacagtcacaggcttttaatcttgatcaagcaccagaactttgtgatcttcagattctaagtccccaacaaataactgacgaaataccctaacacaagatacaggcccatactgttaaaaccatcatggtaatggggacactcaaattgaggacgcctcacccatcaccaaggtaacagaatcccatacgctgaccaaatcaattctatgatgacatcagttgacacaaaattgtgtgcaggaaccaggagcaggtagaccaaatgtatccattagctgtgagttacataacaaatcaatctaaattctagtttaaaacaaaaagccctcgttgttggtcatgggtctgtgggggtgggggatggggaataggtctgtctgatctgtgctgggccaattcaagtgtctggacagatggctagtacaatcccatcagctggttgaagggcatcactgagcctctgtaagccattcatggaatgtctattccaagagagcaagcacatgtgtatgacgtctcccaagatctggactaaggaacacacttttacttctgcatttctattggccaaagcaggtcaaaatagtcatatgcatgaaatattctttttgctgggcagctgtggtgcacaccttcaatcccagcactcacacggatctctgtgagttcaaggccagcctggtctaaagagtaagtaccaggacagccaggactatacagagaaaccctgtctcagaaaaaccaacccctcccccagacccccaaaagcttaatccctcttcctgcctctgcctgtgctttgcatatgcatgctcacaccttatgcatgcccacaccttatgcatgctcacaccatatgcatgctcacaccatacgcatgctcacaccatatgcatgctcacaccttaaaagctttatgatctcagccttgcaccaaataagagccatctggctgcacctgaagatgtgcctgacccgagggtgtagtcagggcaaacctctctccccactgtctcttcttagcttgggatgtgaatacagaccataggctgacagttagttattctactttagcggagggctgctggctccactagttggcttcttcacactatctctgcttcctcctcctttgccccactgccaccacttaggaaacaggcaaaagctgcctggactgcatctgccaactgcttttccagatctaggttccgacatgtatgcggccgcagttattatatcgcatcccacaaactaaggcgcggcttctgctttgtttggctttagaataatcaccatgaccttttggagagtgtcactctccactgccactgggatgctttaaatacctacttgtgaggtctggacagcatggggtgggagaagaagagaattccagaaaccagaacaacagcacaatagaggagacagctctactaggaaatgcctgaaggctcctcggagggaattcctcaagtgggaagggggagcacgtaacccagctgccttgagcgaatcgcctgactctgacttattaacgtaagcctagttttcacctgccggatagggtcaatgcttatcataccaagcaccgagagtgcgacacaccagaggattataagagatggggagatcaccatgaagaagccttgggaaagccaaataatcaagcactgcatcctatttgtttcaatccaaaagcctgggtcactaaagcaccaacaggaagagtcaactactctcttccaaaacgcattctgtcccagagttccgggtctggaagagaggcaggtttgacagggagagtgatgtaattttaccagaaggtgaagtacccagtgtgtgaatgcttaacagagccagaaaggctctcagtgctaagcgccgtctgggttggcttggtactcgtccatttggctctttgtcataattggacagtcatggatttaaacttgtaatttccaggtaaaaccactccgccacagggtttctcacttccgcttctcaaccacttggcgtggaaacaagtgccatccttggatcagaaggtgaagagctggctgacaggcactcaatcaccctcagcttttaattagccgaagggaagccacgtggataaggaagcaaacatctggcattatcaccccaggaacaccgataatgacaatgaaggcaggctaccaactcttcagcagaaggcacacagaacttcctgcagacaggcgtggggggtggggtagagcatgaggaggccattcatccagctcccctccccctctgctctcacgaaccaactgtaggctcaaatgctctctctcccggcctcatttgtttgctcgttttgtttttggctgctcattgctgctcaaaaaacccaggtgtagggtaggggcagctgctttggacagagaatgccagtgctgcctgcaccaagatgcagtggagaggcaccagacatccacaaggttcacgcaaggtgcttcagcttaggacaatttctatcacagtttctgttctgcttgcctctcagcttcgtgtctttccactctaatgcaatcatgagataattcctcggggctgttgagagcatagcgagtctcaaataggcgatgctggtgtgatcgggttaacttcgcccaccgatttatcttgcctttcacacagtgttcttttattttcttcttccaggtatgagttgaggctggaccaggaaccagaggcagcagttttattccttcgaatgccagtgcattctatggcttgttttcagaatctctgaagcaaggctggctaacaatgcactacttgattgctctgactgactctcacccacagcattgagacagaggagcccttagccagggctccacacaagaaacctgtttcccagcctcctccatttgtctgacgaccctttcctcagagtccccagcatacagtacaaagatctccgttttctcccttaaatatcacaggaggcccacatcaaacgccagacctctttcttcctggaatgctgccaatttaatctaatatgtccaggctcacataaatttaattaaactcacttatcttttaagtcccccaccccaaacaccacctcttgtcacctctccacagtaaaagcttttaaaatgggattttctctttgcttttcagccaaaatgtcatgcaggtttactttaaagctacagcaatcagatgtatactacaactagtcagtagggcccatgtattaaaatgcccacaagcccttaacacctttttttctcaaaccctatttggttacttggtgagcaattggggggttgaagtgaagggaagtggggaggtgggcgtgaagtttggcatggagggcctccccaaggccaaaagggtaagttatgccaatcagaagtcatgagtgtcttaaattttgctttaagccaggctatcaggttacaagttctaatgaactgctcccgagaaagacatttctttgtctcaggaccactgagaactagccaaacagagcacctctcagaaactctcccacctcaccacaatggaacaggaaagccaacaggagagcaaacgaggtccgtgaagagactccgttgcgagtagctcttaccaaggtgagcagagtccccctgggaaccccggtccgggctctggatcctcccggttcaaggaggtgatggcgaggggtcctggtggtgggtgcgggtagaggtgtgcgctgtgcatgcttcaacaggactcccggcaggctgcctgcctgcctgtctgc

SEQ ID NO: 113 - DNA, 7577 bp, Mus musculus
gggaagagggatcgcacttcctcagaaggctagaggtccctccctcagccgtcacggctcccccccatcccccgtggcccttaatcccctggtgcgggggcttgtttctaaggcgctgagcccttcacctttccggagcccggcatggtgctggcaacgcctctctcatcgcctcgttttaaaaataatgcgttaaaaaaattcagtttgctatgcgaacagcattccaacagtacacaattatatccgaaatagttaagcaataaaagaaaaaaaaaatgacgggcgttgttgaggcaggaggattactgcgaattctactccaccttgggctacataccgagattgtgtcaaaaaccacggagtgggggaaattaagtgaagtaatcgtctacgttgggaaccaaaggtatagtcaaggtcagcttgagacatgcctgggctacctaaggtggctctgcccaccagagtgggacacaaaacccacaaggatgagggtattgtcatactgctatgtaaatgtagagttttcaaatatgcacaaaggggtttttggtacctgtttttccaggtcttagatacattttaagtggtcgtatggctattctagttgtttaaagaacccatagttactgggcttttaaggtatttacaatttttcatttctacaagcagtgatagattgctagatcaaagggaatgcccatttgtaagattctgaaccttaacagaggcttcctagaagtgttcttattaaaatgcattttcccagtaagtattagaatgctgcgtgacagcatgaatcattctgttactagtcagccttttgtcagactcttgtatgaatttgcattttgttacctaggtataaaactgaatactttccatatacttactggttctttatgaattccttgcttataagttgttttctttatattcgaggtattaacatttttaaaacttacagtgcttttgtatattagcaatattaacttttatttaaagattgcaaaaatcgtttggctattaaagccagtaaggtttagtttgtgaaaggttttaactttgtggtaggcatacctaatcaagcttccgtccctctccaactccctgcttacctgattgcatttccgtatacacttgcagggtttttattgtacatgtgcacatatgtcgtttacttcatttgaagtttacttaaaaggagtagtcttgcacgcgctcgactggccaggaagaactggtgctgcttttataggcctaggaggggcgtgtctcacacccggattggttatgcactaagcctcatttgcatgttcctcatctgattggctactctctctcagtaccttacagaacctcattatcatacctcatttgcatgtctcacatctgattggttatactctccgtaccttacagaacctcattatcatgcctgggccaggcagtgtctttgcaaaaaactttactgcatatgtacacattggttgtttgtccaatcttatgcgtggtggccagcagtagtcagtgccactctgcaacggcacatgtggcttcccacagagtaggagttttcaaaaagcttctctttttttttttttcttccaagacagggtttctctgtgtagccctggctgtcctggaactcactttgtagaccaggctggcctcaaactcagaaatccacttgcctctgcctcccgagtgctgggattaaaggcgtgcgccaccatgccgggccataaaaagcttttttaaaaaagggctggtgagatggcttggctggtaaaggcccttgctttgaagcctcgggtcctgagttggatccttagaacccacatagtggaaggagagaaccaactctgacaagttgtgatatgcatctctttccacatagtaaaataatgtaataaaatgtaaaagggaaaagaggggctggagatgtagttcagtgataaagtatgttgcctagaatcttccagatcctagatacgatgctcagttatggcagaggcaggcagatctcttgagtttgaggccagcctgatctacagagtgagttccagaacagccagggatacacagagatacacagagaaaccctgtctcagagagagagagagagagagacagacagacagacagacagacagaaaagaaaatgctgcttttacaaaaccctaactttccaaatgtgcctttccgtttattccattgatttgctactgaacagtaatactgtttcagtgaatctttaaaaaattgttttattctgaatttgtatatattattgtgtgagtgtatgtgcaagtgtgtgtgtgcatgcacgtgcatgagagaatatgtttaagtgtgtgtatgtttgtatgtgtgtgtatgtatgtatgtgtgtcagtgtgtatgtatgcgcatgtgtgtatgcatatatgtgtgtcagtgtgcatgtgcatgtgtatgtatatatgtatgtgtgtcattagtatgtgtgcgcacatgtgtgtgtattagaggaaagtgtcatggaactgcttcattcctccacctttacatgggatccaggaattgaactcgggttgtcagattttgtactaagtgcttttatctgctgaaccattttcttggccatcaaattttaaaaatatatttattattatttgtgtgtggatgatgagaaggcacgtgtgccatgagatgcatgtggaagtcaggggacaactctgtggacttgcctctccccttttacttttcgtgtgtgggacactcggtgtgagcatccctgcaaatgctatggcaggcagagcagtaacgggagtgacgtccgtgtgaggcaagaaagacatctgcttcagctccactcagtagctgctgtccgttcacacctctaaagtctgatcttgggcagtttattctaggcacatttaagtacagtacagctttggaaaaagtttcctggtaacagttaaccaaatcccatgtgcatgttaaagctcaaggcatgactacattgaaacccttttgtaaagtccatatgacatcttccatgaagatggggtctattgactgggaaacagtgctcaaactagaggtctctggagtaagagtctgggatgaacataatagtcagtgggattcaggtgtggcctggccccacaggtcacacagatcaccaagctatttactacttccattcctagccttctgggcagaacaggttatatatctcttctcttgaatagataacccttcgagtttaacattcctacctttcctagtgctttatctgtgagcacaaggaccccatttcctctacaacttaggtcaataggcttgtgggtcaagtgcttttttctggttgaacaatctcactggctctgtttaatgcacctttagtttttaaagtttcagtagtgcgaatccctgataacagtctttaattattattattatttatatatttatttttatttatttatttatttattgttttttttttttttgagacagggtttctctgtgtagccctggctgtcctggaactcactttgtagaccaggctagcctcgaactcagaaatccgcctgcctctgcctcccaagtgctgggattaaaggcgtgcgccatcacgaccggttgataacagtcttaagaactagataggtgtaatggtgcatgcctttaagcacttgggaagcaagttcaagaccagccagagctacctagtgagacccaagacttacgattttggttggaatttgtattagttttcttattgtttgtgatgactaggcaactttggggaagaaagcttatttcagattatacttgaggaatacagtctgccatgcaggtaagaggatgaggggacggcaggaggcgtgtgaggcagctgatcacatgtgtctgcgggagaagcagagagatcagttctggtgttcaacttactttttattcagtctgggcctcctttgatgcaatggtgcccccatatttcaggtagatttccttcagttaactcaatctagagaattcctcactgactgacttacctagaggcttgtctcctaggttattccaaattcttgcaagttgacagctagtattaaccttcgcaacttcaaccctagtcattttgacagccacacatcatttttatgtcataggacttttcaaccccttgtggctctggctcatggccatctcctaatgctaaagacattcagtcccactttgcattccacaaggtggaacccttcatggctgccctcaggacacccttcctgctccaggttccttccttccttccttccttccttccttccttccttccttcctccctccctccctccctccctccctccctccctccctttcttcttttcttttctttctttttgaataatttattttattttatgtgcactggtgttttgcctgcatgtgtgtctgtatctggttgtcagaagtcctgtagctggaattatagatggtggtgtcatgtgggtgctgggaattcaacccaggtcttctggaagagcagccagggctcttagtgagccgtctctccagccctctgggtttctttttaatcgcactaatctgtttaacaactgctttgagacatactatgtttgtaactttaaagttgctctcacttgctcccgattttgctctctctactaaggatccgaagagcagtgaacagcacacacagcatgaatgctgccttgttttgaaagttcttccatcagaaacattaggatttggactttgtgttgctcaagttctcaggatgtgggctggatgtagtctctgtgcttagaacctcatgagctaggtctccactgaggcattgctcttggcattgttgtttttcagattccaagaaaatgccccaatgtgtgctgcttctaggatcctagagatccaaagactcctgcatccttccacaaaccttttacatcacctgagatctacataactgtgtttatgacagcaacagctccacttctaagtaccaacttgtcagaacacgaaagaatggagtcgtatgaagatattagtgcttgtgaggaaacgccaagaaaacgcgagccttgtgatctcagttccttcaaacatggcgccattcttagaatgtgcgttcatgcttctcccagatgtagcccgtagagtgggttcgcttcagattactcattaaactgcctattgttatttgcttatatgcctttatggaaaacatgtttttgccatgtgcaatttgtccttgtgattgcacactttaccatgtgactcctctgaacactcagagtataaattgaatggttctctgaagaaagctggctattggatgagactttagtgtgcctcatttatcagctgcactctctcaggtcccatcacctccggggcagcgacaccagctttctgtctagttacttgctttattgccatgaaaagagagccaaagcaacagaaggagtaaaggatttcctgtgctttctgttttactgaaagttcaccatgggggtgaagccatggcagcagagcaggagtgtactgcatctgtgtgcaaggagcagagagagatgaaggctcaccatggaggtgaaggcagtggggcaggaggagcactgcatctgtgtgcagggagcagagagagatgaaggctcaccatggaggtgaaggcagtggggcaggaggagcactgcatctgtgtgcagggagcagagagagatgaaagctcaccatggaggtgaaggcagtggggcaggaggagcactgcatctgtgtgcagggagcagagagagatgaaggctcaccatggaggtgaaggcagtggggcaggaggcgcactgcatctgtgtgcagggagcagagagagatgaaggaatgctgatgtttagctttcttctttttatttattgtagaaaccctgcttttgcccacatttagatgggcttttcccacctcagtaactcagcatagacacttcctaacataatgtccatggccttcccttctaggtgttttagattttgtcaagttggtgacgttaatcatcaagaattgtattaaaattccagatcatggaaaatggatgttatgtaaattaattttatttttgcaatactaatgattgatcccagagtcttgcatgtgctaccaagtgctgaaccactgagctacactcccaaagaagaaacagattctttataaaggtaatatagacatcggttgtaccaagtgcttcatttgtgttcggttgtttatatgagacactgtgtcatgtagtccaagtgcccaggccattgaacttttgaccctcctgcctcagacctgctagtattagaggcttaagccaccacacaaactgagcagtggtctctcttatgttaattcatttaattcacagagcctcactgctattgctaacttgaccggaccctccccacctctgtcatgggtagctgaaacagaggttatagaaaactgattcaaactaattcagtctgatttttctctcccagaatttataggtaggtttagttagtttcaacctagaaaggtatgacacagacaaacagacctttgagccacacacagtcggatgtgggaatctttgaaggagtgcacagacttacccacgtctccaaataaactgctaatttaagcccacccaaaccacctctggcataaaacactggttttgcaagttttcaagtagcagtttctccccatgtatcctataaatttcttatttaattcatttgtttcttttttccctctttacaattgtaactgcttattcatagccccctttacgtcaatctgtagaaattctttcatcagctgagacggcaaacgtcagtggcgtataaatgtgacatcagcctttgaagtgcattccagaacaatgtttcctattggatcgttccgttctataactcagttttggtggtgattcatatgaggatgacagtgattcatctgatttcagtgagccacaggatctcaaagaagaacctcacgtcctacagcccaatttaaaaagaagttctcacatctgagtaagagcagttacattccaatacattaaacagagccaggcagagtgactcatgcctggagccccagcatcccagaggcaggaaggttaagagttcaaggccagcctgcactacaaagactacgggctctgtctcaaaaacaaacaaacaaacaaacaaacaaacacaagcagcagtaacaacaacaaccaccaccactaaagcacactttggaatgaagaaagccattttcaagaggactactttttacttataagatggtaatcagtagaggacacaactgaataagggtctgcaatagaagagtcaacgttgaaaggaaattgatatttcattattaatgcgagcacatgattctttcccaaagtctgtcttaccagacagatttaagaacacaattgctggggttttagacatcatataatgtatcacataatccaatgccgcctactgcagaacctcactggagatggaccaccatgttcaataaaaaaaatgtcaagc

SEQ ID NO: 114 - DNA, 22835 bp, Mus musculus
aaagctagacataataagagatctatttatttgtagatacataatacatacatacatacatacatacatacatacatacatagctgcaagagcaacaatgtaaaaaggggagagctcatggtcgcttggccttccctggcacactaggaactgcccccagtacccagagtacagacagttttctgcccagagctgccctcctccatggcagcagcctcttcaactcccataaaggactgagttgggttctaaagctacatcatggacctgcctcagaaatggggcctgcttgtatgttcccagtccctatcctgttgggagaaatatggccaatggcagtaacttccagctttctacaaggtcaggattgggagggatagactttggggtctcagatgtccctaagaacaacagacacattcaggaacctccaaagttgtctccaagctgtgactccgggcttgacacagacctataacattatcctctcatgtcaaaggtctccagaggtatgcactgggctccatgaaatttctagagcctttgaccttagatcagagtttagggagagggagcacaattcccatagttctctgtgagaactgcaattccctggctccccatttacagcactaggaacacctacactgcacctcaggaacaaacctcagcctcctcttctttaaaactcagcattgtagacgatgccctataacaactattcctccaagtgtcagtgacttctctggcgcaatgagtttgattgtgtccccccaaagttcatgccttagaaacacaattcctaaattcacgtgttcatgatatttggaggaaaggtctttgagagataattaaaacgagatgaaagcaaaggcagggactccaggacatgcagcagctttgtaatagaaagaggggagatccatgctacagagcttgctctgtctgaccacattgccctctatcatgttgtgatgcagccaaaaggtccttcttcaccggacacctagcaccagtgaaggaagatagggagaaaaaggtaaagaagaaataagatggggagggaagaggagttgtttcctcttctctgggctacacttacaaggctcatctgacctaaatcccaatcctagagaacatactaaactactgcaaagatttaccagattgtcctagaagattccagaatattaactcaatgctttctctagaggttagctcatctgtgggtactgaaagtgctcagattccccaaggacattgggagggtaagcagaatggcttagttactgtgagctgcgtcccccacctccattttattcctacagatctacttagaaatctccacagcctccttccctcccagtctagcgtaccataccacgtcacaataaacacatcaaaatgcatccatatcctgtttcaaatatcatttacatataacttcagaggagctggggtgagctccatttaacaagttgacatgatattacattatgcacatattcaattaaacatcaattaactttgatttgcagtcattttgagaagttgatcatttttttcctctgtcatcaaatacccttggaaagactgtaatctgtagtccatgagttggaggtgctctgtccttcctgaaggctccattgctgggtgccccatctatctgtgcgaggccagctgctgcccgtttcttcagttggaagttttacctacttcttcccccagatgatagtactcagagtccatggagaatctgcataacgacagaggctgctaggtcctatggtcagagccaagaagggaggaggcagccatagattcaagggaggcagtccatgaagcacaaggagaagcctcttgaccaacatcacagaccctcctgtgacttacagtctgcaaaatcccttctttctcagtcttctctagatctccacccaatatctgtgaagtttgcaccatcacccccactttccagatgagcccacagaggctcagggacatgtgagagactatcaccaatggaggagttctggcttcaccttcctcaccacccactaagggtgggtgatttgagccatcggggatatgtgttttctctttgcacaaatctctttgtgaattcttctgtggcctgtcagcatccaaggtcagcaaggggtgccaggcaggggagtggaccacagtcccagccctgaagctggtagggacggcacaaagccagagagttgggtaagttgtgctgctgagcgtcaaaacgtgtcaggtctcgccccagcaggctgctccctggaattagcagatacaatcctggagtcagagagccatctccttggatcagctgtgcagggcaagacggggcggggaggagaaagccattcatgggcggaaagagtttcgagtggcctgatgccagggcatctggggtcacagtgcggtccccaagtcctttcccaaaccaggacatccctagctgtctgagtctgatatcaccattgaatctgcaacttaagacagcctgctgaacctgtctgtctgtcaccccaccatccacagttatctgaggaagcttaatggagaagcaaagcaaaacctgtggaaatggtgccctttccccctctttctttcccttcctccttctcctcctctttcccctttccccttcccctgcccctaacaccataagctggagtgagcttcccattctaggtgggccccagcagctcccaagtgagtatcggttgtctacaatgtgtcacgagcaccaccagttacttctcagttgggttcttgaagttcacagaaactcaacaatgcagaaagcatcatctttttgtgtgtggagaagaggaaatggacagagagctcattcatttgcccaaggccaccaaagtagaaggcagcagagttggattccaggccaggtgggcttgctccatgatcttctgaacgtccacatctgacactgttttctccacgcttgccctgctcctccaggccgtgagaaccatgtgataaaaaataagagccttggcttagcatccgaggccctccacagactcccaaagtgtcttgagctagctttctaaccgtgtttcatctcagccttataactgcagtacttcaacctgctcccccaaccatgctatctctgtgtttgtaaagatctgccctggcaagcctgggtccatctgccagaagtggccttcaccatctcctccctgtcatatccacactccacagagtgaaatcagagacagtgacttggaggaggggccacttaggttggagtcagttaatcctttggattcatgaaacaactttcacattcactacaacgtgatatggctgaggaaacatgggtgtttattcaaatatcaggtcaccagacctggaatattttcagggcaggcctggtgaactgtttgtgtctgtatcctagcaactggcatgaggttctggctcagagtaagtactccttggaatgatgatggatggatgaacagatggatagatacaaagatggatgaacacttggatggatgcttggatagagtagggagtgactggacaatgagatggatggatgggtgtgtggatgagagataaacagatggacagatggatggttggttggatggatggatggatggatggatggatggatggatggatgagtacatggatggatggatggatggatggatggatggatggatggatggatgatggttggttggttggttggataacttggctgcaagatgaataaattcgcagagggatggaagaaaaggaaatgagcaaattactcatgtcaataagcacaaaactactcagccctgggagactccaaaagcctctccgatttgtggtccttgcaaccttttgttgcaggtcaataaagatctcataggcccccctctgggcaaagaaccaagtctgtctcagcaggaagaggggaaaggaccccagtctggaactctgagcttatatcctggaatccatggctgcactcgaggaagaggaggccctgccccatccctagagaggagccaagcagggaggagtccacagttccatctttccattagctaagaaactgttccaagcatggcctctcccaactcccaaattccactgctcaggataatcggagcctgggcctgaggccagtgttgcttcaactccaaaaccaaaaccacactggcttgagtaggagaggcctggggagtcaggatccaggagggcaggggcaggaagaaacttgaccaaccactggagacagctgcaggcagcttgacctccagccaacaatgatgtgatcagggattgcagcccctctcccagagcactcaggttccttctgacaccggcttcatgctgggtcccaccacaccttcggctcccctcagtccccacccagcatcctcacatctgcagcaagactctgccaagttaacagctgcagcctatgttccaaatctctccaaaccctgcactacccacatggctaaagccacatcccttctgaccccagagcagtgccctcaggaaagaaaggctcattactccttggaaatctgcttctgggcagcattgaagacaggctggtgagcctggagcttgaacaaagttcctgcaaggtctttagggcaatcaaggcccccatgaccacccagcacaaagtttctcggccactcgcctgctttccaggatcaggggctctcccaaaagctagccagcccagctatgggctggaaataatgtgaggaaaggagagggtctctccgctgatgcacctgccttctcctcctcaagaaggcaccagaaaaagctactgtggtcaagagaatggaatattggttctttgacctctcagcagtttctgcaaattggaaaagggccctgactctacccacatagtatcctagaagctgttgcactgaggtgggcaggagagattcttatggaggcgcaaacccactgttcctagatccacccaagaaagaatgagccaaatcctttgctacatctgaatcactagtgaacagcccttattgggccagctcatagcttttatgccatgcatgtgcaagcctcccagtgggatgtgctgccttcagtgaggcacacccatcaccagcactcatcgcttgaaacccacccacctgtcaccacggcctgacgagcatttccaggttctctgcctcttactcaatgaactgaatgaaacgaagcctcgcatggattgcaaaaaacagcaaggggattctaaagcggtgcagtagtaacgactcagaaagaagtatgttgtcaagaacgacagtaggccacatgagcaagggtactcaagggctccaattattatttggggcttctcttaatggggttcaagagaagaaggtgtatggctgttaagggacataacacgggtagttctccattttgattgacagacttgaatgaggattacacaattacataaacctatgctcagagcacatgtcccttcctgcaatgcatctgattttaatcatacgcctgcccaattatgcataggcataagatggtaaataggggattctccctaagggttcactcagaagacacagtttgccttattctgcagacatccaaaaccaatcttagccggatgaggccattgccaggagttcccaggtttgttccagtgtgtgtttgaatggaaacaatgcattatcaagaggttgctaaggggagtaacttacttccatttattaaagcagatatacagtgcaattcactacaatgaggtgtgcatacttggtttgccaaatcaagtaaggtctccggctaggaagctattccctatgcttgcccacctcacatcatactgaagctactcaaatggcccctggaatcagtcagcatgggggaggttttgctggcaggatcaaccagccccttgccctacctcagtgattcaagaaaacacaaatccatgtttggttcacagtccatttctaatcacctgcttgaaccaagcccacgttctgatcttcacccatccctctgaccaatgatgcctcaggaaccacagtcccatttatagcagctgagacctccatgtcctacagatatatgcttctctatgaccacaaaaatacctgggccactaggccaaagaaggccaacagatgcctgatctcactgtgtggccttgggggtattcactagcctgtttgagaatgggaaggagagataggagttcccaagatgcttgccatcttggggcaaaccatgcccaatctccaattctgacccagacctggggctcctaaaattctctctcttgtggcccactaggggcacgagggctggctagttagggcttattcttaagcatagttcctcttctcccagaaatcctccactgtttggacagttacacccacagcaggcccttagcatgattgcatgctaccagtgacagagtgttcactgcctctgagtagattctgccctgttcttggtttcgaaagcaacacaattaggcatgtggagggatcacaaccgaatgggtgaaaatgctggagtgctctccagagcccaacccaattcagccctaggccctcggcctccagactgccaagcttgcctctcagattggaccattacctgtttctccctttggtcgggctggagagtcgactgatctgatctgatccttaagacgctgatttccctggcatggactgctcagaatcccataccgatgccccctaagaagcttcattcagtctgtgactttgcaccaggcttcccagcctccagacctccattcacatccatcaaatggaggatgggtctctataaatgttaccttccaggtagttaagcaccccacctatcctgccaccttccagacctaaggaaagcaacagagaagccagcagggcccctagtgaagagggaggagatacaagagcagaccccaggctggccccatgcccattttgtcaatgtctgctttgtctggagctcacagcaagcaggtgagttcattttccattaaggacaattagctcttcatttgcatatgctaaattcgacatttaagggaacagttcctccccacccaaacaggatgaaagtccaatgacaggcaggcaacctgcagtttggggcagaggtgtaattggctcttattaaaggagatgtgggagatacaggttttgaaatgcaaatgattgcatcagtccttctgccaggccagcatagggaatgaaaggaggaagctgagcctcttttctgctccatgtctgcacagggcagccctccttcctgacccacagcaagagagtcagagaagctgggcagaaaggattcctaatctcccggggagtgcagagagcaggacagagtcacctccaacagctccatcccttgcctgggcctgccctgtctgagtcaaccacttcctagtccctaaaggaaggtctagtagcttgttcggcctgagcccaacaatcccaactgcttcctcatggcttctcccacagcatacagtcaggaagccctaaagacccccacatagaccatttgccactcccctgccaagaggtctccccctcccacccacccaaccatctcattcttgtttcaagctagcttagaggctgtttgatctgccttgtgagcccagactgaagccatggtagcatccttaccccctctgagacttactaaaaacagaagaatctgcctcataagagttagtcacatcatagaaaagaacagaaatgagtagatgaaggaaagatagaaagaaggatgggtgtatccatgcatgggtgggtggatggacggatggatggatgggaggatggatggatggatggatggatgggaggatggatggatggatggatggatggatggatggatggatgggaggatggatggatggatggatggatgggaggatggatggatggatggatggatggatggatggatggatgggaggatggatggatggatggatgggtggatggatggatggatggatgggtggatggatggatggatgggaggatggatggatggatggatggatggatggatggatggatatggtatggatggtacatggatggatatcaatggatgcttatttgtaccctatgaaccttccttctgcccttgctttaacatatagcactaaagtaaggctggatgagataaatgccacattctgtatgtaactcagtgaggaaatccagagatgaagggtctatgtcatgcctcaggataccccactcaaatgtgatggcgataacttggcctcaaagtcctccactgtgatggaagtcttcaacctaaccacctctcccatgtgactgtcacagctccttccttacacaaccctaactacctgggcctcttcagatacagaggctaactatgcaggtacgtgttcctgtctctctgtgtctctgtctctgggtatgtgcatctgtctctgagtttctatctgtctctaaatttatctgtctctctgagtgcctctgtctctctatttctccctctctcagtgtgtgtgtctctctctctcctctttctcttctctctctctctctctctctctctctctctctctctctctctctctctctctctctcctttctcatagaccaaagactcccagctggccactccagactgaagaaagtagtcacaaagcctttcccagactggcttttcagggtctcaactactgacccatagatctcactgttccctcccaagacaggaaggacctctgcagtgacagtgtcccacacatctagaattgaagccctgagataggaggagtggagatacagggatggggtaagagcacagaggcagaaagagcagagatatgcctggatccacacattgggatgaagatagtaagcagtctaggcagccacgggaaccatgagggtttgatgctgacctgtaactgaatagccaggaaatgacagaatgctataggggtggaaaagactaacccagaagctctcatgcctgaccccacatgggattcacctaggaccacttaccccttctaacagctggccaccctagacctattaagttggaacacctggagaagaaagcagacatctatatattttaggatccctgggagattcctgaatgattcaaagtttgtcggccactggactgcacagcagggttggaactatgagctaccacacccattgtacaggccagaaaagcaatgccttggaggtctccatattctcagacatagggattcaaacaggtctgcagaccaggctctaccctcaagaccagcctgttcccacattgaaccctagagataaccacaaagagaccaggatcctgactcccagagttccagatctgcagaggtttcctgagagagtttctaagttggggggtagggggggacgtgtcagcaggcaggaaggatcccaaagacaacatggtggggagtgagtgttgcaagttaggtgcaggtctatgtactggccagctcacgcatttctcgtaaaatccaaatagtccttggctcgagcccaggaacctctcccatctgacttcattctctggcatgcggggggtctgttcctggactgtgggacctagacatggactctttatctgcgtctttcctgacatcgctctaaaggcggtggcttaaagatagcttcctggggattggggcttcctcctcctggtctatgctgaaaacacagatgtccacgtgatgcccaggctacagttgtcctggaaattagaagggctcatgacagttccctttctccagtccccaacctatctataccaaggaaccagaccagccaagttttaagcatggaacaacatactctctcacagccctccagagtggagcgggaactccagttcagctgtagccacatgttgggtgaccttgaagaagctgcttaactcctttgagactggacctaatgataataatgaccctcatcgctcagacattatgaagtcggggttaaataaggcccatgaaaactgtggtgccttggacatattattttatttctattgcctcagctagcctgtctttaaaatgggaacaattatacttaagaaggataaagtaaggattaaattctttaaaatgagtcaatctacacaaagtgcttaaaacaacatccagtctatctgccaggccagatgaggctctaagcgtggggctggcccagagaggctcaggaaaatgcctgcctcctttctaccttccaggcactttgcagatacaggcagatcacttagctgccttctgacagctagtggctggctctgagccagctctgtaaaaaacactggaaattgtgcctactttctcttctccctttccacaggagatggaaagacagaagcttgagcattgggcaatcttaaccttgtcctgctgtgtgatccgaagtcaaacactggaactcacttggagatagctgggcacgccaccatgcctgccccataacaaccactagactgcctctcctgctgccctcgcccagggtgccctagaatagcggagaatgatagaccacagggtcgttctgttgctctgttcatttgggagggttttggtacaggataaaaagaagcaggcaccaggctggccaaaatttccaccaatgtccaggtaacatggagcccaactcccacggagactctgagggtcaaaaatgttgtgtcttgccattgacccaggagatgtggaagagtgtgaatctgaccataggtcatttgaccccatctcacccagtctttcactaagccacactcttcaggaaccatctggaagtttctgcagaagtacctggctctgaaagggacagggaacagggaagtcattgccaagctatttcaggtcaaaataaactatcatgctgccaaacacaagggtgataggggctgctgggaggcatgagcagaaatggaaacacacaccacagacacacagacacacacacaccacagacatacacacccccccacagacatacacacacacatcacagacatacacacacacaccacagacatacacacacacaccacagacatacacacacacaccccacagatacacacacacacaccccacagatacacacacacacacacatacacacatcacagatacatacaccacagacatacacgtacacatcacaaatacacacacacaccacaaacacataagccacagacacacaccacacacatacacacacacaccacacatatataccataccacacatgcacaccacatgtgcacacacacacataccacaccacacacatataccacacatgcacacacataccataccacacacaacacaacacacacagagatatacacataccacaccacaccccccaaacacacataccacaacagacacataccataccaccacacataccacacaccacacacacagacacacctaacacacacacacatacctccctacagccctgtgtccccaggaagtttctggaagtacagagaagtttccaggactcagtgaagaaaagggtttgatcagtactaactgtgagtctataacatcggacagtcccctcactccgcaaggctgctccttcagcatctctgggctctgagtgcaaagtaagtaggacaggaaatgtccttgagtcctggtgtttgcattttagtccaaagggtggaggaaatagacaccaaagacagtaaagctgagtgatacattagggggaagtagagaggccacacctattgtccccgcatctgggcggctaagtcagaaggatgaagagttcaagtctagcctttcagcttggaacagcctgggagacacacaatgcacgtatacatgtgtatgtgtgttcatacatggaggaggaggagagagaaggaagggagggatgaaggatgggaggaagggagggagagagggaagaaaggagggaggaaggagacccagactcaaagaactgagaggttaagcagatggctccatgagaaaaatacttgccatgcaagcatgacgaagttccaacttcagatcccatgtaaaaccgagcggagtacaagtctgtaatctcagcactcttacagcaagatggaagacagagagagaaggatccaaaaaccctgaaggcctatggtgacaaacactgatccagtctcaaacgaagtggaaggcaaagaccaacatctggagctgccctctggcctccatgcccacgctatgacacttgagaacccatactcctgtgtgcacacaggaaagagaagtaagcctgagtccagctgaaatggagctgaccacacagtggcccaggaaggagagtcacctgccgtacaaggacagagaggtgggtgccatcaggtgaggtcaggatgagaaagaaaggcggggacgctgaggtgcagtaggcagggaaggaaaggggatgtgacagactaaagatggctaggccagctctcaagtccaaaggtcagcccaggatgtgtggcctggggaggaccctttcacaattttgtttatgcatcttcttccagtagctaggtagaggtaaacacagggaacaccagcagaaacagggatcccctgtaggacagtagaggagaatgtggacaggagggacagtagaggtgaccaggtgtggagagatgacagactgaggcagtcagtacctttgattgttagcagaggagcaggaagcactcaagcaatgatagagacatttagagactggcttgaatgacagcaggaagtgagaaagccaccttcatctggatggagcaccttctacaggcctaacaccatgagagagcaaggagaaagagatcctggctctgtttcctcctggaggctggaaggtgactagggctctctaggggacagggcttgtggggccctttgctcaaatctacccatgactttctgtagaaaagaaaccaaaggactcagccatgcccagtgacttggactctagctcctaattgactggggcctgggattccccaacacagaatggaacatttattctacacccagcaccagggcctgcctggtgacacccaagctctcctagaaccagaagcatggaagaccacacatggaaggcctctcaacaaaaggtaaaaaaaaaaaaagtgtgcttagtacagcccaatgccctccactcttccttccacccagagaaggtagattcttcagaacatctcccaacctcacctcggggaaacttgggagccctttggactctgaacacagacagatgtgacttcagatgcactatatagggcttccttcataaggccagaggaaagtcacttgtgtgtttggagattctatcatgctctggtatcaaagggctttctgcatcccttccagctaacacaccaggcaagcacagcgatttcaatctcataagacgagtatgaagaccaacaacctggtttttctccatttttccttcatgtcccagactttcagaggcttttcctggccccagtgctaggctgtgtttcttgttaagtcaccttatcctggcagtggtgatggcctttaatcccagcactcgggaggcaaagcagatggattcctgagttccaaggcagactggtctacagagtgaggtccaggacagccagggctatacagagaaaccctgaatggaaaaacaaatgaacaaaggatactttaccctagagtttatcatgctgataccccagggttgctcctactttggctgccaaggagccctagcttcagaaaactgatggtatagatggctaactctccattaatgtcttagttagggttttactgctgagaacagataccatgaccaagacaactcttataaaaaacaaaatttaattggggctggcatcaggttcagaggttctgtccattatcatcaaggtgggagcatggcagcatccaggcaggcatgatgcaggaacagctgagagttctacatcttcatctgaagactgctaggagaagactggcttccagacagctaggacaagggtcttaaagtccatgcctacagtgacacacttactgcaacaaggccacacctcctaatagtgccaccaagcatatataaaccatcactataaccatgcaaagaacccatccctgtacctgggtaaatgtgacttattgagaatatagataatttatacctggccccaggctcccagatgaccatggggagctttccctttcccttaaatccataatattccctcccctcaagtcagactctaggtcttcaggcagcattgactggacacaacatctggacacaggaacctgcattgtgcactgtatgaactgaaagcctgaatccaggagagtgacatgactttcctacctttgcaatgacaggtaggacagctgggcttcctaattcctgggctttgtgtatatgcatggaaaatcggggcaggaacctaagatgagcatcctcatggcagccagagaatggtggtaggtagtgggggaggaagcggatgggggctgctttgcccaagccaccctgctgcttctcggaagcaggcaatgccaagcaggcagatggccggcaggtcccctcagagccctgggacccagatggtcatcccagcattaggtaaggcatcacagcagcagcgagagagaatgtactgccagccaaagccaccaaagcccccattctagccaggggcctcactgtcttccctcctgaagcctagctattgctgtgtctgggaggcccatgggacatcagagatgctgaaatttggaagctacagttcagagtggccacattcaggaggccatagcccagaacagtcatgtcctcccaagaaaagcctctgccatttctgttgctgatctgtcagcagaccaaaaaaaacctgtcctctcctcagtcttacaaccaggctgtgaatccaagtcagctccagacctctgcatctcccttggggttgcgtgggctcaggaaaagcactaataatagactctaatactccttaagggcctgccagagacagctaggagttctcagagcttcatgggtaaaaaccaatccctgtaatgtgtaaaaaaaacaaccctgagaggcaagtctgttgaggtctccactttacagatgaggaaatggagacccggagaagatgtaaagatcctaagtcatacaccaggaaatgaggaagccagaagtcagcctggcagcctggctctggagccagtgtcctcagaaatatcatctgtctaaagccactgtgagtcccatactgcactacgtcagggagctgagacatatcacctcgggctcaggcgtgacgtgtcaagaagtgaactgcccatcacagacacacagctgccttggtggaaatgtttaagcagtgggtaaggacaagcctaggtcacctctgcatcagacagaatagacaaatgtccctgaggccaggccttaaagtcttggaggaagtgtggggaccttagggaaacatgaatactgacacaagttcattcaatcacatgcttatgaacatgtgctcacatgcacatgtgtgagcttgtacatatgtgtccctggacacagtagctattctggtgaacaaaggatattactaagtccctgcaagtgtggaagcccctggctacagaagtatgttcccccttaacaagtgcctagaggacactcccttcccccttctcagcctcactttccccactgtttgaggaaggggttgtctgaggtcatctccaaggtcttgggcttcttgccgcctggccagtcacctgcaactctctgtccccagagctggcaggagctgtgactcagaagcaagaagcagcataggagctgcccactgcccccttcccccaacacacacacaaagggcatcttgttaccacagcctgccagcaggcaagggagggctgggaggtaagggaccaggatgcctgtgtcagcaggactgggggtagggctcagttagaggctctgccagggccatcggctggctggccaaggatccccagcagtgggcaaggccttgggcaggcaggcagccctgaagagcagtctcaggaaatggccggcccccaggcttctgtatgcaaccgtgtttgtcaagctcctttttagtatcattatttttcatttggattctaaatgaaccttgtgcacccagcagcagcctcaggcctggaatttcccagctgtgtgggctgaaaccacagcccctgctcagagcttaccagatgtgagcacagtcactcttccaatctgcaaaatgggagtgctgagtggagaagatgcttaaatcacactctccagtggggcagacaccacctcccagaggagccccaacactggtcaggacaccctggtacctttcttgttgctactggctctgtcacttccttgctttggatcctaaggcaaagcacttatcccttcttacctccgttctctagccagtaaaatggggatggctgaaaggcagcagaaactaaatagaagattctttctgggcattacctggcatcatattctgacactgaacaaaggacaagctggaagacactcagattgtccgtgctagtaaataaatcagtctgcagttctgttcccataagcgtatgaatggtgtgcatacatatgtacatgcgtgcataagtggacaggcaggaattctcccaggccagtacttgagcattgaggccattatgtgaacagtacggggtccaaagcaaaggctctttgaggcccttgacctccttaggacaactggactcttgtggctggtttgtgatatccagctagccacatccttgcagagcaaactggtggctgcagacgctgcatcctccgagcactgggtggagctagtggccagctgccccctaaagcatgcattacagtcccaaggagcaatacatgctcataaacaccccctagagttgcactcccaacattttccataaacttctatgcatgggcatctcctcggatcagtatctgtaggtctcttacaccccagagaaaggattctgcattctgtcaggaacatctaactgacaggctttcaaaaactaatgtgtaatgggtactggttagtctaccagatcctccaaatgctaccgagctcccaatgttctttgtcccacttgatgcatgaaagtgaggcccaaacaggcgaaggtaagtcaggcccgtgggatcagaaaatgaaaagggtaggcacagattgagccaggggagggggtgggtatgaaggaccataacccagaaacctagacagaacacagccttagttgtgggcttggagatagctatgaacggtcggcaggcgagaaaacaagcctgcatgcgtaaagactctcttctaccatcctctactcctggggaagatcttaagacttcttggcaaacagtgtttccttttgggcagtgcccaggtagagcataggcctcaggcacagattacctggtctcttcctcccctggttgcatcagtgactgagtgtgggaggctctttgcaggaaaacagacccacccaggctgagcagagcttcctgacacaacagccactgcatccctaaaggaggaagatcagtggacccaagggccacatcacataggaaagactgcattgtactgggttaccactgcacaggaggcagttcaaattcaccacctatttagcaaatcttcactgaatgcccttgaagtaccaggcccgggactaagcataggagcccaggagaaaaaaagcagagagggcccgtgagctcacgaaactcacacgccaatgagggatgaacacgaatatgctacaggaaaagaggaaggtcccacagtggggatacttgcctggccttgctaacaagggaagacttctgaaggaggtagcactgagcaggatctcctgaagggtgaacaggagccatgcagaccaagagaaggtgaataatgttaaggactagagatatctaggcaggtggaagcaggcacccacaactttcacaagaaccatagaacatggggacaagcactccactctacaatggaggaatctgggactcctgagtgactgagtcaggcagaagaaagtgaggcccatctagctgggcagcttgttttgaccctatcccacacactgacatctccaatgagccctagctcatttccagtccattagccaaccctgactcggcagcatcaccctcttaaaggactggtttgagaggcttccggtgctacatgcaagctctgtgggaaaatgtcatgtttgtgtagtgggttttgtccattatggtgtgtgtgtgtgtgtgtgtgtgtgtgtgtgtgtgtgtgtgtacacttctgagatagatggaatgcagttccttgtgcatgatagacaagccattctataactaagctacagccccagcccatgattgattagtaatgtctgctgtgggcagaaacttggaagccttcatcactggttcaccataaccaggcaaatgccttcaggcatctgggaagatgcaacagaagtccctgtccctttccctactttgtgctctgccatggttggtctcagtgacaagggtgaaattcttaccttttgactcctgttgtaatgtagatagactatctgggaagtttgggccacggaaagcactagattgagtttcctcgtctgtacatgagtaggaccaaagggtcctggaggctctgagatctagaaaaacaaagtaattctccagcccatgacccctgagcacataatgggattgcaggaagagctaaataccatctcagggtcctgagatggagactaggggaaagcgagaccagaggagaatggcggggctcaggccaaggttgccaagtgtggtatgtgatgggcttgtactgaaaggtttgaactgtgactagcagtagcaaagccagggaaggaacaatgggaccaagaacggagaccaagccctctgacttgtcacctacctaggttggcccagaatcccctttgcttcccagcacatgggacgaggacctcagagaagccttctcggccatacagacttaaggaggtccctatgctgcctttgtgtctccctgtcagcccctcggtgtttccgcagttctggtgccttctgctacatttcagttctttccgtggtctgcttgtctcactggtctgtgagcctcaggggatgaccatgagatctgttccacaccctgggggctcacctcctcactcaaatcactgttgtccaagcagtgcattggctcaagccggcaggggtcaggtcctcaaatacctgacaattcatgcagatagagtaaatgaggggagacatgccctgttaaactcggagcagtagcaaccacatggcacattcctccctgggttcccgggctggctgcactacagcatcttgactgggtttatttgacatatatgcaaattacgcatttataaacaccatgggggaaaaactatttcccaagaaatatgctcttttccattctctagagtaaatgatacttttattttttactgatttagtggtgtgtgtgtgtgtgtgtgtgtgtgtgtgtgtgtgtgtgcacagtcataaagcctaggtttgaaccttgtgtatgctaatcaggtgctctaccattcagtcatagccccacttttctatcctttttactttgtttacttttgttagagttataggcaccaagaactatttctctagtccacataaacacaatgggccaagcatgctgaccaaccctctgcaccttcaaatggccaagtggttcttcacatgagtccctgaacctccagaggcaacagcaccacctaaagcttgccagaacccctcaggcaattctcactgaagctccgggtgggtgcagcagtgagagatttaagacgctttcacctccagggctccaggcaagtctcctgcctgatcaatttagagaagagcagagactatggcaaactgaagagcatgcatcttcccgaagggaccctgtggctcaactccagtctacctacattcactgtaagccactagccggcctgtaagcccagccttgtgaggactgaggtaggagtatctggagttcaaggctggccttagctacatctcaagatccttcctaaaaggaagagagaggcacaaagaagcaggaagacagagaaggaaagggactatcagtcagcgcatctaaatacggaaagaccacatctctctctatatgatatttttgcacctaagtattggcggcatttttgagtttgtttttaatcccataacgactaaagaaacttttcttataggttgaaaccagcccaagaacagccatggaacgacttgaggaggtggagataactctccacaggaatgttctattaagaggctttaagcccaggctattatagctaccttagtgccaacgttcccacaaagcccctacctacagtgtggactgcttctgaatcctcaattaccagagatagtctacaggtcctggcctctctctgggccagaagataaacaagatggaaaattctagacccttgatgatcacagcccagatcaagacgggagtagagagtaaaaccacgccctgagccaaacttaggttgttggctacaggcactctctctcctgcagcccacctatggaggagagaatcgtgtgtattttaaaggcagattcagataggtcaaatgatttgttgtaggtcacagagttggcagataaaagagtcaggctgtgaatctacctgcaccccaacctgtgtagctcctagtcttccaaattgtctatcaactactggatgggagagtccctggggtaaggcctggattcccctgccaccaccttctttgtccaggacacggtgaaggctaccaaccaatatcagagtgttgacccctgcaagaaggaactagtgatgactctgtgataggtagagatctcagaagaaggaagctagcccacacttggcttcagttttagagtctctctctacatggaagctctaagcccaagctagggagttttgggagctggggtcaccctggagagagagagagcagggcccaaggttgaaggttctggacccagccaagaatcttgagtcctctttccttgtctcagtctcagtgttcacatccttcttcctccgggcccagccatagtaccatgacccaggtaagcatgggtggttgccagagatttgggggaaaaagacttagtcctgccccttcctgctggtgacctcatgtggtcacagctcccagaagagctggactggccaaggtcctgccctccccggggtcatggggggaggggagggctcccacaggtagaaagtgagattccattctcacagccacaggccacagcggggctgacccacaaggccctatcagagccctcagggaccaatcagcaccaccagcctgcatgggaccacaactggctggacactgaagtcagcctagccaggtcctagcagtctgctggggccctgaggtctcactaaatggggagagatagccccaaatgacccacaggaacacataaggaaaaaggggaaagacaaagtagagacatgataagcaaatggattcggagttaagaaatggtcatccagtacacacacacacacacacacacacacacacacacacacacacaccagacccccacacaaatgcacttctgtttccatatgtgcacttccttatgttccagtattcgtaacacacatccctgtatccctctgcactgtgtgcatgaaccaaccctccctccatgcctccccccactctctcgctctcacccgcccccaccccccgccccgccctctgagcaggagttctacactatactagcagcataaacccaacccggagttgactgattgcaccgcttttgtcaaatgtcagggcagagcgtttacaacctggctttctccaccagacaaggacaccatgtcccactcacactaaggcaaaaatgtttgtgatgactgtggctaagaacaagcctgagaatcaaggtcctgggcaccccacccgggattggggtggaagggagacaaatccgggttgtgcgatgcgctctgcgcagccgcagcctggctgacttctgggccccaccaggaggtcgcctagcctagcgcagccaggaagtcagttcggagtgacagctcccccctacgctgtttgtttattcatgactcattcgcctccacagactggctcttctttcttctagaaggagggaggacaggagctggcgggcgggcgggcgggagaggacgggaaggggagaggccggctccacaataaacaatgaggcagctgaggcccggcgggagcagcggcccaggcatcccaggcccgcctgcccgaggctctctgtcccctatcccgccgccacctccgggcgacccggccggagcagccgtaattggatcttcgtctcctcctccccttcccgcccatcatcggggaaccggttaaagaccgggtacctcggcatcaccggcggatcccaacctgtgatttggctgccgggcttccccggggcggctcggcgacaccctgcaggccaggccctcccccaccgctggccctgcgtaggtcccggggtcccctccgcgcgcagactccctcgcctgctccgggataacaggaggaagcgaggatcccaggcttcaagggcctcattgttct

SEQ ID NO: 115 - DNA, 2423 bp, Mus musculus
aaactcctcttgggaggccagggaacagagcgctgttgcaccttcctaccgggttacggggttcctaccagccaggtcgcaacctcagcccagtaggctcatcttaaggacaagaacggtgggtaggtgttattcttatttcccggcttcaaataacaagagaaataagctgcctctggaatcctcccattttgataacaggcaagaagaatctaaggcggaggaggaaggtttgatcctggggattttgaaagcaatgaaactctgagcctggctgcaccattctcgggcttgccttgatggtaacttccggtaagcacccgcatacttttcggtgggtatctggttttacggttgcggctaacctcattttctgatctttgttctctttatattttgctctaaaaggaggaaactttgaagagaagggcgattctgagaaaaatcccctgcacccacttttaccacccgggtcacagttctctcattgtccctagcaaactgtccccgtggcctctgtcccgcctaacacagctcagttggggggtgggtgcgaggggtggggactatagcctgtgatgctccagcaggagcagctggcctaggagggagtctctccctgcgccgcttagcaccgcctcactgcgtggctccgcccaatagctgcttagcactctttcaacgacacccagaaattctgacgtaccctccccctctcctcccggggacgaaggcctggcttgtgacgcccgctccaaaaggcatgagactgatgcgggtttccccgggtgcccgggcctctccaaactgggagagcttgccggaggtgcccaccgaggggcgacccaggactgcgcttggtcacccacgatgcccacgtaccggatccgcggctcgcaccgcccagcgtgtagccagcctgcggcgcgcttccgggtaggacacgtgactcagccacatgaccggggcctgctttgtgggttcgagccccgccccgtcaggcattgctcacccttcaggctactgtgcttgctggtcacccgccgctagggagccgtgccacgttcaccctggcataagtaggtatctcactgcctttagaggcaccagctgagccggtgacatttctagagtctcttttgcttgatttagctaaagggattccccacagatttacagaaggggcaactgagaaccccgagggaacccccttgctgaagaaggaacaaatggaaccagaacccaggtttccttgcaccttcacctggcccttcccagcctttcgttttcttgccgaatctagttgtaggtgaaaggtaccctttttgtgggtgctttcccttacttacctccagggggcggaacccgtgtgtcttagtcagggtttctattcctgcacaaacatcatgaccaagaagcagtttggggaggaaagggtttattcggcttacacttccatactgttgttcatcaccaaaggaagtcaggactggaactcgagcaggtcaggaagcaggagctgatgcagaagccatggagggatgttctttactggcttgctcagcctgctctcttatagaacccaagaccaccagcccagagatggtcccacccacaaggggcttttcccccttgatcactaattgaggaaatgccttacagctggatctcatggaggcatttcctcaactgaagctcctttctctgtgataaccccagctgtgtcgagttgacacaaaaccagccagtacaccatgcagaagagcccagctacctttgggctccttgatttacaaaggttcccagtctgactgagggctgcatacacattagggcttttgtcttgaacctgcgagtgattgcatactatcaagatttttatgtgtatttggaggggcagaaagagtgaagaaggccaatggagtccacagaagaggttgggcgcctaccacaggtcctcattgggtaccttggtgcttctgagaaactttgtgtacgacccagcatgagcactccgcacccactaggcagaggccaagagccagtgctgcggccactctagctacctaaggtacaattaaacaacatcgcaaacgcctgcgcctgcgccttcgccaccaccctgctcagccaggctccacagtacagccacaagcatcagtctcctggagtcctgaatctgccgacactatcctgacttcggtcggtcatttcccccttgtttcaaacagtttgtaagcctgaataactgttacccgtgaacaatttataactaatctagtccatgttacctgatgctagtgacttgtgtcttgcagatgactaaagaatggcgccgatcatctcttcatgtggtttttctcttcatttgtgtagctttaaaattttttttgctttcaaataaacatttattcatatcttct

SEQ ID NO: 116 - DNA, 2987 bp, Mus musculus
gttctgagtgaagcaagcgggcggcagagctggaggtttcacaaggctgctgggagaggcttcggtgcaggaacccaagtccaagtttgcttcttaggatgtgtaaagcatggtctttaagaaagagaacctggatttcattgaattgtatttatgtcgaatcacgagtaagttagcaatttcaagctctgaatgtggaatgaaaccagagaatctcagaacgctaaaggaatgcgtactgtcatctccttcagacctctcaggtcgctgtaatgagctttattttctcactctctctgcctctctctctctctctctctctctctctcgctcgctcgctctttttttttttttttttttgtctccaagccatcccagatgagtactttggagggagcagaactaggtaatcagggaggggcaaatgcatacattaaaactccctttttttattaagttcaattcgcataaaaataccctgcgcagctgttataatcgttatcccagctttcgctacttacagatgattaatattgagtgaaaggactaatactcatatgattgaacaaactattcctctttcagagctgtaattactagggatagccgtgatcctaaatgataacgtcttttctgggctttaatctatatgttttgattaatgataccaacaaactgctaaaacttaagaaaactggttgatcatttcaactgttcttaaaagacagtaacttaacaaattttctaaagccttgaagtggaaaaaaaaaaaaatccctgatcttgagattccatacccaaatgatcctttttaaaccctggagttcagaagtggcagcaaaagaacagagaaaactgtgtggctctcccaaagaaagctcactttttaaaaagaaattggagagcctggtgggtgggttgggtggcagacaggtgtgtccacactgcaccctagggtagcatgaaaatggcccaccagaaaactgtaaacttaattaacatattatgacgtttattttgagttgtttttttttttttaagttctcttgtgcaattattagcatgaactctgtgcatgaaagcaacatcaggagtctgcctgggtccgagaggagttcagccttactacagcctcagatgagaacaggagtgggaccagctctgagttagatgaaacccagaagacttcagagaaagtcctctatcacttccagcccagcccagtaagggaaactgggactcttcctccttttgttctactcaagttgctgcttccaaggctctgtgaccgacaagggatggactggactattaatctaaaatgtttaatttttaaagtcatttgtcatagagagtcacaaccccgagcaatgaaaatattttttaattcataggtgagtgttgggttttggtttggttttgttttgtttttacctcactccaaactactcatcttgggtttgtgttgtcctggggttcttcagttgggtaccagaacagtctggtgcacagtgagtgaagctatcactggcaagccttggcatgagttgagcaggtgtagttaactcaacattaattgtgctccttgtaataaatccatctctaccctaaagtcagaccgtgatcgcttttccttttaggggacagtaggtaaggatgagagacatatcttttgctctgagtacaaagttctattcttggttcttagaaacattcacagaatagacggcctctaatttgcaaacgggactaatgaataacttccagttggggctgtgtagtttctcatgttcatatttttcaatgctcttcccttaaaaaaaaatgcattcagtctggctcaaaactaactgagagttttacccagttcattggtggtaaatggtcatgtgttaccctgtgtaggatccaaggactctagaagagaaggacttacagatgtgtggtcacttctttttcaaataggaagtaaatataaaactctgaacggaaaatagttttcttgttctctgcaacttaaccagacccatgcaagttgctaatgaaaaactgaatagacaaaatttccatcctcaataatgacctacataatgaaacatgtggataacttgtctgtgttgtttgtgtatgtgtgtgcatagatgcaagccatcactcatatctgccattaagcctcggcagtatgtgttggcagcagaattagatctctgaacatccctagtccccttgtttctttttgttccatcccagttccaccgctcaggtatattcctggtcttcggtcctgaaagcctggacattgcagagataggaagtgcactcatgaatactgtttattctttgagaattcatgcccattctcttttctactaggacacctgctgggagaagtgtgctcctgttactcagaattctgcaagtgaaagtaaaatgtgttggggatagttcctccctaatctccattgggaagtttgcatctggatcccagttgtatacagtttttgttaatttatgcttgtgtgaacagctgcctgagacagaccatatttggatttagcaagtgtttctgttccttcaaaaaaaaaatatatcaaaacaaaacaactccacagtaatgacaatgaaggctttcaaaagaattctggaaactcaggttcccagaagtggcccaataacatgaagatatgaaacaaggtctctactatgtcagagacatcgccatgttagttagctgtcaactgacatctaacagaagccttttcacatgactctctgtcagacatccctgataaccgtgtgcacactttccctgtgtcacatcaccactccaccagtggtgtcaggaggaaagacaacaaaggccagaactgttactgctgagacagaaagaagactgtatcagtagcatgactctttaatcactgttatgtacaatttatcatctgacagacttacagggaataaataaaggaaaatagacaattggc

SEQ ID NO: 117 - DNA, 15091 bp, Mus musculus
gccccgcgcccccttacccgtggcgaccgctacgctggccacgctccagcgaaatgaggtaggcggcaagtttggcgtcgctccagccgctgcggcgtctcaggtccacccaggggccgtgcgcctcgcccaggtacacgcgccgcacgtcgtacttcttccgggactcgagccgcctccgggcccggtccgactcggtgagccgcggccggccccgcgcctttctgcctgccgcgccttcctctgccgccgcctccccgcctgcgcccgcctccgcctccgccccgggctctggagcccgctccgccatccccccctccctggttaccggcctcccccgttgttaggagcctcgaccggaagtggcgcgcctagtctgcgccgccgggagatttctcacagggtcttctctgcccgcggcgccaaacggggacaactagccatagctgcgcatgcgcgtagtccgtccggcccaggccatggaagtgcgttctgttgacaagtcagttatttgggaggtagaggcactgggtactgaaactcaggtaatccttgcctctctattgaattcttcggcaatgtgattaaagattttttcaaaagggctggagaaatggctcactggttaagggcactcactgcttttccagaggacctgcgctcaaattcagcacctacatggcagctagaactgtctgtaattccaagatctaccattctcacataaacatatatacatgcagaacaccaatgcacataaaataaaggtaaatacatttaaaagatgtttttaaaggccaacaagtcggctctgcaggtaaggtgatggctggcatacttgacaatctgagttacatttccgagattcacagggtcatatatcggaacagactccagcaaatggtcttctgacctccacacatccctcccataccataaatatataaatggatttttttttttttttttggtttttcgagacaaggtttctctgtgtagccctggctgtcctggaactcactctgtagaccaggctggcctcgaactcagaaatctgtctgcctgcctcccgagtgctgggattaaaggcgtgtgccaccacgcccatctataaatggaatttttgaaaagacaagtttaaaaaagggtcccaaggtggtaaacccaaaagagcccatgcagaacatacgaagggaagccacagggccagggaagaggttttgatttttttattttctccatattatttcataccagcccagtcttttctcctcatgccagctctatctgactcaactttgcccctgctgctgctctgcctgaatggtctcatcatcttcctcaggccccttgggaggactgtggggaggggactgtccctccagccttgaagttgtcaggagctcccccgtggacctggccaggcggaataccactgggatctgtgccagggttgggttggtctcctgcaagccttggatccacttgatcaatgttgcctgatcatgggcaccagccatgcacatggcgaagacagggccttctgtcactgttaggagaagagtttgtgtctcaccactgtgacgtactctgagcacctccatgagttcacagccagctccctgtgccacataaatgttctacatttcccttggccatgccacccgctgctcagatactatcaagagactaagtttgagccctaacttggaggctaccatgtgcctcctcccaactccccacatataacttgactgttccctgctgacctgaggcttgcgcgtattctggtcacatcactagtcagtatagaatgctccttaaaagatagtacaaaggggagagggagtagccaaggagaggtaccctggggggcatatgacccctcatcctgtggagcgtggacaaatggccaccacacagatgtgctgtgttgagacctgcttttaccttcatccacgtcaaactcatagtcgtcccaaccactccttgaatattccaggtccagcttctgtgggtagtacagctcccattcttctgggatctcctctactttctacctcaggcaagagagcaggcaggattagaggccagaacacaaaacctgtccctcagctgagccttcaggacagtgccagccccacccccaacacagaatctgtagttctggctaatctggaagttgctgtgtagaccaagctggccttaaactcagagagctcggcctgccttgccttttttttttttttttttttttttgggtaaacatttatgcatacccctgtgtaattcagaggacaacttgtaggagtgagatctctccttctacatgggccctgggggtcaaactcaggtggtctggcttggcagcaaatgctttggccagtaactcacctcttcctcaggaggtggcaggtcagctcttaggatgtgatagtagacacacttattacgaagccagagagggaaggggccctcaacaaaaacaggcctggatgggttgtggcgggccagggcagcttgctgatctggactctggattcctggtgtagagatgagaacctgttggtgccttagcagcaaaaggcccaggagctcatttagtgggcccagagggatccagcagaaactgggataggctggggccttacctacaatgtgaggctgtgtgggatcttccatgcctgtcgagtcactgggcaaagacatctgcaaagaagagcagggcggtgactccccaacctctacaggggagcctaagagcaaagggagggaaggggtgcttcctgggcgactgcaccacgtctttacaagtagcctttctctgcttctttgtagccagcttgaccagagtgccaacactgagagtttacccagaagccatcagcctaagttcagcctgcagtgagctaatccaagtcactgtacctacatagctcagtttatccatgcgcaaaaatggcagtgacagaaagtaacagttcttcagatggtatcaagagcttgactcggctggggagtgcttgcctagcatacagcataaagccaagtttctctcttttgtcactcactaggaatggaaccacaagccttgaacaaggaaagcaggtgtcctaccactgagccatacccccagctccatcccaacagggaataaggcagagactcctgtgtagctctggctgacatagagctccctatgtacgggccacacctggcccgtcagtggttttttgttttgtttgaagcactatgtagcccaggctgacctttaactcagaaagatccaggcatctctgcttcccaagagctaggattaaagacaggagccactgtgcctggctgctcttttctttataaagtacccagcctccagaattttgtttcagcaacaagaggaggatatagggtcttttcttccaatgagtaaatagactaagacaggtccaactgtggtaataaagggacgatcacggtcactgtcaggacagtagcagaacccagggaagcagtaaggcccagccagggagggcagcgacatgtatacaggaatgcatacctggtagacagtgaccttagcactgaggtcaggctccatgtgtcgcaggcctagcttggccaggtccaaagggtcctggggaagatctcggggcactgggtaggggttgatattcttgaatcgggtgaaccacagcttcatccgcaggaacttgagcatggggtaacttttgcgcccgaatatctgaatcagtaggaactctgtctctgcgctgggcatgacccctgttttgggcagatccaggacttgttaaacacaagtttgaagtcagtaagaacagaattacaagggatttacttttcatgatttgttttcttcttactttgagacagcgtcttgctactagctatgtaggtagccctggctggcctggaagtctgtcatctatagagcagaactcacagatatctgcctgtccatgccttccaactgctggagttaaaaggtgtgcactaccacatctggcccatccatggtttcttgtttgtttgtttgttggaagctgaggctgaggctagggcacagttgagtagtgtgctggtctggcacatacggtggaaggcttgactcccagcaccatataaaaggggcactgttgcacatgcctgagatcccagcacttggaacagtaggcaaaaacctgccaaggccagacatggctacccagcacagcaaattcaagggcagcctaggctacatgagaccatgtaaagtgtgtgtgttggggaaagagggctggagaaagaaatagctcagcaattaggagtatgcactgcaccacttttaactcgaattccagggcatccaccacccttttctggcctccttgggcaccagaattcacatacccactaacacatagcatacatataatttttctaaaaaagatttattatatttatgtgagtacattgtacctatctccagacacacaagaataggacatcagatcccattatggatggttgtgaaccaccatgtgagtgctaggatttgaactcaggacctttggaagagcagtcagtgctcttaactgctgagccatctctccagccatagcatacatataattaaaaataaatcataaaaacaaaaaaaccaaaaccaaaccaaccaaccaacaacaaaaaaccccagaaacgggctggtgagatggctcagtgggtaagagcacccgactgttcttcagaaggtccaaagttcaaatcccagcaaccacatggtggctcacaaccatctgtaacaagatctgacgccctcttctggagcgtctgaagacagctacagtgtacttacatataataaataaataaatcttaaaaaaaaaaaaaaaaaaaaaaaaagaattctttaaaaaaaaaaaaaaaaaaacccagaaccatacggagtgaaggatgagcttgaagccctgtctcccctcactgcctaggagctgaggtgacagggaagcacccgaggtttagatacaggggatcagcctggagacatcccaggtaagtcctcctccaacttttctacagcccaagcctaataattggaagagggaggggagaggggaggggcaggcgaaggacttgggagactgagaaaggtgagtggagaaggatgcgaaggaaggctgggcccacattcctcaccgtgtcgttccatctgctccaggactgcgaccccacattcctgctgccgtgggtagtggacgaagatgcgctggataacgttgcggggccggaagacctccttggggaaaacatccagcagcaggttgtatactgacaagtcccgctccacaccaaactctggcatcttgcgcagtgctaggtagatgaagtccacgtggccgcgcttgcgcacattgtgcgccccaaagctgcgcactgcgttcaggaagcttgccttgtcccgctccctgtttcctgatggcttgaacgagtcttcatgcattgctggaaccttgatgggcttcctctggggctccgggggtcgaggaaccaaccacggctcatccttgtgtgtagctgcactacagtgaaggcctcgtagagcctggagggacacctgggagaaaggatggtgcctgctttttgttttctgtttcttggcagaggtaccctggacatcatggaggaccttttaggcgctttgatactgttactgctaaccgtagcttagatatcatgatatagtacattaaagtacaatgccacatggtagtacacacctgaaatcccaaccccaaggaagctaaggcaggagaattgagagctcaatacttgcttgagccacacatacatgttctaaggccatatgagattacatatggtgcatacacacgcatacacacacgcgaagaaaacatcaagaagcattgccaggaccacattgttgtggtttgaatgagaattttccccacagacctgtcaaactctgcttacagcattcacttgcttggttagaccaaatttccaaagtcttccaccttcccaaaataacacagtcagggtctttatagcaaccaccctatttgtggacaccaacttctgtactagtgcttccctgttactgtgatgaagtaccatgagctaatctggcagtgttgtatggtactggctttgaaggcaggaaggaagcaagaatcctgagaaggtaggaggtcccaggataccactgcatcaatctgtgagagtgaagcttgggctgctgagcagacctcaagatgttggtgatgtcagagctatgagatgtctgccaaggacagccgcacagggactggagccagtctggggtggggtatggcttagggcagctgagctagaggagtggggctgtctgagcacattggagctacagggcttcctgtttgcactgctgggttttcagtcttgtttggggttcagtatttcttcattttggcttcattcctcccttttggaatggaaggatggaatgtgtcattccctgatggaagagtgtgatttacttctacgtagaatgtcacagttgcgagattgcacgagtctcagaatagactttggacttttaaatggtattgacactgtgacagaccataggaacattagaaattggatgaaatgcattttgcatcatgatagtgtcaggagtctatgtggccaggagagaggcagattgtcatggtctgagtgagaaatgtccctcaaaggctctcgtatttgaatacttggcccagctggtggcagtgcacagggagggtacagaaccttcaggtttataccggcttctcatttacaggttgttctccttcctacatgcttgagatgtgatctccagtttctactctggccacaaacagccataagggactctacccttggaactgtaaaccaagacactctttctaatgtaaattgcttttggccatggtcatagtactttagtactgcgatggcaagctaacacaggaccacaactaggacaggcaggacaagggccaccttcagtttctgtggcctgatcctgagagggtgagagtaaagccaggccgttccctctccacccacaaatgcccagcctgtggttacctgagcaaagggagttcctgaaagggcaggcctgcagaggcctccccagcccctagagaggcttcgcaccagcaagttgacctgcacccagctcatgtctctgtagattcaaccacacctagttgagagggattgagacagcattagcctgcagcataccttccatgagacagggcgtcactatgacaaagagcacagttcagacagaagagcctagtccaccaagctccaagggttacttctgtctgattttgttattttcaaaaatagaatatcatattgcccaggtagccaagggtggccttaagctcctgatcctcctgcctctgtttccccagtgctgagactacaggtgtgagctatcatgcttgggaatctttccactatatttactgatttagtgtgcatgtgtgtgtgtgtgtgagcgtgcacatgtgtgcatgcacatgcatgtatgcgtgtgcgtgcccttgtgtggaggtctgaggatagcttggagaactggttctctcttccatgtgggtctcagcatagagcttggtttctaggcttcagcaagcaccttcatacagtaatcattccactgcctcatacctgggagtttttcttcttcatttttttttaaagatctatttattattatatgtaagtacactgtagctatcttcagactctccagaagaggaagtcagatctcgttatggatggttatgagccaccatgtggttgctgaggtttgaactcaggaccttcagaagagcactcagtgttcttacccactgagccatctctccagcctcttcattttttttttttttttgaaagacttgcctgtttattttgtgtgtatactcaggttcacatgctacaatacttttgtgcaggccagaggacaacttttcagtagtcttctccctcactttaggaatgccatgacatctagctttttgtttgtttgttttttgttttttgagacagggtttctctgtgtagccctggctgtcctggaacttactttgtagaccagactggcctcgaactccgaaatccgcctgcctctgcctcccaagtgctggggttaaaggcgtgcgccaccaccacacctggctccagccttctttttgagacagggtcctactagcccaggctggtttaaaagttgctatgcagactaggctggcctcaaacatcacagagatccccaacctctgcctcttgcgtactgggactaacagcatgcaccatgtttcctgagacagctgtcactgatctggagcttaccagttaagctagactggctgaccagtgggccccaaggattccctttctctgcctcctccatctttaaaaggaaaagaaggcaggcttggttgggcacaagggttaagagaaggggctcaggggctagagagatgatgcagaggttaagaagagcactgactgctctcccagaggtcctgagttccattcccagcaaccacatggtggctcacaaccatctgtaatgggatcctatgcccttttctggggtgtctgaagacagctacagtatgctcacatacataaaataaataaaatctcttaagaagagagagtgggctcagaaggaagtaggagtcacctgacaacaagtgtggctgcaaacaaaattattattgttatttttataaaactttatgtgtgcattcctgagagtatatacaaatgtgccaggcaccagcacagaggacaacttgcaaaatcgagttctctctcccaccacgtgggtcctcgggatggaattcaggtcctcgtgattagtagcaagcacctttatcccaaactatctccctcttttctttggtttttccagaaagggtttctctgtgtagctttagctgtccaggaactcattccgtagcttgggcaggcctcgaactcacagagatctgccggcctctgcctcctaaatgctgggcatgtgccaccgccaactggctgatttgtttaactaaaaaaaaatttcttttgccacatgtatgaatatttttccattatgtaggtgcatcacatgagtgcctggtgcctgaagacatcagcatagggctttggagcctctgcaactcaaggttcagatggttgggagccaccatgtgggtgctggggattgaactcaggtccttaggcttggcagcaagcacttttaccctgtaagccatcttacccgtcccatctccttttgaccctgggtacctgagatagagctcaggtggtcaggctcctgcaggaagcacttacctatctgcactgtctccatggcagctctaggtccttttcctgcctgagtgctacaaccagacacttggtgcaacactgacaagtggccagagtgcacagccttgcctggcaaaagaatctattctttcactgggcatggtggctcatagctttaatcccagcactcaggaggcagaggcaggcaggtatctgtgagttcgaggccagctgtagatagagcagagcttacagacagcactaaagaagaagaaactgactcccattttccatccagaaggctggagatggacgtgttaatacttggcagactttgttcctctataaagccagccccacagcaccccaggatcctgagagctttgtctcagtcagtagagcccattttcaggaaagagggcccttgtattctgcaaaagagattgctattctgcttattcttccatgggcccttgtcctgatcactgttctcagccaacaaaagccactcttgtggggcaggtgctttgctagggattttcaatgcagccatgcctaaagctttgttgtgataactgtctcgtgtacacttatccccaaacttttactgcttaaatgtgcaagaaataagtcactcagcattagactccagaagtttggaaccaggaccagctaagttctgctgacccaagtttccttctttgtttgtttgttttttccaagacagggtttctctgagtagccctggctatcctggaactcactctgtagaccaggctggccttgaactcagaaatccacctgcctctgcctcccaagtactgggattaaaggcgtgcaccaccactgcccggctccaagtttccttcttaaccttatctggactcagtgctgggtatgacacttgcagggacagcgcagccagtgtgttctacacagagagatgttgtttctaacaaataaatagagcaagtgttggattttctcaaatatttttctgcattgcctgaaataatcatgtagttttagggttttttttctattgatatatacataaatgttcagatattaaactaaccttgcattttgaagataaattctcttaggatgatgtagaattctttttgcatgtttgcaagcccattgcgagagaattttatagtcatattcaagaggcactagtgtgcagttttctctctttctttctttctttctttctttctttctttctttctttctttcttttttatggttttagagctttattgtagaagggcagagagaaagagagatggttaaagaaagagaggggctggccatggccacgtggagagagggagaagagtgggagagaaggagggctagagatgagcgtaagaaaggagagagcttaagagatgtgtacagttttcttggtatacctgtttggttttggtattggggtatctaggccacagagaacatgttaggaagagtttggatcgttcttgccaccactaaaactttgcagaagtgggtgctgtggcatacacctgtaaatcccagcactggggtggaagccttgggtcagccttagatacacagcaatatgaaaagtatgaagccagcctggactacatgcaaacctgtctcaaaaacaggaaaagagctgggcaggggtggtgcatgcctttaatcccagcacttgggaggcagaggcaggcggatttctgagttcaaggccagcctggtctacagagtgagttccaggacagccaagggaacacagagaaaccctgtcttgaaaaacaacaacaacaaaaaaaaaaaatacaggaaaagaaaacaacacaacaaaacacctttgggatgacacaatggctttgcagataaaggcagttgctgccatcctgacaaccagaattccatccctgcaatcaatccagggtggaaggggagaaccgaccccacaagtcgtcctctgacctccactcctccagtggcatgacaggcacgggcacacagacgcagagtaaataagtgaaaacaaacaaacaaacaaacaactttctctagttgagccagacatggtaacacacacctttaatcccagcattcaggatgtaaagacagccagacctttgtgagtgccaagttcttacatatgagaacttatttaaggaaaaaaacaacaaccccttttctagtgtctcccattttggcccaaaatctccgctcagctccctgctttcttatcattaaagctacaccttagccatgtctacgcactggctccttcctcagcaacctgatggctgccctagtaatgcctgtccagtgagttggtgtgcgcaactctttgaggaagccaatgacttcaagatgtcaactttctcccaagtattagatagtgaagtccccttcccctcagcccttgttaacatcttgggtttcttcctagcatccatgcctatttctcagccaatcatgagatggctttcagtgtccacagtgtctgcaaagctgaggatgcagacaaatgccctgggagcacaaagcctgcagattcaggcttagtggaaatatgtccgcccttctgcaactttcaggtgatagcaacagctgctggtctgaggatatgcaattggaccggactcaggctgtgactcggtaatacagacctggcctagactcctccagtgagctgctggcccccgtgagcctctgctagggggctaggagtgtggctcagtagtagagcccctgcctagaatgccccagttagaggctgagggtgtggctcatggtatgtacttgcttggtatagttagatgaaaagaatctaaaaccttgctttgcaaattgtgttccaggacctgtaaaatattggctctaactgcatgagaatctgcattgtaatgcccataggtggctccaacttgtatcagtgtcgtgagtattcatgctcatggttccctgatgcgtttgcctcctacagaagcacaactctggtacaaagcagccaccccaaactccattcagggaacaccaactgacagcacttttgtttacagtgcttctctggaggtagccagtagcaccagtgcttactccagccacaacgtaggaaccatccagcattcactgtgtccctattcaatccatccgagttctgaagatggcttccaaatctatccctcttgcaggtcaccacagcagtccgtggtctactctcctgcatacgtttttgccctctctcttctgccctcccagttacttccttccattgcaaaggaaagcttttaacaacaggagctaggtgagcttgaaatgtggctccattggtaaaaatgcttgccctgaaagtatgaggaccagggcttgagccctacatacaaagcggcttgcaatctgagcagtcggaggaagcaaaaaagggcaggtccccgagctcgctgctagccagcctagtcagtgagctacatgtcccactgaaagatctgtctcagagcacacggtggacagctcctgagggacaacatccaaggttgacatttgtcctttgtacacgtgaacacatactaacatacatccctgtacccacatatgaacacataagattgctgggtgggatagcacatacctgtaatctcagcacttgggagaccccggctggcagacctctgagtttgaggtgagacgatctatataggcatagcaagttccagaccagccaggactacataggcaggaagatggcctccagaatcaaaccagctggtgataattagtaagtcccatgtcagtctgagctacagtaaggtcctgtctaaaatttaaataaataagagtggggagaggaaatttagctgagaaaggaacttgctgttggaacaaacaaagcaaacctaatgacctgagtttaaaccctggaaccaacataaggtgtatggataaaactccagagctgtcctctgacctccaccatgcaccagtgcacatgtgccccacctccataccatggctaaaataaaaacttcaaagtaaatacacatcggatggagtccacctgctgtacctcccctctctctcataactccagccacactgttttggtctgatgcacctcaggcacgggctttgaacttttttttttttttttttttttttggtttttgagacagggtttctctggctgtcctggaactcactctgtagaccaggctggcctcgaactcagaaatccgcctgcctctgcctcccgagtgctgggattaaaggcgtgtaccaccacgattcttttaccctctgcctactacttactgtcttggtatatgcctgtaatccagcactcagaaggctggagcaggaggatgttcatgatgaattcaaggccaacttggggtacataaagaatcttgtcgcagggaaaaacacattgcttgcaacaatcactgttttgaattatctgttatgtttgtggtttgctcaattaggaaatactttttaaaatctgtttttctcatctgatttctgtttaaaatctggttgtgtctccactagctgggccagtgcatggtacatggtaactgcccaacaccgaccaacggagtggaactaagcaagtttctacaaaacagagagaaatctgaacagccaggtcgcgtgtgtgtatgcgtgtgggctggcacgattccgggtctctaagaggtctcattggaaggttccaatgcctgcgtcacagacaagatgtgtggcccaagtccgcggtcccatctgtgaaacggaccgcctgcagcaagaggtgcccagcaacctttccaggcacgttcccaagcctgcaccccaaaaggtcacagtgtcccgactctgaggccgagttgaaggtcatcctccccggctctaccaggcctggaagtggacgccccgaatcccagacagtcccataaacctcccacgcgcgacccacctactcacgtggccagccgcagacccgagccggctctgtgggaccgctggacgctgtcatgttgagccacggagcttccggttacgagtcgaaggtgacagcaaatcagaagagcctgtgacgataggtcccgccctcaggaagagatccaccaataggaaggggggagacgctggtttctcctcaggagcaggccctgcccctcactgagctccagaagcctggagactttggataccagtacggaggcgctggagcgggttccccggcgtccgtccggtccaactttctccgcggtgtggtaaattattattattgttacggactggaagcaccacatccggttcggagcccagggcggcttgcgtgctaagcaagcactctactgctgtcaactaagccgcagccccagtcccggaatgcatttttttactaaagaggttttttcagtttggttggttgagttgtttgagtcagggtcttgcagtggtgctcagcctgttctcaaaaccctggattcaagagatcctcggggttcagcctcccgaatagctggaacctcagctgggcaacactgccaacagctttaacagaatgtcaagctgtgtttatttttactgtgtgttatgtgtgtaagtctatgtgagcatgttcgtgtgggagtcagagggcagcttgggggatgttctttccatgtgggtactggggatgaaacctgggtcatcaggcttggctgcgagcacttttaacgccctttaataaaaatgtttgaag

SEQ ID NO: 118 - DNA, 15337 bp, Mus musculus
ttcagagatcctatttggaagacaagtagaggaagacagacatgcttctaaaggcccgctctccctcctgtcctttcattccaggtcctttggagaacacctatcgtgacttctggcttatggtttgggagcaaaaagttttggtgattgtcatgactacccggtgagttagtcttcttttaaccatagattccatgaccctaagcttgaatgattaagaaagctatgccacatctatagttaacatggtaggacacagtggagatagtgttagccttgcagaaatatttaatccgtaactgtagggacccagggctagtgcgctaaagcctatcctggggttctggccttattcacaaaaggacgtgctgggaaatgccagcagcacaccttgaagctgcctcttgtctacagaggaaaggtgccttcctggccactgcattaccagttccctttgctctccatttcctccttcttttgatggctcttctgttcattaatatctctacctgtaagggaacagaaagatggttgaaacataaggcaggaagttctgaataaaggattgtttttgaaatttggcaattctgccaaatgtaaggaatttcatagtttattagtttcatcattaattataacctttttcagatagggaagaaaagcgatgctccctcagttcccgtcctcagagcattgtcaacagccacctgtagttgggagaattgtcttccccactcctgtgtcagccaagggcccttcgtcgaaagaaactgagcagtggccaaggtctaggcctcagtgtggatttgctactatatgtaggaaatacaaccaagtatcaggaaggagacagatgatacagtgaatgtacaatgcatgtctgctaaatgtatacatgtaagaatgttagctgttttaacacttgtttagaaggaagagatgtcatttttctgccaagaatcagtgcagacttcagaagcagtgcagatcacattgctgcctaggagctcagcagttgtggtgggaagcggcttacagctagttgaagagagaaggcttaacttgctctgtatgtcttcagctttgaggaaggcggcaggagaaaatgtggccagtactggcctttagaaaaagactcccggatccgatttggcttcctcacggtgactaatctaggagtggaaaacatgaaccattataagaaaacaactctagaaattcacaacacagaggtaaatgcaggtttctattttctcttttgaaattaggggagctcctttaagagattctcattgagggtggtgatgcacacctttaatctcagcactcagtaagaagaggtggatatctgtgaggtcaaggtcggtctggtatgtgtatggagttccaataaaacaaacacacaaaaaagaaaatgtctagagggaataggcaggactttagggaggtaataaacagatgatcaactgataagccagttatgtagtgtccatctttaatcccagcactccagacagaggcaagttgatatctataaattcaaggtcagcttggtctatataataagctccaaatagagatacctcccattaaccgcctttcaaaaaacaaacaaacaaaaaaaaccctcaactcagaactaatgaagttatcgcctcaatataagagtggcattaagaggctggagagatggttagtggttaagagcactgattgctcttgagtagatcctgagttcaaatcacagcagccatatggtggctcacaaccatctataatgggatctgatggcctcttctgggtgtgtctgaagacagctacagtgtactcacatacataaaataaataaataactctttttttattttaaaagagtggcattaaagagaagtaaaaaatttcaacattgggactctgtatgctaagccatgcttcttatccttctgcagaggaggctgaggcaggattacaaggtggaaaatagcttggactgcacagtacgaatcttgtctcagaaaaactacattgagggactggagagatgatggttcagctgttagagtactttatactcaatcatgaggacgagtgttcagactgtagcgcccatgcatccagctggggggccatttatgcctgtcatcagatctaatggaggcagaggcaagagacttactaggctttctgcttatggcctagttgaggatccctggctccaagttcagggggaccctgcttcagaagagtgggcagcatgtgttagagaggacacctgatgcccttctctggcctgtctgtgtactcctaacatagatgcctaggcacttacaattaactaagtcaataagtaaataaataaggtactgttttatttcgagacagtgtctctcagtatgtagccttggctgacctggatctcatgatagaggtagactagcctgggctcaaatgcatagagatccatctgcccaccactccttcctgaattttgtggtatagagttgtgctccatgatgcctgacaataaatttttctaaggaagattttgtttgtttggttggttttttggttcttttttgagacagggtttctctgtttagccctggctgtcctggaactcactttgtagaccaggctggccttgaactcagaaatccacctgcctctgcctcccaagtagtttttttttttttgatcttataactttattataacatatttcctttcctttttttcctctccaaaccctatctgctctttcaaatgtataatctctatttttactaattgttattgcatgtatttacatattttcacacacacacacatatatatacatatatatagttgtaaatataatctgttgtatccatataaatgcttgtattatgttctagagctgactgtttggactggacaattagttggtgtgtcctttcctgtggaggaccacttctggctcattttttgtcttgtttttaataataaaataatacaataataataacttattaatagcaataataaacaagaaatatggatcctataatatagcaatttgccttcccaaacatatagccattcctttgggtttgaagtagaaaatcaattgtgaagaaagttgacagcagaagacaggatcttctaaagtcttaagaacctggaaagccaagggtagacagcagacaggaatgacattaactcttgcttctttttcacgtaaggagcggcagaaacgccaggttacccacttccagttcctaagctggccagattatggtgtcccttcctcagctgcttccctcattgacttcctgagagtggtcagaaaccagcagagtatggctgtaggcaacctgggagctcgctccaaagggcagtgccctgagccacccattgtggtccactgcagtgctggcatcggcaggacaggtactgtgcctcttagactggtgatgtgcccagaggcggtgggggtagggaggaggagctaaatgcttagggcatgtctgtgtttagaggagaaactcactcatccccttggtggcaaactgctatgataatcactttttaaggtccttttgtattcctatgctagagatgctgcttgccaaaatgtatgctttataaaccaagttcttggggttgttaatcatcatggtcttcttttgaccttgtgaactctgtcatcaacatgattgtggtccccagagagattagctggccctctcttagaggtttcttctcctggtgctagtcttgtcccctgacacccgttgtttgtgtttatgagaccaggtcttactatgaagtccaatctgacctggaattctcagcaatcttattttagcctcccaaataatgggattatcagtttgtgctatcttgcttggcttctgtgttcttcattatgtgtgctgtatgagctgctggctttactagttcagaggtccctttgggagaataatcaggagaactgtatttgtgttagacctctagagagttataagctatggaaattgggtgtagaagtacagctgcactgtctggtattgaagaagcaggatattcttcctgtgtcacctgcctgcttattcttctgatactctcgtgtatgcccagagagacaggagaccctcatttgtctggcctttagcatgccctttgatactccttagaagtctctttaggtttaagtcctcctgccattagaccctgtgcctttgaattcttgtacccagccttgcgtggtgatttggtaaaaggaagaagataggtgaggtacattcatatgatcatttccttccttcttcaggtaccttctgctcactggacatctgcctggcacagctggaggagcttggcacccttaatgtgttccagacggtgtcacgcatgaggacccaaagggccttcagtatccagacccctgagcagtactacttttgctacaaggcaattctggagtttgcagagagggaaggcatggttccctctggtcacagcctgttggccatggacggtcaataactgctccacaagtttccacctgctggtcagccttccttaaactaccctggacactgctgagcctataggttgccatcagttatgctgaagccatggatcaacctctttcctgtgtctcccagcgcacatgtgcacgcaaggcagcctttccctttggctagataaatgtggtgaacttgccactagaaagggccagcagcaatgtgttcttaattcctagcacctgctatcgaactgtgccttatcaaaaccaaattgtggctattgatttttgccagggtccctgaggtaagtggggaaggacccctccccccacccccatctcccagttcctctggacatctcctccttccctttgctatgatttgacagggaggtctggtgagcattcaccttcctacccagaaagcttgaccaagttacatattctagagaatgtcccgagtgccaagcacgtttatacatagggcgtgtattccagtcttttctgtcattctgtgtgtgtgtgtgtgtacgtatgtgcacttacgtgtatggatccatatgtatgtgtgtacataatatatactctgtgataattatggccgtatactataaatacatatacacacagatactctttgtagaagtctctggggatttatgttgcagttcagcattccttgcttcttggaccctgctgattattctggactggctggggttagggatcatggctcatgttgtcagacagcagagtgatagaagaaaacacatacttttttcctgggccacaggtcttcttccttaatgaaaattttccctctggactctatgcttgttggagccaaaaatactgacttatggtaacactggttcaatttagcatgggtgtctttcatctaacaaattctctgttgtctttgctgatttggggaacagacctccactgtgattccagactctgtcttatgaccccattgatggggaccaaggctagaaataaatttacagagctgccagagtccaaagtaatcggtacgaagttttaaaaggaataaaggagagcccagagtgaacaagaggaacctaccatgaaatccccttcttgggaggacaaactggggcctctttttcttgtgttggaagacacctttctttatgcaactcttccttgtctactgaatgcccagctctccctgcctgctagcctgccagatcctagactgcaaactgggtgggcctatgtctttataaaacataaactgggtgggtctatgtctttatgaagcataatccctttggctgcatgagtccgttccttggaatcactggtccactgcccgtacaacttgttcctgtcttttcccagtctgattcgccaggaatggaatcaagagttcccaacactgtgttcccacaaaaccctacagaacccctaaaccttcccttactccacacgatgaggttggcagctggtcagagctcaataattttatactgtaataagatctttgaatgtgtatattcttattttttacaatcatttcattttgtatttaacatcaatggactgagtcaagattcagtaaataattgtaatgttcatatgcgatatcttatagtggtacaattttgtatttacctataaatataccaacatgattaaacccttttagtttcatcaatttgacagtctggggtcgggaaggtgaggagggagtccaggagttggctctggacagatggggaggtatggggtggaggagatccacaacttcagtatctgagacttaagttctgagcggcacctgtttgtgtactgtgtaggctgtgacaggctgagtgctaggtgctttgtctcttatgtcacttcattgaaactgcacagttctaatgaatatcctctgtcctttctattacatctgcctcccaattctccagtgctgaaattacagacatgtgcccccatactgggcatctttcacctaattctgtataaacgagaaaggtgaggtccaggggaaaaacagtgatttgtcctactgtaacccaagttgatctgcttatcaagtctgcagactcttagcagcatcagaaaatggaatggtgctttggagactcttagggcttttcttgttgttgctgctgttctcctgttagaggacagttggttttgaaattctaggatggttcatggtttttttgttttggtttggtttggtttggttttttttttttttttttttatgttttgtttgtttctttgcttgagacaggatttactacatagcctaggctgtccttgtactcacagccattctatctcagtctcccaggggctgcttctcccagcttaggtaaactaacattgagcccttgttccttgtagtagactagagagaccacaggattggtgacattctcccaaaaggaaatctcatgttctagcctcaggtttgcatagttccagagggtttatgcttctagagaaaccccacaaatagtgtcctgctagtttttctatctgagtggaatcagcattggccttgaagggatattcttcacatcacatggcttctatctgttagccagtgacaagctgccccattggagtggcttggcctacaatatgcaaatattagtatgttgtaaataatagtaatagcaaacatttaatggaaattcacattctaggtccttttcaggatactcttataaatatgaactcattcactctcaacaactgctcaaaactaggtactgatagaagaaaatatttgaaacttgctgtggctgtggctctatataccagagaacctaaggatctgtttcctcacttgccagcacattattcttgatgttcttaccttacccaaagactaaactgctggatgtactggaatctcagtattagaaaggaagaggcaggaggatcaggagttcaaggccaatgttggctatatcagtagtaggagcccagcctgggctacttgagacactgtctgaaggaaaaaaaacatggtagcagattaagacagaatctctgaaatttgagtcagagagattatgctgtaatttgaaattagattacagaaatacttagggttggtgaaatagataggaaacagcattaacaatttaaaaagcctggcaggggtcattcaggactgttacttgttcaaacatgctgtacctttgccctgtagattgctcaattcaaagttgcgcaccagttcttaggtgcaaactcctaggccaacccactgggtggttgagtgaacacagggtgatccaggcattcatatggctatttaactcatatctccagttcggggcacagccagtgatagctcctggacattcagtaaaaccctgggttttttaaaaagggttccatagtttccccccaactgccattatacagtgctatctttattagtttaaaaatgtttttaaattttggtggctttaagttttttattatttattcattgggttttctacagggcttctctacataggcctagctgtcttggaactttctctgtgtaccaggctggcttcaaactcatagaaatctgcctgcctctgcctcataagtgaattaaaagctggaactaaaggcatgcaaccaccacggtccagctaaattctttaattttttcttttcttttcttttcttttcttttcttttctttttttttttttttttttttttttttttttgagacagggtttctctgtgtagtcctggctggctaaattttttaatttttaaaaacctatttagtacatgcatgtacatgggtacccatctgcctcggtgcacttgtggtggtcagaggataacttttgagagtccattcttgccttccaccttgttgaggaaggctgtgccatgctgcatattctaggcaaagcttactggctgacttctaggtgattctcctttctctacttcccacatctcccataggagtgctggtgttataggtgcaggttggcattttacataggttccagggatcaaactgagatggtcagatttcctaggctagtgtctttacccattgagccatctcccttgcttaattaattttttaaaaattttattttctaagaaattatgaaaatcctcctggctcagccttctgagtgctgagatcacagatgcgtacaactgtgcctgttatttttagactgagttgcaccaagttacctccattggtctcaaatttctgggttcccattgtctgaacttcctatgtagctgggactgaaacagagacttgtcaccatacctggatgtttgtagcttttttttgccagtgcaagcctacctgtagtttttgattttgaagttgtttgtttgaaacagggtttctctgtataggccacgctggcctggaactcaaatccatttgcctgcctcccaagtgctaggattaaaggagtgtgcaacacacttggcttggtaatgggcattaaaggtgtctaaggaagagaagcgcagagtgttcaaagatgtgagggtcatcacacaagagacatcgaataaagttaaggaaaaagtgttcagtgagtgaagaacattgtggtaccatgcagacttctgcttcagattgcctccctacacacacacacacacacacacacacacacacacacacacacgaacaaaggaaaacctctctgttctctgttccctcctacagctaggacatcctgtgaagagatcccccagcatcttgagtctaggagaactgtcattgccagtgcctgttataatgtcctagtcaatggaagaataagatagtggggatagaacgtgctggggtgcttgtagcaggtggactatgtggtatcaggatcccaggaagaactggctcttgctcgtaaaaggttgagtctctggggcagccccaagggcaggacctggactttattattagagtgctctgagggaggtgagctgtgaggctcaggtggaggcactggctagaagtagagctttttctagaatgactgaggtcgttagtggttggttttaacctagccaacccaaccaagtcctagcttctttcagtaaaaggggctacttttttttttctttttttttctttttttttttttttttgatttttcgagacagggtttctctgtgtagccctggctgtcctggaactcactttgtagaccaggctggcctcgaactcagacatttgcctgcctctgcctcccaagtgctgtgatcaaaggcatgcgccaccaccgcccagccaaaggggctacttttaagcaatcatatattatgggtccactgaccctaaaggtctagtttgttggaattatcaggcccttccttaggctggatcaactcctactttagctccccaatttcctattttcaaagactgccccctttttttctccagactgttgcttttccttaatattccctcagttagttgctacttggcccccaagttggatagaaagtaggttaggagccaactatggtagtatagatctttaatcctaatacaggaaggcagaggcaggtggattgctttgagtttgaggtcactttagtttacatagcaagttctaggacagagagaccctgtctcaaaaacccaaatgtaacaaaagaggaagtagaggaggaaaaggaaagaaatgacccccatcagtctttttgtcttctctatggtacaagagatatctgaaaactaaagagtgaacttagcaagcctcctgggactcctaatttatgtcttagatttgtcttgggcctgggtccactggccacagttaggcaggagtagaaggtacaccagccaggaggtcaggcttagccctcaaacagggttttccactgttttgcacttgggatgttgtttagtctccctctacttttacccacagccttcatagtgcctttctcctagttcagttaaacttggcattaggctaaggccttggaggtcctagctaacttcaatagactctcactaggaatgataggtacagggtgggagctatggagccttcctaaccatttaaggtagttaatatgttcccgatggcttctgggactaaaggccccccactttagactgactgctctgtacctgtaaccatactgaagtctagtggttttctaagccactgcagagttttgttttaaaaccttcaggtccattcagatgcagagcagagcagaggtcaacagtttcatcttgtggagtctcttcattgctttcctgacttaagtacataccctacaggggctgctgggaaaaggcttgagtgaacccaaactatacctctatctcttccatagtgggcttctcattcagattttatttgaacaggggaacctgttattacaattaccactggtctgtaaaacaataccagagaaactggaggaatatactattcttacatcttttttccttacttagaatagtgaccctgaggggtcaactggtgttcagtgaggagaagacatttccaggtactgtaaccccagtcttcaaacccactaaaaaaatcccaactttccaataagaaataatgcaggagctgggcgtggtggcgcacacctttaatcccagcactcagaggcagaggcaggcagatttctgagtttgaggccagcttggtctacaaagtgagttccaggacagccagggctatacagagaaactctgtctcaaaaaaaaaaaaaaaaaaaaaaaaaaaggaaaggaaaaagaaataatgcagtacatgccattgagggtaggatgtctgcagtgccagggactttctttgaatttaaatggccaagaaagaagtatggtaactttgagaaaggaagaaaaagtgaaggattcttaactgtattctagacatatttattttaaaatttccagcagtccaatgtaatacagaatcttactaatcaacagataaacaatttacttaaataatctagctaggaagtggttaaacaaacagactctgatcaatagtttccagggttcccctcctcctagcttgaatctaggggatagacagaaggatcaaaagttcaaggtcatctttgcctagttctaggccagcatagggcttgagagggctattctcaaaaccctcaccgcctaggagtcagggtgagagctcagtctcctcctgggtagtgctgagctgggggtggtaatcagctctgacagcagtcaccgagtaaaagccctaactgaatcttaaggcaagaagagcacaagcagagggggctcaaagtccacaaggtaactagcaagatcctgcttcaaaattttgtaaaagttaaaaagagctaagtacaatgttcatatttgcattactactactggggactcaggagcctgggaaagatcatcatgaacgcctggccagcctggtgcatgtgaaacctggtccaaaccaaatcagaccagaccagaccagaccagaccagaccaaaccattttttgccacacaaaatgaagacctgagtttgacttccagcccccatagaagtcgatatgggtggcagatgcttacctccagcagtgggaaagagaagatgggcaagaggcattgtcctgtgagtgagtgcctttttgtgaatgagagtgtgcatatctcatgtccatgaaatagactgaaggttctgggatgacagtttcaagtatatacattgtgagttaaagactggtgtctctgtgtggctggtagacaaatcctgtttctttgagtacacttttgctagaactacctgatgacaaactgctgttagaattaggtaggtaaggtgtgtgcttcaggaaggaaggctcagtattttctccaaagtcttcgacttggatcgtagcctgagtgtatgcagaaacagcatatgggagatgaaacaatttcaggacttggacttagataaacgtagcttggctacttcatgtaggtaagcccctccacggtctgtggcctcagactcgcagggtatttcacacacaggcatgtcggtttcccaaggagaatgctcacccagatccattcaattgtactttcactagtgggccagtaagaaatgttgagtgtccatataacactgagtcagaaacagttactgggttccccctggtgccccttgaatacagagaccccaaagtcaaattaggtatagtcgatgttcttaagatctcaatctaaagagtgttcagaaaagtctaagcatcagccatatctttctccataatgagggtggagacatagctcagtgggtaagaactcttgttgctcaagcatgaagacccaagttaaactctccagctcccacataaaaagaccagtatggtttttttacatacatgcctgtaacccaagagctggggagtagcagatggggaggcaagagaatcaatggaacttgctgaccaacagcctagctccagattcaggaaagaccttctctcaagggaacaaggcaggggttggtagcaggacacttaacatccttcaactatgcattggtgcacacaatactgtatgggtgcacacacaggtacacatatgcatgcatgtgcattcatgctcatatgtgcacacacaaaataagtaactttatctacagcatgtgccacttgctgtttaggataatagtcaaatgcctcagcttctggcctccactgagattcagaaactgtataaggtaataattgtattggcctcaaaacagggaaagagttattatccttagagaaggctgagccacaggtgagggtggactaaatgggagccaacataaatggggctcagcatttctgactagtgttctctctgtagtaccactgtgcctcacctcagtaacgcagtatctatttatgccttcagctaaaagttgatcctcattctagagaggatgaacactgactttcacggctgtgtcaggcctcacactgaacccactgtcctcatcacctggcctttgccactacacagttctttccagctaccacagacattctagctcctgtataccaggtggaatgccattgcccttcctaagtctgtacttctcacctgtcctgtctccctcagtgacagctttccacatggactccagtcagggaaggatcctaacactatctttaaggaccccttctctgtagacccatgctctccctcatttttctgggaactgaagccctgaactaggaagagatttacctgaacacaacactggctatgccaaccctctttcatctagtaaccacagaaggccactggctacctcttctgttatctacactgagccagctgcctcctcttccttgggattattctcaagtagactctctttaaacgagatgagatccactctgtagcctaggctggctttggactcaaggtcttattccctttgcctcccaaatgatgagatgacaggcatttatttatcaccatataaagcattgtaaagttcttataaataactaggttgttggcatagtcatccagctgccagagaatcctttcctgttcatatcctacctgatacccaagctaactccctttcttcaatgacctccaaaataagtggttcttgggggctgggctgtaactaaatgggaagagtgcttgcctagcatgtatgaagtactaggtctgatttccagaaccacataaagctgatatggtcatgcacagctagaatccaagtacttggggaggttgaagcaggagaaaatgccatctgctatgagtttgagatcagtctgggctacatgacatcctgtctccaaaacaaaacaagcaaaaggatggaacaacaacaacaaaacagtttcttgctcaaaccacgtgctttctgctcagctcttttgaacaaatatgttactgataaatagcaaatgaggcagttaagagcttcatctgagggctgctcaaaatgaggagacttttctggactaggtgatgaataggggacaaatttgccattgcttttcccaatctattccccaatccaagatgcacctttgttgccagtaaactcaccagtccaacagcctctgtgcctgctatgtgtgtgtggcactctttgttcagactgctagctaaacagaattactcatgttgaaatgactgtggatctacttagagagagagagagagagagagagagagagagagagagagagagatagggttgggaaagacttcgccttacttcctgcagcaagcatctgagtgtttggaggatatcgtgaatattccagccagtttaaaattgcactagatagcagacagagtgaaatacctgattcacaccccatagcggctcagacaagtgccagttttccaggttttcggaattcatggctgaaaggcaccttacaatgtagactggacacacgtttaacagccaggaaagtctagacgttgcagccaatcgctacttacctctaatccaaccaaatgctagccaggccggactctgtttagcttctgagatatgatgcgtccaagtggtagggccatagactgttacaggtttctccagacccagctccaaatgggttgtgtgtgaaggaaaccggggccgtgtagttaagatgcacctcctttagcttccaccctgcggaactccaaatcccaaaaggcctaagtccgaagtcctcgaaaaactccaagtggcggtgtgagagatgtaagagcctctgctttggaggcgactcttactcgtggatagtttaattatttatttttatttcggtggaggcaaggggcgatcaatgaaggggaaggggcggggagagag

SEQ ID NO: 119 - DNA, 5845 bp, Mus musculus
ggcctcacccaacgaggacagtgaaggagatcagctcttggtaagactaaaagaaaaggcactaaattctctgcgtccctctctctgtcttcctctcaatcccctcaccccctccccctctcttctctcctcacccccccccctttctcccccatcccctgcaatccgcactcgacgcgagttcacgcgcagggctggatttccaagctgcactgcaacttctcagcgcgttattattattcatctgagggtgcagcctctgcaaccttcgcctcctgcgctagcatccttccccctcgaccgcggccaccagcagagcggtttcttctgcacgcgtgctctggttcaccagaggaggattctggctttttgcttttttgttttggtggtttggttcggtttggggtttttttttttttttttttttttttttttttggttttgtgtcttaattctttcagggtcatcgccaggatgcttttcctccggccaggtggagccagcatcagcgcctgccagcagcaattcccttcaatagccgaggaagcacttggggcttggccagggaggccgctccttgcttgcggggctgactttagcctccactactctcccgcatccatctgcgtgtatattatccccatccctttttattccaatagatccgcctttggtttggactggctgaaacgcggcggactgcaaccaggatcctttaaaggagaacaaaaagatgaggatattgtgcgggggttccgggacaaagcgtcttgggacgcgcggaactctggctccccgattggagagatcaacgctgcccaacagtacccggccggacctgcggacctctgaggttattcggactcaattttattgatttttgtggcatgctttaaaagggtcagtgttaggtaaagactgtgtcccccaaccctgtggggtgggtgggaagctgaacggaaccgatccagttagatttaacttgtcctctatgccctctacctggcttttttgagccattgggaaggagaatggggaaggcttagaaaagagaaaggggggggggggacgactgcctgaaaggataaggcactagtagggagtgggatggaccaggtgagggaggtctgtgggttaggaagcaccttcctcactctggtgcactgggtgggtttgttcagggaatggcaacgtgggtgtctgttgaaagcagtcttgtgaaattgacatgtacatgcataaggtgactggacttgtgtgtaaacagagtgatggagagcagagagggaggggtcttaaaataatattttattgtccctatggatttggggatctctcccccaccccacccagctacattctataggggtgaccttttaaaatctacacccaccctttacctctgtaaaaccggttgacgggtggggtgggggaacatgtaggggtgcgcgctctctctctctctcttttccccctcccccctcccagtctccctcctccctctgtctccccctccctctcccttcactcctccctctctcgctctcccttcgctccccctccttctctgtccctccctgctgcattttgcatgagctatctaggtcattagcattttagcgtatgcaagacttgacaaggctgatgaggggccagatgggcctcgctcttatttatttattttttttttcttttcctttttcccatccaccacttgggacctaagcgagaggaccgcagcaggagagttccggaaggctgattcccacagatcctggtaagggaccgcagcagctctgccctgcggcacgcccggccaggctacacccggaccctacactcaaggtaaaggcggcggtcacaagccctgcccaggcagcagtagctgggcccctgcttcccatccctttcctctccgtcatctccctcctcctggcccccctcagtttcctaggcgaagctgagagcgaactgggtgggtaggattcgctgcggtggggcgaggtggggttgatgttttttcattgtctggaactgcaggggaggcgaagcgcgaggagaggagtgagggagtcggggtaattaacacgggggaggcacccctccgtctcccacttccacccacatcccgaaccctccacccccctcccctttgcaggaaaaagcttggaaacgaaaggatgcgggagaacaaagagcctacggaggacgtggctgttatctcattgtctgtgactgggggagctgcggtaggaaggatgcggtggtccttagctcatcgcgttccccaaccccacaccctccctgctgtcagtgcgcacgcacacgcacgcgtcgccagctttttctttctcatctctcatttttttcatctcatcttctccccatcccctccctttctttccacctttccttcctttcttcctcccttcctttctcccatcctccctctcttccatccttccttcctttccatccttccttctttctttccttccttccttctttctttccttccttccttcttccttcctcaggagaaaggcctctctctccgtgttcacagcggaccttgatttaaatgtccatacaattaaggcacgcggtgaatgccaagaatggggctgtctgagcaccttgggtccacgagggcctgccacggaaggatcgacccagcacaacgccctgggcagatctcagcgctgcagctgcaggcgcccacagtacgggtagcaggcttctgagtgcctcgcaaagtagcccttagggtggggaggtgtgcagctaccgacagagaggggtttgtgcagatgcaaatagaatctaggaagcaaacaactcattctgtgacagaaacacggatctatgcaagcgggggggtggtggtggtggtggcggcggcggcggcggcggcagaaaatagcctggggacggctggagagtaaaatgtgcccctcagctctgggaccctgcccattgtagaaggccgacaccttcatccctacctgtcttagttccggatttcaatttattacccttaaacaaataataataaccaagtacccatgcgactggcagactgccccaaagcctagactgcagctaccttgtattgtgcttggggttgctggggtagtctttaggggaagctgtttgtcacccgttggtggagagctgtgggcatttgacaagcttaaacagatctctggagtgagcgaaggcgatcggcaaatttgttcatggacagcgcacagactccatcaaaactgacagctagcccactgctctaaagcagggcctcccagcctccttggggctgtggctgaagtttcaggcagaaatccagaagctacaggaaaaggaggcgcagcccacccccagcccccagagtgtgggcctctccccatcgctcttaaaaccccaagacagaaggaaaatcagcatgagtaaggtggaggcctaaggaaagtctgttttgaagcaggctgtccaggaacagaaagggttaatcctccctcatcctgaagcacctgcttcccaaatcagcccccaacagcagcagctggtcctggaggcccccgacacagttccatcccgtctccatctcagtgttccgccaacctgcagtggatggatgatggcctggtggccgacctaaactcattaattttcaggtggagtaaatggaggaggggcaggacccagcagcagagggagggaaaggaggccaagagctggcctcctccccccccccacaacccacccccaggaagcaggctgtagccctcccccctgctgtcatgccagaggcctgcctttgcaaggccaagcccatgaaggatgtttaggagtttaatctgattcctaacacagtaatcagggtctaaaagagcatccgttgaagttaatggaggactcttgtctcaaaaagcctcagcctcatctagtctagtaaattagtatttgagggtatatcatagatcagtacctctctggcctagtttcctcaagagtattcattatttcttgagtatctactatgtgtccttctttacgatgatttcaacttctaaatttcctcacagaagagaatgttagagctagccaggctgagcttcaatttaccacattccacctaggcattcccagaaccttctcccgctctgcagaaataagccaccgcctgcttactcttgcaggcagaaagctgcagtgcccacaccctgagggtgtctctggctgagtcctaccggacaagccagactgctttcaaggcagaaagggaaagacccagccacaatggctgtcctaagagacgccatagccattgcttcgagaaaatctacctcccttgaaataaaaattggccctttcctggggtgctccctcacttcacaaatgggttagaagagaacggctagtgtgctgtaccattttgggggtacacccatttgcccccccccccccgtgctcattgagatgttattttgccttcaagcaatggcctaagcagatgatggcccaacccccctggaccacaaatatccccattagcaatcctctactcagtaattgcttccccatgattctttcaaatgtcccctcgtccttcaccgatatttcatcttacgtaacccccagatgcttccccaagtaaagtccttttaggtagaaacccaatatgcttttgctctgagagcgcaaaccgcaggcaccatccataaggcctgcctgggatctgctacggaggatctgagttgggaggggtgcattgttattttattgcttacgtaaaactcttgttccagaaagtattattcgtgtgttattggcgtgtgggagtgttctggactggccagtctatgtgaaccagtgttcgtatgtgtctaccagatccccttcccagaaggggtttgtatgtaggactctaatgacctgctcagccccaggtataagtgcaaaccccttttgtttccaccaaatgaagaatcagagccaaggtcagcctgagccacctccttcctctacattcgctgcccttctctgcccatcaataattatgcagagaagccttctgctctctcaaggcacctcctggattctcagcatcatctcccctgcctatttgaaccttctaattacatcttatggcgaaaatgaagggaggaacttgcgatctaacagtaggatgaggctgccatagtttgatggctgtatatgttttctttttccccttgggtttattcacacccgctactgccttagtccccactgggtacaatctcttgtgtttcttaaggaacccggtacttggactagatttagtaatgtatcaaaggactaattacaattgctatgtttctctcccctgtcagagacagcccagatctgtctcagtgggagactaatatgtggggaggggtgtgtccccagctaatagatctccgagcacacgtattaagccatagatttttctcacacaaccgtatccatcactaatgtggaaggcacttgaccacaaaagcaagtgcacccatccacaccagctctacaaggaaattttctctcccactattgaacttacataatacccacccccattccaaccttagagtgccgtctgggggcagctgcagaattcctgcctgggacagatggagcctccccttcctcagccactctgtgggtggtttctgagcccatgagtcaacatgggcagactgtagtgtgtgtgtgtgtgtgtgtgtgtgtgtgtgtgtgtggcttggcgggctgattcacactgaagatatcaacagcagtgttgagaattatggtacctaataaagatctttttttttctttc

SEQ ID NO: 120 - DNA, 2819 bp, Mus musculus
atttccagataatctttaatcagaataactcatcgagggaagcaacaaccatttaacagtttgtatcataaatgagcagaaagaggcatgtgaaaatcctgcattgtgtatagagtttctgatccttgtttgctaagggaaatatctgtaacatcttttttgctgcacgaaggcttctctgagttggagcacaccagatgctgtctgccacatccctggagcttacattcctcaatcgatagcaggagatgggaaggaggaaggaaaactattgggggcttttacagtgatggggcttttataatgctgatgttatgatttcattaagtagaataaccaatgatatcactgctcctgggagcaggcttgtgattgtttaaagaaagattgtttaaagaaagatgactcgagctattcagtgccacttggttgaaaggtctaacaggtagtcagagtcctcacttttgcggagaccacacatctgtcttcaggttccagaaccccaccagagatggactccagcacttttcacagcacagttatctacaaatacagaaaataatacatacctgagagacaatatataaatgtaaacaatgtggtaaagcctttgcatgtagcagtagtcttacaaatcatgagaaaaagtcaaactgcagagaaactccataagcacagacagtgtggtaaagttttgtgcttcctgggatcttcatacaagagtaaaacctttagtgtgtaatcaatctgttaaagcctttgcatatctcagtagtctttgaagtcctaaaagaactcatacagaagggagtctataactatataagattttatcactgcacacacaaaagattaattgagagaaatctctttaatggcagcatgtatttagctctggctaatgctcaaagaagatccagctgggaatagattttaatttccacctatgctgtcacccttaagccccttttaggttcaggtcccaggttaatttttgaacaatttaaatatggactggagactgcatgtctaaccaattagacagacacacagcaaatatagtcccagaattacttcttaagtacaccagtgtcctgaaacaacatcagtgacaggttcctaagtacaaagtcccagaggatgaaaaagacatgaaaagtagaaggcagaaagttacaaaagctggggtggggaggccttgcagaagcctctgtgtatgaatgtttagcttcccagtgaggaagatgtgttggctaaccatagtgctccactgggtttgttatctggttcctgtttgccttccagggttcacatacttaccagctgaaaagtagctgcagtttacctaagcccagcatgaaggactcaacccaagtgaaattagagtatttgggggtttatttgggggtagctctctagtggattcagtgatcccaaggaaccagagagttcactagtcccaaggaggtcagagaagttatgggatgggagtataaggagcagaggtggggagaaggagctagcaaggcatgcaggggggagggagatggagagggaagtggagggaggagggggaagggcaggagaaggaggaaggaggaggcagagagagagagagagagagagagagagagagagaatgaaacagagagacaaagagtacaaactgtcaggattatataggaagatcttctggagacaggaaagctcagggtacaaggtggggtctgccaactttgctatgtaacaggtggagactgaggagagctgggagaacctggaggttcagctgtaaccttcccagccttgagcaggctaagcagaccttgaacattcatcttgacaggccttatcaagctggatagagacatgtgtcttggctgcagttgcaggttcccatgggaacttagctgttttggctgcctgtgctgaccttgttctacaacatattccagctaaagaaggggatgggttttgtggtttttccctttataaacgtaaagcctattattaaactttgagtcttgatcagaatctttgtcttgacttcattcttctctcgcgtaccccccacccccatcttttcatttccagcacccctttcaggtaaactcagttctcccgcggctgctggatggctccacccagccagctttggtgtgttaaatatatgcagatcagaagctggtcccgggtctgaatcccaaccgcaacaaaactattgtttccccaaatctctttttaatcgttaatatcctgggcacccttccgcttgtaggacagattgataactccactgcaagttgagctatgcaagctaactaccttgattccaggaggaaggcaaacagtctactgagtgaggaaagctcaggctgaaaagtcaaggacttgctgagcacggggtcaactgttcacataggggaggagcaagcggctgagcagtgataggtgcagtggtggttcctccctggggctgtgcggggagacagaagggtaggctattggaggaccggcacaagtattacagaaatgaaaatccctgtagatctggaaaaggtcgtccctggatttgaagcttggtctgagaacttctacactgtgtggcttcagcacactctaactctaagggaggtgctcgactcactcaagacttactggccaatcagagcctccaggcagacctgcgtgtcagaagagaaggcgggttttccgggtgcggtggtgtcggtttcgcttcctggttgagtgcttgaatggttctgtgtgccgtgctccgtttcctgcggttggatgctgtggattgtgcacaggcaagc

SEQ ID NO: 121 - DNA, 2093 bp, Mus musculus
actcgttcgggattcaggctgtatatgagttagtgaggactgaagagaggagagttaaacaaacaagcaaacaaacaaacacacagggcaagaaaacaggacccaacagcagacgctgacaccctcccgacctgcagtgcagagtgattccaagaaccgcgcgcgacattccgtgtctcaggaaagatggtacccacactaagctcagccaagaacggcctccgcgcccgcttaattttccgaacctgttcttgtggtgctgatggggagggtggccgggaagagaggagagaccactgatcaagttgctgtttgtatattggttgattgctgtttgctgtttgtttattgattgatttttttttattggcccctggccgaggatgagctaagaagccttttgcataccttgacctgacctcacttatccttccacacttctacacccttttccttcctgcgcagggtcctgagcaggtgattcaggcccacattctcgtcattcccgcctcgctgctcagcccctttccttggcctgcatttcctattggtctgtattgtgtactgaagcagggtgttccaacagccagctcagagtctctaggtgttctgggaaggtagacggctcagtttctagtgtgttctgacagagccaggcctcagagtatagctactggggcttacccctgatgtgagggctgagggtaggggaaggaggggtgaagagcagaggaaaatccctggggctcatgttccttcctgggtataatcttcatttctcactgccccaagcagaggaatgaaaattgagaacgcccatgtccacagacgccacctagatgaactctgagttctgactgtaatctgtaacaaggttagccacaaaccagaaccacagggtgacacagcccgggctgtttgtgcactcccctgacccccaacacacaccctaaattatttgcctaggaaagtggagagtccagtccctttacccagtaagcattttttttttcttcaaactgtagaatgccaggcgaccagccaaacataaattctttggttttttgttttttttttttttccaggtctaaatcaagcagtgcttagagcctcccacaacgggccttcaaccatatttggaagaaaagaaggaatccagagaggaaatggttacctgtgcttacaggcggtctgcaccacaagcgctgactcagcaagagggaactctgcgtacccctgtcccgaaagccccttgagcaaggacgtcagaaagagactaaaatggagggacagcctccgagggccctggagcagggtaacatgagatctatgactatctagtcattcgctacctgcatttgaaagcatatgcattattatggttgtcaccatttatagtagtatacttagacgttgtccatcgaatctggacgcatactcaatttgaaactaaataaaacctaaaggaacataggtgaccatgagggactccagggaacattctctgggacggaactctgtgaagagtggagaagaggcctctaggatcaagctattcatcatggatacagcctcagatccaggacctccaccctctggtgcagtatttccaggatattagtgggggactgtggaccattcaagccttggaacaagtctagcccaaccactgtctaactttgctgctgacggaagcctgacccagccctgacctcgtagaccttataggaatatgttctcagctcactgctccacatttctggccctgtgacctcaccaaacaaacacctgcctatctcagagcattgtatctattcatgttgatttctgtctcttccttattagtctcttgcacaaaccatgaactggatgaaagcaagaacgggatcgtttgggttctgtgggtgacatcaggacttgactgtggacttgacttgcatctggcacagcctgctcgccagctcctattcccttgcccacctgttctttgaccttgaacgcccaacccctttttcttggcatcagtatcgtcctctctaagagcagagattaggattaataaatctatgacgtgcttgtcacagggactaatg

SEQ ID NO: 122 - DNA, 14200 bp, Mus musculus
accactaaatagccaattttattttgtaatttccaagacagctccaggaggggaggcccagaggccaatgtaatgaatagatggccctgactgacaccttggctccaggagtgagaacgaaactgaggcagagtgggaggcttgaaacccccacccccaccccaagccctctcctacagccctgggggagcaactacagagggccgtggtcaaaccttgtcttagctctagcagtttcacaagctccatggaaacctctatctaacatgtagtcatctgtcctttgacttagcatagctcctgccgacgccgagtccattctccttcagagtcctacttgctagaatattcctccttgggctgaagcctacctgtacacagcacccatctaggccctcattttgccccctggagctatgtcaaataactagtgaagccatttccacaggacagtcctctaagctcaaaagaatcttcttcccaatacatccaaataagaacccttctatatgatactgtaagcaactggaaactgccttcctgcccaactggtctagaagcctccttcctgaaagtctaaaggtaatatatgaccacactttatttacctgcaaacacagagaaccccttgtaccccagctggtaacaactgaggtcgttcatcacctacttggccccttttgaaattcactctgcagcaagcactttttaaagtcctgcacataatgcattttaaagagcattttctgtgcagatccatttgctcaacctcggcactaagtgcaagatggagctgtcttttggtgcagccctgctcctcctggagtccgtgctgagcacgtgctgaaatgaatttgtaactgtacagatgaccggggctcggaagcgtatgctttgttaactgtccatagctgattcaaacgcatcttgcaagaaagagcagtgctaatgcagaaccctggtccaagatatgtattatgtaatgcatagtttttaataatgtgggcagtcctggtgtttctgtactagtgcataggatgtgggctgccatctctatcacgggcataaagctttcccctgaaaaatgaggcactttcccacacacactaaaaaccatcatccacctcactgctgacagctggcatcagtttccatcaaacgggcatttaccagcacccacagtcctgttttcctctctctgtgtgccctaaaattggctagaccaatgtctttgtgctccatatgatgttggcagaactgttttaactgaaaaaaaaaaaaaataaggttaagtgtatggaagcggtcggacccctcagatacccccattcatcagggtggaaaggcagagataaggatctgagatctcaaccccaaacaggggctcaagagtcacagcaatgcactaagagtcagcagaacatctagattacagccacacatttgttcatgagatctgctgatccaaccccactctatctcaccagcatttaaggctgtacatgaactcctagaccacaagatgcagcaccaacagtcaagacagagagattctataatctccaaccatgcagggcacctaggacctaagtctgtgacactgcatctgggagcctgactctgaggtgcaagtgtgtgagggtaagtaagtgacctaggaccagcacctgcttcaagacataactcacaattccacctccaggaaggaaccctgggggagcagcttggagaggcagcagtacctcttgtgactcttcacatggactcaagggaaaaacaaaaaaccaaacagcccaccgtgtgacatgtgttccatgtaaaaaacaaatcaaaaaaacctcaaaaccaaaaacccaacaactaaaacaccctgccaagacttcatgcatccctataacacaactctgctagtgttatgcttttttttttttaaggtactctatatttaacaaggcaaaaggcaagataaacgagccccacacccacttcccacagggctccatcccctcctggacctacctgagtccatcggctcttccaagcgcgctctggaacaagcaggtcgttttaccttgttcttccgagtccaacagcaggatccagtggtctctggccgccccctagccatgatgctcttgctgacgtacctgtttttctcatgtagcgtgagctagatgaagtaatgatgctggaagaatgagctgatgctctggttaagatatattaacccctcaagacccctttctctaatccaagacctgctcctgttcctcgctatcttcagcacctagaacagagctccgcgagtgccgggaactcaagtgtgttggttgaaccctcagctgaaatgcatgagtccgtggctcaaagactaccctaaaaacccacacggagagcagcagttgaagggcattctcgtggatactcactctcagcttcctatggtcttccagcacacctcagtggaacagtgttcaccatgagctgactgtcggcttgcaaattcctacatctacagccgcggggggcggggttgtttgccagtggggttcataccttcttggaggctgctctaattaattacagttactttaacagccctgacaaaagtaaccacctttgataaggttagtgtttacttgaggctctgatcctcaagcattcacgctcttcggtcattaacactcattcacgtacggatcctcattcccctgaatatttacaattttgcgttctggttttcaattgtttggtggctatgctcatggagaaaaagttgaggagtggggacaaccccccgtgggaatctatacttggcttctaaaatccgctaacctgtagctatcttactcccttcgctcgctagacctcgatatccagccccccaccccccatgctttggccaaatctactcaaacaaggttcccgcctgccacctgccggcccactagggtctgcgccatgagctatgcgccaacgcacagctcgcggggaggcactcccgcccccaaacacctccctactgcacatgcccggcagaagtccgcgcaactttatagggccccattgccccatctctcctcagtctcctctatcctctcccagacgagaggatcagtggaggcacctctcggagtcttagacttcagagtctgagacttagcgagaggagcctcgaggagactccttctctcttctttacccatccctttcttttacttacagccacaagctgaggcgcggagctttagaaagttcgcagtggtttgaaggtaggtacatcccttctttttgccccgaggcgagattggggtcttcagaccccagcttctctcctcataaggttaatccttttcggccccaacagtccttgcgcagtggggccactctctgcagagccagagggtgagtcggcttctcggtgagcacctaagagaatggatcgcaggtcccgggctcagcagtggcgccgagctcgccataattacaacgacctgtgcccgcccataggccgccgggctgccaccgctctcctctggctctcctgctccattgctctcctccgcgccctagcctcttccaacgcccgcgcccagcagcgtgctgcccagcgccggagcttccttaacgcccaccaccgctccgctgccgctgcagctgccgcacaggtactccctgagtcctctgaatctgagtctgatcacgagcacgaggaggttgagcctgagctggcccgccccgagtgcctagagtacgatcaggacgactacgagaccgagaccgattctgagaccgagcctgagtccgatatcgaatccgagaccgaaatcgagaccgagccagagaccgagccagaaaccgagccagagaccgagccagaggacgagcgcggcccccggggtgccaccttcaaccagtcactcactcagcgtctgcacgctctgaagttgcagagcgccgacgcctccccgagacgtgcgcagcccaccactcaggagcctgagagcgcaagcgagggggaggagccccagcgagggcccttagatcaggatcctcgggaccccgaggaggagccagaggagcgcaaggaggaaaacaggcagccccgccgctgcaagaccaggaggccagcccgccgtcgcgaccagtccccggagtcccctcccagaaaggggcccatccccatccggcgtcactaatgggtgactccgtccagattctccttgttttcatggataaaggttagttgccctgaccaaactggggtccctgagacagtagggtgggaggaaagagacagatgggaggcaaggtgggaagggagcggtgcccattaatcagcccgaaatgcaccccggaaaaggagagagggctcttcaagtctctccagggcacccaggggcgcttgggaggccaaaggtttgttggacggtgaggcatttctggcgcctcgctggagacaacctgaggtccccgagctgatacccggtgcgcaacattgaattcggtgtgccacactgaattcccagcgcgccccaggtttggagttacatacataaacggcaaaggtaagtcacttgttttctatgttctctcccctcctacagaagttagtcttcagcaacggagttggctttaggtagagcccactgggctcgatatggaggtgcacgcaccaactttggcgatctgagactgctgcgccatagctacagtattgcaatgcgcagaaagtaactgcgtttgggattgggtgacaactctggagcctaaatcgcacgtggcattcagccggcgcggagcctggaaatcgggtaccggcatggccaatttggggccgcgggaccctggagccagtgcctccccccacgccgtgcaagtagtcttggttaataccgctcacctctggaggttcgaggaggcctgagatcgtgaaaaggggcgcgcgcacctctcccgtgcgtcctaaagccaaccttcccgcgcagaaaggagtttcttgatagtggatagtgcttggaggacactcagtggtggtatagggttctttacgggtgcccttctgggctacctgggttggcagacagctaggatcacatcggggtatcgcgcagctggttaggcagatccgacttgtccggagaggtccgggactgtgcgcctaggccatagaggcaggagagaaggaatgagagcaataagaagtggtcttgggaggaaaggtaaagcgggtcaaggcacaggctgagtacggaggtcgtggctatcactctgacaccttcaaaggtgtacccaaagatcgtggcacttcctaagctgggaagatgtcggatcctgcgctttggactgagaggtggcagggaggatgcgctacagccattttggccatcttcagctcgggtggggctgtttttggaacctgtaacctgtgggggaggggagatcacccaccggtgatctgccccagcaccaagcacgtaacgcaccttagaatgctttcccctccagccttgggcggaaaggctgatcttaagtaaaacgcacctactgtatctcacccatttagaaactttttttttttttttaagtgtgcgcggctggtcttgcggcggcttgagatattttgatgggatgatttgggaaatctggttaagaaacgcagtttcaaagcttgaaatcaaagccggctgggctcctgagctcctaagaggagaatggtgctagaaggaacacattacgtagtctccttccaggacctaccctctttcctgggatggcgtcgcagcccccagaatttaagtgagggtgggctgtgcgcactgcggctaattgcgactttggtcaacagcaggaagcagtttgttagcagtgggtagagaatgagccggtagcttgcggaaaggaggcgggggcttttgggttgaaagcgtgaaattgcctaagtgagacattatttttcctaagttaaaatgctcggcaacgaaaaagatgacgtgacgttttcttgacgttaggtacctttatgtcttgtaatgtagcctgagtttaccaagcaacaggtttctagttaacaggtggagaagccgcacttttttttcagcagttagatttttttttcattagctaaaaattaggatgctgccttgttgctgggataaataaaaatttaaaagtgtctccagtttctataaccaccacctcacgctgttcttatagaagcctagagcctggcaaggtggtgcaaacctctaatctcagcgggggtcgggtggggatggggaggcaggtggatctctgtgagttctaggccagcctgctctacagagcaagttcccgaactgccaggactgcacagagaaaccccgtttccgggaaaaaacaaaaacaaacaccctctccccccgccaacaaaccaaatttaaaaacaacacaacaatagctacaaaagaagcccaagtgagcagtgtaagagaggctcatacccggggtattcaaacaggaacgcgcattttgctttctattagtaaccttgcactgtctacctgagtcacagcagacgctttagtccagcctgctaccggcccgcacaaccctcccctccctctcagcacctccccctccctagcgccatcctgactccaggtaaaaaaacctcggcgggctatataggagcacaccacccttgggagagccccaccacccacacaagaggttttgataaaacacccatcccaaggccattttctgtgaaatagttcattcgctcactaggctcaggattttacttttccagggcttttctagcaggtcctcaaacatccctaactagccctttgtctcaccctgttaaagcggggttagcatttgaatggactggcaagccctttccctccgtaggtagactggctgagggagatgcacgtgggacaagtgggggtcggtgacaaagctagttaaactgccttccaagagcttttggatctttagctgcattaatcgtttgcttaatgggaaaacttccttctgtggtggaagggtgcgattattgagtgtcttttaagtgattttcttttttaaaattatgtggcaatgttcaaataccgtgtggtggcaaatgccagatgtaagtactgtttagtttatcagtaaaacttttaattttatttgtgagaattggagaatgagatgggaggtgtaaactctaggattgatttgtaagtgtgtttttttgtttgcttttttatgtgcctgaagccttttatcctctgggattgcttacaacctttgactctttagcctacattttagcagctgtgtccccttaacgagaaacttgaaacatcagaactggtaagaataaagttttttttttttaatggatttacttaatttctccttttgtcatgtcaaaagaaaagaggatgaggaaactgagcagagacaacggtgtgggggcaagcaggacagcagcccatcacaaaagcaacaaaagcaagtcatgataatcaattgttcagggccagagaccagtgatgtcaccttgttagctcaaatactgcttcctctgaagtcccacttagtaacaagatgagaaactcaggccatacctttgatcccgtgctccacatgagggaaggaatgtcctgttgtggggtttggccactaattaacctaactcccaaacccagacagaatgagaaaccagcagactgagacaaaaggcataagatactgggtgagcccagggtgcctctttcccaccttgctgactgcctccggtcttccctcacacccctctgcctcagtttcttcttaaagtgtgctagcagaacaaaatcgttctctctctggtgtcagaagggcagagccgcacctctagctccagcgacgttcccaaatctcaaatgtttgactaaataaaaagcactaactgtgaagaagtgtgtttgtgttgtcaagactcactgcgtccagtcctgggggcggggttggggagtgtgagcgagcactcctaagagcacctatcaatgctatgttgtgctgttcccgaattctccccctgtggttagtgtctagaatgaaccttccagaacccagttggtacaagcccattagggatgctagctacgaaatatgggagacagcaagctgacagtacaggttaagtaatggcttagaggctctagatagttgggataaacggggaagtgtttcacctcctgtccattatcattccctcccaggggctttttttccagccatatccagccagtggttcctgtctccagttttagtactcacatctttttatatgctgcaaggcctggtaatagctaagctcactctcacacacaccacaaacatgcacacacgtatcaaacacatgcacgtactcatacaaacacaccagacactcaatactcataccccagatacctctcacatgcacaaacaccacactcatccacacacatacccgacacatgcacctactcatccacaaacacgacagacactcatgctcacacacaagcacacactcatccacacacatacccgacacatgcacctactcatccacaaacacacgacagacactcatgctcacacacaagcacacactcatccacacacacacacacacaaacatcacagtcatacaccacacacactcacaagcacaccagacatactcatacacacacactcatacacacaagcacacccacaattatacacacaccagacactcatatacaaatgtacccactcatacacataaacacagccactcacacaagcacaccatactcatacacacacaaacacacccacactcactcccccatatgtatgtatacatacatacacacacacacacaccagacacacacaagcaagcacaccacactcatacacacccacactcatatgcacagcagacatacaccacacactcacccccagacacaaacacacagccaaatttggctccactgctgaggcaaacaaagcaaacacttctcccaataatcggctctgcaaattgactttttattgaccatttatttatttcatgttttaacccctttggggcatttaaaaatttggtctaattttactagtgtttgttttctccaagtctcctagatagggagccccagcccagccatgaagcagaacagctggcatggtgaggaccagaggacagacatagcctagtgacttggatcccctgagtgcaggtgtctgcagtgcagagcaacatcacttattgatagtgctcagccacagaggcgggaggccccaggggagctcaaatgtgcacattcctatgttttttcctatgagcctattttagggtaaacatgttacacactagcaaggggatgtggctgccccaaggtgaggggagcaaaaagggttgtggggacccagggagtaaaagaacatgctatggaggcccgggaaggagcacacagccaacacatttcatgggtgcacaaaagcactttgaagagatagggaatcaaaccattgaggacacaccaactatggcaggctgaagagggaggatgggaccaggtgcaacaaggagcatcgacacctcagggtgaggaagagtatttttaatagccaaagatggacactagaggagaatttcagatcagtcacccttgaggtcaccatcccagtcttatagacctagctggggaatttcaacttcagctctacagaatggagttctcataaggatacctcaaattcattaaccaaaaagacttaagagctactaaccttacttaatggtttttaaagcattgggttttgactcaagaagaccagcctctgaggctcccattcctatggcacaggaatgcaggaatgtgggcctagagtccacaggcttctccctcccgcaggcaatacccggctgattctcctggcttatgtgtctgtttcaattagacttcattaggaaaatttgctttggatgattgaggttgcctgaaaaggtgaacaacacaatcccctcaaattcaaataatattcaggccccgaagcccctgggtgcctacaattcccaccatgagttacagaaatcttacatagcctttctattaaatctaaccgccttctgggatcccagcccccactccttccaccccagcccgcccctccggcagacacctcccctgattgtttctctcatctgcaacaggcacttctccctcgtggattcagctgcattctcagctgttcatgtggacaccttgtgcaggcacaggtggcaggagcatggcaagctaaggcacaatttggtggctcttccacaaagaaagccattgatatcaagccactgctaataagcctgagggaggggcctgccctttatcgtggcttttcatccagagttgaccagctgtattcataaatatcatttcatccccctaacatgagccccacatcagtccctagtccagtatcttgccctatctgctagagacatcttccctttaattagcatttgtctcaaacaggccagccacacagccccttctgcagagctgctgcctccaccggccaaggcttgcagagatgatggcagggaggtggggggagggctgcagcagtcttaattgaacagtaattaattgaacagcttcaaagtcttattgctactcagggaaacactcagaaaacctttgtcattgggaggctgagcgacttagtgtttgcctgaattctttttctatcttctctttttctgcatctggttcctttgcctgaaaattaatgggacacatatgtactataggcagagaaggctccttataaggctgccccttccccaaagccataaaccaaaagaaaccttactgccaatggtcttgctattcctggcttctgcatccccccccccccaccatcttgctcactccaccctcccttctacccaagggacctttcctacttggctttctcttttgcggccacagggataaatcaaagacgttaagaagcagttacttggggtatctggatgggccttgggcttttagcagaaaacaaaaaccccaaagggggaaatattatatatacacataaagccctaaaatgtaaatataaatacaactgttgttgtaaacaagcacccagcccagggcaccacagaaaagtgggaccacgcctttttaggtaaggaagctgaagccgagggagagtcagcttctttatggttggtgtgactttcaaaaggtcacctgattatttctgacttgagcgtctgggccaactgcactgagcaagctgcctttcctcagagaagcagagcccaatggaaacaggggcactccttaccagtcctttctaatacggaaagagcctcctctccacctgacacaccatctctctcatagcctgtcactctagcatacactgtgtggatggtcgaggcccccaggcttagcttctgcctttcccacctagtaagccttcctctgcacccactcctttcccacccacagcttttgtgactcgccggtggctttgttttactcacatctctcagcatttacctccccccatcacaaccattacagagtcagctggactagggatgacatatcttttgccagggagctgaggagatgggcaaacaaaggcgcctgattcatggaacctacacgacaccagaattagccccaacaagttgtcttctgacctacgcgtgaatgcacgcgtgcgcgcatacactcacccgagcacacacacacacaactaagaggggagggaaaagatcctttcctagtgtagagttgtaatgtgggaccattagaaacctcactcctagtagggtaaggccccaggccaggcactcaccaattgtgtcagacatgtatcgaggcagccagatcaccaacatcaacaggcaccagacagtgaaacccagtaaggtgactccaagccaacttgtccactcatcacctccatctcttaaccattctggactccccaagtcctttggccaggccatacagttaccttctgctacaggccctcttgaacttgctgcttgtgtacagcagagcctttgtacttaggtctatgccaccataggaaattgagagcacagggcagggcataatcaggattaaatcccgagctctgtttttcccagtatgaatttacctttaaattaaagtgcctttttaaaaaaaaattattttttatttttaaagtcaatgtaaagactttctcagcttttccagccaggggcaactctgtatcagaggccatctgtacaaactctgaggacattgatattattcatactaaggggatgtcattggcacctggtaggtttagactagagaagccatataatatcctgcctcacacaggacagtcaccataacaaaacattacctattacctgccccaagtccccagtgcgaggctaagaagccatgatgcacacacaagggctgctcccacttcagcctctggagcctgccctgctctctctctctccttctggcctctccttggctgtatccctccactggagaaattttatctggttcatttatctcaaaccttagtaaggctgatggacaatttgaatttttgccttgtacccttctcctaaacttcagacctttccttcccaggaatttattgtaagtgtatgtgtatatgtgtgtgtgtgtgtatatatatatatatatatatatatatgtatatatatatatgtatatatatatatacacacacacacatatatatacatatacacatacatatatatatatagtaaatatatattgtatattgtgtgtgtgtatatatatatatgtatatatatacatatatgtatatcaaatcgtccatcttcctttcaattctgccatgtctaaaattaaaaaaaaaaaaaaaaaagcctctacctcagcaccagcccctccccgactctatgtaattcccagtgtccaaaacccaggtggtagtctttgattcctccgtcttttgtgacttgtctaatacgagtgcttccaggaagcctctggaacccttaagtctcttttatccactgtgtctgggtctctcttctctcagggcttccgcggctgcagcttctttgtgcacagcccttcctttgttccctttatcggaaccaccctccatgttggttctgtcctttctaaaagcttgattcaaatcctgatctgagaaggagggagaaacacacacctttcaccatctaccccatttcctcctctccacttcctgcccaaagagcccggatgctgcatggacgcctcagaaagcacatccattttctcccttctttcccactgctcctacaggagcaaaggtgtccgtccgatcatttatgtaaccagaccccacacttccttacattggaccctttgttccagataggtgaaggtgtgcccgctctgccccgccccttctattcagtcaagacatcttgctatggagacccattccaggcgccattttctccatctggtctttgcaacccctcctattggaggccttctctttccattttcatgccgttctgctctttcacaaggagactggcatgctctggaggtttctccctgtcagagaagcacgatataagaaagaatgtggaacaaaggattctcacagatcataagaatgtctgaacaaagagaacctgaaaccatttttttttccttttggatgaatggtgctttagggatgggtgtgagaggcctggagagcccacaagacccgcgtggcggtctccttgggtcgccaacctcagcgtctactgacctttcaccttgtgcagggttcagcatctctgggaaatgaaatctgtccatcttgtactgctcgtctgcatcggagcagtaagctctctttctccataggcctggcccaccacctccaggccctggaaaagcctctctccgcggtgcctcggcgatagccctctctgtgtagtgagttagcctaccgccatcatgagcccaagggatggtccatgggggtccctgaccttcccaccttgccttggcgatttagggcatcaaaaagcttggcccccaaggcactcacggcgaccgtggccttctaggcctggccgccatacgcccgcccgccaaccgcttccaaccaacccagcaagcacaacctcttt

SEQ ID NO: 123 - DNA, 1737 bp, Mus musculus
gaccttttccagatctcaggtctgacttgcactccagtagcatttgtgcctatcctccaagccgtgggagaggacacaccatttcagctcaggctcttcagccgcctgctcttcccctttgtgggcagtggtcctgcactcaccatgacctccttcgtagcttgcttgagctttcttcacagcacttccccttcttcaaggtggatagcctgttactgaacttggagtggaggtatcaatctggcccaccggtggaaggatgcccaggatattaacattaaagaggattttaggaaacaagagttttgttttgtggcttcatgctgggctcaggaaaactgcagctccttttcaccaaaaaggtatgaaacaaccttgggaaaaaaacaggaaacagatgacaaactgtagagcactattgttagccagcacatcttcctcaatggcaaggtggagaaaaaccacagttgtcttagtacagaaaaatgacctcatctcataggatgaatttctctatgtatgtagaaaggggatttaacagaatgactcacagacagtggtcctcctagtccaataatggctgagcagattcattgccaagggaaactagaaaaatcaaggacttgttcagttcacgttgcttgatatctcagcggatcttgagtacttcccagaattctgaagaaataagtattactaatgccagtttcaaaacaaaacaaaacaaatgaatgaatgaataaacaaaacaccttgctaaaaaatgtagggaaggaagaagacaatttgaaagaacctccctgtttaatatccagtaaagcctcattaaaaacaaataaatcaatacaaaggctgaaagatcaagcacaggtcttgtgtcttctaaattaaacaacaaccatcttcataccttcagcttcattgaattaaaataaccacagcaggactttttaaatgttactaaatctaaaaacaaaaaaaaaaaaaaaccacccaggacatgtctggtcagtactttttttttttttaattaggtattttcctcatttacattttcaatgctatcccaaaggtcccccatacccacccccccaatcccctacccacccactccccctttttggccctggcgttcccctgtactggggtggccagtacttttaaaaggtagaagggggataactacttatgagaagttgtctccatacatactgagtaaggcattttttttaagatttatttttttatgtctatgaatacactgttgctgtcttcagacacaccagaagagggtgttggattttattacagatggtttcgagccactctgtgcttactgggaattgaactcaggtgctctggaagagcagtccgtgctcttaaccgctgagccatctctccagcccgagtaaggcattttaatgtgactgattgtaggatatccacagtctcataagaaacaccttgtcaattttgtaaaagtaaaccaaataatttcactggcatctttggttgaactatgataattttgaaatgtggtgccattgagaagttagaaagaggggataaacattgcttattccccacccctaaataaatgttctcatagtagattatgaatttatttgttaaacgtattgtgttatggtattaacaaatataaaatgttagaatgatcgaaagacagaaatagttttaataaagaaggatttatgtatagattaggatggaaatttc

SEQ ID NO: 124 - DNA, 4012 bp, Mus musculus
tgaagtcgaggtcggtcctacagcgccacctggaggtaggctgagaggcttgcctctgcctaggtgctcttctgagagctgctctggaatttagaggcggcatcttgtccagaaccatctgcagactccccttatttgttttgggccccagagctagtctagatggtcatgcccgaagcagtggtggagttgtggcttgttcaataacagattcaaccctcatcacctttatgcagagttaactgttgcagtggcaactgaagatggcaatctaactagcttggaggtattgaaatcggcttgttggactcagatctctctcagttgtgtgaccggtgataattaagtcattaggcctcagcatctccgtcccgcaaggggacaggaggtgaagattcagggaggtagtagtgcacaggtgctcctagaacacatctgtaatctcagcttgtggaaggcgcaaggtgagtatgaccttaagctaagtagtacgttccagatctaagctacatgaggccttgtttcaaaacaaaacaacctacatggtatacaacctgataaacttaaggtaagttagaaatgtaagttaaaaaaaaatgcatttaatgcagataccttgggcccaggggagatgattcggtaggtgggacatgaggtctgtcaaccagcacctacacaaaattacatgcctgtaattccagagacaggaaggagggtgcctgggctggatggccaactagtctaacttaatcgccaagtcctaggttcaatgagagaccctgtctcagaaggtagggtgaagagtgactcagaaggacacttgatgacatcctttggcctccacatgcacacagaaaattgttgaaaatgtatatgcctagtctactcaatgccatcgcttagcaacacaacatagcagcctttcttgaagctgcagctgccccccacctcaccagaaagtacctagagctgcttaccagggaaatgatcaaaatttaaaatgcaaagtctgatttttttttttttacagaattcatattgctttcacaccatctttaggatgaagaattgtaagtcaggagctatctggatgtgtgtgtgtgtgtgtgtgtgtgtgtgtgtgtgtgtgtgtgtgttaaagcctcgtcccccaccccacaacacaagtagcaagaaaagggactgattaacctgattaaccatgcctatgttagttagtaaccatgcctatgttagttagtaaccatgcctatgttagtagtaggcaagcctactcagttttctgttaggacagggcttgtggcctggttcaaagtctatctaatattttaaaatatttaatatttaacatttatttaaatattctctttctaacaaggaagctgagccttgaaaggattttggatggcatctaaggggactggctggcactttaggagataccacttaggtcaaataacagaatctaaatttgcttacctaaggtcttcttcagatgagaataacacgagcgccaatctataaaagtattacgatgaaagctttttttttttttttttttaagacagggtctcattctgtagtcatggcagtcctggaacttgctatgcagaccaggctggtctgaactcacaaagatccacctgcctcttcctccagagtgctgagacgaaaggcatgtgccaccacacctggctgaaagctatttttaagctacaaaaagagacttacatttttttacatgggaaaattatttctttaaagagaatctattacactccaaacatgagaaaaagcatttactgcccacaaaggcagagtggagagaacccacagagacccactccatctgaaatgcaaagacacctcaccacttgcttatgcattttctgattcctaaactttggttagttgaatcctataaacaattcttttaagtgattctacaactcatcagaaatgttgtatgatttctttgttcttaaaacaaaattattttccagggccagcaagatgactcagcaggtaaaggcactagcaatgaaacctggtgatgtgagttcaattcctggattctatgtaaaagtggaaggaaagaaatacattaaaaaccatacacttgctgggtatggtagcacacatctttaatcccagtagttagaagatagaggcaggtgaatctctgagtttgaggccacccacaaagcaagctttgggatagctgttgatacacaaaagctgaaaaacacaaaaacaaaaacaaaacatatacttacatgcatgggaacacatcgtaagtagaaatgtggtgttctagcctgcgtagaggacagtggacaatgtttaaggagttttggttggttgatttgtatggtttagatttgtccaggtatcttgtgtttactgatgacctagtatcactacttgtaagtattctagctttatatattatttggtgggaagtaagtagaattttcctttattcaactttagaatcagattatcaaattttaaaacattattggttttttgttgttgtttatgtttgtttattagtagaatgtctttgtgtagccctggctattctggaatctctgtagaccaggctgacctcaaactcagaaatcctcctgcctttgcctcccaagtgctgggattaaagatgtgcccaccattgcttggcaaaacaatattatttgccttttatgtgtagaggtgtttctgtaactaggcctatgcaccacatgtgtgcctggtgcccatggaagccagaaaagggcattggatttcctggaactgaagttacagatgattgtgacccaccatgtgggtgctgggaatcaaacccagatcctctgggaatggagccagtgctcttgatttctgagccatctgtccagcacctagatcaccaattttttaaaattacatttggaatttgtgttactattaaatttaatatcaatattaaatttaaatgtcaaattccagtacatactattgacttatttcttcagaggtttttgtttgttttttaagtctgggtttagctctctggtagtgtaggactaacaatcctacacgtggccttggctttgatcccttctctttcccccctatccctagacaaacttaagcctgctataatgtgatttttgtaccattgttggaaatatagacaggacatcaagtctgttggtctataaggaatcaatgattccacagattgtagtacagtgcaactgtcatcgagagtaaaggagctcttttcatcccttgtgtcctgacaggagaggtcagccagtggcaccctgatgggggaaagcaagcaatggagtgtgtggcttgagattgaccccagtctcaacctaggttatagcagaatttagggaaccacatgtacgtgtgtaactataaccccaagaataagcacttccttaaattgtgcccaagctacctcttcgtcttaccctggagaggttccagccctgagagcctaaatagggacaacagtgtgggaagagagcaacaagattagctgaggggctggaaagacagttcagcctttgagagcacttacccctcttatagaggacctagctagcctaggttccctggactcacatggtggctcgcaacagtaactccagtgctataaccctgtgctgccactagggacacaagtactacatatacatacatgatggcaaacactcataaaaataggtaaatatgaaatatgttggctatgaatttgtaattgttaaagctaggtaacgtcctggattttattgtaaaactttcttgtcattctgtttcaaatttctctcatagctgggcgtggtggtgcatgattttaatcgcagccctcaggaggcagaagcaggtggatctctgagttcgagggcagcctggtctacagagttccaaagcaaccggggctacacagagaaatcctgtctcaaaaaaagaaaagaaaatatgaaaaattttaaataaagtacagaatggc

SEQ ID NO: 125 - DNA, 22645 bp, Mus musculus
catgaaacgttatattcacaattttcagcaggaaacacccaactcgcccaagctgtgtttcctgtgttttctaaacggtataatacgttattacaaaagaaacaatccaaacagccctgtggaggggtgagaagtaaagaatagttttatacttaaccagacaccagattatgaggtcaagtcatacagcatcgtgagagatacaaggaaaaactgaaagtgaacgctttctgcctgaacttctcgatccaaaaaacaacctttgagaagaggatgaaccagaatgtgtaaaactaagtaattccgggaggaaaccctaagatgacctgagatattcagtccaagagggtgggtgacaccatttcaaagccagtctaagaaagggtggttgagatgcctctggcaaaccctttcaacttctgaaggtcccagcgccaagcgacaagggccctgggcagagccaagggagagcttgacacagacggccgcggtcacagggctggagagttaggccccgggtcgtgtggtctggcggattctatccatttccgcccaggacggtaagaaaccccagagaccgagccgtggcggagcagttggtccccggtgcaggaattcgctgtcctcccagcacagtgcacggctgggaacccgatcagcccgcgtgtcagcttggggcggagccaagcctggtcaccaccggaagtgcgtcactagagcgggccgggagcgcaggccgaacccggaagcaggcctggcgtaggctggagcttgggggaggcgccgggtctctgagatttagtgaccgaactgcccgcgcggagaggactggcggcggagaactgcagcaagagcaggaaacccacgggaccgcggacgtgcgcgaggctcgaggccgtgctgcaccgaggggctcgactcgtggcgccgagcggtcacttccggcctgcggggggtactttttaaagggatagcgggtatttccgaagccacgggggcatcgccacgccgcggtgtcgccgctggggccggggcttctgtgggttctaatgattctgccgtacgtgctttgccctaattgtcaactgttttgtcaagtccgcgttggctccaagagagaccttccctgacgttttcagtgcccgcggagtggacagccccggcggagcatctgaccgcccgctccccggctcccgctgcagctgtcattcacgtcgatgatgctgttttccttagagatccgagtgtacaaatggactgatgctgcaaagtccgtgggtggggttggggtggggagagtacttctgcctgccaggtcttcagagatgggtttacacttcgatgagtagcgctgacaagccacgtcttgcaagggcggttgcattcgaccgaatagcacaggttcccttcaccgatatgagctcgggtagcattcatcatctggagggggatctttccttatctacttctcctttctactgtttgaagtgtaaattcgtcttaggttattgagttttcagtactttgattgtatccaaatggaagcattcaagtgtgatattgtctggcagtaaatttactttaaaaaaaaaaaagcttaccctgtggactatcacatgagttaaatatccaagataaaagagtgaacagagagttgcaggaggactaagaaacacgagtaaacatgagtaactgtgataacggttataatttgctttaaagatcatttacattttctttttaaatttcctgtgtatgagttctttgcctggatgtgtgtctattcacgatgtgctagagcaaccagagctcttaaccactgagccatttctccaacccccaaagagtatatatttgccttttgagagagaacagtttttagtcgtttttgtcatttccatggacgtgggaaattaaaattccaaatttatttcttggctattttactaggaaatctaacttaataaaacggttgttctgttgaacctataggtcatacattgggataagatagttccaaaagtgcagttaccacctcgatgtaccttaatgttagtcattaaaattctctgagtggtgtggaaaagtaaatcgtacacatcaaagaaggggctcttgggatctaggaggggtgggacaaggcttaaacagacacctttcagtctcaggcttagtctggaggacatgaagttcttgtctgtagttttataggttaagattattttcattgttgtgggaaagaatagtgttattgtttttagttttgtttttcaaaaaagaaaaatgagtcaccatatagtttgtgggacttacttggagagagagatcaaaatgtcgcttgcacttgacagtcggtatggagtaaaaggctttgaaacccatggaagtctgggcacatgcgctcctctcattgagggcagtagtgtccatgtgcagtcttttgcaatatcatatgttataagaaattgttttaaaatagatgctcaataaatgcatatgttctaaagtaataaagcataataaaaaaaagcaaacacgaatctatgactgatattaagatctagaatgtagaatgtggatgtgtgagtgcaggtgcctgtggaggcagaggacgtgggatcctctagagctggagttaaaactggttgtgcgccattaactgtgggactcagccctgcatctacttctacaatatagtttatcattacatcatatgtgcagtgttttaaggttttcaactagcttcactaatttgtgattttgtttctagcattccaagccatggcctgttttgtcagctcttttcaccaatatataatacttcactacaaatagactgtatttctgtgtctggttccttgataatggccatttgaattatcccccaacattttcttatacaatattaaacaggcatacctttcagttataccacagccattatgaagagtactttcatattttgacagataagtatcccattcaaattgactaatagatgacgctataattaacaattgaaaaccttagaatagtgcctcgcaagtgatacatacttggtaaatagcggtcattattttaacatacagtatttaaatcagcttcagcttttaatgctactcacccttgtctcaagtagtgctggtaaattataggcttgactatagcattatgttcaatatctgatacagcttttataggcttcttttgtgtttttaatttttagttacgtgtgtgtgtgtgtgtgtgtgtgtgtgtgtgtgtgtgtatctgtgttggggaatgtgactgtcagtacaggcaccgtggaggccagaagaggagagcagatcccccggagctctgtctcagtcctttggatactgtgaatactactgccatgaacaatgtgtacaatatacttgttttagtacctgtttcaactgttgggggggggcgggaaggggtgcaattgcttagcttaatgaaaagtttatatttgatttcttgaatcaccaaactatttcccatattctcgaaatcaatatcaaaacttttatttgtattctctctgacacttgttattgtccattaagaaaagaaaacatattatttactagattctgcataggagggagaccatcctgcctttcatgtatttgattgagcagtttgccagtgtgtctgtgtgtacatcacttgtgtgcctgttcctacagagatcataagagggtattgtatccctagcaactagacttcagggtgccgctgtgggtgctgggaactgagcctggtgctatgcaggaggaggaagtgtaagtgagcactcgccatgtctccattcatgtcgctggttctcatgataatgccccttacacagagatgtaaaaatctggtgctgcttttttttttattattattttgttgcttatgcattaggtgtcataaacttagaatcctttaccaatcttctatcaggcagatctactcttgctttggtctccaagagttacattattttggttcttgttgttcgattgttggtccttttaagttagtttttgtgtgatgtgagggaggagtccacactaactcctatgtacacatctgcttccatcatggtttgaaaagaatatttttcccctctgcatgatcctgacacacttgtcaagtcagctggccacagatgaacagatttgcttctgggctcttaatcctactcggttgatctgtgtatccgcatgtcggaaatgagctgtgtgtagtgtgataccttctgaaattgggaagtgttactctagctctaaaaaaaccactgttttggctctgtggggccacttaaatttctgtatcacattatggatgggcttcttggtttgttcgtaaaaagcctttggatctttcatgttgctgcaccgaactggtagataatcttgaagagctacactaacattgttaggtctcttaatctggagcagtctattaaaatctctaaattccttcagtgcagttccatagttttagatgtctttggtttatttttaaaaattttgttattttggatattactgcacatgaattttccacttaatttttttcagaatgtttattgctggtgtataaaaatacaactgatgctacacagagaaaacctgtctcaaacaacagcaacaacaaccacaaaatactgatgttttcctggctgactgtatggcctataactttgccagttaacatagtaggggtgtgtgtgtatgtgtgtgaattttcaatataccatctgtaaatacaggtagctttacttttattgttagtttatatgactttttaaaaattttatagcctaatttctctgtctagaactccaatacattgttcacaacaaatggaaaaataatgttttatttctgattttggggtgaatttttgctccattaaattatattgttagcttttcatgtaaatccctttccatactaaagaaatttccttccattcctaggtttgtttttcttttttttttaaatcatgaaaaagttgaattttgtcacatgctttttctgtgtcagcagagatggtcatgaaaatccccttgacactattaggtagaatacggtactgatttgcatgagatggtcatgaaaatctccttgactctattaggtagaatatggtactgatttgcccaggcaaatcccacttacttgtgatgtatataatcatggtgtggaatccttcatagcatccttttatgatcatttttatttctgcaaggtattagtaagggtctgaagagatggcttagctgtcaagagtgcttactgctcttgcagaagatggaattcagttcccagcacccatggcagggagcacacacctgcttataatcccagctccagggaagttgaagcctctggtctttgtggtgcctgtgcttatgcacatatggacacacatagacacatgggtgcatgtgcacacatgcacacattccggagtgcacacatacaggtgaaaataataaagataaatctgaagatgtttagtaaggtctccactctaatttctgaatttagctatttgcatatcctctaattttttctttgtcaggccaaacttttgtcagtcttgttgacggtttccctaggaacaaacatttcattcactgattgtatttcttttttttttttaatattttatttatttatttattttcgagacagggtttctctgtgtagccctggctgtcctggaactcactctgtagactaggctggccttgaactcagaaatccgcctgcctctgcctcccgagtgctgggattaaaggcgtgcgccaccacgcccggctcctgatagtatttcttaatgttttctatctcatttatcccttccacaatgctctttcctccttagagtgctagctagttactcctgttctattacttattattttgaattctcgtaaccttatattcatactttaaagccctaaaccccaatttgactcttaattgaggacaggttcattaggtaggtaattaaggatgactgaggtcatagggtggggtcttaagtggtacagttggtttcctgattagaagaggagatatcacagagctctctgtttatatgcacagagagtgagccaagtgagcacacagtggaaaagtagcaagccaggaagacatgcctcctcagaaaccaaccctccctagtcctccttgatcttagacttcctggaccacagaaagtaatttcctgcagtttctcacccagtctgcggagtttgttttggtggccctagtacacaaatacagtatgttaagttcaacactgagatttttgatttttcttcctttgtgacacaggcatttgctgttaatacattttcattgtgtcatggaaggtttaacacagatactgtctttgttagagtcctatttctgtgaagagacaccgtgaccacatgaccaaggcaactcttttttttttttttttttttttttggttttcgagacagggtttctctggatagccctggctgtcctggaactcactttgtagaccagactggcctcgaactcagaaatcagcctgcctctgcctcctccagaatgctgggattaaaggcatggaccacgcccagcgaccaaggcaactcttataccggaaagcatttaatggggaaccttggcagtgtacaggcagacatggagaagcagctaagagcttcatcctgatctgcaggcagagagccttgggcttctgaaacttccaagcccacgaccagtgacacaccatcaacaagggcacactccagcaaggtcacaccttacaaacagttcatcaactgaggagtaagcatacaaatatatgagcctatggaaggcactctcgttaaaaaaaactcaagaaaaaacaggaagaagaggcagtgtgcacttggggctaagtttgaggttggtagtgggaggggaggaccttgccttagttgccaccaaggaggtaaaaatactgagagagtgaggaaggttttgggacttctagcattttcagtaggaagacagccactaaggaagtgctgctaagggcacctttgagactggccatcacagaccaacactagatgtcctttaagttacctgggtatcgggaagggaaagctttctatgatccaatgaaatcatccgtggaaggaaagatttaaaggtgatgttaccgggtgagcaagcgcctgcttttctcgtgaggcaaggtgtgaatgttgagaatgatcgcagaattggaggaaagccttctggaagatggtcgagtgttctgttttggtttccttcaggaataagtgaggcacaatgaagtgaggtttggctgagaacttcaatcctccttgggtgggagtcaagagacaacccccagttctgccactgccaggctcaggctggtatttcagttttcccatcaaaatgctgcttacacatgatcaccatttctttccttttcctaaaatctccataaatagtgcagctgcacattctttggagtagaacattttcttgcaaatgatatgtgtctgaaatataccttagaatattgggttttgaggggatctaatgagcttggctgttcttgttgcccatagttgttagacaatttgatcaggcagacatagatagaatattactgttattaccggtaaacctagcatcagaaaacatggcctagagctgtagataaattggctgtgtgatactgaactccagaatgaggcagtattactcacccattgccagaagcacagaaaattgcaggccttctcacattgtctctgggagcatttcgtataggcgggcagagcggaagacagactttatattggcagccagctccctacaggcaaagaagagggaatggagccttctattatcatgttatcttcaaaatgtattgataaataagttactcctccttagaggataataagggaagggtagagggaggccagcataagggaccccagtggctgctactggttagatttcccctgctggcctatcattctgatgactaaatgttggaaagcttctgggttccaccccgagaactccggtcctattctctccccccttcttgtctcctccacctcatggtcctctgctcttcactgtctgcctctactttttctgtagcagtcaccactttctgtgaaaaatgctcgatatttctgtttattgtccatgggcaatatctgtctaccaaatgtttcttgaagtcagggtctagaatcaccagaggaaattatccaagccctagtagaccttttctttgaattatagctctaggtttatgaattagttaacatcaggcgtggggttatttaagctgagagaatctaaagaggacaagaagtacaagtgaatttcaaaaataacttctgcttatcctaccctccaacctgacctctgttagtgtgtgtgtgtgtgtgtgtgtgtgtgtgtgtgtgtgtgtgtgtatcagtgagtgtgtgtgaggccagatgtggttgttgggatgtcttcctcattcatctctcctatctctctctctctctctctctctctatcatctctatctatctatcatctctatctatctatctatctatctatctatcatctatctatcctctatcatctatctatctatctatctatctatctatctatctatctatctatctatctatctatctatcatctatctatcatttatctctatctatcctctatcctctatcatctatctatctatctatctatctatctatctatctatctatctatcttttgagacaaggtcactcagtgaactcactcactgagctcatggttttagctagactagcaggcaagtgagatccctagaccggcctgtctttccatccctccccagcgtgtgggttacaggcacatattgcacccctggcttttactgggtggtggtgacctgaattcaagtcttcatgttgcatagcaaatgtttaacccaatgagtcgtttccctagccactcatcaccctttttaaaatgtctattttatgtgtatgattgttttgtcggtctgtatgtctgcaccacgtgcgtgcgtggtgccagtgaaggccagaacagagcattggatctcctggaactggagttacaggtggttggtagccactgtctgggggctgggaaccaagcccaggtattgcagaagagaagtcagtgttcttaactgctgagccacctctctaaagtgagtgactccccacttgtcactcttaaaaaaattattaaaattcttcatcattgctagtaactttgttaagcagtgaatttcattgattgggggtcagggtattttgtatgagaaggcatcagttgcaatagaaatttattttgtcagccccctgcaccccctacctccaaggctgagggatctggaagacttgaaaaaaaaaaaaaaaaagaaaaacagtgaacaaggaacagtgtcttccatacacagcagcatagctgcatatatgatctcacaggaattaggacactatccacaagccctgtgtaaactgaagccagatcaaatcctaccatggagataggaaggggacatggcatcctattcacaggctaggggatactggtagttgaaaacttccaggaaaggggtagtcagtttccatctacagttcagtagatggaaagatggctcaacagaagacccaggttccattcccagcacccacatggcagcccacagcaatctctgactccagtttcagaggatctgataccctcttctggccttcatgataccaggctggcatgtggtgatgtggtgcacaggcatacatgcagacaaaacacctacacacacacacacacacacacacacacacacacacacacacattactaagtgtcgcacctaatagtgttgtggtaggttgaccacactccagtacaaggctatccatattagaatatatgatcagcacaagttggatttgatggatgaaaagggggtggggcactaagctgaatgggtggggaaaagggaataacctaggaggggatgggatgggtgaacaagattaaactgcattgtatgacatgagatggaagaaagaaatgctgatatacatgtcttagttctcaggaatggagagaggtatagtatgcagaggtgtagtgtggtacagaaccagcctgctggaatggtgcagaaaggcgtgctcaagatgaacattgtagtggcttacatgttaacttcaggcaatcactgcgtttgactgacatcacacacacaacagtgttggtcatctaataaagaatgtgtcgtctaatacaagtattatatatgtgttccatttgagctcagccaagagtatagctattttattaaaccacgaatgcatgacaatactgatgatatttcagctttattttgtgttgggttgctcttcacctaagctcctaaatcttgggaccagtgtcaaatgtgtgattttctaacaagtacaggtatctaaagatacatatctacaaagctgacatctgtatagtttttgcctgtgattcttgaattttaacctatataaaaatcatccctataaagttggattttttacaccgtatatggcatttaatcctatttgccttagaattattcatattctatctgtatttttgctttcttttccttttgtgattttaagacagggtctcaatgtgtagctctgcttggcctggaacacactatttagaccaggctggactcaaactcacagaaattatgtttcctctgcctcctagagctggaattaaaggcatgtgccaccatgccaagccatcctctttttttattaatatgtaacctacttcagtgtagaggtcatataatggtatttttatatcttacatagcaatgacccctctgccttgcttattaaagttattaatcaaatatattttaaaggaatatttaataagaaataatcttaaatgtcatttataataccatttaaaagtaatttccagttctcaataatgtctgtaaggttcagcaacgttcagaggaaagcactatatagtattttttacttaaacataatcattaaacttggtatgaataacaactaataaataatgatgttggtaatgatgatatagaagaaaatataatatttgtctgtagaaaagacctgtgtgttttgtcatttgttatattgctttcccccccaaacccatgtgattttagtttttcctctattttctcgtttcaaaactgtagcatcatctatatccctgcattctctgcgtgtgatactcaaagccagacctgctcaactcacaactcacagtctcctatgtggccttctcttagtttgcaatataaatttaaatttcagttttgctatgcatgtctacaatgtaataaaatggaaataataataataatactatcctaaagttcaggtgatggatattgctcttattaatcgcacaagaaaagcaatgagattgacatgtatttagaaaggtaatatgaattacttaggtttgacatgtaaatgctcagatgaaaaccttatctttggaataaattatgcttatttgaaagtaaacacccacagtgcctagaatgttcttggcaccataccttgtgaaggagtagaagcaaattccaattcaggactctggaataaaaggcgtagtacattgagattggacatggggagcctctggccctgtccactgcccttctatacccctcacgctggggagtaggctcagaatgttctcagctttttagaggaggcatcaatgccgttgtcaagatatagttataaaagcaagcgctgacattcggactccttagcctgaaactgttcagggtactgacatggtgttactaatggaaaattccattcctggcctcatgtgattggtcacttaaaacacaggctcactgaaaatgatataaagttacaataactgtgtatagcctagacatgaaacaaaatgaattttgtgttttgataggttcaatctaaagataccttgttacgccaaaatctggggggaaaaatcttaaagatgaaacacctccggtccaaagcatttctgatgagggatgctgccaactttatagaaatgacttttatatttacagagttttaaaattcaagaactataggtgcacgcacatgtgtatgtgtgcatatgtatgagtacaaaacaaaatttgtatatggtagaaacaatgctatgtgttcactgagccctgacctctctttataaactcactacctttggtgtctttgtttaaatacttattctaccataatactaataaataatgatgttgttaatgatgatataggacaaaatataatattcgtctatagaaaagacctgtgttttgtcatttgttatattgcttttctgccaaccctatgtgattttagtttttcccccattttcttgtttcaaaactgtagggtcatcagtatccctgcattcttatgcaatagttatctagaccttttaatatttgctaaggcaaacgaggatggcaaaaatgcataaggtacagcaagcaaaaccttccccgagggacccagggttcagtgatggaaagcagaaagcagtaatccagtgtaggtgttgtgtaaaacaaaacaaagacaaaaagcactctagcaagacagggaggatacctaaccctatgtggatcactgaagctcgaaggaggctgggccaggtctggaagtgtagcaggaattagccaagtgaagaggaagtgttcacagagttgcctatgcaagatgaagacatggaaatagatgccagcctcagaacaccagactgtgtagaaactgttagcatcgcaggaaatatgaagtcctaggcagggagtggcaatttataaagctacccagtgggcagaggactgtgtagatggtacacagtgggtaccatgagggaataccccctggtgttctttcttatcatctttggtcatgtgaaaagagccaagaatattcctcccaggcctctgcctttttcacagaggtaatgtggacagttccttcatcctttctttcaagtacatctactttgtttatacaatgctttctagaaggccacaccttgggacacatattctgcattctaccacatccatagttcactttttaaaaaaaacaaaaaacgcaggctctgattttgtagaccatatggtaccttcagaagtctaacatttctccaaaagaagtgacataaccacatggtgtgtgttgtattgtttacagaaaaccctagtgaccgtaggcttagatttctcaaaacctactttgataagagttcttaaatgctccaacttccctttccactcaccagaggtagtggaaaggaaaggttaattgggcaaaggagaatatggtcctgttcagaaatagctcttttgggggggattccagtgtttgttgtcaggatacctgcagttcagttcatatgaatcagcagtggtagctcaatccacctgcaaacaccattcatgaatcagcaatgggggttcactcaagaagtaaccatgaggctctgccagtcagccagagtccacacaggagcagcaagaagctgccggaatatcatgcatagttctttggtgcatttctctctacaaagtcaagacaaatgatgatcagtgaagaaagccaggtgaaccaatgtcatcacattgtcggtgaagaacagcaccagcaaagcccagcgaaaaaccagcaaagagtggcagggcaaaccagcgccaaagcattgtccgctctgttgagtcatacttataccctttccaaacactgtccactctccaaacatcatgtgtcctctctagcgtccactccagccaaataccacaagcctcttttccaggcagcttctagggaaacacgacatgtctgttctccgcaaaacatctttttataagacagtttcaacaacaacaacaacaacaaaaatcacatgacacaactgagtctccaaagaaatcagaaaattccatttcagtaatctgtctccactggggtttaacatgactctccacctgtcatcgtaaataaacttttattgaaacaccatcatgactattaattttcacattgtctgctatgcttctgtattctgaaagcagctagtagttgtgaacgtgtagcagacaaagcatacaaataaacagatataaaaataggagactaaaaatgccattttaatagtactgcagtaatagaggtaggaaggagaaaatgttggaaaggagagccagagagatggcttatcagttaagagcacacgtttttgtgttagtgtagaggacctgggttcaattcctagcacccacacaccgctaacacccatctctaactccatttccaggggaaatagggtcatttcttgaccattgtggggcacatggtgcaaagacatgcaagcaggcaaaaaacccactcacacaacattaaaaagataggttagtagagatagatggatggatggatggatggatggatggatggacagacagatagaatgtgggtttatttgagcaaggttgccaggaatagagagtgaattgtaactttaagacgctaaaaaaaaaaaaaacagtgccaagtttgggatctgttttagactttggctgctactcactggggcagagcaaggatacagagaactgtggaaatgggggtaagatttaaaaaaaaaacatattagttctaaatatggcaaacctgctttcatatgtcatctcacccaacccttacttatgaggctctcttcttactgaaaggtctagggttatgaccagtctggttgtcagtacacagtggttaaaagtgattgactcccatggtttgggttacaattatgccacagaattcgcaaaccaaacatatctctttcttccttgcagtgtgaaatctccttcatgatgatccaagccatcttgctttcttttcattgtttgcttctgcaataaataccacaactaaaatcactcagagaagaaagggtttctctcatcttacagcttacagtccatcctaaagggagcttagggcaggaattccaggcatgaacctgagttaccaatggaggcagagaccatagacaagtgctgcttacagacttgctccttgtggcttgctcagcctgtttttcttttttttttttttaatatttatttatttatttatttatttatttatttatttatttatttatttatttattatctgtaagtacactgtagctgtcttcaaacgcaccagaagagggagttagatctcattatggatggttgtgagctaccatgtggttgctgggatttgaactcaggaccttcagaagagcagtcagtgctcttaactgctgagccatctctccagccccctcagcctgctttttatatcacccaggaccacctgttcagcagggatggcaccacttatggtaaactggtcactctcatatcaaacattgattgaaaaaaaaagttccctacggacctacctacaggctaatctgatagaaacattttcttaattgatgtaaccttttcccagatgatccttctttatatcaaggtaacaaaaagaaaaccaaacaaccaaacaactaactaactaaccaacccaaccatcaaacactaaacaagacaaggaaacaaacctagccagctcacaggtaatgttggaaacttctactttgtcaacaagaaaactctctttatcattggttccaaataacccagaacccactgagtttccagaaatgatatagaaactggttttgctctggtgtcacctggatggctagaggtccatgcctctgtctttgcagagatgtgcaggagatgctgtgtaagacacaggagagcaaatggtgtccatcaatcatggttagctctgtcatccctctcctaacttatacttgcatttaaatctgggctttaccacagattgcctgtataaccattgtcagggtatttaagtgtcagtatctcagtatgcttgtctttcaaataaaaacagaagcataatcccacacaaatgtgagagttaaataagataaatccaagcaaagaaatgagcacagaattcagcatagtcattggatctgggttgactgactgctgtatgactgaggttgggctaggtactggggatgctgtggggtgggctgccttcttccacccctgtgtccactcatcatccattatgactcagcagctcagcacctcactgtcatgagttttcttatccctgattgctcagcagtcatgtacaggccactttctaggtcctgttgttattcagaatagcttcatatctgaaacattattagatgcacacatcctgtctttggtcctgttaactttcttctttgtcaccaggaagccggagctctgacttcattactgcgtacacagaatgacttcataacttcctttcttacctttcctccctaaataaggtcatgctatttagtggcattctaatctgtaccctcatttcatgtgtccatgacactcaagacctttgctgtccacagctgggttctctctctgatcctcctgggctacaaccagttcaaatccagcctggaatacactgtgagattcagtctcaacaaagaagccaaggcaaaacaatcccttaaaagcactgggtatggtagcatatgccttgaatcccagcacccaggaggcagaggcaaaggcagaggcagaggcagaggcagaggcagaggcagaggcagaggcagaggcagaggcagaggcagaggcagaggcagaggcagaggcagaggcagaggcagaggcagaggcagaggcagaggcagaggcagaggcagaggcagaggcagaggcagagagagagagagagagagagagagagagagagagagagagagagagagagagcgcagagagagcagagagagcagagagaggcagagaggcagaggcaagtggatctctatgagtttgaggccagcctggtccacagagtgagttccaggctatcaccattctcccttgcttttcttccttcttctgtttaaagaggtatttcttgcatttgcttttttccttttaccctcttcccctttctatttttctgtttgtctccttctgttttccatttcttctccactatctgcttgaacatgatttattgtagattcttatgcttaaaatttactgaacaaatttttataaggtcaatccactttttgaagataagttgaatgttgtgagttggaagctccatgctgtgtcttagagataatcatgttgatttgaatctgaatattgtcatttcactttcctcccatgttaaccatgctattcatcttccacacatgccatgcatgccatctcatgtctatccatgttatatcatgtacaccatgccatgtatgctatgtcatgcctacatatgttacattatgtccaccatgccatgcacgctatctcatgtctacccatgttatatcatgttcaccatggcatgcacgctatctcatgtctaaccatgttatatcatgttcaccatgccatgcatgctatctcatgtctagccatgttatatcatgtccaccatgccatgcatgccatctcatgtctatccatgttatatcatgtccaccatgccatgcatgctatctcatgtctagccatgttatatcatgtccaccatgccatgcatgctatctcatgtctacccatgttatatcatgtccatccatgtcatgcatgctatctcatgtctacccatgttatatcatgtccacccatgtcatgcatgctatctcatgtctgcccatgttctatcatgttcaccatgccatgcatgttgtctcattttccattcatgctatctaataaaatcagcagttttacttgggaatttgggagaactttatctagagaataaatgtggatacatggatcattaataagggaaaagggttttcaatgaagtcgatgttctccaggaaattatttattttctgtgaacacagtgtaaaaatttaactgttctgatgcaatttctccaacatggaggttttgctattgttcctctttaagaaaatatggttattgcacattttaaagcatcccacgggactcataaactgcctcgtaaatgcaaacccgcagaggcatggctcttcattcttcaagcctgaagaatgccttaatattttctgctttagcacagcaaagtcattgcttttctttatttcatcgcctgtcctccctcacttttattgttcagtgacgctgtctttcctctttctgtgtattttcacctaagtctcctttttgtctttacagaccagaaacgacaatcagtgttcttggcttcttcatttggttttttgtctctgtgtctcagcacaaggcactcacccctgttttaattatgcttttcatcacccagtgtccttcccgagggccaactcaatagtttgagaaagaattcatttccagcattttatttctataatcattcaaaactcatgtgctcagacattttggaaagaatcatggcttaatttttcatgatgaaaatgtccctatttaatctacttcaacagtaccaggggtgaaaaattattttaaattctagttggttgaataatgtatttaaaatgagtgttgagcaaaaagaatcagggtctgtctggaaccacatgtctccacatgtaagggtcttgagtgtcgtccaggatgtgcttgcaaatttttctagttttttttcaacactaacacagagtagaggaaaagctggctaaagaaacgagggcttgggcctggagagatgacacagcgattaaaagcactgactgttcttccagaggacctgggttcaaatctcagcacccacatggcagctcacaactatctgtaagttcaagatctgacattctcacacagacatgcatccagaaaaaaaatcaatgcacataaaataaaagtaaatacaagaaacaagggcttgaggaatcccaagaagtgcagctcttcattgcctgtagtgtttttttttccccagaacccattctttagcatttgtttaccaccagaattctgtttccaacttcataatgtttccacgtattttaagccaacatttctcccaaatcccgagtggttttgataaggagatacttttccacatgtgctttctgggtcctccaaaacctttccgagtacccctggaagggggggggggtgtccagtttgataggctcagtgctgggctaagaaagttgggcatctactatagcttgtttactgtcttgctttttattgctgctcccattactgagcagaagtgaccgcagaagtcagaatatagtagatggtagccacggctacctcactggtagaatggctgtctttaaagctgtttgagcagggtgagttgccatgcatggagtattcaaacagagacacagggggactacaccacgagataaagcttcgttggggtgagtctgggtaaaagatctgtcaatgaatccaactcatagtatagctaaataaatgggaacatttatctttctcttaggtattcagataccaaatctagcacttatattaaatataaaagtattaaagcccagaagctgcatcaggatattgaaataaaatcaacaaaataattctggtcatggtacaaatttgagataacgctgagtgaaatctacagctgaaaccacctaaacaaactaagacatatcaccaaagtgactcgcagataatattaattgtcttgactaaaatatagacaggacctggtactatagcttggtaattgatcccctgcttatattgtgtgaggtccaggaatgatcttcagtgtaaacaaaattttgcgcacacacacccccattagactgagaacatactgtcgttgggctctgtaggaatggcattaggaagggggagggtcaatgaagagatgctttgagaaaggacagagtctacaactcttgttcaggaacgggggctgagaaattcttgtttagcactggcctgttgttctggttcctattagatcacatttctgtctattgccactccaggctcactaaaaagctagagggcccatcggtctatgtaccgatgtttctgttagttatttttacttctcctacctctttggctactttctagtctagcattatgcaggactttgtctccattttttttgtttgtgtgtttgtttgtgtgtttgtttttaatacttgaaaagataagtgatgggtttgggagaaacgtacatactttttaaaagctgctgatatgcctgtaagctggccactaaaggatagaacactgttctacagagtggacatcccctgaaactcgttaggaaggaagactctcgggttctactgtaccctcctgactcacaggctacagcttagcctggtccccagaattcacacacacattaatatctatgatccactgatctactaattgtttcctgtagggcacaatgtcctcctagcttgtcaatgatttctggagtgagtttaattgggtcatgctcctttttctctctccctccctgcctcctcctcctcctctgcctcctccttcctccttcctccctctctccctctctccctctctccctctctccctctctccctctctccctctctccctctctccctctctccctctctccctctctccctctctccctctctccctctctccttatctctctgagacagagtctcactatgtagctctggctgtcctggaagtcactgtgtagaccagactggcctcaaactcacagaggtccatcagcctctgcctcttgagtgctgggatcaaagacacacagcaccacaccaggaccccttgctctttcttaattcactgagatccatatttcagagggtcctcacagcaaaccctgcagatgcctcagttcttgtagtatagacgagatgggccaaatagggtgacatatccaaggttaaacagtgagttaatggggaaggtgctggacctgcgtttgcatctggttgatccttaagaatgttttcagatgttcttaacacgatattttcctgtggatatttgtttatgcattcggtgagtaaaggccatgaacacacaaagttgtaaaaaattaagggtggtggaggggtgtttatttaaagcagtcggcagtcattcaagcaaatctcaaatagtgcttcatgtgtcccacggtgctgaaactagaggggcagatagtttttgttcccaagggtttgggtgtatcttgggcatatgagaggactccacccctttgtgcatgggtatttttcctacccattggctgatttgcatcgtgctgaggcaggccccatctgtttcatctcctatgacaccaggtgctaagagcatttgtgactgtgttgtgttgaagctgcccagatgcctccatgataaccgtagttcaagatttgtgaaactatttacattttcaacctattatggctttgaacaaactcggtgccagcctggctatttaaatgcctatgtttgccaaaacagggtagagcttaaggcttttaatcaaattgttagtactgtgcttttagaacagcgctattatttccaggaaaaggtgaagaatgcccaaaaactctgattgcctttggttttggacaaccccattcaactacagagatggaggataaaagccaaggcaaggggatccttatgtggtttttgactctgtcactgaaacccacacgcgcgtgttgcaagctggtggcatctaatgagcgttgcctacaccgcaccaacattaatcagggaacagatatcttcaagtgaactacgggttaggagcctgcagtgagcatccagcaagtccttgttcagggtggaaccaactgtaaagggcgcagataccaactgaaccagatctgggcaagctcttaagtatgtaatcaatgtcagagatgtttttcctcatccgtgcagaagttggagtttgtccgagacatgtctcatctgtacttttttttgcagtgactaacaccgtttcctctcaggctatgaccttgagaacctgcaaatgtgggagttgacccagtggtcacggggaacaggacccgcgagcagcgcccttgtcatgcatgcattgcaaggtcatcctgtttttctcttttagctctcttgctgacattgagaggcctggggcagccagagaagtcgtgaacagcaaagacgggttaacttggtggttcctccctctgttcagagacagccacactccaagaactcagcctctggagtaaagtctagtgcgatgtggggaaagggacaaactcatcttaaatgtcagcccggcatccctgggggtgagtgacagcaggtagttagaagcaattagttgtgcgcctgccgggaaaccgggcaattacctttctgtctggcttccccttccgtccttcctgcttcggtggaagcggtagaagcgccctgctccttcggcggtgaatcgccaagctggcgcggggaccgaggaggagctgagccgggttgcctctcc

SEQ ID NO: 126 - DNA, 7857 bp, Mus musculus
atctgggggacaggactagcctgtgacaggcatggcctctgtacagtgtgaggtctctgctcttccccttcaaatccaaggctgtgctcagcccaagtccacagggttgccgctcgctagcaaggctagaggtcaagatacaaagacccatgtcacaagccagttctccagggagcaataagctgtcactcactagataccaaagcataataaacaggggctaaaggcagggcagccttattcagctcagggctctgcgcccagaaatggtaccctggccatagtctcataggggacactagcactcccaacaaacccacagtccccaggggttgtgtctgcacttaagcttctgctgtgggtctgccatggctcagtctccagcaagacagtctttccatggcctgtcgatgtaggctgcttttttttaaaactctaatagtttctaatatttatttatttatttatttattaattatatacactgtagctgtcttcagacactccagaagagggcatcagatctcattacgggtggttgtgagccaccatgtggttgctgggatttgaactgaggacctttgagagagcagtcagcgctcctaactgctgagccatctcaccagcccctcagctgcttattgtatgggtgtgaccaccagctgctgtcaggacatgggaacaatttttcaaacttctctcttggatcacttaccattcaccagatttctgggtcagttgtgaataagcaactttaaatagaaaatagcttcgtgtgtgtgtgtgtgtgtgtgtgtgtgtgtgtgtgtgtgtgtgtgtgttagaggaaaagtattgtcccaggtttaaatgagctattttgacatcttacccggcagagaacagagctgtggctcttggtcccccacccttcccccttccccacccatgctgctttaggtgaagatggtttgtcagccttccttctaccctgaactacaggatggtgtgggtgccgcccatagaaggagcgaagtataattttgcaggctcccacctgtaggggccagggaacagacttaaagactcaaaatagactgcagtttgcagcatcacagtgcactggctgaagctgctgtgtgcatgtggcccagctctaggcttagagagagcaccagatctgaagggagagtctttgactgaatgttcccaccaacacccactggccaaagctcagacctaaacagcactcaccatgctggtctgttatcatcccatagggttcattcgcacaccttttataagaataacgttgggtcatccattccagattcaaagcttagttataaggagagaagagccaatccacctgaatgttttgcctcgcctataactctgttttgttttctaaacctcatttgatctttgaggaggccttcagtcaccaaactccctatagccctatttaattctatctcagtatttgtggtaccagggattgagcctggaactttatgtatgctaagcatgcgccaagcatgtgttctgtactgaaccacacccctccacacacacacacacacacacacacacacacacacacacacacacaccctttaacttttttattctgagacagggtctcactaagttacccaagatggctgtgaacttgactgtactcttgtatcggcttcccaagtagctggatgtcagagcctttccaccaaacccagataaatccattttgaaataccaagcatactgaatctcagacgttgtgggcagaatgactccagagtctatttgcagagacaagtgtgaaggaagagaggaagtgtaatgttaacgcagcaaaaaacaaaacaaaacaaaaaaaaacctggattcaggcctcaggtgacctagactccaggatgaggagcagcatcagacctggaagctcctgctgctgtcctgtgacagagaatgggaagtgccaccaaagccccccagagaaacccccagagctgctgttcctagtctgatgcagcctgtctcaagaatactgccaagcacagctttacaagttagtatgaactgaggcttcagaccatgatttaaagtggtagatacagaagaataggggaggggaggggaggggaggagagaaagaagggaaagggagagaaactgagggggggagatggaggagggatgttagaagagggagaaagggaagcgggaggagaggacaaagggaagaggctaaagttgggaaaggaaaggaacaaagagggtgtgagccaccagaaacaacggtcctcatttcacaataagagtactggcaaccgggctgtttgatttttcaaccttgcaaagagaggcatcaccatgaaagactggtacaacagtttggtacaaaacagtgcttcccgtgttcctaactgtatttccccctgcccctgagttcttcattgcctgaacatttccgagagggacgagaaactgggcagactgcacctcctatagatttccacgttgagaatgtgaatgaagcctagtttgctatgtattcagagactggagactccctccctttctgacacatggactcaactgtacagcagacttcgagtaacttttcagcctaggatgaactgagggcagcaggacaggcagataccagccgtcggctggggagacagtcgtccagtgtctccttcatatttgtgattctgataaccaacaatgtgcctccttttgagagtggaccataatgatttgtttaaaaatacaaacacagtgctaacccagcaggcaggcaggtcgaggggagataagatgtcttaggatgatgaaaacatataggcatagcataaaaccaagccctgggtttaaccccagcggtagtcactgcctcaaggcaacaaaacactatacagagaaacaagggacagaaagtcctgaaattgcatgccttgcctcatgctgttcacctatcagagcaaaagaaatggctctgtcaattaaatacaaattatcaattatatataaatacataactacttcctccaaagtctccttaacttcagtcatgagtctgtctgtctctctctctcaagattttgtatatgagtacactgtctctctcttaagacacaccagaagagggcattggatcccattacagatggttgtgagccaccgtgtggttgctgggaatcaaactcaggacctctggaagagcagtcagtgctcttaactgctgagccatctctcccgtctatccttttttctttttttttttttttttttttttttttttcttgttttgttttgttttgttttgttttttttttttttttttttttttttttttttttcatttttttttattaggtatttagctcatttccatttccaatgctataccaaaagtcccccttacccacccacccccactcccctacccacccactccccccctttggccctggcgttcccctgtaccggggcacacaaagtctgcgtgtccaatgggcctctctttccagtgatggccgactaggccatcttttgatacatatgcagctagagtcaagagctcaggggtactggttagttcataatgttgttccaagtgtaaattatctcattttaattggttagaagaaataatactttttagagtgtccacactacccagtgcaataccaccactatattcaatgcattttctatcaaatttcaaataatatttttatggatataataaagtcctaaaattcatagggaaactttaaaaaaaaaagaaaaaaaactcaatagtaaagcgctcttaacccaaaaaagtaaaattggatagcactattggactaaggatatattacaaaattataataattcaaatagtttgatagtgacgttaagacagacagctcaaacaataaaacagaacagaatcccacataaactaaatacacagggtcattagctttttttaaaaaaattacccttttcccatcttcagttgtcgatagatagatagatagatagatagatagatagatagatagatggatagatgtatccattctcctttctctcccttgagaaaagtcaaggaagaaagggtgggaaagtcagagtgaggaatcagggcttcagagaagacccccccccccccagcttagcagacatcacgaagaactgcattgtgggaaagtgtccacagctgctagcaaccacagtctccttggcaggggtggagagctgtgagcagagaacagaggcagacccaggcagaggctgcttttcccaaaccttggctgccaggaatgaccacagaccacatgctgtgtgaacactgcgtacgggctgtccttgtgggctaggtgaagcgcgtggggctggcatgttcttccttcccagtcactggagcatagtcctccatgcctctcaaggaacaaagagcccccgaagtgcagagctcacctgggctcatcactgggttgcagacggacggtccgtttcagctgctctttcagcctcagtagtgcctgatctggtggtatacagccacagccaaacagacaaagcaagatcatgtgcctctcagagtcatcccttaaccccagagaaaggctactaggagaccgtccgtaggctggagaagagcccacaaagctatctctccgctcttagcctcctttcaccttacccaaggtcacactcgtccctgaaccatgtgaaagaccaggcatggccacacatgcacctgtaaagacagccctgtggaaggcggagacaggagagtccctggggcttgcaggctactccctcacttctgtgttcagtcagagaatcagacagaaagtgatagagccagacacttgatagcctctttgtgtgtgtgatgcacccacccacatacatacaaaaggagatgtctgaaacaagggagacaagtagtatcgttaagaaaactttactagagagacacacatggggtgtgactcatctcatgctgctgtgatctgtgtagacagagggccgcacacaaatggcactccttgccagaaggggtctctggaccaaacacagtcaggctctggaaattatggaagcttttggtttttctgatcccccctcccccattccctattgtttggggctttcgtttttagcttgtacttccttcacagacatgaggaaaagcaatagcgttttaacgtaaagttgtctttaaatgagtttttaaattgctattgttccttgtaataaagctacctctccaatactggcctctttatctactcagtccccattttcagagttattacacaattaacacaattcttctctcctttcctcctctccctcccctatccaccccaccccccaaagtatggactatggaagacactttggcaaaggagtcttttcgttttggtttctctctccaaggcacttgtctatgaatcattcttactatggcagcaaacactgatgaaaccatttaagtagcttctctgcaacctttgtgacctgcacaccacatccaggactttgaaagtcatgtgcttaaatgaacgacaccagagagctcactggaggcttcagctgagatggaggctctgggaacactggcagcccatgcctcagcaggcagtgttgctggcatcggtccccaaatggctggctttgtccccctctctacaaatccatctgcttcgagagaagcatctgctccaagcagcagccctgaagcctcacccatcaggcggggcgggggctccatctctatttctagcagaaaaagcctttgacttttcttctatcctgagaaatgagctagccattgaggccagaaaattcttttttaaatttatttttagccgggcagtggtggcgcatgcctttaatcccagcactcgggagacagaggcaggcagatttctgagttcgaggccagcctggtctacaaagtgagttcccggacagccagggttacacagagaaaccctgtctcaaaaaaccaaaaaaaaaaaaaaatttttaatttcacacacacacacacacacacacacacacacacacacacacgagagagagagagagagagagagagagagagagagagaacgagagagcagtgcatatggggtaggcgtatatgcacatgggtatgcaggtacccttggagtccataagagggcgctggagttacaggcagtggtgaactgccggatagggttgcttagaactgtactggggctaagctgtatctccaggtcccagactgtttaaacggctcagtcagcaaagcccttgcctcaccagcttgaaagcctgactttggacccccaacacctctgtaaacatttgggttctgcactgcatgtctgcaaatccagtgctgggaagggagagtcaggattcccagagcttgctgcccttcagtcctagcagcttaattagtaagcccaaggctcaatgttagcactgactttaaaaatcaggtggagagcatgagggggaaagacatatggcccctgcagtgatatgcagaattactgtgtacacatgaacatatacgtgcacacatacactacaatagaacaatttgttcttagtcaggtttgagcctaaatgcctgcatgtttctcccatctcctaactctgacaggtgggtcaagctctctacaggttgtcagggcccagagccttctcaggatccttggtctacatcagcctgtgactgtgcccatctcaggtaactctgggagaaagcgactctctcacaagtctcagctgccaggcaaccatgatttaatctgaggctgaccacaaaaccacaagagaattgagatgtgggaagatgaggaggctgcctgggtcatgtggccaaatacgctcgttgagatctgcacacactgtcctctccggtaaatggcttgctgttcagccccaacagtccccaagccactccagagaataagtcaccttggggcagaaggcgggtgaaacacaccttcagactctgcacattccatggcctatgagccaccagccagatactccctgatgtctgccaggaatgtctccagtgcctccaggcagggatgtggaaagaggcccctggcaaagccacagggcagaggaaggaggaagcttatgaactgaagggagcaggcgtgagcatgtggaagtgagtggagaggtctgctggagaacccgtagggttatatgagtattagcaagagcttgacatgccttgcggaaaacccagcactgtggctgagacagtcactccccatcctgtccccacactcagcgcccacagcaaccagaatcctctgctgctctgaggctaaagaagcctgctgggacctggcctaagatagccacactcaggagtctgtgtgccctgcatgcaggagtgttgcctgaacacaagtcctttctgtcccgcccttggtacaagggctcccaggagagtctaagcccctcacccccgcttccagactgccctcctccccactctctctaccttaccttggatcacagtccagcccatactctgtccttgagatatgttgggttccaaacacagctactgggctctgcactttaccccgaatctctaagtcctagccctgaaagactgtggaggctctgaaccctggtgccatctccttccccacacagccagctcagcccccgggtctttcctgtacctcagaggctaaagaacctccagtaggtctccctgtggctctctctctctctctcttttttttttccttctccaactgaagacagaggaggatgtaagaatctgcctcaatgctaaccggggaccacctcgctccaccgacaaaagcagttttgttc

SEQ ID NO: 127 - DNA, 1760 bp, Mus musculus
gccctgtccacttccctgaggtgccctacaccacaggaactgaagctctcccatagtgcttccgttagttccccaagtgtttctgcatttgaagcttggtcctctgtggaactgtgagaggggacaggggcactaggagatgaggcctagagaaggtctttcagtcaggtaggcctgctctcaggaggagttagcatagtgtagtccccgttcatggggattattaaggaacatacatgcctgggccttccccctcccctggacttcctgcccaagtcacatggtcactttctcttgatggattcccatcaataaggagtttgccagggctcagctaaaggtggcacaatcccttaaacttctagtagagactattgcagcctcccagagaaccctgagctgggatgctggggaaaatttgggttttgtcacagagcttatgaaagtgaaatgctgatggtatcttgtgagggcttggggggtagggaacagaggagataacagtgccttggggctggacctgctcatgtaaatggcttttttttttctttttttctttttgggtatttttgtgttgtggatagccctggggctaattatatttgatgtaaattctgttctcctgtgagtggttgtgaacaaggactgagtcagtactcaggtgattccctgtaaacctgctttccacctgaatttgtaaaataaaggagagttgaagattgggcagagagagggaagatgagatggatcggaaagagagaaaaggaggtttggggaagggtggcagaggaggaggaggaggaggaggaggaggaagaggaggaagaggaagaagaaaagtggagcagaagcacctggcctggagaaactgcaagttctaaggggtctcatagatgtggaagatggcagtgtagcaaatatacaatgaaacatgacaaaaattgtttataaggtttcagtattccagctatagtgaacccctgaatgaacactagaaaatgtggtttttaaaggaggcaggggacaccttaccttgtaagaaagcaagcgcctatcgtctttatccagtataaagccatcatttaaatcatctgctgatgtatgttttggtttctttttattttcatgttcatcttttccaagcattcttcgaagtctttcagcctaaggcagtaaggaaagagaagtcaccagctgcgttcgtcaaatctctgcagacactgaggtactgaagaggcctgtggcagtcagctgcacagtatctgcttcaacacaagaaaccaaggccctaagcgcacaggcacggactcaatccagtgccagcggttgtttgtgggaggctggtacaaagaaaggcctcatatactgtgtattttacttcatatgatcacctcacgaatgaaaagacacttatgtctgtaccaatgtgaaatgtaaacacagcacaattcagcccgccttccaagatagagcagaaaagcttagaaaggacaagcctgctgcactcaggccttgagagggagctgagcctcttgggtgtcaggctgggccaagcactcagttacaagtcacccgtacctccagcttcttgagcctctcttgctcctcctttgctagttcctcttctgttttcatcctgttagagggctgagccttcatttcaaagccaagctcacgaaccatcatgtcatattcatcgggctaaggggaaaataagatgtttttcagaattgtttacaaaaagtaaagaccattccatt

SEQ ID NO: 128 - DNA, 74649 bp, Mus musculus
tgcggctcttcgtcccgcccctgcctctgagtgacagcagcgtggacagctgcccacccggccggacccgcagttgggccgccctcgctgggcaatgctgaggtgtgtttccggcgagggcttgggggttcggggtcacagttctcttgatgcgggcccagggctggaaacgcgctttcccagcgtctcccagccccgtggagactgtagatctggcctggggaacagccccaggcgctgggcctgagcatccggaggctcctccaggggatctgggctccgagcccagcagggagacctccttttcgactgttttggcttctccggcccagagagaatggccagactggggtgggcgtggccgcctgggttgccgagcaacgcgggtgcgccctgccagcgtgtcctagtgctccaggaccttgcagaaactctcagtcccacccacttccccaggtttaccctaggctggggattaattagcttgctgtgctgtccactaatttgagaggcctccttgtagttacaggtgactctagtttctactaatcctgcttaggccgccgccgcctcctgtgttttaactccgatttactctttcctgtttcccttttatgggaacagtcttgtaagccaaaatatttgtagagttgctttattggttagtggtagtggtgaagtggggttactttttctgatgtttagtgaatccccgaacccaaacgatgttgtatgtggatatgctctgtgatatgctgtctttcacttaacctaatgtaatgaacttcctctggaagttgcaactcattacagcaaggactttcatatgtgattttccttgcagtctattgtgaagtatgttaaacttctaagcacttactattgagtccatatttaatgatcaactacaagataacacagataaatactgcaaacatcttcttccctcatatcttttggccccacatgattcagaagaacaaacattctataggaaaacacagacaagaagggagctggctttaattttccatgccagggttccagtgtaaatcctcaggaagagagtttctcttggcctgctgttaacagtggccctcagtaaggaagccccttcgtttcccttagttgagaaccttcaatcatctcatctataaagttctcaatctagtatctatcctagcaggattgatttaaaagtataattacaatagtgatctgcagtaatccaagatgttattggttataatgtccgtttgttcttatcttagggtatttttaaatgttcttgactttcctcatttctttggctagtagagtggtgaggattatgtccatccatctttcctcgattaattcattgttactgcttaggtagcacacaaagggccttgcatagtttatctgcccttagtattagtcccccaccacccaagaatacacagagaaggggttgtggttttgtaggggctcttggagatattaggaaatgttcgtgttaaatctaataatgtccagtttttgatgtcaccattttgagatgccagagaaagctttgagtaatcctgtagattgggcagcatttaaataggaagtggaagctttatcgagaccaccattttcctttaatttaggacacaataattactttcccccatgtctcactaaggaaaacttggagcagagtttttgttttgttttttagtttatttttttaactctttctttcaaatagcctttaaccccatttcactatccaaataaggtcatcacaatttatctcatttttactaacaatcaacagaaacatcgaatgttgaataacttgttactttgtttcaatgtaagcccttgatcatgtctatgaaagaacattcaggagaagaaaacgtagtgctataggacagtgttaaattgtactttgagataaatgttaaatgtgtaaaatttcttctgcatcagtcctcattttggacaaattaacaaacagagtcttattatggtaagttcatgcaactgtaaaatcattacctgactctttcttacagctcacgttttaatgtacataaaatatcctggttgctttcagtttctggtagctgtaacgctctgtctgttccagcaatgccccagttcctgaataatgactcggaggcttattatttaatactagatgtctaggccttaagctcttaagagttgtttaaactagccaactacctcttaactcaattatcctgttgatactattctatgtctgttacatggctggttacctctcttcagttttgtctgactttctcagagatggtcagatggcaaattcccttcctgactccctctgagtggaagtcccacctctaatcctctctcagcaaattggccattagatttttattgacaggcaattcttctaacactacacaagagattctctctacatgtagctcttttcccaatttcatttttaaatagatgattttaaatagagtttgtttactttgctcaaataacccacagaagttggtgccagttgtagacatgccaccactggagagatgaagcattacaataggaagaatctatttcttttgtagtaagggttgagtgtacaaaacggcctggtattagaactactctgcccttctttactggcctctctatttctattagagaaactgggtaaagaaagactagacttagcatctcaaggacataaacattttaaggttctataatagatttttgtttcttgtcttgagtttgaaaacagtgcctaaacatcagtttttctattaacaaactgactaggggttagcacttttgatcagataccaaaatgactgttggttcttcctactctttttttttttcttcttcttcttctttcttttcttgtcaagatagggaaaatgactttttttcatagttatctaaagaaacaaaactggtataacaggtaaacattaaaagatgcttcattagaatgtcttacaggatgtgatctgggttatccaacagtgactggttcccagtggaaagccaagaattctatttttgtttagctcttgaaactggatgacacagcagttccagtcttgtgctggaatcccaaggactccaaaaagctactaatcttcagtctgtgttggaatcctgaagatgtagattctaacaccggtgaaggaatccttcagccccagaatagatgaacttgccagcaagagtgagggaaaactaggcaaagcttacctttttcattccattttatgtggcctgctgccagaaggtgtggagcagatttaagcgtcatcccacatcaaatgatcccatcaagaaaacccttcacacaatcccaggctgcttgggttttagtttattccaggtgtagttaaattaacaaccaagttggttatcacagtgacattgtagaatgttggtcataaatactttcactgatgttacccacccagactcccacaaatatgcatatgcacatcataacctctgttccctttctcagaaactagaccttaatcaccttgggaacaaatactcagatttcacaatagatccacttactcagacttaccattttgcatcatccatgctagcttcactggagagatgaagattggtggattccagtcactggttatatacacttccatgttaattttcttggtgctgacaaagtgcccgattgtagcaacttaaggatggaaggtttgttctggattagtgttctagaagtagtctaaaatggtagggaaggcatggagacaggaacatggatctgctgggaatattgcatcaacagtcaggaagaagtaaacaatatagcttaggctcagctgactttctcctttttatgcaacccagggaatagcattgcctccttttagactgggtttttccacttcaacatagtgatgataatatctcacagacatgcaaaaaggattatttcctagatgattgtaggttggtaattgatataactatcatattctctcatttagaagctgcaagtgaatgggattgtaggccaagactgttaacctagcactctggcttataatgagtggcattccttggtcttttgaagtatgtaatagcatttttacatcattacaatgatgtaaagcagctacttgtgagactctggattgggtgacagggagatctgtcagctgaaggaagaatagtcttttcttactgaaatgctgagtgccccattggaaagtatacatctgtgagtgtttctctgtgtcaacgcatgaagtgaggttatctttcccccagactttatgaatatatgcatattttaacatcaacagtttgtggctctatgaaggtctgaaacatactgtttaaaatatagtattatgcactccctcagcatacctaaaatgatgctaatagaaaatagtgatacaatttatttatatttcctcaagaaatctgttaaacaaataagaataatttagtcctagaactaattcttttacagacctcttaatatttttatatggtagaaatgctaggtgtttttgaaggaggagagtaattttacctcacaaatctgaatactaataaaaaggtaaacattctttatgcagtgatatatcaaaccattgtgttgagtcacaggtaagagagtgtcataaatgaaggttcttgtcaacaccatgtcttttaagtcatggaaacggcaataagaataaagaaacctgcttcttttatagtttccacactcactgcaaaagtagcaggccagttaggacgtgaagccaaaattttaactatgacaaaagatagatgactcaatctagaaaacacttgattttaaataaaaatgcctctggtagatttttaataatattttaaatatagtctacacatgtcaagatcctaattagagattatagcttatatcctgactcagcgggacagacactagacgttgggaagctttggatttgactctgtgtcctttacagtgatcgctctcggtctgtgagcaggaccagagcaggttactgagtctgagtctgtcttttctctgcttctagctttaccattctctcgtttcattccactcctcaaatctttccttcaaatgtggggaatgctggattatatagaactttttatgtactgaaatattctggacaataaagagtttgacagtgaaaccaagtggaagaaaataccccgtcaaatcaaagaaattagcaaagaagccagaggcatgcctcaagtcaaagaagaccaactcagggaaccgtttgaagctaatgcattcaaaatgcatcgcctctgtgtttagaacgccatccaaaaacgacagacagtgatagagtgatagcagagagatagtagcaaagataaaagatgtcatgaaaatttttaaaatatataaaaaacattatgtatttttataaaatgtagttttaatatctcatacttctatttggagtttggcatgtgccacactggaaatgaccgtgttatcagggctgtaatgtttgcgtaaccttcagtagacaatcttggtttctgttccttttgcaggtcttatggctaccacattcctatgcttatggccctcttctctcatctactaggtcagcaacattgtatgtatctggctggtcttttgcagtgcatctcctaatggcaataaagatccttcagtaaattatatgaggttctaggaaccagaatttgaatatctttgggccaggcaatataatactatctctgatatccgtaagccagtagttcacaatgttttattcttattcaaatatatatttcactattgaattaatttgttctttattacatgtgctgtccattttaaactagattgaatcaaagtatttagacgagcatacacagacaatttcatgttcatggctcacgtcttataattaataccttaccaggttgattttttttttcctttccaaaataaaaaaatgtagctagagtcttatatacatatagtagcagattgctcaaatcctaaaatacaaaactcaaggaaatatacatgaagttcccaaacaattgctttgctggttttgtggaataagacagttcatgaaacagatgagaaaccataaactttcctgaagataccttctttattttcacgtgaaatatgattataaattaaaacttttttatgagtgatcatatcttacataaaaatatgccttttgcatttctgttttttttccttgtaaaatgtcgccctttcttggcctgaatgctaaatgttaatgtagaggactaatgcctttccgtccaggggatccagatttgctccaaatgtctatcaatattttatttgcctcagcatcttcttgctcttcaaggaactgtgctgccaacaccagaaaagtctacttttctttacatttcaaaattgtgattttattttattttatagggatgggtcaacatttccataaagatgctagactttgcttttgaaaggcaacaataagtatcctgatatcctgatattataaatatttgaccattttattttaaaactaagtgactataaaggtaagcgtgcagtatttaataagtgaaaagcatattatcaaaggtttgtctgggtggaacaggtaaattatacagattaagtgtaaaattaaatgaagtcttaagaatatccatgaagccaagactggtaagtccagggggaagcttggatttcggtaaaagggatagagctgtgaagcggttgaagtttgtaacaggggtaacttttacttagaaaataggaagcggttcagcagccagggcagtctatttgtaatattgctgaaactgggaccatagagtctgcatggccaagtgaaagggctggtatatgctatgcagaaaccgtctgaatcatttagcagacgatgcactgtaggatgtaaagggtcagattagcactttagtaactctcaacctttcacagtatccccacccccaattctgttatctgttaattctgttatcacataaacgaaagtaagcatgagcaattctctagtggtttttaatatccttctttaaagtattgtatgtaaatagtttcttagccaccctaggaacacatggagtatataaaattatgtcacatgtaaatatatgggctaaataagtcaaatcactcaaaagttagaagattaagttacttataaggtataaaaggtaatattttctggtcttcataggcatatcaattgagacagaacatgatacataatcatatgtttgccttctgtgatacctttaagtatgtcacatagaagtccatgaaagcttaagatggtggtttagttagaggccacttggatctgtatatattttatagtttagatgtcgataatgcaatctctaaactaacgcttatcatttttgatgaaattaatatttcagtgcccacagagaacttgactatctgcttttagtttaatattggttcagtcgctaatgaaatcattttctggataataacatattatttatacatgcactggtattcatatctcatcttataaagagtccttcctcctcttcacagataacatgtcagtccgtagctcagaacatgtagttccctgtaaagagtgaactctacagatagattttaatgcaggttcctgtccttttccctctcgaggtagcatgcccaagtaggtcacttcccggatcccaggggaagcatttctccagttacagctaattgtatgtattccagagggatgtgaagacacgtcccgaccctacagctggttacataatcacagagcttgccatgctggctgccatttaacaaatgccaactcctcgagattatcacttgtttcatcatcatttataaggggccaggacccgttatttacattttgaaaattcagtagttctgttaaatgatcatttctagagctttgtgtaggctgtgattgaggtgtcagtaagggctgacctgttggtggggtgcttgtaccctcggtgggggtaacctttctccactgtgtatcttccctttacttcagaaatctcaagtacacaacactgagggacagacacgttacctttataaatctaaaccctcccagggaatgtgtggccccgagatcttagataaggaccacagagtatattattatcctacttttattttaaattccatattgcgatacatagttcacaagcataagatctgacatgttaaaaatggtcctattgggtaggttcagaatgtttacagacttgtgcaaccatcaacactaaacttgaaatagttttattcttcggcaagaacttttttctccattaaaaatcacaatttatctcttccacctcaacagcataattgttttactctcactattgatttttccccattctgaatttttcctgtgaagagaacaatatgtggccttgatttttttcagttagttcattgtgggttggttcccctttgaggctgttagaataagtccattctgaagacgcgcatgcgcacatgtacattttgtatgccaagcctttcacttctcatgagtgtgcacttactagcagaggtgttggtcatatgcggttctgtgtgtaatttttggggagcagtcgctgactctctaaagtgtgatttcacactttcactttgctaaccaatgaacaagggttcaaatctctccactggcatcttcctccactggcagtgttttccttttgattggtcaaccatgcagaggtgaaagtgccgagcctctgttctgaatttccacaacaaataatgtatgtgcttgttggaaatttgaaaagcctttggaaagatgtcatttcaaattcattaatcattggaaaattggattaatgcttttttatgttgttgaatagcaagagtctttcatataatctcagtacaaaacttgtatccgttacctgagttgcaaatgttttctcccattgtgtggatcatctttgaactgtttttattctttggagcatatattataatatcctggcttcagtctctgagaaactgttgttatgtagctcaaagtcatgacatttgagtcacacatttttgaagagtattataatactagccctgacatttaggactggtattattttgtttttgttgttatctttaggcagtggtatgagataagcattaagctttactctataactgcactatttatttaaaagccatttctcataatatgactcgactttaattttcatctgtacttatgaaaggcctagaggctgggtagatggttcagcagttaagagtgcttgctgcttttgcagagtgctgaagatgacctctcagcagccacacggttgcttatagcttccccagatccaggggatctgcagctcccttccagcttccacagacaactgcactcacatatgtgtgcatgagtatgtaagtgtgtgtgtgccctcccctatgccttccccacccccatgttagcacatacacataccctttttaaaaagtatttcctaagattgtaaaatatttgtatttatcatattagaattaaaaatatcctcaaatatatggattttaatttttcagttactattattagaaagcagtttggagtcatataaatttgattctcatctatacaagagtgatttcagtgtaaactagaaaaaaattcggaatttggtgtatcatgtgtaatatatcttactcttatgttcagtgaaaatgtgtataaattacatatagacagttattttccattattactgttaataaactgtttgggacataatatgcactttaaagtttttcattaggtactattattgctttgtaagtttgtgagatacaagttgaaatagctaaaagtaatttgaaatttgtctcttatattcatgcatgactctaccatagtggttcttaacctgtgggccatgaccccttttgttactcctgtatcagatattctgcatatcagatatttatactgcaactcatagaattagcaaaatcacagttataaagtagcagcaaaatatgttacagtggggaagtcctcgcaacatgagggactgtattaaaggatatgttaagaaggttgggaaccattgctctagaataaactagaacatctcccactgcttttcagatgacctttgcacatatattaagtcaagaaaattgttgtaatgcttccctctaagggaccttcttctatgctttcctctaagggaccttctcctagccattattatggctttgtgccttataaagatgcattatcttccatatatactctggcagttaaatctgttttgggttgaaaatgttttttgttgaataagtaagtaaacaaacaaatcaatattagattattggttaaataatattgtactactgtgtactgacttgccccacatttgtcatgttgtctattgatacttagtacattactgtaggtgactacattatatttggtaattacttattggttttagtcagcatagcaatatgctaattaatcaacagctagaaaaccaggaatcatggaatgagacaaaagaaaccctataaagtttaaaatgctcttgttttttctattgtttcattttcatttttaaattatttttgctcctctatgtgtgtgtgtgttcacatttgtggttatatgtaatgtaaggtgggtatatcaggaggcccagggctgacatcaggggtcttcctcagttatattcacattatatattaaggtagggtcaggtactagagcctaaaatgtacacctttcgctagttgagctagccagcttgctttagccgtatcccatctcggctatccaagcactgagatttttggtggtcccttgctccttgcctgccttttcatgcaatctggaagcctggactctggcccttacatttgcccaacaaactctttaccaacagatctgtctctagccccttcactgtgttttgattttagtcaatgcagtaactgaaaatcttccattttaatttgtccatatatctcattttaaattacagtaagaaaaatcaaccaagagtgtaatttttggcaaggagttgaatttgccaggaatgctgcagagcttctgagacttgcttcgggaaacatctcttgttttggccgctttccagagtttcgacttggcagcctcaaggacacagcgtaaggtgtgtttccttgattgaatgcttggaaaaaggtgttttgatttgtggtttgtttccttgtactttgtttttcttggtttgaattgtttgcttctggcagtgaacttgggctctgaacatggctttttgttacagagggcactattgtaataagaaaatattttacatgtttttatgtgtaatttagacatatcaaagtaaatcaagctaaattcataagctgtgtgcggattttatctggcttatttgttaaataacactgtactattgtgttctgacttgttaccacatttaacatataatctcttgatacctagtacatcattatgcttagtacattataatatttagtaattacttattggttatagtcaatgttgcaatatgttaattagtgaacataatcatagctattcagtgttacatttactatttttttgttttttcttttttaatgtattgacacatggcttcaaaagagtagtaggaaggaaataaagcataaagtctcttgcttggctgatgacatctttcctttctcagtctcgattcacagtcccccaaaggctctctagtcactcctgctgaaagccgaggcactgaaaacaaagccctgccccttgtttgtttctcagtttatctctgctcttgtacacatgtgtttgttccaggcttagaacgcagttctttgagcattccaggcttcgcccatatcagcaagcttgtgcttgctgttctgttttgtcttattccttattatattattattcctgcactgtattgaaatgtcaccggttatctgtgccataaggtcacttttcagttagaaggtctgccatgaacataaagtattgctctctatattgtagtatccatccatatttaataagtagtatattttatacttattttgcttattttggttgtcactagcaaggttacaatatgcaatagtggttttattctgaaatgtacccgcaggcttgttcatttgaacgctcgctgcttggcagggaggctggagagcctctggtcgttgaggtttattggaaggagtagctcaggggccatagcacagaggtcagccctgcttcctgtctcatcttttgttcctgatccatggaggtgtaagcaagcagcttcatgctcctgctgtcagcctgtgacacgcgtctcccagacctcagggctgcaagggactggacctttaatagtgaaccaagataaactcattctaccttacgctgtttcttttgcaggtgtttggtcactgcaagaagagttaatcacgaagcatgtgatggctctgtttttgctcagtctccactagctagcgtagctagagagctcatatctcaacgtcgtaaaaccacaaaggtttatttcttatataggcgccatacccaaaattcattcataggaaagcttaagacccccaacaacaaagtcttctcctgaacccgcttccaccatcacttcaacagtgagagagaagagtagcttcttgggctttgtgtttagtttcattagataacgcacgtagcttactttcaaatgcaggagtgatgattgcagcatttcctccaccaggacagaggatggagaagagttgtcatgttgtctgctagtgtgtgtgtgtgtgtgtggtatatgtatgtgttgtgtatgtggtatatgtatgtgttgtgtgtgtgtggtatatgtatgtgtttgtgtgtctgtggtatatgtatgtgttgtgtatgtggtatatgtatgtgttgtgtgtgtgtgtgtgtgtggtatatgtatgtgttgtgtgtgtgtgtgtggtatatgtatgtgtgtgtgtatgtctgtgtggtatatgtatgtgttgtgttgggttgtattgtgtgtgtatgtgttgtatgtatgtggtgtggtgtgtgtgtgtgtgtgtgtgtgtgtgtgtgtgtgtgtgtgtgtgtagaggggcggtgcacatgtgccaggatatacagagaactcagagagcaaaccacagaagttagttgtcttttactatgtatgtcctgggggtggagccaggtcataaggcgtgatggccctgtctgtttctattaagccatctcaacttacccctttctcttgctttgaaggaagaacatttgattcagtttctaaaatcttattccaagaaagagagaccatgaacacaatcagtaaactattctgtgatttgataaattcaggaatatgtacaactcaaaatagttagagcatagtgtgtgtgtgtgtgtgtgtgtgtgtgtgtgtgtgtgtctggtgtatttagcctgggaaacaaagccatatgttcagactagaatgaaggtagatggagattttgagagactgggagtgggtgtgatgatggaatgacatgggagacagcagattagagggacagaattgcagcacaacatcaggcatttagcaaactcaattgcacagtttactgcaaaaattgtcaagaagctcattatctgcatattgctaccaattcaaaaatttttgaaaatatatcccttaaaatgattgtgttgtttctatgaaaatgactcatgagataaaatctcacttatggacaaaaatattggatagcatgataagaaaatttctttctttttcttttttttaaattaaatattttctttatttacacttcaaatgttatcccctttcccagtttcccccatcctattctccttccccctgcttaccaacccatccactcccgcttccttgtcgtggtattcccctacactggtgcactgagccttcttaggaccaaggccctctcctccctttgatgtccaacaagtccatccctctgctacatatgcagctggagccatgggtccttccatgtatactctttggttggtggtttagtccctgggaactctgaggatactagttggtttgtattcttgtttctcctaaggggctgcaagctccttcagctccttggtcctttctctagctcctccattggggaccctgtgctcagtccaatggttgactgaggtccacctctgtatttgtcaggcactggcagagcctctcaggagacagctttatcaggctcctgtcaacaagcactgtctgtaatagtgtctgggtgagacaaactgaagagcagggtctgaaggaaatgccatccagagactgccccatctggggatccatcccatatacagtcatataagaaaatttcttaatagaagaaaactttctgaaacttaagtaattatgtagtactttctttcgtttttttaaaaaccatgttcattgcagctttattcataatagccagaaactggaagcaatccagatgcccctcaactaaagaatggattaacaatttacatttacacaatggagtattactcagctgttaaaaataaattacatgagattggcaggcaaatggatgcaactaaaacaatcatcctgagtgaggtaacccagactcagaaatacaaatatggcactgtgtattcaattaaaagtggatattagctgtttagtgggtgatcaaggtgcaatccacagatgcagagaggttaagtaaagaggagggctggcggggggagcatagacctccctgagaaggggaaatagaataaattctataggtggtctggggatgtgtggtgcaggcagaaggaaacagtggtggtgagaaagacagctgggatgggggagcatactgagaaaatctagtgcagtggaaacttcctggagcccctatgtgtgatctaatgaggactcctagtaatggaggatatggagtctgaattggccatcctgtgtagtcaggcaaggcttccagtggtggaactggtgtcctccattcctatgtagtactttctagaagcattttacataagacttttcgatcagctttaggatcacagcaacataaagagaaagatctagagatttcccatgtatctcctgttccaacacacatgtaaccttacctgtgacccacatccccttaatagtggtacatgtgctcgtctaaggtgtcccagtagtgcatcatgtctctgagctcacagctctgtggactccactgatggttctgtaaattctatgggtttcaatctatgcatacagacttgtgtccaccagaatatattcaccactctgcgagtctcctgcatcttcagctcccctggggcttgcacctccaggacatgatgttatattttgcctttcctcctgactatcttatagttggagtgttataatgtgaggaacacattgaaatatgcactttctgatcgtgtttctagttttcagtatttctcattagctcaattactggctggcgattttttttggtaatttttgcagttccttatgttatgtatttaacccctttctgtggagattctcattcattctttaggcagtctgttcactctgctgatagtttctttgttgtacagcttgtaaatttcacatatgccttagggttattttctgtgtatttgaactcttttgaaagaaagtctgtcctacctttatatctgggaggttttttcctccagcagttttggggcttagaatcctatacttcgaggtctttggttgactgggagttgattttcgcgcaggattaaagacaagtatctcatgtcttctgcatttgggtatgtccaagttttcttaggttttttttttttaatattttttattacatattttcttcaattacgtttccaatgctatcccaaaagtcccccataccctccttagttttatttatagataaagctctctctctctctcttctctctctctgtatgtatatatatatatatatatatatatatatatatatacacacacacatatacatatgagacaagttgacaagaattaaatgcttaactatcaggaaaatgaaaagtaaaattgccttgagaatccatttaactcctttcacaatgtaaccatcagcaaacaccactgcctgctagtgagaatggggtgtcagaggagcctttatatactgtcggtgtgcttggaattggtatagacgctatgccagtcaatatggagctttctcaaagtgctcaaagtagatatatcaccttatccagttgtactcaaaggatgcagtcctaccctagacacttgtacatctgcacttacttcccaggttttcatattaggtaatagagccaatatagatgtctatgaacagatgggtggatatggaatgtatggtaaatctatatgttgtaattttattcatttataaagaaaaattaagtcatgacatttgtaggaaaccatatggaactggcagttatcttgttaaataaaacgagtgaaacccaaagaagcaaacacaacgtggtttctctcatatgtaggaggtcagaataaggggaggaggatggtataggaagggcaataagaacaaagtgtgcatgaaatgctgtgctgaaacctatttacctggtgtgctaattaaacataataaaaagaatagtggctttttcactaatttcattcaccaagtaggtgaagttttggttcagttgtgttggttttggttgttatttcttttgtcatattatattcctttatgtggaagtatcatagttttaaaattcacatattaatggatatatcggttccttctaagtgttagccattatgtgcagggttttatgtgaatgaagatcttcagctccttttggcaaataccacattgctggttctatggtaagcacgtgatttgtaagaatgtgcccaacagtcttccagagtgactcatttctgccctcataacaccaatgtaggtttctgttaaattaccagaaatgtggctcctccgtgggagaagatgttctccctctcagcagtcatcagtcgcctagggttccttgtccaggaatgtgcccccatgagatttccccctgccattgtagagtctactgatattaccgttgttcagatcttgtttacatagttgtttctatgagaacgttttcaacagaagacttcctggtgttctggctcttacaatccttaagctaccccttctgcaaagttccctgaatcatagatgcaagagttgtaatatagatctatacattggtctgggtttccccatgatctgtagatctctccattgttccaacttggagttgtctgtattaatctcaatttggtggtggtgacctgaagttagttatttccttcttcttatcctaagtgcaccttgggattggctgactcctctattatcagataggtgctagttaactagtctcttgtgttagtagaacttgtgaagaataggtgctcccgcatatttcaaaatagaacctttgcaacccacctccaggagtctggccatctttcttttgtatttactctaaaaccaaatcagtctccttgaaatgaaactcacaagcattcacacagtgtgcctaaagatggagcgtgctggttttcagtctcacaattcatctactttcctccaagcagtttcagtattactatagtaatattcctgcctattgagctggtctagcatactactctgaactttgtgtttgtttgaccattatatattaatctttttagtactttggtgagttattaataactgcagtttatggacttaattattgaagtagtagtgttcttatataatgaaaaattgaaatattaaatcctaatgacattgacaaaaatgaaaaaatttaagggcaaaagagaaaaagaagcccttaagaagtgctgtgctttcctaagcgagtctcccttgcaaatttttcatttgcaagtggctatcaattggaaataacttctggtttaaagaagggttctctgtttctcctttcagcccaaggaccccatatgggtacagacctgtgcatgtcctgcacatgttagctcagtttctttgagtactctgtgcatcatctgccctgctatctttaaaggtctctgtggtggcctcttggatatggcttcctgagccttgagaagagggattggatcatattgtctggctatgggtctctttatctgttcccatctgctgtaggaggaagcgtctctgatgatggctgaacaagaccctgatctatggaaaaagcagaatgtcattagtagccctttcttgctgtgttactttagtagaacggtagtatttggttttatgccaggtccctgttttatctagttctgctcttaaggacaggccgcatgcccagcacaagatggaccacagaaaatgaactcaacagcatctttggaggatccttgtcttataatgccatacaagggctttttcttgtaaatttcataattatttatttgtaaatctctctctctcttttaccctccaggctctctgtgtatatattatgggttctggctttgcgtttctttgccattcttgagtcaaatgggtctctgcttctatgtttcttgtgcctttccttgggctcattcccttctgtttggttttctatcctactttgatgtgtttgtttttgctttctcttattatattttattattatcccatagtagcctgtttgttctctaataatagacagaaagagggtagatccagatgggatgggacatgggaaggaactgggagacgtagagggagggtaaacaatagtcaatatttatgatgtgaaaaagtctatctttaatttgaaaaaaagaaaaaaaaagagaaaagtagtgtgctatgagaagtaaaggcaggtttcctgcctaggacagagtctgtgttaatagaaagtcccagtctgttggggactttatttctgtgctatgttagataatgtacaagtttttgaaatgaactctgataactttggaaaaagtagcagtaacaaaagtgaagcaaaataaaaataaatctgatatattaaaaataaatcatctaaccagagattataacagtacatggaaaacttggaaggtcacttttcccttggctgatttatgtaattttttcatggaataagaattatttattttcatgaaatctattttgtttgtttttgtgatctgagctacgaaaggaagtataaaggctatagttgggaataatccagagactttttactgcattcatttttatatgctttattgaaaagggatgtcctggtttctgattttcatagttttccatctttagaaagaggcagatggtatgaaaactggactcccttatttaaagagaatgttgatatttataaccaagcttatctacagcaagatttgttttttttttggggggggggggcaagtttgcagctgttccaggttggaaaaatattatattaaagtcctgacttgctgttctttccgcatttaggggggaaattttcagaaagtgaaaaagtactgtttaattttaaacatgaatgtgatgtaaactgtgaggtttctgtctaaatgtgaattctctgtttgtgtgctgtgatattactctttttgtttctctggtctatttcctcgatacatcacacttgagaaataatttcctcatcattttctacatatatcatcaaagcattctaggaaattctgtggactttttcagagttagattatatcatttacaaaccatctttttcactgggaaattaactttgtttctctttagagtacttaaaataagtatatttctatttatctttgctgtttgctttcattttttaattataaatgatactattttatctttggacaaaccctagataccattgcttataatttggttgaaaattaactgcattttatactctaacaatacacggagctgtctcaatgggcacatgccattaaaaactgaatttccatgcctacatatacatattatctgtgaacataggaatgtctgtgtatataccagtacatatatactattacatgaagaatggctttgtaactaatataatgtgagtacatatgttgattattgatatatgtagctatgtgcttctcaaatgaaagtatactccacgacttatgtggggattatttttcagagaatgaaagattatacaaatcgtggtaatgactaaaattcattttcccttttttaattttgaaacaagattttacttaaatttttctgtcccttctctggcgccagtcagtttcactattcatttggaaatcctgcaagtcaggatattacttaaacctgcaaaactgataatatgtagaagccatagtatcattatctcctgagacatttcctcctgtgtgatggataaacccttgcaagcatcggtcctcagctcaggaagtggagggtcattccttacctctgtagtcagaacctcgagtgccttgctttatcagttcaggcagttctatgtcttagatgatgctctcattcctctatacaaggttcgtggtttcaagcagaagaaaagaatacaagtcccagtgagtgtgttgtttgtctgctgtgcactgctcttactttcctgtgattctgtaatgaacagatattctttacctgtataaatattttattttgtgagattagaaaaatttaaatgaaattttcaaaattgcaaaaacagataataccattgccctcatattatatatattttggaggcaggacagattttaggtcaaaggttatgtggctggcttgttgtccttgtttcttttttggtatcctgcagtgtaccttcccataacaaatagagtagaatgtaggggtgaggcaccatgtaggcaccagctcaactttttcatgttcagtgagatatgtgggtgttatccttgggaatggggtcagaaaccatttatcttcgcaacatcctgggttgcttggggatttaaatgggaccttcttggtcaacagctcaattgaatgaaacccagtcccatcactggaatcctcacgagaccacagaaaaagccattgaaactccatatcttcaattactaggaatatttattagaattaccttcatatgttctaggaagtttccactatactaagtttgcacaccatcaccaaatcatcctccaattccagccatctttctccacaacctaccccacaaactgacctccccacctcttccagtccccacccaccccgtctacctgtaaaatctactcaatctcccctttaagggggatccatgagctcccttgtcgtcttgacctaacttcctaactggtttatggattatagcttggttatcacttacttaatgactaatgtccgctataagtggtgagtagataccatatttgtctttctgggtgaattctttcagttccactcctttgcctgtagatttcaggatgtgctttttaaacagctgagtaatagtgcattgtgtaaagcacatgcttattaaaggacaaggctgggcagacactgtgtcttgcgatatcactataggagtgacagcataaaaagattgaaataaaatatacttatgaactatactaatagaactggtttcatgggagggagcctttattcgatgagacccagtttgtatttcctgatgactaatattataatataatttggctttagtattaaaattattttctaagcatcacttttgtttttaaatgtgtaaattacttttcccttttttattgaattcagaaaacattttgaattcctgtgcttgcagcttctcatttttgaacattagctattgttattctgttagtttactgaggcaaatagcaaactattgataatctcttttgcaaatatcccatacagcccagcgcagatgtcagacatttgcctttttggtagattggatcatcactgacctgactagcgatggagactttctcatatttacttggacttttaaatttctataactgactctttgaccaagatttaatatgttgatgggactggatcagtcccacaaggataatatccatcttttaacatcatctgatgtgggaacttcattggagcttgatgtgccttgtgctatttacacatagcataaccacagaatctcctcatagctacgggatttacccatgtacaaagtgaggatgaggaggcaattaaactacacataatatagacaacacataacagtaaatttttaaggagaaaatcgtttacttaaatttttaattttaaaaatttttctacatgaatattgtatttatattacttccattccttttcccctcccctcaacttctctcctgtaccccaagccccattcaaatctatgacttatttattattgttatatgttatatatcataatccatctataatatataacaaatatattttatactgtatatatacaatgcatattatatgatatgtgacatctatacacgcatatagatatttaatatggcatccattgagtctatttactgttgtccatatgtgtatgtgtttagggttaaacatttgtgattgcataatctatcaggggactcacccctgagttctctcagtggtcattcattgcatatatctagctattcacctatggcggtaccttataatattttctccatccgaatgggcatgtcaactggagtcattgtgctagtcttgtttaagcagccttttgttgagatttcaagcgtgtagctttcttgtcatatctaaatgatacagtcttgcatctcgcttttacaatctttctaccccctattgcgtgagaatattttgggagctttagaggtagggtgggattgcagatgtatcaggtgcagttgggcatctgattgttggttgttctctgcacttttgaccagttgtagatttcttttttttttctttctgttacttttcttttctttttttttattaggtattttcttcatttacatttccaatgctatcccaaaagtcccccataccctccccccaccactcccctacccacccactcccacttcttggccctggcgttcccctgtactgaggcatataaagtttgcaagaccaatgggcctctctttccactgatggccgactaggccccttcttagaattgggaataaaacacccatggaaggagttacagagacaaagtttggagctgagacaaaaggatggaccatctagagactgccatacccggggatccatcccataatcagcctccaaacgctgacaccattgcatacactagcaagattttgctgaaaggaccctgatatagctgtctcttgagagactatgctggggcctagcaaacacagaagtggatgctcacagtcagctattggatgggtcacagggcccccaatggaggagctagagaaagtacccaaggagctaaagtgatctgtagatttctttaatagtctctatttgctgtccaaaacaaacaaacaaacaaacaaaccaaacaaaccaaacaaacaaacaaacaaaatcttttttgatgaggcatgagagctatacctgtgtgtggatataaagatacacatttagaatgcagtcagaaatcatgctggatttggaaagtggcaatagtatttttacctctagaatctaggatgtaattgtaaatgtggcttttatttcttcagatgaagggatgagatgagagccatacccaaactgaaccagtacatggcttgccctgagcccagaacattttattttctgttctaactattaagagcctaggcctggaagcttctagcttccatacaatctaatctcgaatgactgattcagcctggcttcacacagcttctgactgaattgctctgttggattcatactaactttagcagtagagtctagtcttctagcttctcatcccctggttcattctgttttcacccatgtctagtttattctctctacagtctgtctctgtaaaactatcccaataattgctatgtggacaccacacaccttttttctctctagcttctcttaaatagtctatttttttgtgtgtgtgcttttctcctgtgagttgagcatattcattctctaactcattctgtcagatcttccttagattcatcactttgtctgtcccccacccccaactaatcattttcaagcacagctgcttccttctatattttaaccttaccttcaatgccagggattaaagatgtatccagttagaatatgctatattccagagtgtgtctgcattctgtctagattttatagacctagaagatctttgggtatgattccttgccagaacagccatgttgttgaattaaagttcctctataccaggacctttccagccatggatagttggctgaatctacagtactagacatgaaccctcaagataaacaaggcactattacacaaataggaaagccttgctggactggttattgatgtgatccatagactttatatctaattatgtctattgattattttctttccttggtatcttgcatagcatctctgggtattattagacatagttcccaggatttagccttccaggtaagtgccatcaagattcttccaagttctgtgtctacagtgtggaatctttaacactaaaggcttactttaaatctggggtttaatcaagacaacagcagttgtccacattgttttgggagtctctaagataaccctgaccataccaagaagttttaattcaacaagtattccattcattgtaaagttcatgtcaactttactaaccacattttgtactttgttttgtttgtctttgttttggaattctagggatagaacccagaccctagtcctaagcttttataccattatatacacatacatagaaaacaaaataggcaagactaactgattttataggtagggtctactctgcactcaagtgaagataattgctataaaaatccattaaatatgaaataagtggttttgaaatacatggacagaaacaacacttccaaacttatttcttggggctaacacaattttgaaataaaatcaggatgagcacattataagaataaattcagtctagcttcctatgtttacaaagaattctcttttttgtctgttttaatcatctatttgaaatcttgtttcctaacattttttttaacttagtgttttattacctgtaatttgagagatcatacttctggtgtgtttttttatagttcattctttaactttttggtttgtctaagttttttttttttcttaaaattttaacctcattcattttaaaaggactagcctctaactctgtgtgtgtgtgtgtgtgtgtgtgtgtgtgtgttatgtatagtgtttgtattctagtgtataaggcatattttcacaaaatgaccatttatataaattcctggttgtttcagccataatttttagacattttacagattagcatctactgttctcaaaatggctaaaatgtgaagtcactttcatctggataatatatttcaaatatatatttaccatattttcctttctgagagctgtcttatttctattttttaaactagatatttcaaaaatgtccagtatcactatgaatcaattttgtgacatctccttaagtgaaagtgtacttacctttgataaaatataaaggttagagtaagatatggaggtagaaagtgatgacaaagtagactttccaatggtcttgctcatatattttatctgatcagaccttttttctctatgatatacttccacaataatttaaacatgaattttagtattccttttcttattttctagtatagttaatattagtgatatcacagtgcttcaccttgctaatttttccatattattttcccagtattatgagctcagtattcattattgcatttttctagtataatttggtagcttttaagtgtaatttgcctcatggtttgtaaatataaaatttaatagtgcaatctgtttgaaaactaccactttgagaaattcttacattagtgaattggtaatgacgatatcacatgggacattcatataatgaatacttttaatgtaacttctgtccaattgaatgcatactagttgttttgtacttttgacacctacttactaataaagctgttcttaaataagtactgcaggattacccagttatgagagactaagtaaccacagagggcatgctagggctcacttgagctacctgattcctcctcaacacttagattatctttacttcatatcttccatttgctttaggaaatgtatattattatatattagtattattagacttttctaatatgaaaaatatggttttaggaattaaaataataattctcagcctagtcatgggtttatgcatgttatgcttaaaattatacaaatgaggttaggaatattttattaagaaaatttgtcaggccatatattcttttattgaacaggacagactaatctaaggccttctaccttctagtctgggtgttcatatttgtcaaagaacaaacaatgaatctcttttggaaattatctatgaacataactctgtttctgtttcagtttgttatccccggagttgttagaaatgcagagataggaaaaagacacgtctgtattttctatctgttcagggtaaccctggatgtcttcttctagaatagcgttctgacatttagaggcctgacaacgaaatgactagcaatgaacacagttattgctgtcattaaaaataaatatgagaagctcagtgtataagctcatctatatatttttttctagtcaaaagtataaaaattatgttttaaggatcttagattctgatagatatactgataattcacaataaacatcttgaattttagtaatttgatatatgtattttctaatttatacttatgtacataccatataattattaaagtcatagtttttattgaaaatacattttttatacaatatatcctgattagagttatcccacctcctcccagatccttactaccaaaccaaatccatatccttcttggtctttgtcattacaaaacaaataggcatttttttttaaatcaagcaataagataaaataaaataaaaaaaaaaaataaatctgaaaaggaaagaaccaacaaatgtaaaaacaaccataaaaacaaagccgaggcccggcctgagaggtttgtgtcacaggcgccggcgggagccttcttggctccgggactccgcggagggcaggctgcacgggagaccgtgtggaatacagaggccagccatttctggtacgggcgagagtcgcagagcttctgaggcggcgccatcttcggctccagacaaccggccaccttcctggcgagagccacagagcttctgaggcggcgccatctttggctccagacaaccggccaccttcctggcgagagccacagagcttctgaggcagcgccatcttcagctccagacagccggccaccttcctggtgagagcacgggggtctgcccggcctgagaggtttgtgtcacaggcgccagcgggagccttcttggctccgggactccgcggagggcaggctgcacgggtgaccctgtggaatacagaggccagccgtttctggtacgggcgagagtcgcagagcttctggggcggcgccatcttcggctccagacagccggccaccttcctggagagagccacagagcttctgaggtggcgccatcttcggctccagacagcgggccaccttcctggcgagagccacagagcttctgaggcggcgacatcttcgactccagacaaccggccaccttcctggccaaagcaacacagcttctgggaaagatcctgttttgggccttcaccttcagccaggaggaggtccaaacaccagataactgtacaccttccccgaaagaggagagcttgcctgcagagactgctctgaccactgaaactcagaggagagagcttgtctcccacgcctgctgattgagggtaacaaaatcaacagaggaacaatctcttaacaaagacaactataacaactaactccagagattgccagatggcgaaaggtaaacgtaagaatcctactaacagaaaccaggaccactcaccatcatcagaacccagaacgcccacttcgcccagtccaggacatcctaacacacctgaaaaggtagacctggatttaaaagcatatctcatgatgatggtagaggacataaagaaggaattcaataactcacttaaagagatacaggagaacactactaaagagttacaagtccttaaagaaaaacaggaaaacactgctaaagagttacaagtccttaaagaaaaacaggaaaacacaaccaaacaggtagaagtccttatagaaaaacaggaaaacacatccaaacaggtgatggaagtgaacaaaaccatactagacctaaaaagggaagtagacacaataaagaaaaccaaagtgaggcaacgctggagatagaaaccctaggaaagaaatctggaaccatagatgccagcatcagcaacagaatacaagagatggaagagagaatctcaggtgcagaagactccatagagaacatcggcacaacaatcaaagataatggaaaacacaaaaagatcccaactaaaaacatccaggaaatccaggacacaatgagaagaccaaacctacagataataggagtggatgagaatgaagattttcaactcaaaggaccagcaaacatcttcaacaaaattattgaagaaaacttcccaaatctaaagaaagagatgcccatgaacatacaagaagcctacaaaactccaaatagactggaccagaaaagaaagtcctcccgacacataataatcagaacatcaaatgcactaaataaagatagaatactaaaagcagtaagggaaaaaggtcaagtaacatataaaggcaagcctatcagaattacaccagatttttcaccagagactatgaaagccagaagagcctggacagatgttatacagacactaagagaacacaaatgccagcccaggctactatacccagccaaactctcaattaccatagatggagaaaccaaagtatttcacgacaaaactaaattcacccattatctctccacgaatccagcccttcaaaggataataacagaaaaaaaccaatacaaggacgggaaccacgccctagaaaaaacaagaagataatccctcaacaaacctagaagaagacagccacaagaacagaatgccaactttaacaacaaaaataacaggaagcaacaattacctttccttaatatctcttaatatcaatggactcaattccccaataaaaagacatagactaacagactggctacacaaacaggacccaacattctgctgcttacaggaaacccatctcagggaaaaagacagacactacctcagagtgaaaggctgaaaaaaaattttccaagcaaatggtctgaagaaacaggctggagtagccattctaatatcggataaaatcgacttccaacccaaagttatcaaaaaagacaaggagggacacttcatactcatcaaaggtaaaatcctccaagaggaactctcaattctgaatatctacgctccaaatgcaagggcagccacattcattaaagacactttagtaaagctcaaagcacacattgcacctcacacaataatagtgggagacttcaacacaccactttcatcaatggacagatcatggaaacagaaactaaacagggacacagtgaaactaacagaagttatgaaacaaatggacctgacagatatctacagaatattttatcctaaaacaaaaggatataccttcttctcagcacctcacgggaccttctccaaaattgaccatataattggtcacaaaataggcctcaacagatacaaaaatattgaaattgtcccatgtatcctatcagaccaccatggcctaagactgatcttcaataacaacataaataatggaaagccaacattcatgtggaaactgaacaacactcttctcaatgataccttggtcaaggaaggaataaagaaagaaattaaagactttttagagtttaatgaaaatgaagccacaacgtacccaaacctttgggacacaatgaaagcatttctaagagggaaactcatagctctgagtacctccaaaaagaaacgggagagagcacatactagcagcttgacaacacatctaaaagctctagaaaaaaaggaagcaaattcacccaagaggagtagaccgcaggaaataatcaaactcgggtgaaatcaaccaagtggaaacaagaagaactattcacagaattaaccaaatgaggagttggttctttgagaaaatcaacaagatagataaacccttagctagactcactaaagggcaaagggacaaaatcctaatcaacaaaatcagaaatgaaaagggagacataacaacagatcctgaagaaatccaaaacaccatcagatccttctacaaaaggctatactcaacaaaactggaaaacctggacgaaatggacaaatttctggaaagataccaggtaccaaagttgaatcaggatcaagttgaccttctaaacagtcccatatcccctaaagtaatagaagcagttattaatagtctcccagccaaaaaaagcccaggaccagacgggtttagtgcagagttctatcagaccttcaaagaagatctaattccagttctgcacaaactatttcacaagatagaagtagaaggtactcttcccaactcattttatgaagccactattactctgatacctaaaccacagaaagatccaacaaagatagagaacttcagaccaatttctcttatgaatatcgatgcaaaaatccttaataaaattctcgctaacctaatccaagaacacattaaagcaatcatccatcctgaccaagtaggttttattccagggatgcagggatggtttaatatacgaaaatccatcaatgtaatccattatataaacaaactcaaagacaaaaaccacatgatcatctcgttagatgcagaaaaagcatttgacaagatccaacacccatttatgataaaagttttggaaagatcaggaattcaaggcccatacctaaacataataaaagcaatctacagcaaaccagtagccaacatcaaagtaaatggagagaagctggaagcaatcccactaaaatcagggactagacaaggctgcccactttctccctaccttttcaacatagtacttgaagtattagccagagcaattcgacaacaaaaggagatcaaggggataaaaattggaaaagaggaactcaaaatatcactttttgcagatgatatgatagtatatataaatgaccctaaaaattccaccagagaactcctaaacctgataaacagcttcagtgtagtagctggatataaaattaactcaaacaagtcaatggcctttctctacacaaagaataaacaggctgagaaagaaattagggaaacaacacccttttcaatagtcacaaataatataaaatatttccgcgtgactctaactaaggaagtgaaagatctgtatgataaaaacttcaagtctctgaagaaagaaattaaagaagatctcagaagatggaaagatctcccatgctcatggattggcaggatcaacattgtaaaaatggctatcttgctataagcaatctacagattcaatgcaatccccatcaaaattccaactcaattcttcaacgaattagaaggagcaatttgcaaattcatctggaataacaaaaaacctaggatagcaaaaactcttctcaaggataaaagaacctctggtggaatcaccatgcctgacctaaagctttactacagagcaattgtgataaaaactgcttggtactggtatagagacagacaagtagaccaatggaatagaattgaagacccagaaatgaacccacacacctatggtcacttgatcttcgaaaagggagctaaaaccatccagtggaagaaagacagcattttcaacaattggtgctggcacaactggttgttatcgtgtagaagaatgcgaatcgatccatacttatctccttgtactaaggtcaaatctaagtggattaaggaactccacataaaaccagagacactgaaacttatagaggagaaagtggggaaaagccttgaagatatgggcacaggggaaaaattcctgaacagaacagtaatggcttgtgctgtaattcgagaattgacaaatgggacctaacgaaactccaaaatttctgcaaggcaaaagacaccgtcaataagacaaaaagaccaccaacagattgggaacggatctttacctatcctaaatcagataggggactaatatccaacatatatgaagaactcaagaaggtggacttcagaaaatcaaataaccccattaaaaaatggggctcagaactgaacaaagaattctcacctgatgaataccaaatggcagagaagcacctgaaaaagtgttcaacatccttaatcatcagggaaatgcaaatcaaaacaaccctgagattccacctcacaccagtcagaatggctaagatcaaaaattcaggtgacagcagatgctggcgtggatgtggagaaagaagaacactcctccattgttggtgggattgcaggcttgtacaaccactctggaaatcagtctggcagttcctcagaaaactggatataatactaccggaggatccagcaatacctctccttggcatatatccagaagatgcctcaactggtaagaaggacacatgcaccactatgttcatagcagccttatttataatagccagaagctggaaggaacccagatgcccctcaacagaggaatggatacagaaaatgtggtacatctacacaatggagtactactcagctattaaaaagaatgaatttatgaaattcctagccaaatggatggacctggagggcatcatcctgagtgaggtaacacattcacaaaggaactcacacaatatgtactcactgataaggggatattagctcaaaacctaggatatccaagatataagatacaatttcctaaacacatgaaactcaagaaaaatgaagactgaagtgtggacactatgcccctccttagaagtgggaacaaaacacccttggaaggaggtacagagacaaagtttggagctgagataaaaagatggaccacgtagagactgccatatccggggatccatcccataatcagcttccaaatgctgacaccattgcttacactagcaagattatgctgaaaggaccctgatatagctgtctcttgtcagagtatgcctgggcctagcaaacatagaagtggatgctcacagtcagctaatggatggatcatagggcccccaatgaaggagctagagaaagtacccaagaagctaaagggatctgcaaccctataggtggaacaacattatgaactaaccagtaccccggagctcttgactctagctgcatatgtatcaaaagatggcctaggcggccatcactggaaagagaggcccattgaacacgcaaactttatatgccccagtacaggggaacgccagggccaaaaaaggggagtgggtgggtaggggagtgggggtgggtggctatgggggacttttggtatagcattggaaatgtaaatgagctaattacctaataaaaaatgaaaaaaaaaaaaaccttaagagtagcaagtaaaaaaaaaaaaaaaaaaaaaaaagccgaggaaaaatataagaaacacatatagatgtagcgacaaacacattggcatccattgacatccctaaaggcacaaaatcagaaaccataatatataagcggaatacctgtagggtaagaaatagaaaaagcaacaagaacagacaaaacattatgtgacaaaacaataaatcagcagcagaagcagcagcacaatccttccattattaccattaagtttgttttttattgaccgtctattgctgggtatgagtcctggccttaagggttgtttttatgcaaagtgagacactgttagagaaaggtaaagctagtttttcatttgccagtgataatcacttggaaatagtttctgggctagggatgggggtgggggggtttgcatccacttccactctttgcactgaaagctcatcaggcccagacctgcgcaaggttctgtgagttcatatttacattggtccttatgtgtttagaaggccttatttccttggcattctccatcccttctgactcttaaaatctttctacatgctcttctccagggtcgcctgagccttaagggagacatcccatttaggactaatgactccaatctttctcacattgtccaatgtgggtgtctgtattgattcccatctaccataggaggaagctttgctgatgacagcttagcagctccctggtctatgagtgtagcagaatgtcgttaggagtcattttgctgccttgtaccttcagtatgtggttttcttctaaacctgttgcctgtctggtgttgagttcatggctacctgagcaatgttggaaattacttcaatctcatggagatggaatgctaatcaaataagatgtgggtcggttactccctcaagttttatgccatcattgctctagaacaccttgtagacaattgtccattgtagaccaaagggtttgcagctaggctggtgtttacctttgttttttggtagcatgcagagtactttccagtaccatggagctcttaacagtggcacagatagtacactgagaaggggatttagtacaaagtaggccttatgggccccatgggttttagctttctggttctggtcaaatgttttcctgactatgccctgtgatcctgcacctcttgttcctgtttccatggattaaccatgatgcactatattcttttaacccaagagccaaagtaaacccttgatctcttcagtgtctgctttgaagccctttatccagtgagcaaggtaaccaccatgtgagctgtgtgtttaagcctggtgtttgatgccttcattggacataagcatgtatcttatgtcaagttcacaaaacctcttgataaaagagaactgggccccttagaaagtggcagtttctaggataataaataaggaagtggtttaaaagggtgacaatttctcatctggacaaaaaacacctgaaggaagaatccgacactgggcagtatgatcatcaagataataaaaatgaactctaactgggtgaataaaacagtcttctgtgactgtatactgataaacatgtaaatgaaaaagagaacattatgtgttcatttccacctaataaatgtaggcggaggaaattaaatcagaatcatttggcagctgtcaaatttcaattcagtacaaggagattctggacttgtagcttcaaatttcttgagaagcaagatgaagttgacacagttttgaagattattgtaaattattatgaataaaaagatgaaaattcttagttcacagtgatgatgcaaggatgtctctagatgtcctgaaatggtcaggtctttttgcttgtcttgatgtaatggagccccctttcaatcttcaaagtggattgattgcttataaggtaaattgtgtggttggtctttctataggtttctgtttataggattatttttctggaactaatagataagcatatgcttatgacagtctttatatcttatatagtagtcaagtgctcattttttcctgtctttctaaataagatccttaataactgatccttttactacctaaactttgcatagtcaagaaattgcaagatcaaattatagataattttaaaagtcagacaaagaccaaaataggtaatatggtatatccaagctcttctagagactatgagaaacatgttacgactaaggaattcttcaagtagagtttcaaactctgcaagtatcaaaaactggaaaattttcaggtttgcttaaatgtacatgcaggaataataaggaaaaatgaagatttaacattactttcattagtaaaagtcgttaaaagtcatgattctaatagatttagtagagtctgttagcacatttcattttcatgggaaaactatttagaaattcattgttaagtgtatttccttagtctttgccttagagaaatatattcaaaacttctttaaagaatttatttgccaggcagtggtggcacacacctttaatcccagcacttgggaggcagaggcaggcagatttctgagttcaaggccagcctggtcttacagaatgagtttcaggacagccagggctacacagaggaaccctgtctcaaaaaaaaaaaaaaaaaaaaaaaccaaaaacaaacaaacaaaattatttatgtttttaattttcagggtgtctttgtgaacatgagagtgcagtgcctatctagaagagggagtcagatccctttggtatagtgtgtataagctggtgtgagctgcctggcatgggtactggaaactgaactccagttctcagcaagaacagtatagactccctacaccctatccttcctgcacccattgaaaacatttaatcatgattctctaatattatattagacctaaaatgtaaagttcacatagaatcatgataaatggctatgtctgctcttttggggtattgctttttttttctttttttattctttcttttcttcttctttttttttttattgaatattttatttatttacatttcaaatgttattccatttcctggtttccccactgcaattctcctctctcataccacctccccttctataaggatggcccccacttcacaggaccaagggccatcctctgctacatatgcagcttgagccattattggtcgctccatgtgtactctttggttggtggtttagtccctgacagctctgggattctggctggtagatattgttgttcttcctatggggttgaaaccccttcagctccttcagtcctttctctaacttctttggggacccagtgctcagtccaatggttggctgcgagcatcgaagaaaagcaattaaagtgaggcagcccactttgtagattgtggttcttcacagtgggcaaagtaaaggaacagatgcttcaatcccctggccccatcacacccacaatctggagtgaacacttacttacatgtattctgctgactctctctgcacaatactaccaagatccctgcagaaaatggtcttaccacagaggtggaccctctctatcagctgttgtaatcaagaaacccccacaagcatgcccagagattatctctcagatgattccagcctttgtcaaattacaactaccacttaccattacctctgcttactcagggattatggaaaaagaaaacatcatctgagatggccatgtctatggcttattactttcctttctcctttggagccagcatttggtacctgctgaataaatataaataaataaatataaataaaatattatctacataataatttagacaaactttggtttcatagaaatcgtttaagaaaacttaaaaggaggatacatatggagaactcaaggtttgggggtgtagatatagctctggtttcaattactttttatcttgttagagcaaacaaattggactgtgttatttagtggtcagggtgaatattacaccgccttgcttagctttagtatctactttagttacttttctattgatatgaatagaccttatgaccaggggaacttatggaagaaagcatttactttgagagctcatagttttcaagtcaatgaccattatggtgagtggcatgtcagcaagtaggcagatatggctctacagtaataattaagagcatacttcttgctctacaggtatgaggcagagagctcagtgggaatggagtggcctttttaaacctcaaagcctatacccagtaacacagctccccaacaaggccatacttcctaatccttcccaaacagttcacccactggaaactaagtattcaaataaatggactatgggggcctcagtcaaaccacgaccatatccttgactattgcaatatataggcttgcttctcattctattggactcatcaagcatttatatagagtgggccaaattatttaccccattgattttataagataattgtacaagtttgtttattttacattttaaactgtgtgtcttcttccttcagcactacagcaaaaccaagacatatatttttatttttgattttatattattaggacctttagaactaaaatatatatatatttgaattatgttttcaaatatgtgtttgattgcatgtatgtctgtagatgcttaatgctgatgctggagaaggccaggaaagggtttgtgacgcaggaactagagttataggtgactgtgagcttctgcgtggtgctagaactttaattctagtcattggaatagcagacaatgtccctaaccactgagcaatttctgtagtcccctttagaaacttgtttaaaagaaaaacttatatgaaatataactttgtttaaaagagagtataatttgtttgattaaatttttttcacatttttaacttccagaactccttttattagatctccatacacctttgagtgtatgtgtgtttaaggaggatgtatgagcacaggtatccccacacgcacccacttccagcagcacatctgatgaggaccggagaccatcaagtgtctctttctatcattcttcaccttatttttgaggcaaggtttttcctaaatttgtgacttgcaatttcagttaggatggcaggctagcaatctcctgggatctgcctgcttctgtcccccgtgctgtggggtgcaggctcgtgtgaccatgcttggattctgtgtcccgtgctgtggggtgcaggctcgtgtgaccatgcttggcttctgtgtcccgtgctgtgggttgcaggctcgtgtggccatgcttggcttctgtgttccgtgctgtggggtccaggctcttgtggccatgcttggcttctgtgtcccgtgctgtgggttgcaggctcgtgtggccatgcttggcttctggggttgtgttggaaaatcgaatttcggactgctttacaagcacttttacttactgaacactttccccagcccagttaatgactttcatttaatgaccacaaattaatatgagtcaagtagacaatttgtatttcaataatgtatcttctttggaaataagaagttaattaaagctcagtttttgttttctctagtaaaactattgaattgtgaccgttactttcatgctttgggaaatggtcactcattagagatcatctctcttatatggcacttcagacatgcggtgcctactcctattatatttgggcgacgtttagaattataaaaattattccacgggtcccagctaatgtcacatcaacgtccctgaatgaagaatgttattaatggcacacagaaggcaactttctgtctatttggggcagtataatttaatgtgttgttttcaatgtcacaacagtctgtgcattaaaaggcaccaagagaaaagtaagctaaatatttgtggatattttttggtgggtgctgaaggacttccagtctgaagcaaccaattctgttagattttggggaaaccaagtcagttgctttcccgaaacagttacatacattttatcagttggctttgtcacactccccactgtgacacctagcccttgtgtttttctcctgcgttacttatttctgttagtagtgctgccatctgtccagcacaatattttgtatgaccacttacgtttgaaaattctggtaaggagtaggtgtttgttgaatgtacttagccatctcgcagccttgctgagtattctttatggagaagatgaggccttggactctgtattttgagaaaccattcttgaagtttagaattagtttctctgccttacaaacatatctaggctgactctcagttctaaaaagccagctcacagatatcattttatgtgtatgtgtgtatgtcctgtttgcttggtggactacctttgaaagttccttactatctcttaagtttattagcttcaaaattcccaatctatggaaaggtattaaatatatatatattgaatatggtttcctcactgctcaaaatcttttgatgagttcctgctgcattcagaaagcctatcaaccaagaagtgggagtgggagggtgggggagtgggtggggcagcgtgtgggggacttttgggatagcattggaaatgtaaatgaaataaatacctaatttttttaaaaaaaagaaagcctatcaaaattaaaagcctcaacaatctagccatactgctcaagcaggctgtcacccaccaagaaggctgaaggatgtcacagcctgctgtcaagcatcatactttgtacatgatcacatggagaagtatttctgtgagcctgataaagacgaagcagtggtcaatgggtttgatgctgacaagtattactttggaagtctaaaagcaaaatagcaccgatgctctgtaagcctttgtttctgggattctgatctagcagggatgggggaggtcctgggaacttggctctctgtaggtaatatacgactgatgaacagatattttgacagttgccaacctagagcctctagtcctgcttggtgaatagtgtccctgccccttgagactagagactttcctccattgggctgacttctatctagctaacctttcccagaaggattggatttccccattccacctagtccctaaataactcatgtaaggtaccgggattctgtgtagtcttgagataaacctaattcaggaaaggacacattcctttttctcttactccctttctggtaaggcccattcagtcctgtgtcctgctatggatactcatgtctcatgtacactcctgctgtttcattggtttctggtgtatttttatattcttgaaatccttagatccttgtgcaagttatttgttttttcatctaaccagattctcagaagaaacaccatttccagtctttttgttcgtttgtgtaggttttggttttttacattattttaggaacctcgctgaacctcaagactgaccttggattcctgatattcctgcctctccctctgaagttctggaattaagggccattgtgccactaagcttacctatgaattaatacatggataatcatcttatttccatatctctactactttgttatttatttttaaataatgaataaaacaaggaagaaaagtcaaccaaagacccccatcttatttgtttagcgcacgtaaatttaatgccttcaaatgttcttgttattatctgtggacatctccatccttccttagtctcacttcagagtctctgtccaagcttgcatgtggctctctgtgcctactcttatctgtggccatatccaggacccttcactatctacatttacagtggaaactatcttttctcttaattactttatttatttgccatatcatagtcttgcactctggcaacctttggccaaggtagcctccatctcagtaatcattcactccacagttttcatgaaagattcttactccttccttaataaaaaggacatttcattcaaatatttgtttacatttaactccagagttgggggatttcatctcaccagagctttagaaactaaagactgatctataataattctgattaaccctgctttctggcagctatacatgctctgtcactttaggccccagagtgggatgctcatccttatactgcccttagacctttgctttccttgcgctctttctgttgtgtgcattctggaaaatatgcattctactctatcatgagctttttgtctgtcaacattaatccattaaaaaagccaaaagtatgccgggtggtggtggtgcacgcctttaatcccagcacttgggaggcaggggaaggtggatttcttagttcgaggccagcctggtctacaaagtgagttccaggacagccagagatacacagagaaaccatgtctcgaaaaacaaacaaacaaacaaacaaacaaacaagccaaaagtaatgtactatctatcatagggtatccctgtgattcatgctcatcaaatccatgtctttatatgtacttatccatttgtctgtcttctcaaaactgtacagttcatctaagcatcaatttcaccctccgactctccagtcttctgatgttgagccttccaatcacaggtagcatataacattgccttatatttcataggcgaaaatgtgctacaagaccctccacgctatttcctaccaaaggtcacttctttcatgttcttttcctttctctaagtgtggagaattgtctttagaaacctggattatagatggtgccatttagataaggtctgacgtttgtcagttgagatgaccccaatatgtattatttttaaatgagttatacagctgaggacatgctgagagtatatttaaaacaaattgcagagcttgagtaaattcatgaaactgtgaataagcttgttaccatgatggaactcaaagctaaagtgaaccaggcttggtcttgcatttctgtagtctcatcatgtgtaggtagaaatagaaggattgaaatttcgtggacagatttggctatgtggatccatatttttcagttgttttgtgtgtttcaacaaaattgactttgatagcacagtggaaccaaaatagaaaacaattggccgccaaaagccttgtcgtcactcagaagactcaggtttattaactgcatggtcaaaacagtgaatacgtcataggatcaggaggaaataccggccatgaccatcactgtaccctgcatgatgctctattgtgtgactttttaaactttcattattattgttattattattaactctgtttttaccgtccagtcctcattcccctcctggtccaccctccaataattcctcatcccatttcacctcccctgtctccaagaggatatccccaccccactccacccgaccccaccagacctcttccctccctggggcctcaagtctttcgagggttagatgcttctctcactgaggccagacctagcagtcctcttctgggtatgtgttggacctcataacagatggtttatgctgtctggttggtggttcactgtctgagagatcttggggggtccaggttagttaagactgctggtctttctatgggattcccctctttctcagcttcttccagcctttccctaattcaaccacagggtcctcagcttctgtccattggttgcatctgactttttcagctgcttgtttggcctcttggagggccacttcatgtctgttagcacaccaaagcatcagtaatattgtcaggccttggagcctccctttgagctggatcccagtttaggccagtcgatggacctcctttccctcaggctcttctccattttttttgtccctgcagtactttcagacagggacaattctcggccagcgtttttgactttgggatggcaaccccacccttccacttgatgccctgtctttctactggaggtggactctacaagttccctcttcccactgttgggcctttcatctaaggtccatccaagtcctaagagtctctcacctcccaggtccatggtttattctagtgggtcccctcacctcctacatcccgatggtgcctatttccattatttctgctgttcctcagggcttcacttctgttcccctccccaatacctgattatgttctccttttctcctccatgtctcctctcccacctagattcctccctccctctgtctcccatgattgctttctactccctcctaaatgggactgatgcatcctcacttggacaacttaaatatatcttgatgtctaatgaattctcataggttaagtgtctttctattaggaatgatgctaagatattagttttttctgtggtaaagagttaaatatgttattattattattattattattattattattattcttggtttttcaagacaaggtttctctgtgtatctctggctgtcctggaactcactttgtagaccaggctggcctcaaactcagaaatctgcctgcctctgcctcccaagtgctgggattaaaggcatgtgccgccaccacccggcaagttcaatattttaataacctatgttttgatataaatttgaatgtcacaatctggatttaattcttttacgggaactagaaaatatacaacagctttgatttgattttcctacttttaccctttgtcttttggggctttatagaaagttttgaacactatgaacatgactaaaattttcagaccttccctaaatggtaccattaataatccagacttctagagagagaatgtgtgtgtgtgtgtgtgtattcttagttcttatttagggtttcattgctgttaagagacaacatgaacaaggctaactcttataaaggaaaacatttaattaggactggcttaaagtttcagaggttcattctattatcatcattgtggaaagtatggcagtgtgtaagcagacatggtgctacagattctaagggttctacatctagatcaaaaggcagccagaagaagattgtcttttgaaggcaaccgagagtaggctctcattccatactggatggagtttgagcataggagctctaaaagcctgccttcactgagacatagttcctttaagaaggccacacatcctccaataaggccatacctcctaatagtaccactttcaatgggccaagcatgtcacacacacacacacacacacacacacatatatatatgtatgtatgtatatatgtatatatgtatatatatatatgatgtcatttcaatgtcatgtgattgagcatattaatccttttgcttttaaagatttcttttgtgtgagtggaggtgaaaccagatatgcacatgtgagtgtacatgcccatggaggtcagaggcatcaggtgttgctgcagctggaggtacagaccgctgtgaactgcacaacatgggtgctggaaagaaactggggtcctctgccacagaatatgatcacttaatcactgaaccttatctccagtccaagtaaatgactcaaaatgtgtttaaacctacatataatacaaatttctgtttaattcaagttaggaagccatatataaacagtaatgacatcttcatttttaaaacttctagagtgtaaaattttaattaactaacaaacttaataattatgaattattttaatatgtggtctatgttttgaataacattagcatttattctttttaaatatgatatcaagtttcaagaaggataaaaagttctctgatgatttaatctgaaatcattcctacagcaaaattcataaataataaatagcagcttattaatccatattttagttgagctgggtctcagagcaagttacctcctcagggaatgcggtgttctttataagagaaggcgatgagacacagtttctaaggaattaaattgtgaatacaatcttggtattgtgcacactaatataaatctgttattccatttccacatctatcacaacacgttttaaatcatggctgatctcatatgcaaatagctgtcttattagaaatcgtggcagtatatgccagtgtctccctggatttcttgggagtttgctatcatgccatcaaagcaatagaaatgaatgttgattactgcaaagctttgaagagcaaaacacagtcagaacattttatagattctagatgtctgaaacactgacagtttgtgctatacagatgagcgtgcatatctttaggtcattttcaatagagtcaaagcatttatgagtaaagcaaaacacaataaaccattttatgcttgttttgcctaacaaactttagtcatgctcatcgtgggtttcaggcttttaattgctttttaactcatcatctggttaaatgtgttttggctttaaagaatagaatataattatttcaaacaaataagaaagttgaatttttataattctgatcaactattattagcaatcactaaaatgattagaaataatagttataagctagcttttgtgttttgtatagatctttaagattcctaagtaatttataattttatatacaatagttatatatatataatatattatttatagtatgtttatatgtgtaatactttttttctgtttccagcctacagacacttacaacaaatcatattggttaacctttttgtcataatattattaacagcacatttggaaattaataaacttcggtttaagatactggttttttttttttttttttttttttttttttttttttttttccattttttattaggtatttagctcatttacatttccaatgctataccaaaagtcccccttacccacccacccccactcccctacccacccactccccccctttggccctggcgttcccctgtaccggggcacacaaagtctgcgtgtccaatgggcctctctttccagtgatggccgactaggccatcttttgatacatatgcagctagagtcaagctcaggggtactggttagttcataatgttgttccacctatagggttgaagatccctttagctccttgggtactttctctagctcctccattgggagccctgtgatccatccattagctgactgtgagcatccacttctgtgtttgctaggccccggcatagtctcacaagagacagctacatctgggtcctttcgataaaatcttgctagtatatgcaatggtgtcagcgtttggatgctgattatggggtggatccctggatatggcagtctctacatggtccatcctttcatctcagctccaaactttgtttctgtaactccttccatgggtgttttgttcccacttctaaggaggggcatagtgtccacacttcagtcttcatttttcttgagtttcatgtgtttaggaaattgtatcttatatcgtgggtatcctaggttttgggctagtatccacttatcagtgagtacatattgtgtgagttcctttgtgattgtgttacctcactcaggatgatgctctccaggtccatccatttggctaggaatttcataaattcattctttttaatagctgagtagtactccattgtgtagatgtaccacattttctgtatccattcctctgttgaggggcatctgggttctttccagtttctggctattataaataaggctgctatgaacatagtggagcatgtgtccttcttaccagttggggcttcttctggatatatgcccaggagaggtattgctggatcctccggtagtactatgtccaattttctgaggaaccgccagactgatttccagagtggttgtacaagcctgcaatcccaccaacaatggaggagtgttcctctttctccacatcctcgccagcatctgctgtcacctgaatttttgatcttagccattctcactggtgtgaggtggaatctcagggttgttttgatttgcatttccctgatgattaaggatgttgaacattttttcaggtgcttctctgccattcggtattcctcaggtgagaattctttgttcagttctgagccccattttttaagggggttatttgattttctgaggtccaccttcttgagttctttatatatgttggatattagtcccctatctgatttaggataggtaaagatcctttcccagtctgttggtggtctttttgtcttatagacagtgtcttttgccttgcagaaactttggagtttcattaggtcccatttgtcaattctcaatcttacagcacaagccattgctgttctgttcaggaatttttcccctgtgcccatatcttcaaggcttttccccactttctcctctataagtttcagtgtctctggttttatgtgaagttccttgatccacttagatttgaccttagtacaaggagataagtatggatcgattcgcattcttctacatgataacaaccagttgtgccagcaccaattgttgaaaatgctgtctttcttccactggatggttttggctcccttgtcgaagatcaagtgaccataggtgtgtgggttcatttctgggtcttcaattctattccattggtccacttgtctgtctctataccagtaccatgcagtttttatcacaattgctctgtagtaaagctttaggtcaggcatggtgattccaccagaggttcttttatccttgagaagagtttttgctatcctcggttttttgttattccagatgaatttgcaaattgctccttctaattcgttgaagaattgagttggaattttaatggggattgcattgaatctgtagattgcttttggcaagatagccatttttacaatgttggtcctgccaatccatgagcatgggagatctttccatcttctgagatcttctttaatttctttcttcagggacttgaagtttttatcatacagatctttcacttccttcgttagagtcacgccgagatattttatattatttgtggctattgagaagggtgttgtttccctaatttctttctcagcctgtttattctttgtgtagagaaaggccattgacttgtttgaattaattttatatccagctacttcaccgaagctgtttatcaggtttaggagttctctgttggaatttttagggtcacttatatatactatcatatcatctgcaaaaagtgatattttgacttcctcttttccaatttgtatccccttgatctccttttgttgtcgaattgctctggctaatacttcaagtactatgttgaaaaggtagggagaaagtgggcagccttgtctagtccctgattttagtgggattgcttccagcttctctccatttactttgatgttggctactggtttgctgtatattgcttttatcatgtttaggtattggccttgaattcctgatctttccagaacttttatcatgaatgggtgttggatcttgtcaaatgctttttctgcatctaacgagatgatcatgtggtttttgtctttgagtttgtttatataatggattacattgatggattttcgtatattaaaccatccctgcatccctggaataaaacctacttggtcaggatggatgattgctttaatgtgttcttggattcggttagcgagaattttattaaggatttttgcatcgatgttcataagagaaattggtctgaagttctctatctttgttggatctttctgtggtttaggtatcagagtaatagtggcttcataaaatgagttgggtagaataccttctacttctatcttgtgaaaaagtttgtgcagaactggagttagatcttctttgaaggtctgatagaactctgcactaaacccgtctggtcctgggctttttttggctgggagactattaataactgcttctatttctttaggggatatgggactgtttagaaggtcaacttgatcctgattcaactttggtacctggtatctgtccagaaatttgtccatttcgtccaggttttccagttttgttgagtatagccttttgtagaaggatctgatggtgttttggatttcttcaggatctgttgttatgtctcccttttcatttctgattttgttaattaggattttgtccctgtgccctttagtgagtctagctaagggtttatctatcttgttgattttctcaaagaaccaactcctcgtttggttaattctttgaatagttcttcttgtttccacttggttgatttcacccctgagtttgattatttcctgccgtctactcctcttgggtgaatttgcttcctttttttctagagcttttagatgtgttgtcaagctgctagtatgtgctctctcccgttttttcttgaaggcactcatagctatgagtttccctcttagaaatgctttcattgtgtcccaaaggtttgggtacgttgtggcttcattttcattaaactctaaaaagtctttaatttctttctttattccttccttgaccaaggtatcattgagaagagtgttgttcagtttccatgtgaatgttggctttctgttatttattttgttattgaagatcagccttagtgcatggtgatctgataggatacatgggacaatttcaatatttttgaatctgttgaggcctgatttgtgacctattatgtggtcaattttggagaaggtaccatgaggtgctgagaagaaggtatatccttttgttttagggtaaaatgttctgtagatatctgtcagatccatttgtttcatcacttctgttagtttcagtgtgtccctgtttagtttctgtttccatgatctgtccattggtgaaagtggtgtgttgaagtctcccactattattgtgtgaggcgcaatgtgtgctttgagctttactaaagtttctttagtgaatgtggctgctcttgtatttggagcatagatattcagaattgagagttcctcttggaggattttacctttgatgagaatgaagtgtccctccttgtcttttttgatgactttgggttggaagtcaatcttatcagatattaggatggctactcctgcttgtttcttcataccatttgcttggaaaattgttttccagcctttcattctgaggtagtgtctatctttttctctgagatgagtttcctgtaagcagcaaaatgttgggtcttgtttgtgtagccagtttgttagtctatgtctttttattggcgagttgagaccattgatgttaagagatattaaggaaaagtaattgttgcttcctgttattttagttgttaaaggtggcattctgttcttgtggctgtcttcttttaggtttgttgagggattaccttcttgttttttctagggcgttgttcccgttcttgtattggtttttttctgttattatcctttgaagggctggattcgtggagagataatgcgtgaatttggttttgtcgtggaatactttggtttctccctctatgataattgagagtttggctgggtatagtagcctgggctgcagtttgtgttctcttagtgtctgtataacatctgtccaggctcttctggctttcatagtctctggtgaaaaatctggtgtaattctgataggcttgcctttatatgttacttgacctttttcccttactgcttttagtattctatctttatttagtgcatttgatgttctgattattatgtgtcgggaggaatttcttttctggtccagtctatttggagttctgtaggcttcttgtatgttcatatgcatctcattctttagatttgggaagttttcttcaataattttgttgaagatgtttgctggacctttgagttgaaaatcttcattctcatccactcctattatccgtacgtttggtcttcttattgtgtcctggatttcctggatattttgagttaggatctttttgcattttccattttctttgattgttgtgccgatgttctctatggaatcttctgcacctgagattctctcttccatctcttgtattctgttgctgatgctcaaatctatggttccagatttctttcctagggtttctatctctagtgttgcctcgctttgagttttctttattgtgtctacttccctttttaggtctagtatggttttgttcatttccatcacctgtttgtatgttttttcctctttttctgtaaggacttctacctgtttgattgtgttttcctgtttttctttaaggacttgtaactctttagcagtgttctcctgtatttctttaagtgatttattaaagtccttcttgatgtcctctaccatcatcatgagatatgcttttaaatctaggtctaggttctcaggtgtgttggggttccctggactgggcgaagtgggtgtgctgggttctggtgatggtgagtggtcttggttccttttagtaagattcctccgtttacctttcgccatctggtaatctctggagttagtagttatagttgactctgtttagagattgttcttctggtgattctgttaccgtctatcagcagacctgggagacagattctctcctctgagtttcagtgctcagagcactctctgctggcaagctctcttacagggaaggtgcgcagatatcttgtatttggacctcctcctggccgaagaagaaggcccaaaacaggacctttctcagacactgtgttgctttggcagttcccaggtggtacagactctcacctaagcagactaaattcctaagttccttggagtcccgggaccaagatggcgaccgctgctgctgtggcttaggtcgcctccccagccgggcgggcacctgtcctccggtccggaaggtggccggctgtccccggcccacacagggtgctgcctcagcccctctgtgcttctgcctgttccagaggctgtcaggttctctggcgcaccctctcacccgttcagactaatttcctaagttcggcgggtcccggaccaagatggcgaccgctgctgctgtggcttaggccgcctccccagccgggcgggcacctgtcctccggtccagactgtggctggctgtccccggcccacaaagggtgctgcctcagtgcctctgtgcttccgcctgttccagaagctgtcaggttctctggcgcaccctctcacctgttcagactaatttcctaagttcggcgggtctcggaccaagatggcgaccgctgctcaagatactgttttttattactacaagtaattaataaatacagcattggtctcttaagtgtcccttttgttaaatgatgagaatacaagggtagtatagggaccaggatgaagggctgtgtgtgaacagccatttgctgcacagacttagcaatttcctgtgctttgcgtgtttatcttaagcgtattccatgaaggaacaaacctataattgaagaaatattattatcttgtgtttttattcatgcaagctaacttctctcttgaaatggataggtcttcaagctccacacaattaagattaaaataatgactccactttactattaataaatgcaaacactatgcaaaatagaactgctatatgaatacattatatctattgacattatttatggcttctcttgacagaactatttttaatgttttgatttataaaaggtaagactatataggctttagtaatatcttagtttcatttagaaaactttaagtgtgtatcatcttagatgtagtaactctgtgttttattagagataaagacttaatttatttgactttctcttatcagttgatattttatattcctaggtattgttatacaatcaatctgaaggttattattataagaaaaaaaaagcttttagatgagttttcagttttcttatacatgagtagaagttatgtccttttgctgtgttgatatccttattggctatttctgtgaggatgcataaagaatgtagtttaacttgaacagactttgaagtacttgatatctgagaaccctaataaaacccactaggaaaattctgtttatttagagcctgaaagagctccccttttattaatccagtccaaccctgagagaccagaacagattgtcctatcttaaactctgccctgagctccttaaggtttgcatattatgaaagttacagcctaccctgcccttcctagtatcacccatcaggagattgtgtttctaactaaatcatgatcatttcagagaaactcctgtgtgtgttcatgtctgttacttcctcttttggttgtctcctcctcccttgacactctctcagcatattcagagaataaggaccacagcctgctttcattcatgcaatcctgtgcttcaaatagtatcttccttaggaaatagttgtctcagtttttgccagtcttcataaccactaacagggagttctatgtgcctgtatttttgtcacatttactttcctaaatataattccatcggctttttgtctattctttgtaacttctttggaacttctgggcagaagttcctctaatttctattcagagataacctgaaataatagattcaagggaaagtaattcccatcctctgtgccccaccttctcccctcccccctttctcccctcccccctctcccttctcccccctctctcccttctcccccctctctcccttctcccccctcctctctcctccctcccccctcccatctctctcctctctctatgtctcactccctctctctctcctctttctcttttctcttttttctctcacattctcctccactgtctctctatccctctgttttccatttctctctccctgccctctcagatgagaaatattaactgactttcaaactgatcttcaatatttttttcagttttttcttccaactttgtagaaattagtttttcaagcctcttaaaccccaagatcttagaactcccgtgcctttatatatttctacttactaatttttaattaaaatataattatagaacttatctacttcctttcctcccttccctagacacaggcagcaaatgactgctcaggaagggggagttagcctctcccaggaataaggctcctaattggtacccagtacaaagaagtcagtcctgaaattatgaacactcaggtcacactaaacagacaaggcagactatatttatatatgtatgcatatatattttattaacaataataaagaagaaaagtcctttgtggttttagtcctaaagtgacttcttgcttgaccatgtttttcacacataactataccagaaggagcaaggaacaacttctgagcacaggtgtttgcattgtgttcgtgaacatttgtgactatagtaaatacgacccacaaatacctaccaatgcacacaagaattaaattcttttttcaaggatgacaagttattaaaaatacttcctccactcctagaaacgggccttctaaatttgtctgaggctcatttacattccattgcttcaggtggaggagagcaaagatggacatgcctgcgagtttttcatacttatgcttgaaaatggtacattccaattcttgtagtaacaacctaattactattttaattcaagctaagcagtcttttctaacagtgaaaatagaaagtaagtgtagatttggtgagaagaggatagtttttggtgcaacagtaaaatttaataaaaacagaatgcgagctctgatttgaggattagatagagcagcacatgctgcaaatgtgagaataacaacagggcggtgctctctgctgctgctttccacgtccaccctggccacacccgcgaggcattctcaaacaaaattcaagccagtcagctccataccctagccctccattcggtgtaacacagtgggtaactgcaaggaaactgccatttcctgatgcttctctaatattctgctttaattgagcttagttcttgatggaattaatgtgacctagaataaatgaataagattttatcactagtaattctatagctgataacttattggaagaattttgtgttcttttgtatatatttaattgaagtgaagttggcatcatttttactcattgctttaaaaatgattttaaggaaatctttggaaggttttttgttttttaaagatactttttaaaaatgtgtttcattataatggttgtctttctttttagcaggtattttggagatcaaagatgggtagaaaagactcttccaatacaaaacttcctgttgatcagtacagaaagcaaataggtaagcaatgagcttctgcagagagaagctaaaaccaggcggtgtcggttaaagactccatttcccagaatgtacacaactcacatgttctcacaagaagaaaggaacaccttacagggctttaggaggaaagcaaatataaaactgcttcctagcaaaggatatatatacttcatgtgtttgctcttttaagtgctgtggggattttatcaattgaacataagcaaaatgaatattgttattttataaatagatgctgttttacagtactttacatattatcatctcataatttatccctttatagtcacctaaatatttacttcttttgcctcatgatgacactggtttatattttcagaatacttcattaaaattgctaaatataaatgtcattccacatgtacaactgtgcttagaaagaaaaggaacttcccaggagtcatgagtaaagacttactagagacaagatgcaaggctttgtcatctaaggttccaagcatacccttagagagtaggcagagcccttggggaagatggccatctagagagaatatagcacaacgagggagagctggaagcagcttgcacctgaacacatgcttttgttctatgtgcacacaaactatttgctcacagaatgctcatgcactagtcagtgcacaagggaaagcctgagattttagagaatttgtagcttaggaacaaattatttttttaagtgtaataaagtagaaatcagaagttaaacaagcacttcctctaatcaacacaacactctcttcctcttctctctacctctacccattcacatttaaactaaaatgcaatgaagcaatagaaactctttaagtaattgtaaaataaaaaagtctcaatggattcagataaaataagtgaaataactgttaaaaattaatacacatttattttataatactcccaaaacatgcactacataaatttaaataattacaaaaccatacaaattaaaaaacaaaaataagaatgcataggccaacgaacaaatttttatattttgtattagccatataaaatgtatgtatatttatatatgcacacatacacatatcaatgttatgtggctattgcaaatccaattaaaatatcaattattccccattattgcctcttttgtataagatatcctacctaaatctactcatcaattttctgtttaacatgacacaatattattaaatgtagccatgttagagctctagatgccacagctttgcactttttgatttgcatgtccccatttctgtccttcaacttggtaagaacggaagagatacatctcttcttttttgaatccttttccttttgagattatactgtaattacttcatttctttccttttgctcttccccatttccctatttctcccattgctctaagttcaaagcctccttttttttttcatttatagttgttgtgtacatattacttcttaactcagttgcctcaagttatcaggctgtgggcagaattaagtaagattctttggcagagggcacttgataggcctctattccatttcagatattgtatttgttgatgaaacttcatggacgggacctccactctctgctggctagcattctagtgtctgagccatccccaaaattgtcagacaagctataccacaacattatagggcacttcttgcctgcaaatccaaacactttcacattcttaccacaaattaattccaaaggcaccaaaacaaaggatcagattcatcatagccgtaacccttctcctggtaccaattttcagttagttcctatgatcactgctgagacaaaatatctgacaaaagcaacttaagaaaggagaggtccaccttgcacgattcgcaggctgtagtctagcatgtgagagagggcatattgaaagggctgagaaccaattgatcacattgttcccacaggcagaagcaaagagacgtgaacactgctcaagtctccttctcttatttaggcaaaaagcccagccaatggtttgtggcctcacagttcattataggtatcctctcttcagctaaacattgttggaaatatcttcacagacaaacacagaggtataatttcatagtacttccaaatctaagtgagttggcagtttaaattaatctcaacagttgaaatttggtcagtgtgaatgatattttgagtgtagtgtcaaatttcattcaccttctactaatttgtagatgatctgcacaactgttttcttatgaatatgagatattaatttttttgttttttttggggggggtgcacagggtttttctgtgtagccctggctggcctggaactcactttgtagaccaggctggcctcgaactcagagatctgcctgcctttgcctggagatattaatttttgctttgtattgtctttgtttagcctcagaatataagttaactatcttggagatgacgtgttctttctaatatattttgaaagagtttatgaagaaggttcttttctaaatgtctggtagaattcatctgtacaggtatctggtactaggatgccattcgtcaggaaatttctgattactgattcagtatctttgtttgttatttgtctctttaggttttctatttatatttgattccttcttggttccacgaccaaaataaatgtttctaggaatatacccatatttatataaattcttccatttcttctagttattcagtttgttggcatacaatttccatgatagcctattacagtcttttctgttttatacccccctcctcattttggtatttgttcactttcctaaatctagaaaatccctgctctcttttgttaatgttttttctattgcattttggtccatatatcatctatctagtatttattattcccttcattctactaactttgtacttaatttatacttgcataatttgagatactttgggttatttagttaaaatgattcttttaatgcaggcagttattagttcaaacatcactccatactatatcagcccatttgtaactttaacaaaactaagttaaagccagtagtatgtgaagaagagatgttcaggaggctacccactggctggcatgtcacatgtgccaccttgctgcttcttaacatgccatcaggtatgacgttgaacgcacgagaaagctcaagtcagctagcccagtctctttctgctcttaccgctgccagccctgctatgtcccgtcctgatgacccgcatgactctaattattatgcaggtcagctagcccagtctctttctgctcttaccgctgccagccctgctatgttccgtcctgatgacccgcatgactctaattattagcaacagttgggctctgaattacatttcagcaagaattttgaaaaagacattcaagctgtggcacccacttttgctgcacacaattaatttgttaattttcatatcccaaaattggtgattatttaagtcagttatttgctttcacatcatatttgtgaattttcccatgtgacttgctgatgtataattccattgtatgcagaaaagatatgttgactgagtttagtttccttatgtttggtaaaatgtgttgttccctagcatgtgatacatcctggaaaatataagcatgccctcaaaactgtgtaatctgttactacagaattggataatctctgttcatctatgagatgtattatctaagttaactatttccatcttgatgatctatccataaaaagctgcatattgtcaataaattatttctattcatagtgatcttttgaatttcatgatttgtttgtctaccattcttccctctatctagctttatttatatctatatctatctactatatctttctactatatctatctactatatataactatccactgtatttaactctcctgtctgtctgtctgtctgtctatctgtctatctatctatctatctatctatctatctatctatatatatatatatcacatacatacagatatatgcatgcatatggttttatatgtacatactttaaagtttagtgcatacaaagtatatcttctttttttttttaaacaagatagagacaagagagtcatttattaaaggcaacacagataagtcaagtggtattatacagacagcagaacaatgtttggaaaaggtggcatgaggaccaaaggatatttagcttataatgaagatgaggtggggataacataatgacaaagtagtgacctacagaataggaaatatgacaactggatggggagatttcccaaagttaacaagatcttattgctcaacccagaaatatcttaatttaattaatcatagttcatatcctgtcacctagcactgaccctaccaccacatgtttcaaaggtgatggagtcaacaagctcagaatggaaaaattgtctctgatcttaacatgaatagggtttgtttattgtcatccattttgtaaataaacagcattgtgcaggctttgtactgcgttagggactataagaaatggagaggtgttttgaggtctgcattttagctgcatgctaacagcatttgtagacagcatctcagttttcctggatatgaacatctattgaaggtcctgaatccatcctctgaagacaaaggaacatttataactactacatccctttattgaattaactcatgtataataacattgttacttttttagcacagattttatagtttgttttggtcagatgtaagcctggttatttctgtgcttcctagctggctggctggctagctctagtgttctctctctttctttgtctctctgtgtgttagtctctctctgtgtctctctactctgtctctctccctctttcactctcccccctctcctctccctcttcaatatcttttctgtttctgtaatgacacagcctatgtatcattaaatctaaagtgattctcatcttgaatgaatttaattgtgtcttttaaaattctgctcagctatttgtttctttattggtacatttaatctgtttacatttaaaataattgtcaatagaacatgaattacttttgccattttgttggtttctaatttttaagttttttcctcccttgctgtttctttgccatttgatgattctttaatgctataaagtctatatcttttctgtatctactattgatgttgtttctaattgctcaaaagcttacagagacataatagtccaactaaggctggtaacaactgaaattgcatacaaagctggaaagactgttctctgtattatcaggttttgctagatacttttttctgtgcagtcggtcttgctaacatcctctctgatgttgaaagaaaactactatcatacatttagatacaatactgctcatctaattatgattttaatatctcttatgttttacatatgtgtatatatatatattgagattccattgtttgacaatgaaaattaaattgccctaaaataatgatgtatttttacaatacatttctatccgttttattgcttaatgtccaaattaacacttatttttgtttccccgtttctcttttagtgacttaaaagtattttaaaagttttttatttgtttattttccgagcctttttgttttaaagtagtatttataactcccttctagcttttgtataattctcaattatgtgtctcactctatttttaacatggattttgaaattttgatttcatgttatacacacacacacacacacacatattcctcaaaatgtttagttggataaacacatttaatatatttttgtaaatggaaggtttttattttccagcttaaatttacatttatttaaagttaatgttctttattagtttgctccttgttatacagctgtgtaatatttggactacattttttctaagtatttaatttctttctttctttcattcattctttctttctttctttctttcattctttctttcttactttctttcttgggatttttatttattctgtgtttttttctgtcacattagatttactgaaatgtaatgtttatcaagttttaaaatcatattgagtattcttatttctcatatgtttgtagctattgaatgtgaatattcttaaagcagatactcttattatttgcatctatactgatgtttacagaaggaccttaataaagacttgcttaaatatcttcaatttcttacttttagattataattacaatgtttcttccttctctttcctccctgccacccgcttctctccctcattgctgcttttcaaatttataatctttttcattaattgtcattacatgcacatatgtgcatgtgtgtgcatataaatttctaaaagtaacctgctcggtctatgttatgtcacctgtatgtatgtttttagttctgagcattattattggaagagaagttggtgaagacagtgtcttctgccctcagcacctttctgttacctgcagtgttgtgtgaaggaccagggtatcatgggctttcaggttccactttggcatgtctagtgttggtgcccatgtctgcttaaacattcttaacgtagaaacttgctaaaagatatagttgatatagttacggaacttttctggaatgctttattttctcatgcttagtcatttttgttttattttcttttagtgccataaatcttagtgcttatttatttgtatgatgttagtagatgatgtggcctttgaaatctatgatagctggcagtatgttctgcccaccactggaaattgttgtaattatctctataataccattaatctaaatattttggcttgagtttaaatgtttatggattagtttactgcattgcttgctataatccagatgtctgtgtaattttgaaaaaaaaaactttttcaaattttactattatattacctttatcttttaggaagcacatggtattattttatgtgaccgacaacagcaaaatttgtatattttcatagatcaatgtttctacttgattcttattatgtaataatttcactaacttgattattattctaagtatacatttttatgagtatttctaagttggtttatctttaagacatcaaaatgcaaattgtttactgatgtagccactagagttttctgtagatactctgcaaaagactgttgtgttttggttttgtagtgaaatttctgtagctatatggtgcatgtaatacagtaaaaatcatattccagctcatacggcagtttggaaattatatgacaaattgtcttggtcttatatttacttgtggtagtataagaaaagattataaaatatttttgacttttgaataagagacgaggtatttgaagcagttgaaaattattctaaattgttgaaggcaagataagtctttactgttgattagcaaatattatttgtcagtgcttttggcatactgcaaataactcatcttccaataattcatttgagtaattaaatttagattgcaaatttttcttttcaaatgttttgactgttatctcccttcttttctattgtatcttaattggtgtggtctatataaatggacaataaattatatatctttgttatagagatcagacagcaaatagagcttggtattcatcccagacagaattatgatggaatgtatttgaaagattaaagcgctgaatttactttttttttctaattaaaggcaattaaagatttgcagacacaaataaaagacaatgaattgaggaataagtgtagaagcaggtccatttgcaggtgaaaggctgtgcctttgaagcagaaccagctgcactctcatcgcaagaataacagtttaggaagcttttctgcatgggcctgcttgatagcataatggagttataagcagcttatgcagcattcagaaaagacggagcattaatgctgaaagcagtggaggctgagaagaagtagcgctgcctcatgatgatagtgagcatggccagtgtggagctgagagaagagctttgtgctcctggaaagatgaccatttataaaacagtaaccagatagtcacatgagcctgagcaactaacttagcaaaaagagttttctttctgcccagtggtaaagatgtgaatagggtagagccaaagaattgtctggtttttgtttgttttttttttattaaactaaggaaattcctacttaaggcctcgtaatattaagacacctactactttaaatatgaagtaattgcttatatatagatgatatattgatttagagcctcatataagttactgcatcctttgctaagacaatgtgatatggggaatgaatattgaaaactagtatagtcctaaaatgtgtgatttttactgaaaacattctatgaatatgttttcaatatatatgtgttatgttaatttaaatatttgtttcttctatggaaaatgcctgtttttaaacatatttaattttactgaatatataaaacatatttttagtaattttattaatttttgataatatcatgcactatattctgatcatatgtacctccttatcgcctctgagatctgtgttctccttccttatctccctacctatccaacttccaggtttctctctgtatccaccattccctcatctctgtacattgaccagttgggagtttttatattaattgtcatcgactacaaaaagaaacctctctgatgactgttgacagatatgctgatctatgggtatatccatttaacagaataatagtattggctttattccaaatgcctataacctaattatccataggttcttggctccactagccatgccagatatggcttctatctaaaagaactggtattagattcattcagaaaattattggtgacttccataacatttatgccacggttccatcagtgggtatatctttaagtataaataatgaaattaagacatttggagaatggagctgaagattatgttaacacaataagtaacctataccccaaaatgggaaaaattatggtaacacatatatcagtatgattatcttcattgtcttcaattaacagtttatgttttcccctgtatataacttaaataatttggaaatacttgggacatttatttgcatttatttactgttataggtgcttagagattgaatccaaggcctcgtggatgctaagaacatatggagtcactatgctattctatccactcctattgctttatcggcatacccagaatcaaatgcaagcttaatactgtacattttgattttaaaaaaatctaggttatctagtttagataactaaattcatgtactcttaatacaagggacttctgtgtattacagtttttcagccattatgggtaaaagcttctgtcttaatgccgtaggagtatcaatttcatatatatgtgaagaccacatctgaactataacattaggaatgggaaatcaggaggattgttgccatgatttcaagaacaacatggtttacttaagaagaaagacactgtcataaaataaaatgttcaagtgtttaaaggttcttgtccattctagaaaaatatagcctgagttggaagaccttagacgaggctttgtacgtgttgtcaatgctacctgctttgtgcagtgtatgctgttgtgtgtcatggacaggaaggtgaatggggacctaatgtcagatgtgctgtttggaaatgtgccagccgtatcattttaataacatctactataaatacacatttagatgtttacatccacctcagtgataatctagaagtttgttctgtaaaagattacaggtgggaaaataaccaatggtttcatggcacctaagctgaaaggtaaattcttactgttacattgcctctgatactgatcagatgggtgttacgacagaacattatgtaaaataatatacatgattgatgagtcatgttgtctgaaaccatcattcatacttattttctctttttaccttgggattgttataaagcatgtggaaggtgaatagaagtgtctttctgtctttctgctcatctctgaaattttcacatttatttttagattttcctatgcttggtaaccttgagtggagaactttgtcgccatgttcatcgctctgaactgtctatattgcagcaggaataatgacaagaacaacttgactgttgagatgtgaaatcacaatgaacacttgccaagtttttttccatctccttttttttcagcaaaattaaatgttgctaatttaaagtgggtcagaatcatgtttttctgcaaattattttttcctttatttaaatttagaacatttgatatacttttttttttacaattgactcatttccaaatcattaaaccccatcaacaaataatagttattaagtttctgctgttagatgcagagcgggtgcattacagcagggtgagccacacacttgtcttcctgtaaaaactaacacatggctctgtagccagagaagcacttgtatgtgagtaatgaactccaccgtagaacttctccttcattactgtccatttacctcactcctctgccatttctacttgtaaaaatctatatgaaagtttaaaggtacttttgaatcattagtagacacattaagaagcagatttatctcacattaaagttttatggtatactttagtttagatcaactgctttcagattcacttgcatgtgagggaaatgaggatatttggagtgagtcacggtgtcatttaggtaagggagatgcacatgagctctggaaatggaccaatgagaggagaggggctaagtgggtctaggcgagcagagtgagctcagaatcatgggttacagcttttggatttaacatgactcccacttattttctttaagagtgtttttaataatacttttgttgtaaaatctattaccccctcccacccaaggctgagtaatgtttcttttgtggcttattagtagggtcaccagatggtataccaaaaccaaaagttgtatgacactaactcattgttgcttgtttcttggctatgaagtatggtaaagaagattgtgtcaatctaaatgtcgctgttttctgccatgtttagtcatgtctatgtgtgctctagtgaagggaatgaaaataaaggatgtattttgttctaatgaattttggtaagagaaaggcaattgtttataggttctacttttagtctcagaaaaaaaataacagcaaatatttcttaaactaatcctttgaatattgaatatccacagtataataaatttatcaggaattattttgaaatttctaaaacaaagttaactttacaaaattatatgataatataattatgtatgcattatttatcagtgcctttatttccaaaaggtgcacttactgtaaatatcttagtctttaaaaaattaaagttgtaattttgctttgatattctttgcacatcaaatcaagatgtttgtcagcatcttccaaaatgagtaaaaggacattgatttggagtgacgtttaaactaatctcaaccgtgaataagcatgtagttctctgtcatgttttactttatgtaaacattcttagacattttataggtgactgtgaattttacattatacataaacataactcactgtctgaaactatttctttccaggtaaacaggattataaaaaaaccaaacctattttacgagcaaccaaattaaaagcagaagcaaagaaaacagcaataggcataaaggtatacttctgtttcataaatttataatttgatgtgtgtatgcccgttcattttgcacattttatacaactgaattagttgtgtaaaattattagttttgaattctggacatcttaagctaggagggatttcaatatagcatcaaaaatgaagggttttggaaataatttacttattttaaaacatctttgccatcttgaaattttgagggctctcaaaaggtatagttaaagtatataacataaacagtacatagaaaataagttattcctaaagttatcattctagctgttataattattgttcaaacatttcagtcatgtctgtgggattcgtcagattcttgaacttttagtaaatttccctacatcatctatattactgttgtaatattgctgcctttctattgtctctagtactctgtataatgaaattctaatgacattctcaaacttgtccttttggcaaaccagtgtttatctgcttatgtgggataaatgcaactgagaatgatgtcagcagatcctagttcactgtgctgacaaatccaaagttactttcactattattcccatcaaatgttcaccaacgatttaggatgaagtaagctgggcaggagaaggcatttggaaccagtgctaccaagtgtgtaaaggaaaaatgaccaatacaaatattttatttaaatattaaactgttaaaaggagatttgggttttcatctggcagataaaaaatcaatttttctaagttatagcttataacaaatgccaaggtattaccagcaagctgtaacagctgttcagctgccagatgatatatttggttatcttccagaacttgctattatgatcatgaagcactgcctgccttttgcttctgattgctgatgttgatccagcctcactgagtgatgcgctgtttgcacagcacaatctcctcagttgctgttctgatataggttttaatgataaaataattttttatttaaaagaaagacttcttatttttttcaaatatacatgatgttgcattcatttgtaaaatacactatggcatgaatttttaaaaagcaatgcttagcatttattttctgtttggtcccatagtggtttgaatcttatagtaggaacaattttaacactgtccccaaaggaagcagttaatatttggtttttttttttgtttcataatatactaggcatttttaaaggaagtgataatgtaacaaaatatatttctaacataatttaatgaatagttatatattaaaatttatgaaagaattcagccatttatagatttatgtaccacatttttatacatatcccttatttagtttgctgctatacttttggtttgcttagaagaaattattgtgttctggttataagttaaagaccagtacatactactattagctaatttatgctttaaaaactatgaaaaatgaattttcttatctttgtttcacaatataaagtatgtactgaaagtatctaatatagatgcatattttaataatctaacaaatcattctgagtgctaagtctagagaatcacaaactatgatttgccttgaataaatatgtctgaggccattgctgtgatgggaaaagtttaagaatcagaaccatgaaggtgtcttgcatttcaaatctaacatagcgattagtttgtctgtcaaactttgattgccttgtcattttggcataggattttaactaacagagtttccttcagcaattgttttttaatgctttttaatttccctagtgagtgattttatccatattgataatgtcagagaaacaaccgaggactaatgaacatcaaacacgtttgactcttacctagttgatacgcgatgaccataatgtcatggtactactttgctacttttgagtgagttatgtccacagaaaagataaagagtttcacagagtagaaaaagaacatcaatggctaccaaactaagcatataatgaaaagcctgcgatctcaccccttgtgaccctcaccgttgctgggagtgatctgattaagcctgaaaagctatgtttggagatggagactctcagtcacctcacaggtgtccacggagctgacgagtacagggagagcaagataaagccttgagtttgccatgccaaaggcatctgtgactattaagtggttacagacttaaactgtgtctagtttagataagaagacttcccatgaatatttgtcagggccttccctacttcagctgacctcgcattgtgcagccattgcaatttgatacaaagtgctattggatttgctatggagttagtattgtggatattcaggactgaaagtcttgcagtcatcacacacttttaagatgcttactatcaaagccacgtaggtattacttgatccagtgtttcttagaaatctctataagctattacaatgttgtggaatctctggaaggagacgagtaagacatgattgtcttgaaaagagtgcacaggaatccattgaatcagcatgttaacaagtgtactgagccttgagataggaggagttgggaagtagggcatttaccttgtaaggtttctggtgccttgttgtaaatgtatgactgagtaatagaaaatattttggaggaaaagtagtttcagcttaatacatgaatgtgtcatattaagtagaattcacttgtaatctaaaaagcactcttactttttatacttcctatgcgtgactcagtatcataatttaagacacacagaggccgagcagcactgaaagggatttccacagccaatgttcatacttggttgttttcaaatagaagattaatttttccatcattaaaattaattttatatttttcttttattaaaaataaaattttatatagtatattctgattatggattcccctcccacgaatcttctgagctcctccacacctccctcccattcaaacccacacacttttgtctcttgctagtagccaaataataataataataataataataataataataataataaaccaaacacattgtaatagggccaaactaataaggagaagaaaaatagccaaagaaaaatcatgagaaataaacacataaatgcagagacacatgtcggtacatatcagtaaaattcttgtgtgagtacacttgtatagagtacagatacctgtgtttcccaacatgaaaaaggaagcaaatcttcatttgctaattttaaaagtctattagaaaaacatagtcatcacaaaggaataaggatagaaaacttagcttctccccataaataaactcttcagtgtcaggcagatgctgccagcatccctttgggatgaacagcttgaaatgttgtttgttctttttgttatttcgggttcaaatctgaatagcagccaagacttggaaagggagtcatatgccgacaggtgtctaaggttatggtcacagcctccagcattctcaaaggttaattttgagatttgatcatggcatggaatttcaaaacagtcacccgccatggtgttgcttcagtgaaaatgcattttggaggaaactgtgacattgcccacagtgatctttaactcatctgcatgtcacaaactgaccagagagtgttaaaggatagggacctttctatacatacatatactctctatacatactctctgctttctgcagtcaagagtcttagtacctgtgagtatcctgaactcatttaatgaacaaatagcaggttgccttaaggacagtggatggaaaagcagtcattaagattgattaccagtaagatgagaaacaaggtcttgagtcaagaataaaaacatcattctttccttgagcttatgtaagcgatggctgctgttgtccactttacagagcagatggggttggtggctgtgacacttgtttattacatcctcttaaaattagtggccattcacccagatgggcctgggagcacagctgtggacaggagaggatcaatgaaacctgtctgatgcctctatgcccttttgagatgtcaaagtggtccagctgtaacaatgaaaatttcactttcatttgacattacaatgatgaatgatattttaaaaatcaagtcacacaaaatttgttgacacaggtttttttattaatatttattttcatagtttggatatttaaataaatgtaatcaagaagctgaaaatctgtacataatgtctattcatattttttatgttcacttgaaatttcatgttgaatatacagccaatccattttaatatttttaaagtttattaggtggcacatgttgaattatttattttacattcatatgaaatgtaaaatatattcatacaaatgcaaatgaattgcttccccatgaaacaaagcaatataagcagtgtaatacaaaggtgaaaatcagtaagtattctagagccttctgggtcatggactgactctgttctttcttcctgtgcagtaaaaataacatgttaataataagaggttaatttacagcacgcacacacacacacagatactactattttgaaggaaatgtatctttattgtatattaaattgtatccattatttatttaatactaatgattaataaaattaacatcaaaataccaaaggtagcaaataatccctgtcttttaaggtaaagtgaatggcactagtttatgtcttaagagcttagtgttcacttttgttccccactctgtaatttacagatttcggggttctataaaggcagaatgttggcacaaacctacaatccctgaacttgggctgcactctgagggaggaagaacagggcctggagggcagagtcagccatttaccaagttagaggttggcttaccttaaaaacaaaacaacaaagaagggtgtggatgggaggaagcagaggaaaagaaagacaaagcttaataacggtgaaagagtaaagcagttgctgagtgtggaggtgagcaggagggatataaggacaggcgagggaagggatataagcagttgctgagtgtggaggtgagcaggagggatataaggacaggcgagggaaggggagagggaagaaagatagtttataattctatagtaacctcaaaataagtgtgaatgattatgcttgtatagcatctacttcttagaatcaattatcatgggagtttcttcccaatacacaatagtgataatttgtaaaatatcttctggcaagttgcatcactaatggataacataatagttaaaagaacagttacatgtattcagtctaagaacaactggactatataagcacaaactccactgatagcacttaaaattttgatgataaaattaagaaaacatattaaaacaatgaatttaaactttactcctagaaaaatcataatagaaatgccacacacacttatgtgtttgctattgcagtacatcttgttgatgaaaaatagattactgattgatacctattgagctgacattatctatcctagaccatggggtaagttatgttgctattgtatgtgctgaagccgacctctcttcgtcagctcaagtctgctgtgttctcttctccaggaagttggcctcatgcttgcagctatcctggccctcctactggctttctatgccttcttttatctccgactgtccacgaatattgactctgatctggacctggatgaagattagctaaacaacaatcaaaaaaggataggaaataagtctgataagagcatctttggggacaaacacattaccaatttccaaaactagaacagttggaaaacgtgcttcttgctactgtcagtttgcagaaatatctttgtgcttagtggcatagaatatcaaaagaagaccttacccagcaatctaggatcatgtatgctacttgatactttataaatctctctgtcctggcagatatcctattcatggtacagttaaataagatggtaatgtatttttttccagattgtgttccagtgtacatatatgactccatcagttacaaatcactaaatctattatatcctacatatattgtaataaaatatgtattgccatttgcagaagcatactcaaaatcatattcagaatccaagaaggaacagaaagccataggaaattgctatttaaaaggaagtgtgctttctttccagacatatttcatgtcattagggagactatctgcacatacaggcacagtaatctttttcttccttgccaactgttagtgcacatgtgctgcgtcagaaatggcacctggatgacagaagctcaaagagtcacatatgtccctaaagtggagttcctcgtctcctgggctgcctgaactggtgtaaatagaaagttcagctgatcttgattttaattaacttattacaccattaatataaagttggaattctatattaattatgttgttctggctgcctgcagtatcagtttgccctcttgttagggagcagtgtaacaatctgccatttaattgtgcagggttttttacactgcagaattagcaggagtgtatgtacacagaattttcttggtttgtctctcacatttgagcattacaaagttttttttaattgcattttgtctcttgtgaattaattaagactgtagagaaaaataaataatagaaaaatacatgtca

SEQ ID NO: 129 - DNA, 5074 bp, Mus musculus
gggaggcaagccggcactggtgcgacgcggcccgacaggtaaggaccaccaacagtcggagatgggcagatgcgcggacgccatgggaaggcgaggaggggaccggaggggcggcgggttggagggggactccggagtgaggatggggggcagagtgggagggacgaaggttcctttcagcttggtggaccaggggccggcggctgacccaaccctatgcagcacctgccggcacccaaatgcagacgcagacactatggagaaacatcaagcggagagccgagcccccgaccccatttcccgaggctgagcagctcctgcgccatcctttcaagaaagtggggagaaggtgctggcgtctcaggagacgcgccccctcatttctcccctgtccgcagagcggtgactcagcctagatggccccgactgactgagccagggcgcccacgacagacagacgcacacctcggccctgcggctttcttgggacccccgtcctgcatgctccacacacgccccttccctgtcccgtcccttcccgtccggtcccgtcccgtcccatcggactgtcccactgagctcaggacttcccgcctctgcaagcggagctgtcctctcaggaccaggcgggggcggggcttcgatcaggccgccccgccctacccccaccgctccccaccgccggaaatgcctccccgctgggacatctttgacgtcacaggactctgacgtcacggtcgcgtgtctgtccgcgcgcgcttgggaggaggtgggggggcctgagaagcagcagcactctcaactgcgggcgacgggatatccccgcccgggcagcgcgccggcaccttggctctagactgcttactgcccgggccgccttcagtaacagtctccagtcacggccaccgacgcctggccccgccccaggaccgccgacccccggcccctccacgcctccctgcgccgctgtccgcggtgctgatgcagtgcaagcgcctccctcgggcacgcctgttcaaggtccctgtgggttgcggtgggcgcaggccccgcagacactcgcgccacccccgccgcccgcggtgctgacgtcagcctgcaagccccgcccccgcgtctccagggcaaccgtggctttcgattgttactgtgggaaccggaggtaacagtctacagccatggtcgccccgcagcacgcccacgctccccaccactcccgagttctgccagcctgggtttgggcagatacagagcaagaggaggcggggcggcgacgcaacattcgatgtgtctgcggaggtggcaagaggtgtgctcagaaaggcggcctttcaggctgctgtgcatctacctcggtgcagaagcaagatccgcggagtgtctgaacatcctcctcagagactctcctgtcttcctagtcgaggtatcgctgcctaaggtggcgagaaaatgggtggttctgcgataaggattcttatctcatgagtggtgaaccgatgggatcaggagtcctgtgagaaggaagaagtcacttttgccagcagaaagctgaagggggaggagaaggaagttttatcacacctttcttccagaaaaccctaggtgagcaggtagaggggaaagggcaaagaatccctttcctgatagagccataactctgtcccccaactttctcctgggccatcattaaaagggtccttaacacagcaagaagctggcaggctagtgaaattcacctggcccctaattcattgtctgaaggtatcagccagcagtcttccctcaactggtctgtaagtaatgcatcccaacttgagatcttcaaacgtgcccccaaaaggagtacaaccacagagactgcacgtaaatactctctgtggctagggctgttgagagactctgtctgatagggtagaaatcctgagtgtaatcaagatgcagaaaacaaatagcagggataatttgaaaagaggacagccggacagtggtggcgcacgcctttattcccagcactcgggaggcagagacaggcagatttctgagttcgaggccagcctggtctacaaagtgagttccaggacagccagggctatacagagaagccctgtcgtctcgaaaaaaaccaaaaaaaaaaaaaaaaaaaaaaaaaaaaaaaaaaagaaaaaagaaaaaaagaaaagaggaccttttgcagatggaacccatcagaagatgtggttagaaggttgactatataatgctttgagtgttcgttgtcctagaaaacatttagtgtaaaccatgccttctttcccaactttacacattagaaagcagaagcccaggttgggcatttagcctatagagagcggtagtttttgcttgctttttactggacagcagaaagaccaaccaaaaccaggagctgcagtgtatacctgcagtcccagttgctcaggagcctagacaataaatatgagataaatatgagattcgtgtctcaaaggggggggggatgatgacaacagacaagaatatggggcttttgagtctgaatcatccaattttgagtaaggtacttagcctttctgtgcctgtttcctcaattgtaagactcagttattaggttaatgacagtactttttcatgaaattagacaatggggggggggggggacaggggtgctgggcatagagctcagtagtaggtctgtgcttagcatgcctaaggtcctgggtttgatcccagcaccaaaaataaatgagttaggctatggtagagcatgctctgaataccagatcttgggagacagagataagtggatttctgtgagttcaaggataaccagaacttccgtgagacccccgtctcaaaaataagttagatgacaggcttctatttgtctcattgtctggtatagttaattctcaataaatgttatttctacctctggaccttatccgcctgggctgtacataaatgttagagcattgattcctcggggggagggggcttctttttctccccagagggttttgagtcccactagaggctctttcctaataccacatatttaccagagacttaaaattctacccaagactgtagtttgcaaatagctacatcaggaatgaccaggggcagacaaataggtctatagttttctctaggaactccaggtttaacaagtgttccttgtgtaggtggcccccagggatgtgcatgtggtagttcattccgcatggtgggaagtaactctccacttgttgggactcggaactgttctgattcttgggagggctcttcacttcagacatgggcccttctgtgtgttccacctaatagagctctgcttgaaccctctcctccctttttcctggtagagccagggcctacagaccactcacatgaacctttgcctttatttatagggctaccaagtacaggtcatcctgtcccccagcttggagctgacacagggggctgcctatgactgccagtggtctgagtactaacttgcaaacccaccaattagttacagaaaagcaaatagaccaaagggtttataaaattccacgtgttcaatctccttttgtcaaggaagcaatcactgtaaggcaagaacaaggcacagagaccaatcccccacccaagctgttaaaaagggatctcaaatcagtacatgggactttggggtataattccagtctatcctttcgtgaaattttaaaatgtttagtgtgtatgagatggcatgtgttagctagcagtcagtgcctttaacctgctgagccatctcactgtcttttggtggaaatcttgagccctaaagaagccagaggcctttgtaactgagtcagacttctatgtaagtggagttcggggcaagagaatacatggcaaggctctgccttggtcatctaacagaggttacagagagcgttcctgtgtagccctctctgtcctggaactccatctgtagactaggataagctcagtctcagatctgcctgtctctgccagtgctgggatgaaaggcacgtgccaccactaactggttgtttttagactagactgtcctctacctctgcctgcatgtaccaccatggccattgggtcattgactttttaaacacatatcatgtacaaccctgggacctgggactagagcctctggaactaagagctatagatgtttgtgagctacattgtggatgctggagcccgaacctgggtcctttgaaaaagcagcccatgtccttaaccacagaaccatttctctgatgtataccttgaaacacttgtgtgtcaagaacatataactctgggtataagaatgacttgggagtaactggccaactccaactcctgctcagtgactaagctccctagaagatattgtggtgtgggactaggtaagtaccttgtgatatcttggaaaaactgtctttcagaggcagaagtcagaaagcagcgtgcctatgtgtgtggcaagattgggcactggaagtgagaagaaaaatggcaagaagttaagctgagcaggctacttaagctttggctttctcaacatatcaataattagcatcatcaattatgaatagcagtaatctcagaaaccctgaagatggcttcattaggaaaaggcaggttactctgtgctgtctttggcctctacccaacatatggtactacccaagtcttcaagctcagagttcagagggggatggaacagttatggaagagaaagcaatggccaagccagggaccaggatgtaggaaacctaaaagcagatggagccaagcagagccttgccaagtgttttctttccccaaactcctcaaacgtaaaactttctgattctaagtgaccaagatatctagcttcttcagtctgggacttaaacttccacaaaaggatggtgacatggctcagcaggtagaggcatgacttgccaagtcaaatgatcagagctcagaaagaacccacatggttgaatcaactccccgcacttatcctctgatctccacaagtctgcacccatacacacaataagccgaatttaaagatacaaaacaataaatgacttccacc

SEQ ID NO: 130 - DNA, 4744 bp, Mus musculus
tcggggctgctgctgctctcgggtcgccgccgtcgctccttctcctccgccgccgcctcctgacagccgccgccaccgccgccgtccgaacttgaagttgccggcgcgcccgtggccgccgccgccaccgccgcagcggaggtcgcagctgctgcttggggccccttctcggcgttcttgtccccggggtagtcggaggaagcgaggttttccggggtgccgtaagccgtctcgaaaaactggtcgaaagcctgtggcagaacgccgttcctgcccaccgtgctatagaaattggacgagacggcgggggtggggtggtggtagacgttggccgagctcttggccagcacgtcgccaggcacgccggccgcgctgggcgcctgcagacagtctctgtgcacgagctcctccgcggagtagcagtgggccagattgccgcgggggtgccatttagtggcgggctcaatggcgtactctctgaaggtcacttcgcgcacgggttggacctggggcaggttggaggagtaggagtatgtcattgggcgcgaagacggggtctggggcaaaaaagaagggaggctggagaaatctggacccgagacgtagtaagtacaacttggcaaatacatgttagaggagcagggaccacgctcatcaaaatccatcattgggctaccttgggctctccgcagtagccgagcttaacatgattctccactgcagctgcctctttgaagcggatccgtgaagtagaaatttggagacgtaagctgacgtggaaatctatccccatccttagcagggaggtgctggtcatgtgacccgatgttgaaattgacaagccgcgagctagtcccggcttttttttttttttaacccccctccctttccttttttcccctcccctccctcctcggcttcctttctttgtagccacctcaggggaagcaacagatcgtcactcggtgttctcaccgaaagcacgtaatcgccggtgtaactcatgttggctggggggcctccccgcgcgcagaaaggctggggtgcgcccccgggcagctctcctttgctcagctacatggtcctggtccacgagtgctctgagggcggcaagagagcgcaactcctgacgcctccccccactccccggtgggtgagggatactctctgggctgggggtggccaggtgaaagcccggaattgtatagcttcaggtcccggagtctgttatccgaaggcttacgttcagcaccttcttcgcagcccccctcccacaggtttgctctgggaagccccccagcctcagaccctggctggaccccatttggggccaggcttcgccggcacggatgtgccggcctcgtggcttgtccgatttgcacggtgacttgattacacgctctcattcacggtcacttccgaagcgctttagtgccttccgtccccaaaccgccaacaggcaaagcggcttccctccgcggtttgtcaataatccgcgctgtccggaagggccttcgtcttacccgggttccaccttccctgtatctttctgcttacttccttaccccacaccctgtccttgaaggaaccccttctcctcgctgcctgtaggggttcggagtgactcctcagagccagaggcacttctgctcaccggtccgcaagctgcctggtctgctgaagctgacgaatcgggaaaccatgcaattgaggcgaaccttgggctgttttagaggcgctgaggagccttctcctgggtatgctgcaccttggggtgggggtgggggggggcaccaggctgcttgcagggcttcagagctgtgagggaaaaggagggtggcaaagagggagtactggcccaaggagtcctggctaagaaaagagtctcttctttcttgcaaaacctaagagtgaaagcaaaggatattcaaggcagaaattgagacagctcccatcattcttgttctttagcccacaggagaagcacaatgccaaagaaaagagagatgctctcctgcctgcctgcaccttgggccacagagatgcctcaaaagggcaaggcttgctgtacagatagataattctaaagaggccttggctgctaagttgcatttagctttctcccgaggaggaaatggggattaagaagataaaataacgactgccattctgcaagaccaaagatgtacttaggggaaaatgaaagagaaaaaagagggcgcaggacagctaggcaaattgagcagagatggggctccagaccaggggtctcaccacaactcccttcttggaaggtgctagggtgtcacaacagtcaaaagtgaaaaatgaaaacctttttccctttcctcattcaggaaatagttaaaggtatttacatatcttggggagatttagagtataaacgctaagatctttggtatttaagtgtcaacatcgatttatttatttattgctgagctgactgtaactgactcaataacaaatttaatcatgtattgctctggaaaagaactactctcgttatgtattttctccaaataatgacccaccattgcatatgaatgcccactgtaaatatcaataatatcaagtaattactgtgtagtggagtaaactaatttattagcattaatgtttatgtggctccaacccccctctcttttacaagggctgcttatcacaaatcaagctactcggacacattggtttaatgaactctttattcaggatttgctgcaggaactttcatgccccttgaaatccctgagagctgaacttgaaattatttgtgcatcttcagcttgacatatttgttcactgtggcttcatagatgactgccacggcgtttgcatgagattcaggagggagagagggtgttgggaaagggtagcttcaggtcttctaaagctgaggatcacaacgacaggatggtcctgcagcaaaaacttctatttctatcagttaccaaggaggcaagcatatctgtctcttcacggttgtctttctggagatccggatagaaaagggaggtgggcttgcaaaaggccttacaagaacagctctctgggttggttttgctacctcaaactttcttcagcagcccacccagtcctcaataccccttccctcgaacaaaaggaatgcatgaagggtttcagtgactttgctataacaaaggcgccaccattgcagggctcgccccgcccctgggtgaaggcaaacaaattcttgcacttgcattagggcttttaagaccataattgaacccgggggcgtctaggagaaccgaaaacagttctagacagacctgtggttttatagcagttttggcagtcaacttcagcttgtgcctgagcagtggggcccgaggtggctcagccgcgggggacgccaggccgcctcccctgactacatggcagcttctctcataattaactcgacttcccgggatgccagggagaaggggtacccacagaaaggtcggtgcggcactgtgcagtgttctgcacagccagtgcttcctaggttctcggggagggctaattgaataggagccggcaggtctgtatcccatgggtgtcagcaggagacaagacaaattcccgagcaaagactgcggaagaagaaggagccccacagaggctgacagagcaattcgacaggctctacagaagaggggtgcccagaggggcatcctcgaagggagcgtgtgggggcgctgcgatgaagatggatgagggaaaggcttttgatgggggtgggggggaggcggatggcctggagatgccgattgcgtttagttctcttaagcagagagaagaaatggatgctcagatccctaaggctgctcaatagtagccgctttgcctgcttggccctggtagtgtgaatgttcttcagtcatgcatcagggtacaaggtgcgagcagccctgaggttcggaccaaatctggaggaagaaagggaggtctctgagggtccttggttttcactttgctttgagcttaactggttctttggctttccaggaggcccaaggttgatttcagcccaccaggatctggggaagacccaactagggataagagcacaccaaaaggccaagtccgagttccatttctagaagaggcggcttccggcaaggctatgacattggccctggacattggtttcccaggagctgctttttctcaagaactccacagcacggggctgtctccagaaaacgctcttcaacgtttatttcttttaatcgtcgcccggagccctaaggcggctaatgcaagaggccaaaaatgtttggaggaagaaaaacaaaggcaggaagtggccgcggcctgacggtgcgtgtgtgtctgtaaagaagggagggagccggttcaacctcccctcgttttcccgaacttcaaggtctaggcagacccccttagggccttgccgaggctcgcccccacacccccagcggcgcagcatttggaggtggccaacgatttaagcctcggtcgggctgaaaggagatttgatcggcagaacaaaccaacccttttcggaggtttcttttgatttggtcctaaagggtatatgctagtgtccacagcggctggggtggctgctgttttcctcccgccgggctaaaagtaccaagaagggagggagggagagagattcaggcaccttgcgctggctgcactctccttctgagatagaataccagaataaagtgtattcaggtgcctctgc

SEQ ID NO: 131 - DNA, 3043 bp, Mus musculus
agttggtattttactatacagtttgggtcccttgtccaaaaattagaaattctctgaagtctgaaacgttagtattgacaggaacttaaactgcattgctggatatggtgatatatactctgagccagatatgctggtgtatactaccagccattttggagtcttgatggcatcaggatcaccaggaagttgggtgtggtggcatgattacaagcaagcaaacaaaacaaaccaacttggatagtaaatgagaggcacattccttagcctcaaaaaaaaaaaaaagttgagttgattttaggggtggacctcagtgatagaactcatgctcagtacactcagcctgtgttcagtcctcagtgatagaactcatgctcagtacactcagcccgtgttcagtcctcagtgatagaactcatgctcagtacactcagcctgtgttcagtcctcagcgatagaactcatgctcagtacactcagcccgtgttcagtcctcagtgctagaactcatgcttagtacactcagcctgtgttcagtcctcagtgctagaactcatgcttagtacactcagcctgtgttcagtcctcagtgctagaactcatgcttagtacactcagcccgtgttcagtcctcagtgatagagctcatgctcagtacactcagcccgtgttcagtcctcagtgatagaactcatgctcagtacactcagcccgtgttcagtcctcagtgatagaactcatgctcagtacactcagcctgtgttcagtcctcagtgctagaactcatgcttagtacactcagcccgtgttcagtcctcagtgatagaactcatgctcagtacactcagcctgtgttcagtcctcagtgatagaactcatgctcagtacactcagaacctgtgttcagtcctcagtgatagaactcatgctcagtacactcagcccgtgttcagtcctcagtgatagaactcatgcttagtacactcagcctgtgttcagtcctcagcgatagaactcatgctcagtacactcagcctgtgttcagtcctcagtgatagaactcatgctcagtacactcagcccgtgttcagtcctcagtgatagaactcatgcttagtacactcagcccgtgttcagtcctcagtgatagaactcatgcttagtacactcagcctgtgttcagtcctcagtgctggttgccagtgaagttttagattttggagaatttaaatattttttttttttttagatcagggatttttaaccactaaagtgttaaagagaatattctacacaaacatttctaaaacctgaatctcctttggtcctcaacactttagaattttgcttaaggaacacatggtctgtgtttgcttctcatgttatctgtttattgctgttagtacatcttactcttcaatacctatgaaaacatttgcctcctcttttgattctcttaacttctccaaacatccaagataatttatttattaattaggcttaatgttaagtgctctctacgttgaaataattagaaaattatatcattttataaccaccaataataattcaggtaaagagtgtcaggggtgctaaaaccactgcatcaaagatattcactgacttgaagtatctttgctcggattatttagttataaatggagaaatatggaagcagaccaaaaatcccagcagtcactgctgaggcagttaattaataacatgagcagtgagacagcctggcacttgcaggaccacagcgcagggtctcagcgccatgtgctgctctccctgagaatggagggattgcatttggagacaaggaaaccctctagtgattgcatggtgtatgcaacttaggtctcataaaagccatgtcctaaagaacagagaggcaagtctgtagtatggacacagttggtatttgctgtataatattgacacagtaataatagctgagggaaagttaaaacaaggactgatggacatttaagtataaactgtatattgaagaagttcaactttgatctcttagatttgctgatgttttagttgtgtagcaaatgtgcttgtatttagaggcttcatgccgaaggatttagggatgaagtaatgactgctgcctgctttgtggcttttttttttttttagtaaaaatataatttataaacagtaatagagtagatatatgaaaatattaagttaatgaatctaggaaatgagtgttctgtaatattcaagttcaaaatagcagaaggttttggttttttttcaggggatggggatatttcatcttaaatttaagcacatggtatatgacccagttttctgctctttgtatacttatggaccatatataccacttagagtatgtagaacaaaaatctcagtacgtctatcatcaacactaatttgtccttttgtttctaaagttttctttagagtcaatcacgatacatctagatggtaagctatttttatctgttcatgcactaaagtttatactgatccattttatagtaatatttatttaattaattaatacagtgtataaagggcttcatgtaattttattttgtaatgcaactaagcctaatattttagagtctcctttttatttggaaaaattatgttttattaatgcaattcttaagaatagtatagagtaagccgggcagtggtggcgcacgcctttaatcccagcactcgggaggcagaggcaggcggatttctgagtttgaggccagcctggtctacagagtgagattcaggacagccagggctacacagagaaaccctgtcttgaaaaacaaaacaaaacaaaacaaaaaaaaaaaaaaacaacaacaaaaaagtaagaatagtatagagtatagtaaattattaattttaagcttatatttcctccattttttggtttgtcaccttaaaaatttgttcctttttcatttttctctgtttccctctaggaccagaaagtgatcctgtagacattattttaaatacctctgatctaactaaatgtgaatggtgtaatgtccgg

SEQ ID NO: 132 - DNA, 10249 bp, Mus musculus
ggagctcggcccgggctgttcgctgggccgggaggcggcagcgcccccgggcccccctagttcggactattcattcaagttcctggggccctgcgcccgattcggaggtggcacccgccgccctccctgcctctgtgcccccgtttccagccaccgcgcggaaatttaggtcaaggacgccgggagcacacccacaccctgcgctcccagggcagtcctcgagaaccccgggatctggggggcttgcggatggaggagaccctcctgcacgaacaccagccacaagttttattttcccttcgcgcggcaagttctctggctcccgctccacactggcacgtcctgcacggctccccgcccttccccgccagaggtacggagccgtgcccgcgaaggttatttcggaactttgagaaactgacgcgatagataacagggggcgaggaagcaaccagacagggcttgcgccttactcagaccgcgatttgaaaatataataaagtgggcttgtaggggtcaaggtcaaatgattggggttcaaagcaaatgttcatggagattgagtagcagtttgggagtatcccgagggtggttaagataggtgcttatttcagaaaatccctcgaccattcatccgttatctaatttatttatgtttaaagttactagggcttcctctgtaaagagtgtaagcgccaggagtgaaatggctctctatctcccaagacctgcggtaggtcttggagataacaaagcaccttacccctagtttttggaactaggagcctcacagattctgacacttagtaggtgtttggtaaaagttccctttctcccctggcaaagtgtaaactccaaaggattggtgactgtagcttcccgggggaatcgcacacttcgtattccaggctggccagattcaggctgtattcaatttatggagtatttaaaacagtacggatacaattatccttattgttttaaattattacaataaaccaagttaatatggcatgaggggcaacataaagttgtggttcatcaaatccctgggttaatgttaagcatgcattgatgcacaattaacactttcccattaattttcataggattaggagacaatggaattcactcatcaccaaaactatgccgtgtccattgtgggtttggagacatttggaaaaatctcaacacagccaaagcttttgagtggtcagactgtcaatctctctgtcccctaaactggggtagtgcctctctgacagcatggatgggcggagcatttgtagtgaacaatgtaacaatgtcaaagtccctttttaaaattgtgtacttacatggactgtgtttattataaattgtgaatatgatttttagaaggcacttcataagacttcagaccacaaaccctgctgtttcccaacactccaaacaaactgatttttgaatcatctgggttcccatgtgttaaagagctgcatgtttttatgatggtaattgtttttttgcgattattctcaatcacaaagtacaggcaacacagctaattggattatattttggatttttaccgcagaaccacagatcatcagagctagaaaggcctttctttacccggctccttccttgaatatgggagtcccaaaggtgccaggctgtcaggccgccttcccaccccaaccagttaatacctaaaaggggctctggccatggttcagtgccctttgactctgtagtgtgctgtttgttgttcctcgataggcagaagtcagtggctaccttcctgatggagacttgaacaaactgttaagtggtgagctgggaggagacctgatggggcggggccccgagcactgcagtgtccaagccagagactgataaaggactaaaggagaaggctactacgtcactgcactgtttttcttaaggttggtattgttggagttggagtcttgcaatgcaagaacccagacaggccttgaactggagagagcatcctgacactggccacaccaccaccaccaccaagttttatttttccttcgcagattgtgttgttttgttgagatggtgtctcatgcggcccaggctgatggtgaactccatagattgcggaggatcacggccttgaacttctgacattcttgcctctgctgttgcaattgtagcttggggccaccgtgccaggtttgcagtgctggagatcaacccctaggctcccagtgtcgcagggaagcttccaccaactgagccacacacccagccttcaggaggttgttttgcttgtcccatctcactgcactcaccacatacctaggtggcaacactctgctacaggccttcttcccctgctccctggttctgagatttgaccgatgtacagattgtagggtgaccatcaagataaacatgtgggacagtttcattgtccaaagcaaacacacacacacacacacacaaaaaaaaaccctccccctaccgccctttgcactaggattagtaagggttgatgattcagtgtttcttctccagctcgctcagctcactcgctcgctcagggtaccagtggtggtgctgtataactcacactgccttgaggactcgcccccacccccaccccattctgctcttgcccacgctctcctgggctctctggcccctggccacttttccttttctatctctgggtcctcccttcgtctctacttttcctttaaacattggtgtgcttcctctgcctgatgctctcctccagctaccccctctctggatgaccttcctagcaggatgagtttaaataccacccacatgctgatgctgctccaaatctcctccggccctgaccttgcccgagttccaggctctgcacagtatcctttctctatacatctctgtttacatttcctagaggtattccggatgtggacgcaacactgccaaagccacacacatactattctcccctacatttgaacctctttttggaatcttcatcagtgaagagccttagccagcctggaggcaatgtggctgaactctgcccttaccgtgtgcaactctgtagaatccaccttgaaaattttgctcaaaactgtcttattattatttctcaatttaaatttattacattttaaaagttttatttccatggtatgtgtgtgcatgtgtgatcataggacagctttcaggaatctgttctcgctttctcctaggttgcagaggttgaatttagctagtcagggtcaggcttcatcagcaaaaatgtatacccaatggaccatcaaagccttctctcctgctacagtatatcagacctcttgcacctgaggccaggggatggtctcccacagctacccacgaggactcttagtccatttatatgcctgggaagctttcccacacttttctaaccaggtcagatggctctcaatagacacttaacccacgggaaggtcctccgtgtaccttaccttgtgtgaccatttgctttatcatccgtcactgccaagccacgagctcccgtccagtttgctctccttgtacccagtacagtacctgctagttcatggctgacgataaataattttggtggtagacagattgataaatgggtgaatgctgctgtccaatttcaccctaggatctgttttgtgtggtcatgtgcagaagtcaaactgactgcagtttccccttaatggtgttagccctttatattggtctcctaacatagaaaatgttatttgcattcttctttttcttttttcttttcttttccttttttttttccttttccactttctggaacagtatgttaaagactattaattaggcctggactgatgatacacaccagcaattgggaggcagaggcaggaggatcactgtaagttcagggttagccttgtctgcctagtaagtcccagagcagaaaagaatacataataaaaccctgtctcaaacaaacaacaaaaatatgatgcttatttattcttaaatgttttctagaatgttctggcaaacttctggtctgggatagccatttcataggttgattgtaagtacagaactccatttccttataatttcgtcaggtattctatttctatattttccaaagaaattatccattccatcttccttgtttgttaatttggttggttggttggttttggtgtgttgagacagggtttctctgtatagctgtgatatctgtcttggagctcactctgtagaacaagctggcctcaaactcagaaattcccctgcctctgcctcaccaccaccatcgccgccaccaccccagtgcagggagcagagatgtcacctagattttcaaatgtactaacaaaatgcagttgacagttctcttgtaagaaacttaaactccattgtgcctatctacagtgcccacctgctttattccaaatgttatttcacacagagcttctcttatatggatgagttgagccagaagtctgtgtggttttgtggggaggtctcagggaggcaggggttggtctttgttttatttgtagagctggagttcaaacctggggcccatggatgctctcccgaggtccgtgggggggaaagcgaagctgttttgttgttgtgttgttttgtttcgtttaaactgtgtgtatattataaacagttgtaaactgccttatgtgtgctaggaaccaaacccaggcgcctctataagagcagcatttgcctttatggagcagtacttgctctcctctctccagcccctgtctgggattttaaaacctgcgtttacattctgtgtgtgttttcaaaaaatcgtgttttgagttttggtttgatttttgtaacacttttttttctttttcttttttattctgtttgttcctatttatcttattttcttactacttaagaattagaatattatgtttttaagtgtctcactatgttggcctcccagatgctaagattatatgtataattcctgaacattattgcattcttttatttctccaatgtatcctgttactttccccccccctttctccccgccccccaggattgaacacaaagcctcatgcatacttggcaaattctataccactgtgctacattcccagccgctggtggctctttcttagtttcttgatgggtttttccatcttattttgatttggtttagatagatttggtttttctgatacgaggactcttggaaggagcccgtgttggccttgaactgcctctgcctcttaaatactagaattataggtatatgctaccatgtacaacctagctaattcattttagacttttgttttctgatttataagattacagacttctttctaggtaccactcaaactgtattccccaagatatataggtttttagttgtttttttttcaagacaggttttctctgtgtttttttctctgtatagtcctggatgtcctggaacttgctctgtggatgaggctgtccacaaactcacagaaatccacctgcctctctgcctccggagtgctaggagtaaaggtgtgtaccaccactgtccagtgatgtataggcttttaaatgattatctggttaataaaaaatcaaaatttctccaggacagccaaggctacacaaagaaaccctgtctcgaaaaaaaaaaaaaattagaatttctacgaatgaaaagtatttgaaagctgttattaatgtttaaccagactgaattagaatttttcctttttttttttttttttttttttttgagacaggatttctctgtgtagccctggctgtcctggaactcactctgtagaccaggctggcctcgaactcagaaatctgcctgcctctgcctcccaagtactgggattaaagacgtgagccaccacgtccggcagaattagaattttttaaaagggtagtttctacatgcatcagagactttgtgacttactgtagcttgctttggcacatgatcagtattttataaatattttgtacattttttggaaagaatgtatatcacttattgataagtaattttctagatgattcccatcagatcaaacttgctgtttgcattaagatttgctagaaacttactagtgttttgtttacttaatctatcaccttttaaaggagcacattaaatgtcctctctgattgaagcctgccaagagggctcagtaagtaaaggccttgctactaagcctgaggacccaagttcaatctccaggacccaaatagaggaaaaggactcctgaaagttgtccttggacccccacacatgtactgtgatggtcccccgtgtacaaacatacatgaaacaaataaacaaaataaataattttaaagctttaaatactctatatgcccatacttatcctaatttctcataaatctctcaaagtttgctgtctctcttttaaatgtatgttgccagaggcagcaaaaagaagtgctaaaatcaagctgggtggtggtagcacacgcctttaatcccggcacttgggaggcaaaggcagaaggatttctgagttcgaggccagcctggtctacagagtgagttccaggacagccagggctatacagagaaaccctgtctcaaaaaaaaagaaacaaacaaaaaaataataactgttaaagtctcctttaaaagttaaaagtgtagctatgcacttttctgtgtctttcttcctcttactttttgctttgtgtgttttttaaaatgacttatttattttatatgtgagtacactgtagctatcttcagacacaccagaagagggcattggatcctattacagatagttgtgagccaccacatggttactgggaattgaactcaggacctctggaaaagcagtcagtgctcttaatcactgagccatctctccggccccactttgtgtgtgtgtatgtgtgtgtgtgtctgtgtgtctgtgtgtgtgtgtgtatatatatatacatatatatatatatatatatatatatacatatatatatatatatatatatatatataattttttaaggtctatttcattttatgtgtctgtgtatatgtgtagacatggttgtacacatgctaggtgaggccagagagcatgtcaggaaatcatacttaaccctgcttgagtgctgggaactaatttgggttttaacccaaagccatccatccatccatccatccatccatccatccatctgcgctgggattacagatgtgtaccactatgctctgagtatgctgtgctagggagaaaccacaggattttgtatatgataggcaagcattttaccaaacaggcatgtggcttattttaaatctacccagtttttagttttacaatttttaaaaatagagttcaagttttggtttttatgggcccgagggttttgcctgcatgtgtatatttgtaccatgtgcatgactggtacccatagaatcagaagaggggattgggccccctagaaatggagctatacatgttgtgactcgccaggtcagtcctgggaacccaaccccaatcctttgcaagagcggcaagtgctcttaaccactgagccatctctgcagcctccggtgtttactgaaactagttaagtgttagaatgatttgttacacagcccagataactaatccaaagagccttcaagatgcactttctatagctgcttagtacataggtttgcaacaggattcacatgctaacatttgtagactgccttagttggaccctgagcaaatgaactacagattagctacagaatagcaattgcgtgttattaatgtcgtcagattgcaacacatttcacgttcaattaactgaaatgctctttcaggagcatggcttggctcatcttctcatccctactgcatacttagaaaaggtcactgtcaagacagaaaagtatatatgtgatttaaatgtcttgactcagttgctaacaaccgcgagcgtgttctcaaattggaaaagcaagatgaatttcagcttgctctttttcccacaatgctctgtttactttctggtattgcatttctctgccatgctgggcgcctggcttattaaagagtctgttcatttatccgcctcccggagtctcacaagccttacttttcaaaacagacatgccagacttcgcacccaaaataaaagtgagttgtatttttactagaaaccatttagtgaaatgtgtttttagtcatgaaaatttcaccaagtataaattctctgtcaaaaagtaatgggtcctttgtattttccttaagtaaataaatagtttctttcctcgggaaccatgactactgaggccactcttgaattcagggatattctgtgttcctccaatagaaaataagcatgtatatcaagatcctagggcagcccttgccctgacaccgtgcaataagggaaagtcactgggggtaggaagtaactggaaagaaaaaagacggatgtgagataaaacaaaactttggtttgttttgtttttcgagacagggtttctctgtgtagcccaggttgttctggaacttattctgtagaccaggctggcctcaaactcagaaatcctcctgcctctgcctctcaagtgctgggattaaaggagtacgccaccactgcctggctgagataaagcaaactgaatgtttttcaaacagccttactgatctgacacctttatttataattattttcttctaacgttgtctgatagatatgcaaaagcctattttaatttcaatgagagagaaaatgttttgttttgtttttttctaactggggaagagaatacaaaagcttttctggagtgtaaaaaagaacacctaaaatatatttatctaatatatttcctttttctatttttcattttcttttccatgttctcattggacagatttggaaatctggtgttttggctaacgagttgtgttcctcttcgcctcttatgactctcctttctcacctccagttcaaaatgactgcaagcagccaaggtgtgccagctcggcttctcaggggtgaccttcagaggtagtgggggcaggcctcagaaaacatcacctttaggagttttaagaggtgaccagggagtttgactttagtccccttctgcttcggcaggagactggcttgccaggacacggtaggttataagaacttaaacaggaagtttctgtacttctataaaaaaagaaaagccaagaccctagggctgctctcctgtggccgttacactgtttaacttctgcctgcctttatgtcattgctacgctattcttatacacggaggtaaatattttattaaacatcttcgtgctcggcagttaggaagccctctgctgcctaggcctggcagtcgcccagcgttgccagggagggggacgagggtgggctcgagagcttcacagaggaactgcccaagctcaccgttctgtccagtacttaacacctggaaaccattttctcctctggcctctcagacttaatcttccatctcttcttttttaatcagccaccaactccgtcttgatgaaaggggccgggctcccagaagaaaatagctttgcctttcaactccacctggaaacggttgacatggcgctaccttcactcaagcctctccactagccttggcgcttcccccatctctgccaaggctggcccctgccaagccaatctaaatatcacagctggaagtacagggtctcccccgcccccaaccctttctcccacactctatacgttgtaccttgggacctttcaacattctctatggtcattctgaacacccgcaccctgcccatccactacggcaacaggctcacagacccacaactacacattagattttttaaaaaaaacttttgttccccctttacacaatacaggaggtggccacagcagccggacacagcacctcaacagtgttaactctattatgtatttgtatctccagaaggcccttccaacaaaatcaacaaaattgccacttaatagaagaaacgcgcactttggaggactgtgggtgagcgcgccctctactggtgatcagaggaagtgctttttactgtaggttccctcttctggtggagcaggggaaaaaaaaaagactgtctctccagagttcaagttcctgctcccaaattctgacatctaaatctccccaatttaggggtttcctgtagctgatgccaagacccaccacgatagcccatgctgcaatttctacaattaataccagtcagct

SEQ ID NO: 133 - DNA, 10699 bp, Mus musculus
gtcttaacataaagtcttataaaaaataggagatgatgaaaatttaccaaaaaaatgtgtagtccaattaaaaaaaaatgagaatttgtattagaatccactgtgcatttgtagctatctacataggatgtaaccaagatatttcatgtgattatattaatttaaggaatttatgtgctaaagagaacagcttgcatgagtttcatgatacatgctgcctaaatcacagtattaaggagatatgaaaattgtgaggttgaagacaaactgggctgaatactgaattccatggaagcattaattgcatacgaagattctgttttacaaattgctaaataaattccggattatggagcacctgttgctgttgcagaggaactgggtttggtcttctgcattcgcacggtggttagtaaatactagtaactccagttcaggggatctgatgctttctccagacttctgtgggcaccaggcctgcgtatggaacacaaacacattaggtaaaaaaaattgatatacataaaatgaataaatcttaagagcaaattaatggtaaataaatagcttaataaaatgttattgtaacacatcttatgcttggataagataaaatgtatattaaaaaaatgagttgacatgccatacagggaagcttgcagacctttgggtatctgaagaacactgtgtctgcactccttttttgtttgtttggtttttctgtttttgtttgtttgtttgtttgttttttagaaaaatgcaccatgtataacaaaaggagcttttctctcctatttgatattaagttgaggttgtattttaaattcaaagatgaaccttgatttaattctacttattggtctttagagatttgtactgaatttcccatatgaactgtgtgttgacactaaagacggacacaggcctcgagatgtcagagttataaatatctaccatttatttttaggtccccaaagaagagcagaatgaccccaacacagtaaaagtggactctaaaaaaatgccaagggatataaccaacaccagggaccaaagaccactttcacccaggaaaactcgacaagatcagactcctcccctaaataagaaaatcacagtaaccttgggtgtgaactctaggaaacacaaaaacatgaaatatgagctcacgtgtagggagacaagcagcttgtatgcagcactcaacactctcagtgctgtcagagaagaggtagaaagtcaaaagggcagagaaatgctggtgtgtggcaaagaaggaattgaagggtacttaaaccttggcatgcccgtctgctgtataccagaaggcagccatgtcgtcattacattttgtcaatgtaaaagtaagacacaggaaaataaacaattctttgaatcacaggaccaagcatctaccaattacgtccgattttgcattcatgcagttgggagtaagaggaaaaagattctgaagtgtggagaacttcagaaagaggggaacaaactctgtgtctatggcttcaaaggagagaccatcagggacactctgaggaaggatggcaggttttgtactttcatagagagtgacgattggaaactcattaatgacctggacaccatcatagaaaacacacagccagttgatgagttagagggcaagctttttcaggttgcagctgagctaccaaagaaccccagagtagtctctgtcactcagaattctgggtcagagaacagaaactttcataagctagaagagtacattgtgaatgagtacactacattgaaagaagaaggaaaaaaacttagagcatacatcaaggaaaaaagtgaaaaaaggaagaagaaagcttccttattcaaagtgcataaagaacactttgggaaaatgacaagaaattctactcctgttaaagtggtcaaacatctttcgagggtcagtgactcagttgggttcctatggtggaacaacaatggaaatgcaggctgtgccacctgctttgtttttaaagagttgtacattttgacttgtcagcatgtgatagctagcattgtgggtgaaggcatagattcaagtgagtgggcaaacataattagtcagtgtgtaaaggtgacctttgattatgaagagttactaccaacaggagacaagttttttatggttaaaccttggtttgaaatatctgataaacaccttgactatgctgtcctggaactgaaggaaaatggacaagaagtacctgctgggctgtatcatagaataagacctgtgccacatagtgggttgatttatatcattggccatcctgagggagaaaagaagtctattgattgctgtacagtggtccctcaaagtagtagaagaaaaaaatgtcaggaaaattttcaagcaagagaggaagcaggcttctgtttttctacatcttttatccatatgtacacacaaagaagtttccaggaaatgcttcacaactctgatgtggttacttatgacaccagtttttttggtgggtcttctggatccccagtatttgattctaatggttcattggtggccatgcatgctgctggcatcacttgtacataccaggctggagtttccaatatcattgagtttggttctattatggaatccattgatgatcatatgaagcaagataaatataaagagtggtataacacaatttctggaaatgttcagaatgtagaaatgctgagcatagatttctgagggctggaaagggtttagtcttttaaaactttaagggaattgcctattgtgtttttctgcagacaataatgttttatgaagtttcaaaatgattgctttcaccccaaaatggcagttctagattacgtcctaggtaccaggcatttttagtttattcaaacaaacaaacaaacaaaccaagacaaaaccatcaattgaactatttatgtaaggtaacatggaaaagaaaattaagtgctaatgtggtctcggagatcctagtgtcaggaaatgctacgatgtgagaaagttcagagcatagaaactggagttgttggccaaaagattcatggaaaaaaagaagcctaccatgcttctggaaacttgaaccaatttcaaacatactcatttggttctacgcttatctcccttctctgctgaccagagctcagccaggacactggatcacagagttttcagccctaagatgcccctgatcatagatgcccttcttccactttggctttcttacttaagacttggatctgaaattaaccttcaaggaatggttttggaaatcattgagcaggcaaggaactggtctctgccatagaatttgtgcacctgagagttcctggtcttgagttatggagagcaagcactggtttctacttcataggattcacaatggagagggctaggaagatactggacaattttcagcagtgtgacactcaagtcctggtcccttggagagaaaggacgcggtgttcaagaagtaatctcatcaaaatcagagtcaatgagaccttacatacagaagacatgaggtcttagattattggagggaaagtggaacgagtagttgagatgctgagggaaggttgctaagagatctggcattgcttcaattcttcccttatcagaacgaaatatgtcctgtgttagagctagcatgatcgcaagccacaactccccttattttccagacacctcctagtcctattgtgagatattttgtgtcccctgcccaatgtattgttcccaaatcaaatacagatgaatcaccattaaacatagtgaattttgagatacaaattaaaaaaattatttgtatggaattccctttgtttttggtccaaatattcattctcaatattataaagtaataaatgttgttttcacagctgttttctttagttatttattttttgtttgtttgtttgtttataacttataagttactcttaccagccaaaagatcctcattatttttaagttctgttgggagtagagggggttccgaccctgcaagtattatgactgacaacgaagtggactgcaaagaatgaaaattggggcatctgaattgcggcagtcagatggggatcaaatttagagaaaatggcttaattttcttacacatttaaacacagtaggactttgggaaagtagtttctatgtggtaattctcatagaaaagccttagaaatggatacattgaaatccccttgcaaaatgccccactatagaaaagaatctgagactttggtcataagaacagtgcatgttgactgggctacatacagtgcttggggctagaacctgcaaaggaagatttaataagcctgagggtggatcctacagatggagggtacacagtacatgggggcttttcataaggataaattctattttctaagagaaagcccatgactggggcctaattggttctcaagacttgggggaaattcaggtggctgctgctcctaaaagaatagcctagggcaccaagttgtttgaccagtttcactccagcattccaagtgactaggcattcatttccttaaagaaaataggcctgcctaattgacaatcctggttgcggcaatgcttaatctaagctgtgcttcctaccaaattccatattcgctccttaaaattaatctgtaaacatcccaagtcaaattcttacaatgtgtcctgtcgtttgcccataggactgacttgtctgctatactcttctctactgagaggcatgctctaccttctcagctctcaatctatgacttttcttagatttatttatttattttatatgtataggtgtttttgtctctgtgtatgcctatacactaggtatatgcctaatgcctaggaatccagaagaaggcatgagctcctctggaatttggagctataattggagggttgtgagctgccatggctggtctgggaattgaactccagatcctctggaagaaatgctcataaccctggaaccaactctctagcttgtcaacatgtaatcaataactatcttttctattacatattctgctctgtacattccagaacctgagaggattccctgatttgtggaatcaaattctgtcaaccaagaaacacatgcagtgggcaaaggaagaggattaaaagtccccactgacacacatgttaatacgtctgactatgagctagcgatcccaatggctcttcagtattactcaagttattctcagcaaaggagaaaaaaggatgggctgttacattgggtaagcaagtcccatggccctgcagaaaagggatgtagctatagctaccagatacatgacttactagtgtggatattaatcatgtcagcaataaaggacttctgtggtacatagctttgcgttaaccaaatcattagaaatccattcagtttaatacaaaccagttatccaacaccaaagatagaatcatgtaggtgatttcttttttctaactctgaacccactctttgtctacctcctcctcagctgcttttgggggagggagataaaacatacctctgagaggtttctattccaggggggctctgggggccatgcaaaattgtatacccatgttgggaggaattcagaaaggggctcaacagtattattttgactcattcaacgaagtcacagtatccctcactttccaacaaggaggaaaaaatacgaacatcaaagcctggtcagtctgacagaaccaatgggaggaagcacggtgcatgaggccaacacctggacctgggtattctgtagcattgagagttacgtggagagaaatggatgctggcgtgaaaaggtgctgacaatcaagtttcccttctctatctccccacagctgcacttctctactctagctggcctgtaccagagtctttgatttcctgggcttctaagcaggtgtatggggtaaaagcccctgattttcattttgattctgttagtgggaaggaaacaatagaatcaaactgatgtaggttaggtgatacttttgatggggaaggaagataaagggaacccaaagaataggatcatttggatggactcaatacttgatgcagaagaggacctcttgtttgacatctgctccacttggacatgtcgattgccctctgggcctgcatgtaggctagcaaaataaaagtgtgctaaggaggtggaaaagcccagctgtggtgagagactcaagtctgcaggcctgcttagagaccatttcctaacacaacattgccacctattggatggagctgtgaggtacattccctcccaatggcagccaggatcctgtgtcaaaacagacaggtcacaaggaggctttcttctattggcatcctttttgggcaatgactcaactgatatttcataacaatgaaagtatgccatttaaatatatagtttaaccaagattttagcctgcatagtcttagtgttattgatttaaccaaaaaccaaccaaccaaccaacaaaacataagagccttgctgaaggcaatttacaagtttttcactctgaattcacaacaggggtcctggcacacacacacacacacacacacacacacacacacacacacacaccttatggaaatagatcaaaaccaaggataatcaggatatatgaacaccagacttatttgaggatctttatccagagatggtaaaggcacattctcaaatcttccataccttatcaggaagaaggatgtatgccacctgatagatttttgggtcagtgaaggaggacaggaatgtggttaacatttaaatgatgtatctaagcctttcctgttactcttttggccatatttgatggctcattgaaagttttatccacttgaggaaagcatggcagatggtctaagacagccaaggaagggaggttttggtcatggcagcatagaagatgccaacactgcgagacatgctagagaaggatgaggagaatggacagcgccagagagatgcaactgagataaaaaaaacaaaaatatcatatcatatcactggatacagaaaagcattcagcaaaattaaacaataattcacaagcactctcagcaaactaggaatagagcttaatttctcagtatgataaagaactttaaaaaccctacatctattatgatatgtaatgataggagacctaaatgctttcctgccaagatcaaacatgaggctatgatgtttactgtcaccactccaattcaatactagaagtcctagctgatgtaatacaagaaatacataacacatgtattaaaagggaagagaaaggctctttacagaatacgtttgtctatgtatcttaaaaaattcctaaataatgaacaatagccacaaaaagttgctgggccggatggataaatgatttagttcactgttgatgttctaacaatgtacatgaggctgaggtacttttctttccttccttctttgtttctttgtttctttgtttctttgtttctttgtttctttctttctttctttctttctttctttctttctttctttctttctttctttgtttttatgtgtatggatgttttgcctgcatgtatgtctgtgcagtacatgtgtgtctgatgccatggagccaggaggaagttgtcagatgcattgggactggagttacaaacaattgtgagctgtcatctctctagccctggtctgggttatttttgaatagtagaaatttgttactgtatctgtggagactgggaaatccaagatctaaggacttatgtctctggtaaacctcactgcttccaagatagtgccatttgttgcatcttttgatgacagaaggtggaaggacaaagaggcttgatctttaatgaagtactaatgtcaatcatgacagctcagcctggtaatcttactccactgagccttaggtaacatcttaccaacatgcacgttgtggagggatctatgtatattgagaccagagtgaaaattgaagcaactgtagagtgaacagataataacaaaaaattcttatttaccagcaattagcaattggaatctgacatttaaaacaatgttttttactctgagtgtgtcctacttataatattccaacttagcttattattacagtttgtgaatcaacagtatatactactgataggggacgaacacatatataaatagaattgaatagagagattttgaaaatggataggttcacggaatatttgcaggtgtatttgacaaaggtaccaaagaaattcagatgaaactttttcataaatcacactggagcaagaagtccccaaagtcccaacagaaagaaaaggcaaggagggagggagggagggagggagggagggagggagggagggagggagggagggagggatcattttccacataataattaatttaaattgtaccacatatctaggtataaattgtaaaatcataagccttataaggaaaagcagaaaagtcatcaaatctaaaagaccgtcaagcaattcttacactaaatacagaaagtggaagccagaaagttgtaaaaaacaaaaaccctgttaaggatgaaaagagcctccagcttgatagaagatattttcaagtcaagtatccaaaagttttcattgaggatatttttaatgttctcacttcattttaaaagtagccaaacacatgaacaaacatttcacaaagaagatgcagaaatcaagaagtcacatagggaaacactaaataagcatcactattattaacacacggcatgttcacacacattaaaagctcaagaaatatcatgacacccctaatagaaacgctaaaaaaagtatactgataataggattcacaaaatggcccagtggctaaaagagcttaccacacaccaaataacccaagttcaatgcccaggacccacataatgataaaaaagaactgactctacaaagttgtccttccctctccacatacacactatagtttgtgcctcctcacaatgatgctgatgaggacgacaacgacgacgacgatggtgatggtgatggatatgaggagactagatgttgagtacattgcttggtcaaagggagaaacggcacaaccacactagaagactggctccaaatcaatggctggggagctcctagatcctagagtagaagatgccactgctaattcctaaacagtcttgtgtcaaaattccttctcaatatttatgtttatgtccataggcctaggcagaagctttctttaaaatatgggtattattcaacacagagactcatacttacttgttcaaagtgttgagaataatacagagttctcagccctaaatgggacgtctgtattaaccccttatcaagttctggacagtaaccaagagccgtggaatagcctgtaatgctttgaggggttgtgtggggcagctttaaaaggtaacccacacctggccccacacctggcactaggctttttatttgatagtcattagtgtctgggggtagttctaattaaacccattttatgtatgtacatatacaacatccaatgggtacagagtataagagtctatttctttgtttcatattgactttcaaaaggcagtacaatatttcagcctgctctgatttctacatagacagcataaagtttataccataaacgcatgcatcccttggcactgactttcagtggtcacaactgtgacgtttgaccagcagagagcatgaaagctctaagatgctggtgcaaactgacagagggcgtggcttctgcatatctgacacacctccaggattcaggcctggatgaggtaatagcaggccagaagaagaaggcgtggggctgagcgtgcgtgtgttcgtcagtgtgtgtatgtcagtgcgagcaaaagccctggtgagactcaagtgtaggagctctggccgcggatacagccagcgctgagctgaaaacagacaggaagttagtggctgcaaacctcagtccccgcgttggcccctgggaccgggatggcaagcgagcttttggacacccggggacccgggaagtatccgcgggcgtgagctcaccttggcgttcttccggggaggggagacacctggaagcctctgagcggagccccagggagggagctgtgccaccgccgttgcctggctcccagcggagagaggacggagggcgtgaccatgcaactccagcgaggctcaactggtgcgaggcgggtgctgcgtcgcgcttgggccgtgcgccctgggtggctttgcaaggcgggcggcgaatgtgcagggtcaggttttttgcatgaagccgctggacccctcggagcagcggcagcgacaggggcggtggagcacagttggaggcgggcagctacgggtccgcgtcccggtgcctaagcgactgcagactcccccatgaaccacagctgaggcttcccgggaggcggtggcgcccgaggccgggtgtgcaaggacggggaagggagcatctcagggcacttcatgctccagacctcagccttggaccctagtggtgtaggaatggctgaccgatcatggcggctggtgtccctacagccctgctgtgaaacaccacttcaaggcggtgctgcgctggtccacgcgcggggccagcgtggtgttgggctaggtggagagacagattgccccctacatcatcgacctgcagtccatgaacc

SEQ ID NO: 134 - DNA, 2220 bp, Mus musculus
aattcacagactttcctcatgaaaccagctcatctgagaaaacagcaaagtttaaaaaagaaatactatcagtaagtatgatatatttccttggtttggaaatttccaagccacgatattctgccctgtcaaaatatattcactggggaatttttaacttgatgcatttcttttgaacttaatcacatttctacatctagctggtttcattattaaagaaaagaaaaggtggttcccctctggtcctaaagggaaccacagacttgagtgatgcttgaacttctaggttcgcgtacagtaacactgaaaccagaaacttgtgggagaaatgtcactttatctgagagagtaaaatccaactctaacaggaaacagcaaattcatcttttttctttttctaaaccactctgctggagacaagtcccttgagtcagagctctttaaggcgcacttcctttacatgggtcaaactgaagccaccggtttgtgagtccccaaaggaatcactggaggacaacaggagcattttcagatacctttcagggcagacctgccctggctgtaccccctatcttgaagaaaaagaaaaacgaataaggtgaaaatcgcaactactatttatagaatcaaaatgggttcatccattgagttttaactttcaaaaatcataaagtaccatcctaaatatctgagatttcttgaattgcctagtgacctgtgggatgtacgtcagaatattacccagaactgaagttgtgtcctttgaacttcagcattgtagaactatgaaccgtggctgtgttaaaaatgatacatgtattcaaatatttccacagaatttaaagtttgattttataattagtttttaaattgcaaaccttacaaaaattttccaaaatttacttagaagcatttcagagctcttttctttcaaagctgaagtctaccttgccttcagattcataatcgttcactctactttataactaactgtgtgcgtacacacaactatttctttttctctttgcaggtgctgcaaaccaggaaggggaagtgtgtggtttaagttgcatatcccttatcctctggctgctggaggcttgctgaaggctgtatgctgttaatgctaattgtgataggggttttggcctctgactgactcctacctgttagcattaacaggacacaaggcctgttactagcactcacatggaacaaatggccaccgtgggaggatgacaagtccaagagtcaccctgctggatgaacgtagatgtcagactctatcatttaatgtgctagtcataacctggttactaggatagtccactgtaagtgttacgataaatgtcatttaaaagatagatcagcagtatcctaaacaacatctcaacttcaagcccacatgtttattttttatcttgaatggaaagtgaaacttgtatcatttttatttcaaaattatgttcataaccatcttcaatgattcaaccagaatacaaaatgaatgcactaaaaaggacatttctatatttctgtagttaaaattcaggacggccattctcgactgacatctaggattgtctggaatacctcttgtaagacttggaattggcattttttccacattacaatgtattagtcaactttgatttaaaatttgtaactcttgtgttttagtgtaaggaaaaatttagggttagtgttagagtttagggctaggtaaggaaaaactgagtcaacactgaatgatttttttaaaatctatgagccagctgttggtagtttactcctttaatcccagcactcgggaggcagagacaggcagatggctgagtcgaaggccaacctggtctacagagtgagctccaggacagccttagctacacagaaaaatgccttatcaaaaaattaagaaaataagatgaagtattaaaaagtgacatgacaaatcattcctgagggctacctatatattcctcacacggtataaatatttaatttaattaatatttaatttcaaatattcacatttgaaatgaaacccaaatctgggttcaagcttactgctttagctgcacagtaaagctgtgtagtaaggagacccacgtttcctacgcatttcttcatgaatgcggatgaaactttacaaggttggtgtgcagctcactggagatgaacaactctttgtaaggtaataaaatcccacagtgatgtctt

SEQ ID NO: 135 - DNA, 12563 bp, Mus musculus
gttccccacctggaatgcgtcctggcttcggctggcccggcccaaccctcagcggccgcggtgcccaggcccactccttccgcgcctggaaacgtgagacgggtcactgaggacgacgtaggcaaactttgcagagcacgttgccacctgttggagtagccgctccagccccagtcgaaatgcacggccgaacaatggcagttctgagtggctcaggggcccacactttctttaaaaccgatgcactcgtagtaatatttcttatgccccacatccagaggcctgtgctcaccacctcagcagtgcccggggaggttcgccaggcgtgggcaggctctcccttgaaagcacctgacctggttctaccttgcactggggctgaatggtaattaatttttttatttgtgtttttgagataaggtctctctggccgacctggaactccctaaaaccatgctggtttacatactacctggctctgcctcacaaatgctggggttaaaggtgggccccaccgcgccacactgtagctaatttaaaaaaaaaaaaattactgaagtcatgagacctacaaatttcaggcagtccagaaggaaagtgtgtggagacagagaaaggtacgatagtacgttaaaaacaggcagcttaaacagcagcggtaagtgctcctttaactcgtccaccgtaagttttaaatgtttaaaagcaaagttgttgggactggagctatggctcagagattaacattaacgtaagaacatattggctgctcttcaaaggagccagattgggttcccagtgcccacagggaggttcacagccatccagttccaaagaaatcactgccctcctctggcctctgagaacaccaggcacacatgtagagcacattcctacttgtagatacataaaaatatttttgaaaattaaaaaccagtgaaactttgtacctagcaattattaaaacatttacaaagaagaaatacaaaattcatgatacagtagttttcttacaatctgaccttaacaaatgctgcaccatgtctaagagcactgggaagggtttggaaatgacctcgttattacaaatatcatatttaagtccatatattaaggcttgggaattcaccaaccaacttacgtaatgcatataatcttttggttactgctcagcgctgtttgccatggtatgtataagacttgtgagtctttgtaatctgtcagttgtgactttttaaattttcatttcaacaaatttgagtagctgccagatactgttcaggctcctggaacgcctgaggctggcatgctcagtccctttacagcatggcatcatatttgcatataacctatttccatctttaatgtgtttaaagaacagggagccagagcaggtgctataagcctcagagaattggaaatcacatcagctaggcaacagagggtcagaatatggatactaatcagatatgcctttgtttccttcaagggaattacatgggaatctcttattgtaatgcatgaacagagtaagtacagtcatctatttgttttctattactgccataaaagttggtacaaacttagcaatttaaaagaacagaaatgtactgttttctgtaggtcagggtgcaactaaccccctgtgctgaagtcagcttgtcagaggacttcattcctttctagaatctcagagagaagagtgttagtttgttctttctagcttctagaagcccctgaggtgccttggtctgtagcccctttcctctcctttcaaaggcagtagcatcagtaaagaggtctttagtttttaggattggtgtaacaaaattgggcccacttaggataatctcaccatagcaaggtccttaatcatagctcccacgttcctttgcgttttgtaagaaaatatattcacaggctctggtgatgaaagtgtggaaatctgtattgggggaagctttccctaccacacctctggcccccaaagagtcataatgttcttatgcaaaattcattcagtccttgttcccagaggaactgcatagtttcaaagcattacaacatctaagtctaaaaagattaaatcatgtaaaatttctaaattcaataagggtgagactctgggtttctatccagggcaaaattatttcccatctggacctaagtgactagaaaataaattctctgctcccaaagtacaaaaatagtcattggaataagagacagaattataagatggttaaaactatctcctataaaaaagagaagccagagtggggaagcaacagtcccaaacagcctcaaatccaccccagcagtctccactcaaagtcagggctacacctctcctccgttcaaataagaatgtgatggccttaagggtcattactctgcctccaacaaccattgctatattctttgaattgactgttttcctacgtatctgtatatttgtcttacccacttcatctctccattagcccacatcaaatggctagttaccattagttacctttaagtagacacttgatcagtacttttgaagtgcagcattttaagaaactgcattgtaaaccacttcatgggaagtgcaaatatgccatctagtttctgtggaagggaaagaatgcatctccgttttgtattcaggtcacatcttctctgcagctaatttaccctaaaatcgttcatttctttcaggcccaaaggcgtttttttctggtcatttctatggaataggcaacaatgtacatccaaggttatccttgtgaaaccttttaaggatgctggaagcccagctctgcctcccagcaggtggcagcagatgagtgcttagcacagggcactgacttcaccctggtccccagcctggttaatgtggtgctgaccttccttagggagaagagcagagagaatctggaagccgcccacctggcagtgtatcagcatgttgcctggtgggggaagcatacttaaattacatagctaaattttattgttcatattctttctcattttatcttttcctttcaactaactgtgttaaggcattttatgtggaacttttgctgtatttatgagtcatgttggtctgtgacttattttctaatgtctgtcagcagtttttctaagactaatgtcattgtgcttgctgtctaagcttataagattgacatgtgtgttaacgtacattcccctggtgttgccgtagttgaacacactgtccataaccatcaatacattaatatccatcagcattagctaggaatacatgcagtgtagctcaagtattcttatagacaaacatgtattttaagcctttattgaaaaagtcgaaggaaaaggttaaagcatctaagacagggccagcaaactgtggggcatgggacaagttagtgtctagcctaacttttgtgcattggaaaatcctggggaagttcctagaggaataaggataaagagagaaactcaccatatctgggggaactgatcacttctctacaggcataagacaggaagctttggtggacccagggccagggcatgatggcagtgcctgggccatatttggttgtcacagtcagaggtattgttactaatggagctgttaaagccagggaggcgggtaagcatcctgccatgcacacagacatgtccctcagcttcgctgacctccaagattactcatcctaaggttgacaattgctagttaaaactgtcaaagaagaatagtacaaattaatttagaccaataaagtcagatcacaataaatgaataaattcattctaaaccaaaactctctgaagaggaaatagaaattttgagttaataatttaaaaatattttacaaaaaccctctagactcaagatggtttcgctgatgaaatatgtaaatatataaagaccatgtgatgttagttatacataaactgggagaatgagggagtaatgacagcataatcttataaaacctgaggtgtcagaagcagtcatcagcaagtagcattggagatgcagatggagaatccttgtacaaaataccagcagattgtcacagcaaaataagaaaaaaatacaaccgtcaaatggggtttattccagaatgtaactttcacccaacataaataaatcaagcgcctgatggcacaggcctgtaattcaagcttctctggaggctaaggtagggtcacagactcaaagcctgcctaggccagctgaagtccagtcagagacagaaagacagacaccccagcaataatgaacccactctggatttctaacccatcatgaaaacaactaaaacggtaggggggggggctttattactgctgtctgtgaatgaccaggggccaccagcatacttattgataaatctgtcctaggcctgaatgaaatgaggccatctccttacacaactgctgttgggctttgttccagggtctcacaagtcttccagagacaaaaattagaagagagttaaggttgtccctgtttgtacagtctcataattctgctggaattaatgctaggtcataggtgaagtttgaacagtatataaaagtatttcaacatgctagcaagcagcgattttaatatgaaaattttaaacagtagcaaaaatactttaaaatgcttttaatgaaagataggagctatatcctgaaactacacaaatgcttaaatgaaaacatttaacaaacacagtgatgagcacattccagattgttggcctcagaagtccagactgacacccaggtctgttctcctccgccaggggacgcacacgggaaatgagtgtggggtttttagttccagtttccaaacaattgcactaacctggttctgccctgggccaggagtagtctagaaacacccgaagctggctgttttccctctaaatattataccagaagtagaattacagcatatttaaaagtcacaaaattcttccttgcatcctttccccctgatggctttagttgacaaaacagaaaatctgttttgatgaatttaataagtagacaaaatataaattacacgcacctgatggtgtaacaaaaattctttgcagaatgctgactctgaggaagctaccttttgcaaactaagcttctggttgacaagatgactcattctgtttatagacaggcaaggtttcaaggagggaaggccctaggatttcctgggccagctatgtctctcatcctattattccaacaaaatacttgaaattcattattaagaaaaaattgcagcatctagcttttgtgctaactgtatctcttccaagggtttatgaaggtacaagctttggcttaatcgatttttaaaaagatttgggactataaataatttttaatattaaaaagtactttgaacgtgactcttgaaaaggtttgacgttctgcctctcggtgcttttttttttggactgtcaatcatgctttatttagcaagattactgttcaaacttcacttttaaaagtgtgtgtgtgtgtgtgtgtgtgtgtgtgtgtagagccttcagaagtcagaagagggtgcagatcccatgtaaatagatttgtgacagttatgagtgaggtactacatggatagtgggaattgaacctagattctctggaagagcagccagcacttctaaccactcttgagccatttcctctgccctaaaacttacttgcaaatgtgttctgagctgctccccacatttccttcccttctaaggacgttctttctgcttctatgttttacactattttaactctatgctgacttctgatggttttgagagtagttatgctgttgcctacagttttccaaactctctggggatgtcttcttttctgaaagtcttcccattgtgagtctcaccacgaagggaagccagacatgacagtttacaactccccagctgaggactgttgtaagctagcccctgtcctcactgtatcatactactgagtgttcctaccaggatccctatgaagtagatgctcccagggtccatatgttacatgcagacacttctgtccataggatcagcactgatgccttgtgtggtgtaacaaggccaggctcatgctgactccattatcccatacttgatgatgctacaccccatcagcagtgggtttactagagtataacaaagctatgttgatcccctaaccatgcaacttcaacatgagatgtcatggactatactagcacctgattggcaaattttccaatgttactcaaaatttccacatgatggggtcagtgaaattatccacatgctgctgttgatactacaatagggctaaatatgtcaatagaagttaattaaaggttttaaaatataattttaaaagagggtccacaaaagactgtaggctaaggcaacctttttaaatgtaaggaatgaaaagattacaactatgcataggggtaagaggaattaaatacagaggtaaggcatgaacctctgtaatcagaaggtatgtgggacagaggtcgaagagtttctgcaggaaggaaaacagtgaaggaagtgaactaaatgacagcaggtgactttaaaaacaaagtgaggccagctgatggtgacgtggtgccaggcagtaagattccacactgagcaaaggggcagaagcccatcacaggcatggccatttcctcttcttaccaggaagagcattatgttttttcctgaaaaatcaaagatagcacagaccttggagaaatgactaatgccttttagaggctgctgaaaccactcctttgttattacagtgtggcaatataacttaattatcatttctggatcagcggaaccaacattacctgaagttgtcaagcgtgcatactccttggctctaccctagacttactaaatcagaaactcatgtcagatggtgcatatattcaccccaaagctaaaaatccactggcaattaagaaaactcaatgacactttatagtgacataaaatcattgaaatttatagtacaacattaaagcaatatcaagcaaatgatagaatgcatttaaacgtgattctgtgagtccttttggacagtggaaaatgtctgtgacattaacagtgggaagtttaaacattaaattattcttccggctgggggttggtgggctttgtgagtatagaacttcctgtgccagcatgcagacctgaatgtggagccccggaacctactgaaaagtcaggcaaaggctggagagaccactcatagttaaggcgcttgttgcacttgcagaatgcctacgtttaattcccaacacccattctgtggtttacaaccataactccagttccacaggatctgtccttttctgacctctgtgggcactacatagactcacaggaacatgcatatatgcaggcctaacacctacatgtaaaatacagcgaataagtctaatagtttttaaaaggccaggctcagcctcatgcatctgttataactcctaggctgagggcacaaagacagatccctggagttctctggccagccagtgtagccagacacgcaagccctgttaagtgaagagatcctgtttcaaaaaatggaggtggagtgtgatagaacctgctgccagcctctagccttcagagtgtgcaccttcacagatgcacacttgaatcacatctgcactcatgtgcacgtgcacaccaaagaaaaagcttgtattcacttgttgaaacatctgtagaaaaaatgttccatgcaaacaagcaattagcagtggcttttgggcccttagggttatatgaatatcccctcttaatcttatagatactgtttccagttttctttaagaattgttttttgctcttatattttgtaacaatcttatcaacacaatgattaagaaaggagaaagaaaggaagtagagtaggaataagagataaatttaaatggccccagtttggtgaagagagaaaaaagtgaaatcgcacctgagagacagcagtttgcctcatagaaacaaatccctgagccagggacttggatgcagacgctgtttgaggagcatgtgcccagagactatagcagcagtgtgcagtcctgaggcctccacagatgtgctgacagactcattgcctcctcacactcccctaccgtccccagaagccagccatacacagctcagcaccactgcagccttctagcgccaagctaaacgtgttccaaactggtctaaattgtataaaccgttccaaacaagtgccatcccctccattgcccctttctctttagagccctgcactaccttcccccagatggaatacttgtctgcacctgtctcccagtttgtaagtctgtcctgtgcccaaatacaaaacatctttacatttacttcaactcactctatgatttgtttgtaagtgggggaaaataacgaaattccccaaggtcctatttagacacaacataggaaaaaataacgacacaagtggccaccaaatgcatgacagacagacagacaccttgattcttcatggaggatccaacatagaaaaccaagtaacctgtgttcagcattggacaggagaaagggagtaaacacccgagagggtgggaacatcttaccgcaacactacacttgactctaagtgcattactaaaaatactaagtgtgctaaagtgatgttatgggaaacatctttacatttaggtatgcttacatagctattactcctaggaagaactactgttaaattgtgtgtgtgtgtgtttccatgcacatgagggctctcaagtgaaagacagatgacaacgtatgggatatgcctggtgtatgcaacaggctgtgcttaagaacaacaatggccaggcagtggtgatggaagcctttactcccagcactcaggaggcagaggcaatcagatctctgtgagttcaaggctagcctgttttacagagtgagttccaggacagtcaggggtacacagagaaaccctgtctcagaaaaacaaacaaacaaacaaacaaacaaacaaacaaaaacaacaaaaagaacaacaacaatgaaaacataaaacatgttaaataaaagccactagttcaaaagtagacttaagagccgtactttcagaggaaagctaatacgatgcaccctgggggaaacaccctcccccaatactacctgctactacctaatataacccaatactacctaatatactacctgctactacctaacatacccaatactacctaatatactacctgctactacctaacatacccaatactacctaatatactacctgctactacctaatatacccaatactacctaatatactatctgctactacctaacatacccaatactacctaatatactacctgctactacctaatatacccaatactacctaatatactatctgctactacctaacatacccaatactaccacaaagtgctgatgcttgaagaatgagaaaggggacaaaaattgtattttttaattgtaaaggatattaccattttaacaatatggcagcctgactaagttattcaaatcagtcattcccatggtggggtgggggtaggatgatgggcagacttataaatgattagtaagtagcccatcacacaaactctttaaagcagtaaggacccagtgacaccataagggatgccaaacaaagcctaagggagtggagtgactgcaccagacagaagacacagctctgcttggggccttagggattttcagaaacaatttgcaaagagaaatccaaaagcagctgatggggtaagcaagacacaggggaacaagttgtggtgaagtagagctagggaatatcaaacagcaaaacctaacctaagaaatattccaatgaaactagcacggctttaagaacaacaaaacttcttgaaatgcaaaacagcaatgaaaatgcaagtctcagatttactgacatacaagaaacaactgaaggggaattacaatgtttgaagacagacaagaggagattattcagaagagagacactagcaggtaaatacaaaggagtggacataatgtggagcagagcatacacattatatctatctactcagagttctagtcaaaaaggaaagagatagcctgctggtggtggcacatgcttttaatctcagcactcagaggcaggtggatctctgtcacttcaaggccagccgtgtctacatagtgagttgtaggacaacgagggcagacaaacagacaaacaaaaatcatatctagtgatgggctctaatttcaaataaggtaattcatttttaaaagattacattaatagcctgagctgttaccctgaagaataattcaatttttatccaattctttgtacatttttgctgaccttggaaagatgagctttggtgtctggtgtctattattcaacagcctgtgataaatataccccgcaccctttagatctaacacaaatgtcttgttttgtttcttttcagtttcacaagaaaagggaacaggactggaccgctggctgttccttctttgatcccaggcatgatttcagcttgtagaataaatgagaaatgcctgttggtttaattaaaagaaccgcattggctgtgctagcctgcctgccttctggtgcccaagcaagtgtactgataaaggaatcaaaagctgcacactcaattgtcccagggttttctcatctatcttgacagcttttgagaatataagtcaatttctcaaaagcggtttattgtaagccttgaaatatccagtttcctacctggtaccttaaatcattactttttccgtagggataactggtgaactatctccaaaatatatccttcttgtccgttgactcagatagctcattgggaagaagccagctgtctcctctgggatgctggctggcctttgaggtgggccctggagctactgcctggggatcaatgtactaccacaacacagactaaattcctggtcccttgggatatacctccagtgtaagacctccaggaaggactcctgctaggcccaatcacagagactagtaggtgtggtcagaaagcccggggcacagcctgattggtcattgtacaggcgcgttaccactaaggctgagctttaggagaagagcaagacaatatcaatggctagtggggttcacatgaaggcaagacatggacagctgctccttcatccgtgtttttatccccaaggaacagctttgtgaaagtgctctgtgctctcaagctgttgccagcagggtctgtctcttcagcgtggcttttaagaggaaagtgcagcaaactggagccttagcaaaaggctgctcgctagcatgagaagcatttgattccagcttggaaacaaggggtggggcaaagcctttttaccacctccaccccatctctccctctctccctttcagaaaggcagatttatctagtggtgcatcccttgccttcatgtcagagtgtcagctttgtcatattcctgactgttgttactagaatttttttaagatttatttattttaagatgtatttatagatactttttgcctgcacacatatctctgtgggggtgctctggaactagagtatgtgggttgtgggaattgaaccccagtcctctggaggagcagccagtgttcttaatcactgagccatctctccagtcccaattactggaatttcatatgaaagcaaaaccacggcataaatcttagcaaatttgaattccatactttttacctttttccattcaccagagatgagatgcaggtatattcacgttaaaacaaaaatgcaaacaagtcagataattaaaaggaaatccagatgatgctctcaaacctgaagaaacacttgtggagccagatggaagcagagtagagttggactctgtcaccatcccaagggaacgaagcatcatgggctctgatttgttcacttgtttctttatgtgcgtatgtacaggaatgtatacttgtgcttgcatggaagtcagaagagagcatcctgtctccctctccatcactgtcttcttcctctgagccagggtctgtccctcaacccaaggctcttggtcttcttggttaggctagaaggcagcaagtcccagcaatcccccagtctccggccccttaatggatcagtctgggggtgtagagtgtctgtgggatccaaacttgagatcgtagcaagcgatcttaactgttgagccctctttccaactgctccctgtcttgacagcaagaaaaatcccaacatatactctgaggtcatgttggaaccatgtgtttggagacagcagaggtttgggacaatctttccaatcaggatgactcacagctgtgatcagggctttctcttttatcagctatactatcagaaaagaagacccttgtgagcacagtgtctgcctcaagctcttcatcttttccactgttacaaaatctctgggggaggattacacacaggatcatgagtcctgtgtatgaaattatgatgacttatgaatgattacattcatcacaattactgtgaataaaaaatgttatgtttt

SEQ ID NO: 136 - DNA, 45375 bp, Mus musculus
acttccggtggtgtctcagcccagctcccttgaggcgcaggttctggctctcggtgcggtagcgccatctggcgccgagtgttccccggactgcggaggggcgcgcttcctcccttcagaacattccagagacaccgcggcggccggggtaggctttatgcgctccgccagaagggcgggacccaagactcctcctccaccgagttcccgcgcgggaagggttttgcggttaccctgagcggaaatggttggagtctggagcgggaacggacctcacgcgggaggaaaccggccttttcccgtcttttcaagtcctggcgacacagttcctgccccactggctctccttttttgtttcctcctttctgggcactgtgcttcggttcttcactcggcgtggaccgaggtcctccatgtcccgctttgcagagaggaggctttactttgtagcctttcgttagcctgtgttggagaaaagcttttgctccattacgtctgttaagctggggtgttgcgaaaacgagcagtatcggggattaaacattagaagaatgataataggtttttaaaacaagacagtctcaccaggttcatctcagaactgtgaaattaacgctgtggctgttatgccgtatttcctttagataagggaaaacgagtttccaccagagctagaaagtgaacataactttcctcttaaaagaattcatgtttaaaaaagtccagatgtaatacacttggagcactgttagctattgtgagttattgtgtatcaagatgcacagtgcgagccagtgagatgtcccttagaagtcagagatctgcggtcacttgtctctggacctttctcccccactacagcagtattttccctacctgtgcatgcatttgagttcagaaggcttttaagaggccagttcactagagtttagaactgggagaggtgatatggaaggagagctaggtgactaaggcccacagttggaatagtttaaagagttcaggagagctcttcgctgttattgctgttttgacacattaacccgacagattagtagcctttctagcaggtgccaagggagcaaactaagcgctaaaaccataaagtttgtacagtcacacattcgggaagcaagttcatataatatactctgttgtagagggtgctgtaacaccaggtatacaaaatttctcaattatgtcatctctgttcttcagagtttcttgaaaatagtaactcaaaaaatcacttcaacagacatttaaatttttacacccaggaaggtaacattttaaaaatccctttccttttgtaacttctttatagtttcttcttttcactaagtcattgccctttacccctactgtgtcatttaaaatgtacagaatgctttaatgctttctgtttgtgtgtgtgcgcgtgtatgtgcgcgcgcgtaaataagtttttgtattctgagtttgacaatggcatttgaccctaaccatcagtaaaatgcattgctctctgtaaccattccctttgtccccaatagaaatacagatattcctagataggcttgtcgtgttcatagctatgttgctcctaaaagtgattttctagtactaaaaaggttagattgtttactgaagtgtgagtgagtactataaagactgtattacctttaattacaagttagtgtatctaactgtgaagataagtgaaatagtatttttataatgactcagacttccattacaaggcactagagagatggcttggctaagtctggtctccaatggcaccaggcatgcacatggcatacagacatatatgcagtcaaaaaacgcatatacataaactaatgataaaacaaaattggctgttctaactccattgtttttactaacaaaatagaggaaaattcagattcagagatccctccttccctctctctctcttctttcctcactaacctgaatgagtcgccatttaaagggtcagagggaggtagcaggggagagcgtggggcttaacctattttcaaataactattcatactaatgaaacaaagcacacatccttttcattttaaaccagtcttgtaaaaatggagcacatacatgttcattaacattacttgctgtattttgagtcctttattatagttgttagtgaatatttatttactatggctattaacatcaccatttattcagggtaattttgtcagtaggcattatatgaaatgatactgaaatttactttcaatattgtttggtgatatttgacacagaaattaggacttcttcatcaggctttctttgaactgaagtttccaggctcagtgtggtggagcacatctgcaggctaagcacccaggagacagaggcagggggatcatgtctccaaaagcatttttaaaaagtaatttctaatattaatttctttgtggttccatttttctttagttcatgtttcttaaattttcttgtgtaatgaacatctgtacaaggaagcagtttttaaaaaggaaaaaaataagcttatccaccaatgttttaacgattctgtgctatggtcagtggtctgtgcagctgtttagatttttattttaggtggcagtgcctgtgtttatgtgtgactcacagtgtggatgagcttttttttttttttttttttttttcttctgagattttcatcatttttctggttactttcagtggacactgttgacttcacactgtctaataatgtgcttagtggctctcagactctctggtcttttgttttggtccatttaaaaatcgcattgaagttgtcatttcaagctgttttttggaaataaatcagaattaatactgctgagttcatcttaatggctatgttcccctgtggtgaattaaatttattactgtgttttcagaatgattttttttttttactcatgattagtaggaagctatatgctgtgttagctgatgtaattgagtacatgaataaattgtagctttttttagggggaggttgagaggtcatccttgaacttgtgattctgctgtctcagcctcctgaatgctgggattccaggcctgtgaccctaaagtgagaagactgaagcagatggtacatttttctgtttggtgatcatcacattttaagatttccaaactttatatggatagacttatcccatacattttgtaaaatattaaacgtatccatctgccagattcagcagtggcacatgccagactgctatggtctgatttccattgctgtgataaatatcacagtaaaagcagcttgggaaggagagggttccttttatcttaaaccatcattacctagacccgagtgtagtttaccatattaaacaccatagggtctctaaagatgactctggttaaatcagaaggactgtagcttggatccacaggacccacataaaggctaggtgggtgaggtgacccaccggcacgtctagtctgggaagatagagaaaggaatctcaaaataagctgtctagggagcccagccaatcagtgagctccgattttgacttagagatcctgccttaactgaaaaaggtagaagattgcctataccaatcaaggttgagtttcagatgaagaatacaggtacatacacactcacacatgttgcttacacactgatttagaggtgtgtatgcacacatgcacagtacacataatacaaattggaaacaaacacagttcatctcttacagatgggcaatcagaatagaatgaaaaattacctatctcagtgaaccattggataaatgactacaggtataaacttaatggagaccctaaaagaagagagaaaaaagtagaactttgaagagatgatgatcattaaaactgctggtgcatatactttgtttatatctacatcttagaagagaatcatattcattatggcaacagcagtgtaaaccttaagaaaacctttacaatatctgtgagtcacattatagtattaaagctagaaataagtcatcaacttgtttctattaacagcaatgcttacaagatacaatgaccttcagaatccttcatagagttagtgaaattctgtgggaaatcatgagaaattatttcaaatcagcaaaatccattccatatttagcagtactttaaatatctaaaacatcaatgttttgtggagaaaaagaatgaattttctatatgctgtattagacattgaaccatataatattttgctttttttcctttaagaaaggatcttactgttgtagcccaggctagccccagctccagagcctctgcctacagaatgttgggatggtagatacacatcagcttctggctccaaagcttattcttcaaaaatgttttaattggccattaaatacatgttgtgttatgtggtacaatatggttgtttgtttgtttggttggttttttcgagccaagtttcttggctgtcctggaattcattatgtagtctgggctggctttgaactcacagagtcctgggattaaaggcgtgcattaccacagtgcctggctttggcactgtattttaaatctaccacagctaagataataatgaaacaggaatacaacaaatacattacattttgtaattttagaacaattaacattacaaaataatttgacaactcagtaataattaatcaattctgttgttaacttctgggtccagtagccccatgtggaatgagtaaatgttactgagtttgtcacagatgtcctaaggatagtcttgtatccctgttcttcacacagctatatacactgctgaattatacatataagcaagacatcacatctaggacaacattagttattaactttaaatcttttccttctaatgcagcctcaactaatataaattctcaattcttggctttttaagaagtcagatggtccttactatagagtgctgagaggcaagatattttataaaacatataaagattttatagacaagagaaagtgtctaagagaaggcagcctggaagtagcttcttttttttaaatttcctgcagaacccagggtagcaaacacatggccagggccatgtggaaagaacaggaatgatagtcagtcttgcaaatcacggtcactgtagagtggttcttctgtgtgtcctaatattgctgcaagtgaatttgaacaggttgtgactgagatagctcagggaaacccaccgcttttgagtctgcataaacagctcctgttaagcacacatgctttctactgtttaaaattcatggtctggagaggttgctcagtggttaagagctctggctgtatttgcagaggaccctggtttagttcccagaacctacatggcagctcacaactgtaactccagtgccagggatctgatgttcaccttcttcagctcgagctttggtaaacggggcacatgcacgcacaccaccaccaccaccaaaacccagagaccccaaatacaagccccacatagtgaaatataatcttaagcttggttattctttctgtgtcttttttctgcaatctgccaacagtatctcagtaattttataactttttgaccagtagcctgtttttcacaggtattaataaactttacgtgttgttgtttctctccgaggcttgtcttgccagcattgcattagaacacgtacaagaacctcacttcccatgttgcctttcaaactttgtctagtttgagtttctaaaagttcgttagctcgtaaagttgaggatctgttgttgtgagatgccagcagatggaggttggctatatatgaagaggaaggcccagcaggagctaggaatgcagttcagtgcaggcttgtggcttagcaccagtgagcctggctttggtccccagcacacccctaagagaagggacaaataagcaagcaagcaaacagaaaaacaaacctgaatacaaattttttgtattattgcagagtttgccatctttgcagatagcatgggccttggagtgggaactggactaacagatgtgtgaacttgagttccttactacttactacttacctatgctaagttaccttcctgaaattcattattgccctcggccagtgcatacagtttaatgccacaaagaccatgaataatttcagactgttcttcattttaagtcctcttaaattagtcgttttttttcttaagagcttcttgttaatccctagcaatccaagatgtataaaaattattacactgtagtgcttttggtgctacatagatggttttatgacattagtcagacaactccaaaggtatcaccatttagcaataactctaccctagggctgttattgtaccacacactgtgactaattatactgtcatttctgtctgcttaaaccacagccacatttgaaaactaacgtaaattctccttccagatttctcagccagccacacagaagtgttttcttttaaatatttttcttaccacttaaagttcttcaaacaatacatgtccaaagatatgataacattcccattgccaccgaagataaatagattcaacattgttcaatttcggacctgatataagtccccctcctttttcacagttcctgaaagcatgtgtgcttttctattaaagggatataaactttaacatttaatgatagccaatcagaaggaatcatctgccaaccttcttctgatatatccctgttcatctctgacatctgatgtcatgcttggaatgcaggaggacccctcatggactgaatatgcttctattagagttatactccacataggaagatggctgtatctatcttcagtgcaagaggacccctcatggactgaatacgcttctattagagctataacctatgtagaaagatggctgtgtctctctcctcggatcctctggaatattttctggaacattttgcttatatgtcttcctgccagctatctccaaatgtgagacaagtggagcattcccctgaatgatgaggggcgaggagagatgagcccatgagaggcagtgtggcacaagtctcactgggctaagcagcgactttcaagtctttcctttcctagagggaccaagttgccaagtaaatgtgcctggctaggattttattcacacacttgggctagaatgtagagctttacatacgctagacaagcattttgctactgacatgtatcctcagcttctttgtgcttgatagttcttatgtccacttgacagaagctaaagtcatctgagaggtcgaaacctcagttaattaagaaaaacgcctccataagaatggagctgtaggtaagcctgtagggcattttcttaattaatggttgagagggggtggctcagtctgtcacaggcagtgttatccctgggctgatggccctgggttctgtaagaaagctggctgagcaagccatgaggagcaagccagtaagcagcacccctccatgtcctctgcatcaggtcctgcttccaggttcctactttacttgagttcttgtcctgacctcctttgatgatgaactgtaatgtggaagcataagttgaataaagcctttccttcccaggttgctttgacatgcatggtgttttatcacagcaagtagaaaccttaatactccttttatttttgcttttaaattttaaggcatgtgaactgctgacatttaaaagaagtactaagtgactttcttcatgtttttctctttgtcttaaatgatctttctccattactgtttgtctacttgggacagtttccctcagtaaaatgactctttctccatgaaggcttgaattacccagaaatagtctatttctttgaatcatttagtgctcttgatatactttcagtattacgtgcttactaattacatccatcttggcataaacacaccattaaattctgacagctcaggaatcctgactcatttgcctttctggggcaagtaaaatcataaataattgagttagaagaatctttagttaattttatgggtataagcattaaataaatccatgtattataaaaggtgttctgcaaatatttttataatatgatgttaccagttataagtaaaatatataatacagggtttgctagctactaactttggccttgagaggaaatagaaaataaccaggaaaaaacaaggtaatttagtttcagcagttgctgctggaggaggtagggaagatactaataagaacgcttttcattatagcctattttttatagctttgttgcctttggtgctcttttctttaagttgtagttccgtaaaacatgtaatgtatttggtggtgaaaagactacattgctaaaactagaatgtaaatttaccatgggtcttttgacctttgaaataaatggaacttgagtcaggtttcctggaactggattaactcacggctgtgagtcacgttgtgggtggtgggaaataaacctgggtccctggaagagcagccagtgctgtccctctgagctgtggctccagcgtcacattaaagacctactctgaagtatgtcagctgtcctctttttttctactctgtataatgaacaatttattcattctggaagttctcaatcagtgctaccttctttggaaagccttcccggacccaattcaccagtttctcctttgtgctgttaaaagcacgcatatctgttaaagaacagtgtatcacagcatttgtactaactcacgatctctgatctctgaatgccagagtcttgagatggcattgttttctgtacgagtctgtttccggtacttgtgaagacccctttcatcaacctttcttcactctatgaaagcaccatgtccttggggcttctaaggttgcccacatgtgtgtatatgtagaacctgcaaggtcacatgatgccttagaacctggtgggtagaactatctcaccacatccccaggcagaggacaccacactgccagtaggacacctttcatacagttgagagtaatatagacttgataaagaatgcagcatgaaagactcaaattacatataatgtattatggcttatggtaaaaatgcctaatgcaatcagatggaattttgtgaggttggctcttctggaaggcatttgtaaaagcactcttagtgatttttaataccttaatgctttaatttaatagttggtttaaagaccccagccatctgatagcagctagataaactggtgcttaagatacttcctaagatttactggtcaataaacacagcatccgacatttcctttagaatgtcacatgggaaaaaaggatccctgatgcttgcttttaccatgaaaactttaccatagtcctaattggtgtgcaataattatttctatatcttggccatggaaaaatgattattgattaaataatttgcataagaagtcgggcatggtggcacacgcctttaatcccagcactcgggaggcagaggcaggcggatttctgagttcgaggccagcctgggctacaaagtgagttccaggacagccagggctatacagagaaaccctgtctcgaaaagccaaaaaaaattaaaaaaaaaaaaataaataaataaaataaaataataatttgcataagatattaaaatgtccatagcacagtccagattcagagtaaacaaagccaaatccagcttccttatagtttgtcacagtagtaatccccacaaatgtagcagctgctgccctaaaaatgaaaacttgtcgttaaaccagaacctgttttaaaggatttttttttccttagttacaaatattgtggtataaaataccaatgcatttttgtactgtcacacttttaaaaacgtgagacttgagaactgtttaacacttctggaaatttttatctgaatttaaaaaaaattaaggaatttaccgtatctcatagttctactaaataatgacaattattgctactaaatgagctctggaatagaaagcctagaatggatgcatacttgtacagccagctgacctctgctaaaagaatgaggagaattgactggagaaggaaagccttcctaacaggcatcagaaactcaagacagagtagagtgatggctgccaggggcacagactacaaacagtgatgtagtttcagttggggaacatgaaagtttctagagatgatggtggcaatggagccacaacactgtgagtatgcttagtgctgctgtacaattataaatggataaacagaatagtttacatttcagtccaatgaataataaaataaaattataaaaatatagctggaaatgtcctggcagatttatatattaaaataaaactccatgttttatggatgcagaagcaggcaacataaggcactaataagtctctgtgctaagaaaagaactacttggtaatactgagcaatccaaacttagggttttctattactgcagaatcacttctcctgatgagctactctgattcatggctttctctaaaagccccaggatgcccctgagccccatgcatctacacagccatacagcccttttctggaagtacttgacattcttgacaaaaagaccttggaaaaggtggggatggtgaatcttccaacaaaaacattactatgtttccaattctcagcgctgagttgcggccagctgatgaacattcctaggtgacatagtttgacagctggaatagagtgtcttgatccaacatgccagctcagtgaaaagaccagatgttacatggtcaagggaccactggtttcatcttttctacagtgttaattcctaaccaaaccaggtgttcaaaactatgagcttgttttgatgtgggaagccagagttggctcaagatcatgctatgtgactcctagcacctgcactaacctcatgggactgcccccacatcccagcccccattcttccttaagtaaatcctgtctgacaggatagtcatgtgcagcatcagcagcgttctgcaagtccctcagcttggccagtttcctcagagcctcattaccacatctactctgtgaaaccttccacatcttagaggtcaggcaccccatatttctttactactacctacagtcctaacatcatccagaaagatggaaaagattagcttcattttgaaggctaagaagcaaatactcaaactggcaacgggttactcctttttgtccttaggttgtgtttgttcccagatcctgatcatagttggttcttaaatgtccattggaggatttcagcattcagacatcccctgtctccactgatactctgtggactttgaaatgcacagaatacagctgagaaccttaaaatgcaggttgtgatttgctatgcttaaaatagagcgcgaggttctgcatttctaacagtctcccagatgctgccaagcagcagatcctcagacaacactgtaggaagccagttctaaagctctgcttctcctatggtgtcctcaagcagtgcagagccaggaagaagcacttgaaaactctcctcagttgcttcaagcataaaatggacaccagattttgacaccttagcctgaagtaaaagaatataaaatagaatttttatattgattgcatactgaaataattgtttgaatgaatgggcttgaaaaaaaaaaaaaaacccatcctaattagaagttgttttacatttcccacaccaggctctgtctccctttctctgcattctgcttgtggatcagatgtgagctctcatctactgctctggtgtcacacctgcctgcctgcctgccaccatgctgcctgccatgatgatcatggactcaccctctgaaactgtaagcaagcccacagttaactgctcccttttataagttgctttggtcatggtgtcttgtcctagcaatagaaaagtaaccaagacaaatatgttcaataattatatgagttagtttaaaaaaatacactttgaaaaataaacgttggagcatctacaacattgttttagtttgcttttctgttgttatgataagcaccccaaccagaagcaacttgtgaggaaaattttcatttagcttgtacttccacatcataatccattattgagggaagtaagtcagggaaggaaccatagagggatgaatgatgctttctgcctgttctctgtgacttgctcagctgccttactcagtgcaggaccacacgtccagggaatggcgccatcagtcaatagtcaagacaattgcccacagacatgagtacagaccagactgatctgggcaatccctcagttgagactacctcttttcaggtgactcttggctgtgtcaagatgagaataaaaactattcagactcagaaggaagaggaggagggagagggagtagttttatgtatttacattccccttgtcaagggactacagaaaatttaagtcggcatgggtggttcatgttgtattttgcttggactgtgcttttctagcagatcttcccgagtcttatctacctgtctgtcattcaagatgcatcacctgcattgttaaatgtctcatatagagcacttgtctgtgtagagagcacctgaaaaccccaaatttcccattccttgttgtgtttctcttcttgtaagtgagtccttagaagaatgtcttttacctaattgattctgagtgatgatcattatatgatttttgagtcctaaacatgtgctctattctcacaaacctcaaagttcttagcataatgtatttaaaacaccatgctctggattaaggtctaggtcaagtcctaccaattgccgtgtgtctctcagggtgggtctcaagtgtctgaaccactgtcctctctgctaaagcaattcccaataactaatacaaatccaatcaaaacacaatcaggaagtcaaaccactgtaaacaagacatcacccaacgcatttctaaaggagattgggggttgtgcacaccaggctttcctctgttgaggtaataaaaagttgattgatagagaattgctaataaataaagatgacacctctctttcagtacctgtggggacggacttgtggagcttgaggcagtaaggacactgtttgccatgcagggccaggaagattattttcaatctgaattcaggggccactgcccctgcttctgggaacatctttcctcacttgtgtttttactcattcaccatctcatttcttctctgtcctcttccgggcctcataggctcaaaccctcaataagtaaattttctgagtacctttattgttcatatgccagtgaccttggggttcacattgaaaaatagctactggtgggttggagagatgactcagcatctaagagcactggtagctcttgcagaggacctgatttcagttcccagtactcacatggtggctcacaaccatatctaacaacagttataggggatctgatgcccttttctggcctccacagccactgcatgcacacagtacacagacaaatgcaaaaaaaaaaaaaaaaaaaaagtaaagcagtattgttacattaacaatattagcaagtgtgggtcataaaaccatgccaggaagtttggtaaagtagagcaagttgagacccagagacacagtgggcacacacctgaggcttaggtgactcccagctccctgccagactcttgacttggaatacatgttgtgcttcttatgtaaaaggaaagtgtcctgggtcatgcaggcccaagacagagttctccatgctaatgaggtgcctagaggccaggagggtttagccaataagcttcccttcccagacattcctcctgcaaaagttatttgatctcaaacccaccctgagaaatggggtatgattttatgcatccattttctgccatgacaataaactgtttagaaccatggactgtctttttaccaagatttgctgtggggattaatgatgaaagcctttgcctacagagttgcagtctaatctcctgtagaaggcctctctgtgctcctagccacagccgcccccaagcctgcatcttccaagctaaggacaatctctcttctggacaagccagaactcccctcttctccccctccaacccctgccccaggctagatcctgccttctagcccacaggccagactccattctctgctcttctgcaactcctagtggcacccagatgttcaagagtcagagaacaccatggccctagccttgtcacaggccctgggactcccccaacccccaaccagtcccagggtacccatgtttcacactgcacttttccacccccagagtggtgcctcagcagtggtgtgggataagtgcagtcaaactcccagtgttctgcctccccaagctgctgtgccaagtggtagaacagatgcgggcctacaaccctacaagcaagtcttcacatttgcctagcatctctgaaaccctgagttcagtgtccagtacagtaaaaactataattaacatatgcagataccatttttacattctgatgaagtttgagattttgtgtttcgtttgttctgagggtatgactggctcctgtgggttgtttttttcctgctatgtgttgttttctgttgtgtctgagttgcagtgtttcacgatgtagcaaggggtggtcagtcctctgtcccctgaggctcaggcctgccattgctatgcacttgcccaccttgtcatgcagacaagatctacttaataaagattagctgaagtcacattttatattttttattaaataaaaacttcctccattggaatgtcaccttgtgtatgaagtaaaagtaaaatgctaatttggaaactatttacaattcaaaatatgtttgtttgcatatgctgcatgcaaatatccctggctttaagtgggggtcatttatccccaactgtaattaaagttcctttgttacccacaggctgttcaataaggtttcctaaatttaaatggtgcccctatctggagaagctatgacaggaaagagggcatttttgtttctaattctcatttcatggctgtcaacccaacacagcgctccctatattctgagaaaagtaatctctctgataccccagtgtaatcatatttcttcaaagaaaaatgattctgttcattttttaagacaatacacggctgtgcgtttgggaacatcctgtagccaggctccacacatgacaatcattaatctagtaatgacattgaaacaaaacaaaattaatttattgccctgtgatatatggagattataaaagaagcattaaaatctactatttggacagcttcaggctctactgaccatggagactaatgcttcagtgaggtccatccattaattaaagttcctttagtgtgcatcttatattaattgtgtattttatattcatgttgtgctgtgcatattacagactggctgtattcaggactgggagggggcaattacatatctgtgaacagcctgccttcttgtccacagtgacatgggtttgagtcaaacagagctgaaacagagcacttaatttgtcatcagtgtttgaggctttatcaaatattgaacggaattagcagatttgggttaagcaagaaacccgtatagggcatagtggtgtaggcatgcagtccaagcactcaggaggcagcaagaggaagatgtcaagttcaagactgcctgggctaacaacgataacaaccagaatccacaaaaacaacaaaagcaagtggcttgaggcttccatcatctgtgacattagctggtatagagttttgctttaaaagttacattttagttatttatccagttgactgaagcatttcataaggaagggggctcattagactcaagagctaagggaacataagcaagagtcaagcagcccaagcaggagtctgtgcaggagtcactctgtgctgaacagttgaggggaaagaaaaatgttccatagagcagcctgcaggttgtacaaggagctacagggaaatagccatcacccaggtgggtggactttttagtgatgcagcaagcagactttgagttgggcatgttcctggaagtgaccttagtcaagcctctggaaggccagtaggccagctggttcactaagctagacataaagtggaatcctatctttggtatgtttccagtgtggtgagagtgcatttatgtttccctaggaagagtcctgcaataccttcacatgaataaagtcctctctagtagccaagtagtaaaaaaaaaaaaaaaaaaaaaaatgttgagagactgcagagatgactcagtggttatgagcactggctgtttttccagagggcctgggtttggttctcagcacccatgtagcagcttacaactgtctgtaattccattctagggaatctgacaccctcttatggcctctgaggatcctgcatgcacatggtttacctacatacctgtagagaaaacactcatacacaaaaatataaataagaataaatattaaaaagatgttttgggagctagagagatgggtcagtggttatatgccctggctgctcttgtaaaggacccagatttgattcccagcacccaattgtagcttacacctatctaacactggttatagaggatctaatgccatcttctgtcctctgtgggcactgcacacacatgctatgcccaatacagcactgccttatgcattgccactctgctgtctgtgtctgggaatgtcacctctaggtacctcatttaaagaacaatcctagtttgtctgttagaactggattgtctgatttaatgtcttcagccatcatccatattagtcatttgtcagagaagctgtaatatcttattgtgtagacatgccactgtccactcctctgtcaacagacacttgagttgcttctgtctttattgtaactaaggcttctgtgaatgctggtgtattagttactattgctgtaataaaacaccatggtcaaggtgacaagattgatcagggcatatgattccagagggttagaacccatgatggaagaagaaaggcctagctgctagagcaggaaagacaagatgtatatcttaaaccaccagcatcaacagcgagcaagctgggaataccctgagcctctgaaacctcaaagactgcctccaatgacgaactttctccagcaaggccacctaaacccacccagatacccaccaactggggaccacgtattaaacttgtgagctgatggggggcagtctcattcacatcaccacaatgaatatatagacacatctccatgttcatgtctttggataatatacccagtagagggcttgctgggccacacagttatgttatcttcagctcccgaggggccctccatgtccttcccaggattcccttttaaacttgacattttacaatagcattttgttgttcctgattcctatgtctgttctttatagtagccatgaaatgaatttaaatgtatatgtatattggggctatagatactttataatatgtgaaagagaaaaatgcattggcacttgggttaaaaaaatgtgcattaaagccagttaagaagttggggggccaccccaacaaccttaccccataagactgagatatgtagctcatctagagaacacatcaagtgtttcaacccactgaatgacctccagaagtcccagtagaaatacagcatttttagataaagctattatgacttgaaagcaaaatgggtcactagacttaaactgttgcttgaaagagacaatttaaataatgagagaaaagcttaaaatcccatgaggtataaaggaaaatgctgatacacaaaaggtcacccttgggtctggagagatggcatagtatttaggaacagtgactgttcttccagagaaacaaaattcaattccaggcaccctatatggcagtttactactgtctgttattctagtccccagggaatgtgacaccctctcacagacatgaatgcaggaaaaaaaataacagtgcacataaaaaaaaaggtcacttacatgaaaaagatcctttaaaaattacagtgaaaaatctacttaaggtcgactgaatgtgtatagatggatagaattcactgaaatgatgatgtattgcacccacaggaatccactgctggaaagcttcaccccctaaaggacaggtaactgggagtgataaacctggaactgtgatgtgttggcaattatggacacttgtggtatcacctccagcttttacgtggatgctagggattaaactcaagtcatcaggctggtacaacaagcactttctgagccatctccccaaccccaagttgtatttctatttattaaaaagtgtgtcatggagtaggttatgaatgatatacatggctgggctgtaactctacatcacatgtattactattattcaccaacattctaatatgcttctgtactgttggtttaaaaaggcatcaagactctttccattcagtcaaaaaacctttatgtcacaactggtgggtatataaattggcatttgggaatcaatttaggtaaaattccatgtctaccctttagaagctgaaaatccagtcatgtggtcaatgagtgtccacagctatcagttgacagattgacatttcttgctgacagaaaactaaattaatcaatggaacttattctacacagtttcttgaatagcctgaacaacttgcactgtgtcgatgacttctgcctgacttcacagtcatcccaacgcggtcatcaagggactggtgctatttctaacccaatgggcattaacatcttttgtgacaactaggtctccagctttcccggagacttgaagtttgtctcacctattcacaacatgccagtgctgcttctacctcagcctccctaaaataatggtaccacgagaaaagaacgtggcttgatggtagcagatgtttcctgggacagagactgggacccaattctaaatccagtctgccttcaaacatctaaagaaagatcacacagctttgctcttagaccctccctcaaatgaatgctctgagccccatgtgaatgccttcacctttctcctttattctctccctatactttctttttgtaataaatttctgcatgcgcatccatcagtcctatgtcgaccaaggtccttgcgtgaagaagcagtggtggcggatgacatgccaagtggttatgtttgcctctgacataatcctatcagtaactccctttttaaaatatgaaaacaagcagcataaacacaatcttacagaaaaatataggggaggacactgctatagaagatgtcattgacttttaagactgacttgtaacacataaagtttgaaagattttatttgaaagaaagttttttacctgaaatgtagatagcttcatcataaataccttcagtcctaaatgataactcttgagctcaaggcagaaattctggctgcatggtgtatgtgtgtggggatagtggatgggagtttttggtttttgttttttcaatccttgggtcactaatctttgctaagcagggtttaagatcagaccaaatgcttcatgttcttaaaaaaaaaatcttaacttttaccctttgaaccaactgggaaaatattcctggtttgccaccatttaagtaactttctacaaatgatatttacaaagaaggatttcagttgtgggaatgacaataaaaacatcctcaaacagcatcttttccaatgttccttagagataattttatccttattctacatttttaggacttattttcaagcattgtgacccaagtgaagattatgtcttctctcattagctgctttggaaaccagtaatggaggtactattgcatccaccattaaaaccctctccctatcctatgaattgtttctactcagtatacttgacgcatggaaaccaggtcctcttccatgtggacctaagagacttccaaagactgctcagaactctctctgaccagaatcaagcaagtaattccaagatgctagcaacactcaaccaaaccaaaccaaaccaaaccaaaccaacaaaactatactttttgcttcttttattggcatatctctaatttttagttctacttagtaagattgcttatcaattttcttattaataattaaacacttaattccttggagattagttgaggaaagttggctctttattccttatgagacttttagtaggcaccatgggcctaaacaagtgtgccctgccaaccacagacactcttttactagcaggccatttacaggttgaatttaggttaagggtatggagtttaaagagtcagtgcacagagctggagaagtagttcagtgcaaagcacttgtctctcccacgttggatgactaggctggagtttgtttagcagatccacaaagaaataaaaacaatggcaataactgattaacaaacgatgtgtcattcagtgctttaccaaaagccattatagacttttaaaagtctgatttagagtcagtggacatgctcagtgagtatggtgtacaagtatgagacctgagttcaaattcctggaagccatgtaaaggtggagggtgtagcatgagagtgtgtaatctcagcactctcatgactccatggcaagttgagacgagtcctcagaaggttgtaggtactagcctggcacacacagaagaaaacacaagtccctttgtcagacatggtggaagctacacatgacatagcatgtttgtgcctaacccccccccccccattataaattaacaagaaaacaaaaggtctgatgttttcccctgattctgccatttaatagtaattgacttcagaaaggtcaattaattctaatctgtaagtgggtaatgttcattaaaaatgaatctgggaaacagtgctcaaatatgagcatgtcctgcgccctgtgggatgaaaggggagagtgcccacgtgaccatattgtcctttcttatacctttgctgtctcaagtaaaacctgggttgaacaaaggataatgttgctacctcctttgatttttcagcaaattttgaatttattgctcttgcctttgggtgaatgatcaacttatgtgattcaaatggcagagaggttgaggtggagagatgtggaaattatttttcccatgtatggtcatttcttttgttccatcacactggaagatggctgttaaattcaattagccattttttttccttcttcatgtttcaaaaaaaatttttcctgctgtgctaggagaccttgatttctgttgctaggaaaccttgaaggtgcttttgcttttcatggaagcggtgtttaatacaatcactttgactgatagcttattggctccttggctttatgccaactcaagagcagctcacttcaagtccacacaagttaaatctagaagtggggaaggtactgacccctcaggcaccctgtggaactgcctcatgggcttcatgggggtgggagaaaggaagagtggagggcaagaacctcccttgtgcctggagagctttgatctgcgttagtattgggcttcctttggacaaaatgttccatggaggcaggaggtagctgagtgggttgaaaactgtttaaaaagccctgaccctaacctagcacaaaagagaggtgtctgagaaatcacttgccaagaaataggcagctcatgaattcccagcctggagagttaacaggatcttttgactagacatctctttgcaccatccaaggtgctctgcacaccttacatggtccttcctcagagtgtgttctgggacttcacagtccaactctgtccaaggctcttgaagttcggcagccctggacagaaaaagtcatggtcggttgtaccaacaggcttctccaaaaagatgctgagatttttttttttaacttaacacttgccagtcattttctcgaattctgttcaaagagtatgggtttcttgaggggtgtggaagaatgttttgtttcttcttgtagctatgatcttggggaggacttttgctgagtgtgagaggatctgtcttagcaatactatggccagctgagctgagcattcctctgcaacaaacacctagaagaatgtaaaacaccttttgaatgtccggcacagctcagaagatttaaagggaaagcttgcaagaaaggaaaaccaaagtctttacatatgacttgatgctgtcactactttgggccaatgggtgccagcagtttagagtccgtgtcaatttaagaagttgagccctggattggtttaagatagaggagtataatcaaaatagctctgaagcccaaggatccataagtctaggacttttaaggatctgcacacatgtgaaataagcaaatcggaaacagccacagtagagggtggccacaaggaggtttctctctttgtgttgagtgcccaagtagaggcatatgatttcaattttgaacatttctatgtgggcttcatggggaggctgaagatgctccctaaacatcaagagcccattgagataatgtattaatttcataccaccggttctagtctgatgacaaatctaaaagagtgccttgcaaaggccaaaatatacttcttacatttctaaaaatttattggattctcatgggtaactcacctaagttattttcttttgagctcagacctgtgtgttctgagtgatttcataatctgcaatttaaaagttgggaagaaattcaccagtagaaagagttagaatacaaagagatggtatatctagagtgtgtggatttttataaggactaaaaatgtaagacagtcttaaaattaaatacattaaaataggtcaattaaaaatgtcaagtataattttgagaaatgaataaaattgaattaaaaattaaattgggagcaagggagattgtggagagccgtgccgtgagcaatcgcatgtgtgccgtgagcaatcgccattataagatggcgctggcttccactgtgcctaactagtaaacaagccttatgcgcaaatgcaagagtgaactcacgcctagtcactgcccatctcgaggcgtagtaatggggtgatgggcgagcaacgaatcaggagctgtcatgccacatcaggtgctgaaacgtcacgctgcgggctatataagcagcgccattttcccggttcggggtcttcctgagaagcaagcaataaagcttggccacagaagattccggttgtcctgagtgtgttcttgccggcggggacaaaagcttgggataggagatatctccacaggtgaagtacttgacacacaagaatgaggaccagagttcaggataccagaaaccatgcaactgttgggagagtatagagtcctgcctgtaatctctgtgcttttgtcagagacagggaaccccaggctatcaaggttatcaggatcagttctgagtttaagcaagagaacctgcctcaacatacattgtgaagaatgatggaggaagacatcaggtattaatctctggcctctatatgcacatacacacacatgtgtgaacacacacccatatacacacaccacatacatacatcatatacgtctatgaaagccatagaaggatgaatataaattggcagattaatcaactctgagctgagaagagaatttgtgaatggaagagtgtgtcactgtgcctaactctgaggatcaaattcagatcctcccattggaacagcaaacaggttatccacaaagataaccctctaggctcataaattctcaaatatacatatatatgcatacatatgcatacataatacagtgcataccaactatgaggaaaagatacacacatgtgtgatggtgaaataaaagaacatcaaagtcaagagcttttctgcaaacacagaaaaaagccaactgtaaacattcaacaacagagctctcccaagccatagcagagtccaggaaggagcataactcagtgacggtaaaaatcagctctgcacaaacctaggattctcctttgaactaaagaggaatatgcaaataaaggcaaaacatagatacattcagacaaaagtagtgagttcaactcttgctcaaatatataccagtccagcaatttacagagaacaaaaacaaacaaacaaaaaaccaaaactgaatccagaatatagaagactcaagaaaatagcaagaaaaaagttgataatcaaaatgttgggggaagccttaggtgaattgatttgaagaccagcataagcagatggtgctgttaataatgacagtctcctgggtgctatagaactaaagagatgcatgtgaaagatcttactgaagtaacacagcaaagctgacaataaaacatccagggtgctggtagatgcatgtaagaagcccagttctaggaaggcataaacaggatgattgaaagttgagggtcagctctcaagacaaaacaaaatcaagtgacatgaaaattctgtcagccataagttatttttagtgaaaaggatgctattagagttaacgagataattcagtagaagaaaaaaaatttaaaattctaagttcctatataaatcctcttaatatagaaaacagaaattgacagagcaattgaaggcacacaatcataatgaaatgtgcataactcatacagatcaagaacatgaaaagattcataaatgtgcattcaggtgatgacaaagtgggtcaattaagtagtatgttgaacttagaaggaatatattatattcaagtacaaatagttcactgctaaaaatagtccacacactgagccataaaaaattcagtacatatgaaaaaatgacaatatattttgacctgtgttataaaattgaaaccaaaatttatcccaaatttcacaaagactggaaatttaaaaagttcatgggactgctctttcagaggacctgtgttcaattcctagcacccataccacggctcacaaccgtgtctaactccagttccagggatccaacaccctctaaaggcctccttgagcactgtgcacacatagtgcacatacacacatttaggcaaaacacccatgcacataaaataaaagtaaatctcaaaactgcaaggataagtgatccagtcacactggattgttctgcactgccctctgatttctctgacctgtttgtccatgctgagcctgtgctgactgtgtgctgccagggtccttggccatgtttaaaagtgaatatcgctaagacctaagacctgtggcctcgggcagagctaccaagagcttaccctgtggggtagttacatgatcattttggtgactgctagtaaaatccagctgttgtttgtttttgttttttgtctatttactttttgttctgcattttgctttttctcccctgtgaatcaagacacaagcaaggtcaaaggcagtcagtttgtctatcctaggctgttacataagagctgtagccggaaggactctttgctggctcaccaaccacagaggggagtcatttaggctaatgtcattgaaaggacagcgtggtctctaagacttgtagagttctggagacaagcaggaaactaagaaaaggcatgcttgcttcccctccacccactgcccttttgtgggtgagctttgggtgaatccacaatgtccccagagctctagcaggagggatggcgttgtgaagggggagagtggctggttcccagtataattgatgtgggtttcctgcagcattcgttggttcagggtatccactttccctcacataatcttccattgttctccctggttcctgtttgatttggcaggactgactgctggctgtgcactccaatgctcctcattccgctgtgctagactcagctgaaatccttgcctcccctcaaagaagccaaatgcatcatgaacagtgacatttctgctagccaggaaaacataaagaaatcccagtgaagcaagaaggtagacaaaattctttccagcatttgaacaaaaagggtaattgtttttgttgtttttgttcatctaagttttatggaagtcgattatccaactctctgctggactttcaaacctccttttctctgtcctacataatttaaacacactataaatacccttagctactctgagggcgggcccatatttgcaaggcaaccacggtttgagatattgttgaatttgaaaggcagcacttccttgtccggcacataaactccaatgaaggttatgatgagtgtgctggtggtggccacgtttgacagccagacaagcagctcatttattccaaaagactttgaatccatgcccagagtcaaatgtagactctttttttaaaactcaggaggcttgaaataagaaagttaactgactcacagtgcccttcttgttagggagtaggaaggcttcagaatggagagagggctaaagtgtttgaacctgtccgatggcttctttatggggttcagccatggtatttcctagcttgtcttgtgtgaaagtctatattgcttgttgaaggttgaaaatatcatctctttatgaaaatccccaatcctgggaagaaaatatagaatgaaaaaataaaatgggatataggaagcctgtggaataggactttaaaaacccctgtgcatcactgaatcagtaaatgagctaacaagagagttttgtggccaccaaggaccccctccatgtccctgcttccctcaatgatagacataacctgtaagttgaagtaaaacctgtcttcccaagtcactgtttggtcatggtgtttatcacaggaacggacagcaaactgttaaaagtgcatgctatatattataagcctagtcaaaagctggaggctggagagatcacagaccttagaagccattcattattactgttttgctaagtagacggtcccattgcctcctaaacactcatgttcatatgcattgattagtgatactctcaccctgaatcagggtggcttatggcaaataggaggtagttaatgcagaggctcacacctggtcaaagtgtccagaagtgttacagaagaacaggtcaataagaacctaagagccagaggctagagatgcctgcgtttgaaaagatgacttctggacaagacctggctgttatagtcataaactcgttatggaaggtggaggagtgttcctgagacactactgacagtaaatccctccccgaggggctaccaaaagttaatagttgctgtgggtaatgcattgtgcttccgggtgatgtagccaccaatgcattgcccttgttccagtaactatcctgccagctatacttatgtaaattcaatggctcacacacaaaaagaagacttcaaattggagggtacttgctgaggagtttaagcaggaagaagaaagggggtgtgaggatagcagggagtgaaatgattaaaattggttatatatgtatatgaatgccaaagaataaaaagtaatttttaaaaattcaacagtgatccctttgagtgtgttctattgctcggcactaaaggtataaacagattttgttatcagaaaaaaatgtctttgtactgaatacagattcccagaatagtacagaacaaggttgaagccaggctgtgcctccaggctggatagtgagaggaacacctacctatttcccagaagagccttactgtgcatcctctgaggaagagaaaccttttacataaatatgtcgtgagccttggtgaggcagggcactgtaaattcacagtatcagagatgtcatcctgacacctatgtgtcaccctgcactcacagagaaaggactttcgtatggtctgtatttaaccccggctgcaaatagctctgctgggaaatgaattacttatgagttgttaagttctattcagaccgactaatactttatgtaaatctatgtcttcctcaagcctttgatttcactcaggtgattcttgatgctcccaaatgttaagtgaatgagcttaatgttagtaacacagtgccatcattgatagttgccttagtcagggtttctattcctgcacaagcatcatgacaaagaagcagttggggaggaaagggtttattcagcttacactttccacattgctgttcatcatcaagggagtcaggactggaactcaagtaggtcaggaagtaggagctgatgcagaggccatggagggatgtttcttactggcttgctttccctggtttgctcagcctgctctcttatagaacccaagactgccagcccagagatggtcccacccacaaggggcctttcccccttgatcactaattgagaaaatatcccacatctggatttcatggaggcactcccccaactgaagctcctttctctgtgatagctccagtctgtgtcaagttgactcacaaaaccagccagtacaatagtaattcagtgccatcattatttgtgtatgtgtattatttatgatgtgtcatattatttaacatttgctagctctgtagaagaagccacaccaagtatattaacaatacatttcttgccaggattagatttgattttaaaatgaagtagaagggatgaaggaagaaagagggaaggaaggaagatggagagaggggagtaaacagggagggaaggaaggagataaggaaggagaacttcctatcatcagaaagaggaaggctggtatgtataactgctctttttctttttatgaagatcatggtaggatgccacccacatagagagagggtcttcccacctcacttaatctagtctagaaactctctcacagacatgccctgaggcttatctcctaggtgattctaaagtcagtcaagttgacattcaacattaactattgaaccacccccatttgaacattaatgaatactttaactcaaagaataaggaaggtaaaaagcaaaaacaaaacaaaacctacatccaatgaccagagcccaagaagccatggacagggatgatgctaaagatgactattgatgtccacacctacagcagcagcagcagcagcagcagcgacaaacaacctttggttgacctcagcactagagttaaacacagaggtatatcccatacagtccactgcatatggcacatctcctgacttattagaactatcacactcttttgagagtgaagaagtcaactcaggaactttggaaaattccaccagattcctcccctcctggaagagaaaggtcatagaacacataggcacccctcacctccggaagggagaggctaattacattcctcagactacagtgggaaccaaccattggccacctgcagatgaggaaagcccttgctatctcattccctaaggaccaatcagtttaaaagtcacactgttctgccagtcacattgtgcctagtggctgtttctctattctacctctgaaaactgtataaaaactcgctgaacgagctacctggggtcaccacctctccttcaggtctgggacaacctcaacgtgctggaacaataaattcctcttgcttttgcattgattcccagctctgtgtggctcactcagagggttcccagtaactaaggttcttcagagtcttacaagagctatagaaaaatcaagaggctcgtgttctgacacagtacacaaggcctcaaaataacaaatcatcagcaaagcataatggaaagcacagtacaaaatgcagttgggaatattgctgagacttcacagcagtctcgtgttccaggccatatcatcaagaaaaggccgtagtctaaaaccactcttacatataagtgagagatccatcctgacacacatgtcaacctcaacatgaaaggacaagagatgtgaaggagcaagatgcagtttctctcagtgttcataatttccttccaagtgactgcagatatccacaggggtggataaaatgccagcaaatgaaattaaattaaatgggcgaatttagaaagagtaatgcattctaagaaatcagcaggaatgactaatcaagttaagttaaagaacataagatattactgagaaatttgatagattctggggaaaaatttacaaggagactgttcatctaagggtacagaaaggatacttaagtgtatattctttttgttctgatttggccctacaccgtgcacacacatgattttctgggctacttacggcattaatttgcagaatactttcggatatatcagaaagatcggcaataactgcagatgtgaaaaggaaggatgaaagaatgaatggaagactcagggatggaaggataaccccacagctacacagatcacacctgtcttcacagcatcatgtcttacccagatcttccaaccaagctctctattcactatagctgaccttcaactatacatggaatcagtttcagaagagataatcagcacagatgatcaatggatggagtcaatcacccgtagttgagccaatttaaacttacaaatgaatgagattcagactatggttatttaacctctaacaatcccagttgtagacctgcccaacatgacaagagggcagttcaggtcataccactcctggtcacagcgggaataaactataggtgctggtgctggaatggcagggccaacgacttccctaacaagaagttctcttctcagcttgacaatggtttccaagaagtgacccaaaccatgctcaccatctaaagacagattgatttttgtttgtttgtttttttgtttgtttgttttgttttttgtttgtttgtttgtttttggcagcagtggtacttcagaactgacagggactagttatccttacagctaaaggaggtggtctttgcctgtttctccaagaagaatgctgtttctacatcaatgaatctgggatagtaaaagataaaaatacaacagctacaatcagacatccagaaatgcagggaacgtgaggcctctgattcctggattttcgaaaaccctatatggaaatggatactgcccttcataacgcctcttctcatttttctggcgttactatttgctccctgcctcattaacctcatctccacattcctcctatgacaagttaaaaaaaaacactacataatcagctccttttacaggattaccagctgctgtccacagaggaaggagcctggtacaaacaactatcaggtgggccccatggtgaaagtcagcaaaccccaaaattgaggacaccccctagacagcaggaagcagttaaagaggtctgatgcccctgttttccttttaccatctgcttccctctcctcccttctttcttctctttatgataagaaaaagggaggtatgttagcatcagaaccattcacagacagccagaagttgtttacagccagcttctgaacccagctatgatgtcatccctaggtgataatgaccctcctgtgtctgttgccatggcatccatcacacactccctgtacactcgttacctgtatcacctgtgcttcatgtgcgtcagttacctgcatcacttgcattacctacgtcacagactggataaaagatacagaccctgacccatagcactttctctccccatcacttcctcatttcttcccctcaccctccccccacccccctttcagaggtgcctctcatgtgagacctgtgctggcttggcgtgatctttcctggaatgcgcagtctcctataacagtcacaggtaggagaggggaggagttaatgtattcacggtaactgatatattcctaaccagtcaagtcactttcctcttaagtcattttcctttctagctcagagcaaacccttctgagtgactttggacttcaagacgagttctgaggcatgagctagtccctcctctcctcctcaggattatacttcagtgaacctgttccaatcaaaactagagtgtgacccatgtgacttcattcagggtattcatgaatctccaagaatcacacctgatttcgatgaacacaatacagtgtatgaagaagtggcatgttagagaaaccaaacattttttgtggaactgaaactgggaagacaagaagatatatctagctaatccttactgctccaccacacaaatctccacagcttgactccgggcagaaaccccattgaaactaaaagcaagagtaccacattgtatagtatcttgtttagaaataaaaacagcagagccaaacagaatttttaaagatattccagctctgtctgctagagatgatatcagtttgctggttggttaagaacatatttgcattttaataatggctcataggcctggtgatgtggctcggtgggtaaaatgtttgccgtacaagcatagggccctgagtttatgtccccagcatccacacaatgagcctgtcaaggtgtcacagacctttcatcccagcactggaaaacatgggaagagcctgggggcttgctgaccaaggaggctaagtgagagaccctgtctcacaaaagtaagtagaagaaggactaaggataacagccaattatttgctttggctctgcatgcatgcacatgggcacaaacacaacacacacagcacatgctcatgcatatcatacacatacacacacaccacatatacacatatcacacacacaccaccgccacatacatattacatacacatatagtatacacaccaaatatgcacatatgtactacgcacactacagatacaaacataccacatatggtacagaaacacattacacacacttacacatactacacacacacacatacatattacatatggtacacataccatagatactacacatccataacacatacacacaccacacataccatatacacacataacagacacacatgtatacaaacacatataccacacacatatcacagacacatatgcacacaaacatactacatactcagcacaaacacatcatacacacttacacacacataccacacatatatatcatacaccatatacataccacacacacatatgtacacaaatgtatcacacacataccacagacatacagacatacaaacatactgcacacacaatacacaaacatatacatacgacagatacagatatacacaaacatagcacagcacagaaacacaccacacacatttacacataccacaccaacacatactacacacatacatatcacacaccacaccataccacacatacatatcacataccacaccataccacacatacatgcttacatacatgcaacacacacacgctcacatacacgctcatacacatgtacatgcacacatcacataccaaaccacatactactcccccacataccatacacatacatagaacaggcacacatttatataaacatactatacatacacacaccgcagacacacacaaacatactatacccacggcacacatgccaatatacacataccaccataacatatcacatactacacacatgcttagacacacaataaataaattaattaattaaaataaagtaagtggttaatgttgtagattggttctaatgctatttgtgttaattcaactcctgaaatcacatggggacccacttgtctgtgctaaggtccctgctcccaattggctctgattgggaaataaagttgccagcagtcagtggctgggcagggagacagtggtgggacttttagaattcctgggcaagaaacataggagagagtgaagaggacattttgccatgacaaggacataggagacagaccatgctgggaaggtgtaggagcgagaaactgctgaaatgtaggtgcaaaggggaaagtggccccaggagggctgcccagaagagtccagggcagcaaggataaaatatagatttagtaaatgttaactcaggaatattggagaggaatgtgtgaaggggagtgtgttagccacatggaggctcaggagtggcccaaccattgagctagttaagacatattaaaatataaaggttgtgtgtgtgtgcctttccatctgggatccagaacacaagggcaggtggtgagaagcacatgtgtacacgcctgggagtttagagtggattaacaattgactgctacaggctaattatttttagtggaacttctctttttttaaagtcaagtaattaatactcgactttaatattaatatgtgttttaacaagacacgatagtttccaggcaaccaatttttaaaatgatacagctgaggtttatgggtagcaaggaatgacattctttgacataaacatgtattctataagttgacccctttagatgggtaagagtttcaagcaaaaaagaagtagtgatgaatttaaatgccattttttaagattcttaagagccaaggctttcccaggcagaatatccagtgtggtctcattgcctcttgccctggcttcactctatcagaaacactatcaggagttgtaaatctctaatttccttctaatgtgctaactacctccgaaggtttgcagtatctttaagatatgtaattcaaaattgctattattaggtttatgggtctaaaagaaacaaaatgcatgtcagaggcagatgatgtcagaggcaagtgatgccagaggcaagtgatgtcagaggcagatgatgtcagaggcaagtgatgtcagaggcagatgatgtcagaggcagatgatgtcagaggcaagtgatgtcagaggtaaatgatgtcagaggcaagtgatgtcagaggcagatgatgtcagaggcagatgatgtcagaggcaagtgatatcagaggcaaatgatatcagaagcaaatgaaagcctgctattgaaccctatgtagcttgcataggatgtccaacagtccttgccattgtctctcatttatataatttcttgtatattttgtatatctttataagcttgctttcactctctggctctcaaagctgctgcatgggggtaaatctgagcagtttgctttaaacacaaggtaccagagaaatagggaaatgaagtgactcagagctacccagcaaagcatccgctgatgctgactgcagctggcccctctgccccaggcttattaactacagaatcccagctcttcccaatgctttgcaccctcaaacattcctgaccatctgttcattttagcgagcctcctccccccacccctgagaaattcttttgattaaattttagtgtttccttccagtgctcctgatcttgtagccagccccctcagaaagatttcctttaaggcttattaatttgctgatcttgttttgagctggctggttgctgctgggctcaggccaaccccctttccagttgctgcttctgtgcctcatccacaaaggtctaacagctacattccaagatgcagaagcatctatctgtcaggaaaatttcagcctgaccctagagacctgcatctgctttgatgtgtatctattacagctagatccaaagataaaatattgggaaagttaaataaaacagaaagggaaatacttgtaaagaacaatgtctatggaagtggtgcttgtcggccctcctccccgggccagattccttcccacatattctgaaccaagaccctctgaactgtacatcctagtcttcctccgactcccttcatcatgtcagtctagactaattggtgaactccacaattagtgaaagaatgtcccatgatggtgatgatggtgatatggaaaatgattgaggaatgaactgataatcaatctctgacctctgcatacatacacacatgtacgcacttgtacacacacatgtacaaatgtacacatacatgtgcacacaaatatacacatacagagaccaagacttcttagtctctctcttggttagcaacaatgtctgtctttgatttgcatataccatagaagcttttaatgttgatgtgtttcactatgattttcccatgtagtaacatgtacttgggtatagtcgcatccccatcacgattcccacttctttctgctgctggtcttctttacaagtatacctaatgatcttcccaaatgcactctctttctaaggcaatgccatctaaaaccatgtatcaggggctcaaaacaatcaggtgctgtgctgaaatcacactacaactatctcaagtgctcaaaaatatcaaggagatcatttcaagtgtgatttcatcttgcttctctgaaagcatttagacttccctctctgtattcttactctggtgggttgtgagtagcatttgagacttggtttcctgatgctgatgactggtatcaataatgcttcagagcatactgttgactctcccacctcactgaatgagatgtgtggattcaacaccagctttgggctaaaaaaatgctgacatgggggactaaacctgcaatatttaagatttatttaaattaaatctctactgggacctggagaggtagctcagtggtttggttcccagcacccattttgggtggtttgcaacccccagtaactccaactccaggggatctaacacccctttccagcttctctggacaactctacttctaagtgtgtgcgtgtgtgtgcacacacacacacacacacacctaaaagtaataaaagtaaaccctttaaatctatgataattttatgttacattttgattaaagtttagatcatcaaagtagaatgagagacgttttagagatcaatttcctcagatgtctgtataaatatgaacattccatttattcaaaacggcacagcgagagaccaagttaaaatattcacgtactgtctggcagacgaatacaagtaatttagagtaaaaattagaggtacaaaagtggagagagacgttgtcatggcaacacactttcattagttttgaaatcaaaagacaatcttcctgttgtaaaagtttaaccagctcttattaggtaatgatctcaataaacatttctgattatagtgctgtgaaggaaactggctttgtcattataatggatcctgctttgaattcaccagcctcatttagcaaacaccatgcaggagtgcaggtggacagctgactgccagtctgtagctaatagattctaccaacacactgcaggcaaatcacttgcagccaaagaatgctttgagcgggagaggccaggctagtccaccagatcttaccgtttgctctctctggataatgcctacttattgagcccactggccactgatggttagtcctactttgaccagactatataagatagaactttgtgtgccagtttacagaattacagaatcatattttgatacaagttacaatataaccgcaagtcatattcagaaaactattagtagactagtatccactctgctgtgcctatatttacctgaatgtctttatgtttggacctatgtaataagaaagtttgctccaaaatagaaatattttatcaaaatgctgaaaaggcattacaaccaaagaacatgagaaaatattttggcaaaaattaattttattatttctatttaacagtatatatttaactttctgaacttcttagtaagtcatactctgatagggaaaactttattttagaggcgactccattagccctctcttctctacaaggaacaggtttggctgtttttctaaggttgggtcactgtacttctaggcacactattttaattattttcatttttattaaagagaaaatgagaaagatgtaatgtcgattacaacacatatcaactgttcattgcacaatcattaatgatcgacaaaaccctaagcccgaataaaaacagcattatttctgggaaatgtcaagtctgtcacttcaaaagggcaaacatgccaccacaccaagctgtgatttttcaccttgtgcaatggagtcgccctgagagtctacaacaattcatcttatttctgtaagaggtatgcctgcatggtaaataacatcagtgatgaacagtgttggataaagtcagctgtgttactctaccatgcaatgtgtagcattatgccctttctatgtattttgaaagcccttcccttctgattttcttttctctctcaaatactgccaaatggtgtttacaaaggcttcactttatttcatcatattctctaatttaatgatactgagatatttacatcagattcttataaacagtattacagatcacccttcagtaccttgttcgtaagaaaaactccagatgcctaacaaagaaacaatgcctactagcatacatatacatatatgtgcatttctatatgattttcttcatatatactactcaggcactatctggtttagtagatgttaaactgtgtggaagagaatgaaattaagagtgcattttatgatgaatatcctcatggctcagcgtttgcagtctcttcataaatacattgggtccacacaaatgattggcataactaaggataacatattaagagtctcaagaggttgggcattcttgaataattctttccaggctagttctatgcttcattcttcaaataacttaatgtgaaagccacatatggagtagaggattttatttgtgcttcagagagcacagggaggtggctaaattgggaggaaccccagcttcactccttagtctgaatgagcaggctttcctgcccccacctacttcttgggctccctttctgaactctgggcttagtattttcagaaggacctagacacgacaagatcacatctgtttgcatctttcggttaaatgggttcttcagaaagtctaaacaggactcttctgtctgttagaggtcaaaactacaattgattatcaattttttattttaatgaattgaaaagacacgaactgtttgaataaccttgtttccctcttgcctatattggaaagacttcaaatatattttattcatgctgcaacctgacttatacctctaagctaagcattctaagaggcgtcaacccagagcatctgaaatgttttgccaaggacctgtcagaacaccttgagaaaacaaaccaccccatgattctagtcttacacaacattagtgatctcacagctaaaatatgtctgaaccatccaatggtagaggctactcaacaaatgcacagaccttttcttgttgttgtcgatagatattttctgaattccttgaactatttctaaaccattgtattttcaggtaatagctatctttaaaagattctgtcctggggattggagagatggctcagcaattgcagaagaccagggtttgattcccagcactacatggtggctcacaaccatctgtaattctgattttaggaggatatggtatcttcttctggcctctgtgggcactgaacacatgtggttcatataaatacatgcaggtaataatcctagactcctaaaaataaatcttcaaataaaataaagactccagaaccctttatcccaaaaacattaatatgtgagtgtccttttccccttttgcatataataaagtgcctgagagccttgttttgggagagtgaaggccaatgagcagtgtaccctgttgctggttttcttattgtataatcacgtgactattttcagtggtgatgaaagaaacaccctgtcacatgcttatgcctagctctctcctgactggtccatgagggtgggtgttttttttgagtctggaataatttatcatcctgatagctaaactctggtgccacgcacactggaaaatgccacgcactctggtcaagtctgcttgacaggctgagaagcctgaaagcactcactctgaaaagtgtgagtttcacagaaactcacctcctggagctttggcattctcattaacctatatactcataccctattcccgagttagtctggtatatggaactacgagctctcttttaatattttattataaatgccttttaagattaaattctgatatagttaagtctcctcagtgttccaaggtctcagaagcctatgagcgtagaatccagtaggaatgcagtaaagaggttacctattcagtaactaattaagcattacaaaagatggagtcagtggctgggagctggtctgcaaagtatttgctagggactgtggcaaatcgcacccaaacaagagaataccatgaaagagccagggaatcccactgagatagaaatcttcagtacaggctacattgtatattagaagcaagattgatgaattctcctaacaaatggagattctctagatacttaaaagttacactcatataagaatttagcaaggcctaggaaataggggggttgtgatattgcattattcatgaggcctgccaagagcagaacacacccccccccccccccccccccgtgctagccttcacaaggatcaaaggtagagcactagagtgtgaaatccttacctgtcactaagctgaccctaggcaggactgctttatcttctttactgtaaacatttacctggttcctgtaaatccttttgaaatcattcctttgttttgtgtcaggcaacttcaatgtactttgcctgctgtgactcccggaccccttgtattttctgtactatataacactggtgtttactttgtgagaatacattcagatcacccaccaacaccttgcccacctgccccagagactcgttccatgcagacaaagggacccagagggtctgctgcactctgggtccttctagtgccagagctcctgaatagcccacacatttctttttccttcaactgcaatctaccccttagaaataaatgagctttccctaagccctgtaattagaattcaaatgtaatattcaaatagcctataattagaatataaatagcctctaagtagcccatgcaaatgaaggtattaatgaattacaaatcactaaaggaaataaagggggtggcaggccatccctatgctggtcccctccagccatgcagttgtgttcaacagcctgctagaagtcagggtcttttggctgggacagacctcaaacttgcttcaataagggaaaaaaacaaaaaaaaacccaaaacatgttttatataattcacaaatacccctgacacacacacacacacacacacacacactacaaaattttttggttcgttttgtttgtggtaggtagggaaagaacccccccccccccacacacacacacacacgtacacactccttccacactgctgcttattaagtaaaacaattcttctatggcattcctactgtgtttttagaactattttagatacacgctttctttcattgaattttccaggagaagacatgaaagaccattctcattctcacttgtagacagaagaaagcaggactctagaaaaccgacttgtccaatcttgtaattttggtagtaaaacgttgctacatcccaaacagctcactggaacagaaatagactgttaatgttttttggtcatgccaatataaaagaggaaaataaatattgactctaagaattaatctcaaggttcaactattgcaacataagggtagatttggctctcacctgtcagttgtaactcccattctgaccccgcccccaggccctttgaaactaatgctttatctcttaccactttatgcctttcttctctcttttttttttattttttcattaaatttcaaattagcacaaaatatgcacaagaaggtagctagaaggatgatcatgttaataagttggtgagagttgttgaggcagtctttgtggatagggaacacacatttacatgagtgtacctgtgtgtgtgcaggtttgcgtgacatgctctgtgtgtgaaggcacaaggaccaagcctttcttaatggcttcccctcaggtctctcactgaacccagagctcatggagtcagctaaactagctgaccagtacgaacttcttactcgagcctccttagtactgggattatgggttcatttggcaatgcctcgtttctcttcctttgctgtgataaatacactctgactaaaagcaaaacagcaacttagaggaggaaagagttaatttggcttaatcagaaaacatgaaggaatgcagtttgctcgctctctctctctctctctgtctctctctctctctggctcctgctttgttagctttcttatatagtgtaagatgcactgatcagagcatggtgctgcccagtgactgtgcccttctacacaagacaatcaagacaatctcttcactggcatgcccacagaccaccctgataaagacaattctttaactgaaactgtttttcaggtgattttaggcagtatcaaatttatagtgagtgctgagacactaaactaaagctatctttttttttttttttttttgatggttataccaggagagatggatagcagtctatagggtagaaactaaggattgtgaataaagtaaaagctttttttttaaaaatctgaatttaaaaatctatgagtggagggcagagttgagggaagaagaaggaagaggagagagatctcgagggaaatgttcaatatctgtggcacaagaagagaccacggagacagtgtgctaatagagtaatcagctgctgagaaggtgactacaaaaaactgaacttccagtgttccaggcaccctgagggaacttctcaacaaccctacagaatagtgaatgaatatgaggagcactgttcatacaccaaagatcagagaccccacataacctgccctgggacacagccagtcagcagcactgctgggtaggaaaaacatctggttgaacctggtgttccaaagagctgatgggggagttggggtgccaggatactacaagagagttctgggaataagcaaacatgggtcgcaggtcgatacttgcttctgaataactaaggcctagaataaggaaggctgattttgactgaggcaaaaggtcagagtgaatttatacaagaacaaagttttgtcagagaatgactatttagttctaaatagctgtcctgtagtgcatgctgggaagagatgcagcacagctttttgctggagaaggaagagcaggcctgacgttctcacacacgcctgtgtgcaaacagcaggtactgctgtactgtgagagtctcttgaacgccaataacaagttggcattttgaatagtgcacacagacaacacacatgcacacgtacaaatagaacactacacacatataaatttcacacatagataggacacacagcacatagcacacatatacataacagacacaaacagacagcacccatggacacatacacacatagataccacacaacacaatacagaaatctcatacacagacaacacacactcaatagcacacacatagtacacagacatatacatattcaacccacatatatgcatagcattcagataaacacacttaaaaacatgcacatgacacacagagagatagcctatacagagagcacatgcagacatatacacatggcacacacacacataaacacagagacagcacacacattatacatacacacatgcataagacacacagaaacagcacagacacagaaacagacatatggcacatgcacaaatatgtacagcacacacacatacacaaagatagcattcaaaagagacagcacataaacacatatatatggcacacacatagcaaacacagagacacagagcacacaaagacacacacttacagcaaaacacacacacacacacacacacacacacacacacacacaccccagtgtaagaatcttagaaaacattgatatttgcctattttaactccagagaagtttcctgatataaggactaacttgggcttgttcctggctccacttgtctgtcctgtccatagcagattgggctgtggatagatggcctggccttagtagccaatcctgggctgcctagacattcacaatgtggtccaggcccagaataaagcctggatcagtgatcagcctcctctcttgggaatgtgaatggagagacagattacacttcacttggtcatttctgtgtgagatgatggcctcactgtaatccagcctgccttggtctcatagtcatcttgtatgtgtcttcagagagctgagatacgaatgcgtgctccatctgcaggacaaatgcactttgaaatattactcagtgcaagaaggcattgagtagcttgcacccatcagtaagataatcagttgtagaattggggaagctgcagtgtcagggacttatactgttttagacgtgttatcttggaaaacattttattgtttggaaacaatgaacaaccgtttgtctcaattccagaaacaagtggcacttcagtgggtcgcagtccttgctctctggactgggtttgacatgtgcaaaagtttgctcccaggaatgtgcgtgggagttttatttcttcctgagttcagtttcacatagggtggatcttatttgcattcagcggctgtggcagcatggaggggcttcccccttttccccttgcagcgaattgagaattctgtggcttttccagctggcagatattacagagtacatatctggatgataagagacaccagctgttgtcagagagatgataacgccttttcaaatggacagaacacttacaaaaggaaatgtaaaactggtcaattcaatgaaatccaagcagaggggtacagccttctgagaccacactgtacacataaagagagagaatgccgtgtgcatgctcttgattaacagctcagcgctacatttggtggttgttgttgaataattggaactgaatgtagctagatctccccaactttcttttcctcagttaaggaagtatttccatcctagtcacagaaaataaaatttaaaaacacaacttgtgtaattgttctttcatttgtttatttttctttcatttctctttccagggtctccctgtaagaaaagcattttgtgccagggtgaagtggttgtgtgaaggagggcctattaagtgcttatgaattaagtagaggagaaagcaaggattctgggaaatttgataaactccgtcacatcttgactgtgggctgctcagccactgtcttgctatcagaagatgccagcaatggaaaaagtcaggaacattatctccggggcaaaaccagctgacatagggtaatctttgttgtcaccctaaggatctttggctttctaataatagtgaggttcagcatcatgggcttccttatccagctttggaatcactcacgagttcagggttttgttgtttgtttttgttctaaccaccttttgagtaattgtgactatcctaaagttctgatcaaaaaggaatagctctgtgtcatagccttgcagaattcaaaacaataaaatattatgtgc

SEQ ID NO: 137 - DNA, 6291 bp, Mus musculus
tacagccactgaaagtatttggtttatttcctgctccgcattttcctacacaacacttcttggcaccctaagtctggatactccgggcggggtgggggttggcatctgcacctccccagccttgattttgttctaaaagggtcttggggggagctggggagatggtgggagtgagggatacaactttgctgccccctgtggctctccggggagagctagccactctgggtcgggtcaccaggataagagaggcgggacaaaactacagcagcgctctggtggaggatccacccggacgtgctatcccggggtctccgggcctgtaaggccgcaaggtcgctctgggtacgcgcccctcgcgggctatcggggtccaggcaggggcggggcgcgccgcgcgcgtttccgggaggagcggcccgcctgcggcaggtgcggcggcgcggctcgcaggtaggcatttatttgctcgcaggtcccgcgactggggtcccagcgccgcgccctctgggcttccccacccccaaccccgggcccctagctccagtggtcgcaccttccgagcgctgtgtagagcagccatcgcacgcatctctgtctggaacggctgtgttcctcgggtgaaggcagctagcccagacgtgcgtggatgagatttgcctgtgggcccacccgctgcctttcgtctggactccctggagcctggcggcagcgcggcttccggccaggatggacctccggtcccgaggaacactggagcggttggtggggtggtgaccgtgcctggttgaagtgagggtagccatcaggggtgccaatgattactccaggttgccctaccatgctcttcctcacgtttgcttgttgttcctcctcccaccccccgaatatgggtagggggaagatgacctcaaagactgaaaagtgagataggaatcggtcagtgtcaccgagttgtagctttgggaaatgtggggttaatacactgtgggactgacaggtggctctaattagaggtgggatgtccattccaggaggtgagaggggaggccccaggggaggagaaagctgcagagactgtgttaaaccaagatgtgggggtgtttcttaaaagctgtccagtgcccaagcctgggaccttgcacctgcacccttaaggcctgcctgagtggcaggtgggagggactgatggagtttactcgcagcttgcttgccagctgtcagaagtccagggtatcacaggctcaggcctgaggctaaggacttggtcttggtcagaagtggtttagctctcaaccttaggcagtcctagcttgggatctcccaagtccaggatgtggcagactctactctctgttcactacagaatctctgctggctgccaagagcttttactgttggagtaaggtcacactttttttttttttttttttttggagacagggtctcactatatggccctgactgtcctggaacccactttgtagacctgactggccttaaaactcacagagacccacctgcctctgtctcctgagtgttgggactaaaggcatgcaccactaacgcctggtcacactttctttttttgttttgaggtagaatctctctatgtagctccggatgtcttggaacttgctatgtagaccggcctggccccaaactcacagacagagatctgcctacctctgcctcccgagtgctgggattaaatattaaatattaaatatgtgtgccaccatacccagctcacttccctttcttgcactggcttcttcctgggattcagcctttcccagaatctctacttcctgagaagcagctctggtactgggtctgcttcatgccatcgcagtgaccctggagcgtccctgtctcagctgagctttcctttgcttcacagcacctccaagagccaaggctcgctcctatggccagccctgggctgcctggatctggggagggccaggagggagaggagacaacaggggtctcggcaaggcatggagtagaggtgctgcagcaggcccaggaactcttcctactatgcgacaaggatgccaagggcttcatcactcgtcaggatctgcaggtgagccccagatccaagaggttgctagacccaaggccgacctttgctgctcaccgtggtccttcttgcctggtcagggtctgcagagtgatcttccacttacgcctgaacagctggaggctgtatttgaaagtctggaccaggcccacactggcttcctcacagcccgggagttctgtctaggcctgggtgagcaggtcccagtcacctggagaccctcttcagggtgccctgagaccttatgaaagcctgtgcctttcattcacaacttcctagccattctggtatctacaaacaggcgcattctgagctgtacctcccacagctactctacagtggatgggctgccctcccccaatcccttctctgccaaccaaggtggggcgggggagctggctgtcatttcccattcccaggccaatagaaccagaacaaggaagaaaaacaggaaactgggccctgagagtgggcaggatatgttgtatgtggctggagggagttgggtaggtccagggtgctaacccacaaccctgatattctctcctcccatgtctgcagggaagtttgtgggggtggagtcggccccaggtgggtcccccttgaggacttctgaggaaacctttgagtcgggcacagggggctctctggaggaggaggaggaggatgttgagacattctacacttccttggagaagctaggagtggcccgggtcctgggcgagtgagttgaaccccactctctttttgagaatgtttcctcttcttttcacagtctgtccaccttgcccacctgtctgttgttacagaacccctaggtcctgtcagtccatcccttgtctgttgtggttgtctgggagagtggcctggcgtgattttcctcggaatttgcatttcaggaagccttagctctgcggggcggggtgccaccagacaccttaggcacgcactggcccagcacttggtatacagggcaccttacacttgcagaggccaaggaagcataagagcaccaagcgaggggtgtagttctgggctgctgggttctccatgggtttgtttcactgtccgcaatggggagataaaccctcacccaccagctcccgtctctgatcgcatcctccaggcaatgggctgtgagaaccctctgggtcgggctgcagcgcgagcgacctgagctgttgggctctctagaggaagttctgatgcgcgcatcggcctgcctggaggcggcggcccgggaacgcgaaggtcttgagcaagcgctgcgacggtgagggctggcctagcctggggtctggggactcacggagggggcagagacttggctcggaaatgatcatgtctatgatatcccggttcctcgaaggcgggagagtgaacacgagagggaggtgcgcggactgtatgaagaactggagcagcagctcggggagcagcgacaccgcaggcagagccaggtgggcccgcgcacgcctcgcccagccttgctgctcgcctctctggctccgccttccccgaattggttcctccccagaggactcacctctgggagtccaagctgccccaagtccagggaactctgctctgcctcagcaagtgccccttcccgcactctccaccccttcgctacccacccttgcctgcctcctttgagcccggaacgaaggctctagcgcggctgtacatcccagaacctaccccgggaggaacagaggggccacctggagctggagctgcagacccgtgagcaggagttggagcgcgcaggcctgaggcagcgggaggtaagccgtattgagttcaagttggtgtcctcgcatgggggggggggggggcgggcgggtttatctgtgccttggggtcctcaaccaggagccacaggggtgaggggtcagcttgggaccagaggggtgtggcatgccaaccagcattccaccattccccagctggaacagcagctgcaggcccgggctgcagaacagctagaggcacaggcccagcacatccagctgcagagggcctatgaggccatacgggcacagctggaccaggcccaagagcagctcagtcgactggagggcgaagcacagggtcggcaggagcaaacccaaaggtgtggtgaagtgcctgtggtgagggtagaagggtctgtccccccaacccacatctggatcacagccttcctgtccacagagatgtggttgctgtctccaggaatatgcagaaagagaaactcagcctcctaaggcagctggagctgctgaggtgggtcaggcctgcctgggctaatgggaagtggtttcaagtttccagatagtattggctcctacccatgttgctggaagtccttatgtctgccctatagccttcatgcggctggctctgtagtcctcttgactcagggaaggcatctcccccatgcactttttcctctagatcttagcctcctcggtctcctacctctcttttctagggagctgaatctgaggcttcgagatgagagagatgcctgtgagaccaagctgctgggcagtagccacaggaaggctctagctattgcccacaagcccggacccatctactgctgctgctgctgtggctgggctcggccccccagacgaggctctggccatcttcctagtgcccgatgaccagccccgagtgactcacttccctatccagaggactgcccctaggagggactggtcttggtggcggatacttgctaagtgtgtggctctacccagaaggcatcccatgcctgaaggagctaacctcagagtagtcaaggccttcagtccttcagtctttatcctgtcttccttttttttgggggggggggtttcgagacagggtttctctgtgtagccctggctgtcctggaactcattctgtagaccaggctgtcctcgaactcagaaatccgcctgcctctgcctcccgagtgctgggattaaaggcgcgtgtgccaccacgcccggctatcctgtcttccttaatctttgtctgaaggaccaataaaggccattgtatactgtgtactccttggctcttgtgtgtttgggagccacggtgcatttgtggttcatgcttggtatccatggcacaaggtgacatggaggggtttacaggtgcacattaaccccttcgttcctgcagctgggggttcctgtgtgcttgtgtgtgttctgtgattctggatattcaccaagccctcacccattcctcccagctgaagctcccaggactcaggtttcaacaggtgtccgctcccacgctagtccacacgtggaaggtcccgctcctcacctccgtggtcagctagctttctggtccaggtcctttatccatcatcctttggcacagttcctagccagaccatatgccacccacactgggcacctctcgcagggccctcatgtctctatggaatcttctggcaccctccacactgtatctggagtttcccctctagcatttcttcagccgctagaacctgcagctttagagtggttctcccggcttagactagagaaactggtcttgacctcagttctggacctctggtgggctaggtgccaccttccccacctcttcgctccccacctgggttctacctctggtctagctcctctgtctctgggcgagttggggcttttgatgacaaacggggcacctttaaactaactttacagacccacaggtctctctggcgcgcgccttagcaccaaaccagttaggacttgcctgcccaggccggccgtgggcggggctgcgcccggggcggggtcgcgcgcagggcgtgtcctcgcaggccccgggccgagcgttctctgtactccgagtgatcgctcctaccgtggctgccggggctggtatttcaaagcgtggttggtgagtgctccgtgaagcatagccggagggtgtggggagcagtgtcctgagttcctcgctcactggtgttcctagtctccaagctggcctcagggacgcccaggaggcagagcctgaggtaggacagggttgcagactcctttccggaagatcgacgccggggccgggcagttagaaggccggagggggaggggtgagggagagagcttctgtggttcttgagcaggcctgacggtctctttcgtgcagaaacccagaaatttaaaagtctgaccaccctattcattgtccctggacaccggttc

SEQ ID NO: 138 - DNA, 7698 bp, Mus musculus
attcctctcccccataccccctaccccggtcttggatgttttctggaggaactggggagcgtgggcgcgttaagttatagggaaaaccccaattcctgagacgtggatgagggcgcattctagtctgtgattccgaaaccagccatgattcgctgtgagcttcccacccctgtgctggaaggcgccaagttctgaacacctgtggcctcctcgtggcctccaggtcctctgcgggaaacacccagcgtcctttgtctgaccaactcctacacgtcaatcaccggcaattcggacgccacctcttccaggaaatttccctgaatctgcagaaagttactccttccctgaggatggatgtcagttgctggattcgtgaaccttccctttgccttcagtcccaccagtctatggtccaaacataagatcctttaaactcccgtatgagccctccagtgggagcttccgcataaggtacgcgagcacatctgacctgtttccttccaacgcctaacacttactttgtatagtgtgagcatgcattcgtgtgtgccttgcacgtatggaggtcacaaagcaatgaacaggagtcctttctcccacgatgtgagtgtagggaattgaacacaagtcgtcaggcttagcggcaagcacctttaccctctgctgcagaccaacacttacaatctggtagatcttttgtttgactgattctcactgtgccttgggcctggaactcgccgtggagatcaacctgtttttgtctcccaagtgctgagatttaaggcctatgaaaatcttgcccagccaatatggtccccctttttttcccgtttttcctcgatagtgtttctctgtgtatccttggctgtcctcttactcatagatccgcctgcttctgccttcccaaaaggcatgcttcccacgcccagttcagtatgatttttttttcctctaagatttattttatgtgagtacaacagctgtcttcagacacagcagaagtgagcattggatccctttattatagatggttgtgagccaccatatcgttcctgggatttgaactaaggacctctggaagcgcagtcagtgctctaaatggctaagccatctctccagcctttttgttttgagacaaagtttctttttctttgtgtagcctaggctgtcctagaactcactctgtagacagggctggcccagaagtcgaagatctagcctgcctgtgcctctctcagatgatctgattgactccagcctgtcctactttgtccccctatctcaatagccccagggccttttctgctctgtgtcaatctcccccacccctaccccctcgacaccttctgtgtcaccttctgccctggtgcttctgtcattctctacaacttaccagcccctcagcccacggccttatgaggccttctgccacctccaggacgatgtcttaatccttcaaccaccttcactcacttcagcctcactgactgcatcccagtttcctggggctgctgccatcttacatggtgctcctcgtctttggggaaccaaacttgcttctcatttaggacaagagattttatctatagcagtgaatgagatgcattctgactttgagccagccatccttgacagatttaaataaacttagcacagggaatctctgcagtccattcggtttcctacaaatacagattcctaggaggaaactgaggctcagacagggaaaggggattggtcagggctaaacacttacgacgctgagctttatctcactgtagaaaggcaaacaaaacaactttattttttaaaatgtatttaatttggattttgtctgtgtgcacagtatgtgtagaggccagaggctgaagtccaaatgccttcctaaatttccttgagactgtctgcatagaccagacaggactggaactcagaagtccacatacttctgcttctcaagtgctaggattaaaggtatgcactgccttgccaggaaccactttttttttactttttttttttttttaaagaaaaggtctgagccgggcgtggtggcccacgcctttaatcccagcactcgggaggcagaggcaggcggatttctgagttcgaggccagcctggtctacagaatgagttccaggacagccagggctataaagagaaaccctgtctcgaaaaaccaaaaaaaaaaaaaaaaaagaaaaaaaagaaaaggtctctcggtgacactggagcctgaacagcaagccgcagagatcctgcttctgcctcgcgagtgctgagtgctggcatgcgctctgtgccccgcttttaagtgagggctggggatggaactcaggtctttatgcttaggcagcatccactttatactgactgccctagccccattttggagcttttgaagcaaggtctcatgtagctcacactggccttgtactcactatgcagttaaggatgaccttgaacctgatcctccaaatgctgggattacaggtctcctgcatcaagcactgcacagtttaaagtgtagctaacacacacctgtgagacctgccctggagatttaagacctggcactctgctccactcacagctacataccccagcaacctcagagaggtctaccataagtcagggttaaaggtggagcttaatggtagtggttgcctagctcagtggttcttttttttccttttggtttttcgaaatagggtttctctgtatagtcctggctgtcctggaactcactctgtagaccaggctggcctcgaacccagaaatctgcctgcctctgcctcccaagtgctgggagtaaaggcatgtgccaccactgcctggctcagtggttcttaacttgtggctcttaacccaactttggtggtcagaagaccctcccacaggggtcatttaaggccatcagaaaacagattatttacattatcattcattgtagtagcaaagttacagttaggaagtagtaacaaaattcttttatggttgggagggggcagcacaacatgaggaactgtgttaaagggtcgtagcattaggaaggttgagaaccactgccctagctgggagaagtgccactcataacaacagtttaaaaagaaaaaataaacagtccagctggatcctgccacaagccaattgtgtacctgtttattccatgctggaacacggggcgaggggaaggcttgagattcgggagacttacaaggctagcaatctcagagccacagaagattcccaacttgctccccagggaacaaaaacagttatgcatgggcggagagggctcaatgtaagcaccagttcccagccccaggggactgagtgtctctggcctcttgggcatctgcactcatacctgccccaccccacacatgtaactttaacttgaaatctttttgaagaaatcagtaacctaggcggaaaaaatgctcggcagttaaaagcactgactggtctgctagaggtcctgagttcaaatcccagcaaccacatggtggctcacaaccatctgtgatgagaccagacaccctcttctggtgtgtctgaagaaagcaacattgtactcatatacataaaataaataaataaatcagtaagccaaaactggagaggcgactcagcagttaacagtgctttttcttgttgagaaccaaattctcttctcagagcagatacctggccactaactgcctataatcccagtgctacaggatataatgccttcttctggcaccttccttacatgtgtgcacacacataaagacacacacacacatacataaacaaaaaataaagttttaaaataaaagggcttaggtttggagagatggctcctctggtgtgtctaactaaagacaggctcagtgtactcatatctaaataaatcttttaaaaaggtaaaaataaaagtgcttgaacacacgaagtgcacacatgtagcacacacacatacatgcaggcacaaacttacatgtaaagtttaatatttttgcttttgttttttgagatgttctcactgtcctgcccttgcagtcctggaactatgtagaccaggctggctctagattcagagttccacttggttttgcctcctgagtgctgagaaaggactaaaggagtggcctccacacccggtacaaatcccaacactcaagaatcaagagttgctggatagccaggctacatagagatgttctgttttaaaaacaacaaaagaggtgggttgtgataaagaagaccccaaccgtggcgtctcaccttcgtgcattcactccagtgcaaatgtacacacacacactttcgggctctagttaaagaacaaagtttttaatacagacacattttaaacagtctttttggcaaaaaaaaaaacaaaaaacaaacaaacaaaaaataaaaacataaaaaaggtagggcaaccaccaccctacagccctgatgtgtgtgtcgtcatatttcagtcatctatgctgggtcagaggaaacgttcagtccaagggcaagttcaagtccacaggtgaggaggccaggatgcctgcctgcagaggacagagagccccaggctggtaagagggaaagaccccttgagtgggacacttaagtgattccatggctgttctgtgctggccccagtccctgctctaaggacggaggttaagcaacactgatgccctgcaggctgtctcccaggctcttctgtcatctatgtcaatagaagcagggccgctgagctctacctgtccctcctgtcttgccatctgaactccgtcactcctcgcctccccattccacggaatgcagaaggaacccagctgatgctcacaacagtacctctgacctggtacccacactcagtctcggagaacctgctctctcgtcagagtcctttctgctgggactgacacccatctccaggcctttcctggtctatctaagaggatgggtctgttcacagactaccaatatctcagaacccccatctcagggtggtcaaggacccttctgagcccggctgtgtctctagaacacaggttttttggtttttttcctctccttctgaagtgctggactatctcctaacctccttttgtttgtgttttgcctaagctgaccgtgaaacctctggagccaaggatgtctttaaatctagatggtcttgcctcagcctctctggtacttgagatgacagacttgcaccaccagagacaatcatcccgtcccgtcccgtgtcgtgtcgtccccccccccccctccccgttacaccaccaccccacctgctgtgcctcagccatctccaggatcttactatgtaaccctgactggtcttagaacccctaggctggccttgaccttatagagatccgcctgcctctgcctcccaagggttgggaattaaaggcgtgcgccaccactgcccggctacagactgatttctattgcatgtgtataagataacagtcagcggccagggaagcccacagagagttgatgtgtgggtacgtgggaagagccatggggcacaaactactggagactcgagtcaccagataagcaccctgcatccttgaatcccattctccactccacaaccaccctaaacgacgaggaggatgagactggggagctgtgtgagctattctcacaattgctggttcaagccagagggcaacagaaccgacctccttagcacagtgtctggcatacagcaggtgctcaataaacacaagatggattgaatgtaagagctgggcgttctggaagaaaacctgtcaactgtcaagatgtcagtagggttaaacagagacctggcagggtgtgtgtaacttacccatcccccatgggcctggacccaaggcaggaagctgtgtacatgctcaacactgaggttggccaggggacccccaagcccagccacacgccggctcaattccatggctagtgccaggcgtgccagaggatccggggatggcggtgggggccccgggcacggcagagacgggctggagcaatttggggaggagctgctttcccggctagagaagagttccacaaggcgggcgaaagagcctgcggacaggcgggccagtttacgatgcagagccgggtcagatgccagctgaggggcagaggaacagtgtaagctaccaccaagcctgtgtgaccagcctgggggccaggcctttccagcaccaagtccctcccacccaagctgcctctatggccttcaccagtagactcccaagaaggggtcctagaatcagagccaagaacagttctgagttctaagcagtggattctccgttagtccttaaacccaagctgggcatggtagcacatgcttttaatctcagcacttgggaggcagaagcagacatatctcagtgctcaataagttcaagcctgatctacagagtgagttccagcacagccagggctacacagaggggcacagggggacgagtacctgataactgctgttacagtactgttcagttttcaaagcccaattccaggaaactctgaggctatgccctctcaggccggaatttcctccctattctgagctgtgtccttagggtagtcagtcagtcagtcagtcagggttctttggttttagagacagggtttaactctgtagccctggatggccctgacttcgtagagctctgcctgcttctgcctccctgttgctgggactaaaggtgtgtgctctcacattccaccttgttttgttgaaacaaggtctcccagtgtggccttggcggccctggaactcttctgtggccaggatgactttgaactggtctccggcctcatacccgagagtgcagggaggagggctgagcctgctctactccagtccagttttacactcctgccaggcccttctctcacctggctcttggttctggcctcttcttttgtttgctgtcctttgtttttcagtgtttaacttgggggagagggtgatggagacaacgttaaggtaaggaccccagcctgctgggcaagggctctgtcaccaagccaattcctaatgaagcctctggtggcttctgttgcctaggtcccactgcttgttgatggcccatgaaggacactggtgttaagtcctgctgcggtgaggcatcaaggctcttgtgaagatgctctgatgtttactggagccctggaaccacacccagcatcaaaacaaagcagcgccagcgtctgccccctattccacaactgtcctctccatagcgtggagtagaggctggtcaccttttggttgatgacttctgcctcttcctccagcaaggctaccagccgccttagcagggcttccttctccgtgggtgggggtccctggaactctgggggtggggggcagaagagaattggactgggaagggccctggctttgctcctaccatcacccctcaccagggctcctctgctgcttacctgaactgggcggggacttcagttgctcctgcaccaattgttccagccgctgggcaaccagggcatagaactcggaagaggctgggcctgagcagaaagaagcagcgacgctttctgtttacagaacacggtatttatggcgtctctcctaaccatcttgccacacagcaacaatttccacttcacaaaaggatacacctcggccatgagacgttggtaaataaaagatattaaa

SEQ ID NO: 139 - DNA, 2181 bp, Mus musculus
cctgccctggcccaaggagggctcattcgttctgtatcctagccgcctagagatcgaagccctcgggccacggtgaccacgatgcagctcttgatgagagtgccctctcttcccgagctgggtgagctggactgcaacatctgtttccgaccctacaacctcggggcccgtgcgccccgccgcctgcctggcacggcgcgcgcccgctgcggccacacgctgtgcacagcttgcctgcgcgagctggcagcgcggggcgacggcagccgcacggccgcgcgcgtggtgcgcctgcgccgcgctgtcacgtgcccgttctgccgcgcgccttccccgctcccgcgcggcggcgtcacggagatcgcgctagaccctgtcttgtggtcacggctggaggaaaaagcccgggctgagcgtgaaggagacccgatggggagcccggccaaagacagcggagaggatggagaggacgacgacggggaagcggagagcgagaagggggcgggacctccaagtgcgggttggcgcgcgcttcgccgaattttggacagggtcctggcgccggcacgccgcttgcggcgtccgttgcctagcaatggtgaggggcggcctagggaggatactgggtacattgcaccgaagaatgctgggtcaagttgcatcctcctgttgccactaacccttcttctttcctccagtgctctactgtccagaggtcaaggacattgcccacatgacccgttgtacgctgtaaccaaggaaccccagagctatggcagaaagcaggtgggagcagcatcctcaggcgtgctctgacacaaaaggttgatgtcaagactacctggaaatcaaggctgatgctggaattggtacatgcgtgatggagatggagctcaacagaaaggaccctagatggtgtggattctgagcggcgaaggctcctagactgtgccagcattatattttcaggatggagtggccaagggataatagaaacaaagcctaccataatgtaggaagaaaaaaaaaataacaaagctttggcgtttgttcagagtctgtggtgtaagcaaaggatccaattttagcagtggtctgtggttgacaatgtgtactgtggaaaaaaggacaggacaggggataagctaatttatatgtcatgtcaatctcacttatctggttgtgtttgctggcatgccatcttcccactcttgttaccgtgctccagcaattactgagttgactccctgcttatgattgggaatcttgcatatacaacctcccttcagctggatagggcaggtatgaaaacatccaaggggcatttatttacatgaggccttattaaaggcttatcaaagatgggtgagccatttgataaaggaagcaaaatttaggcctttgttatctttactgactctgtagcaatactggggaaaagaaaaaaaaagatgctcacataattttaatttgtgtcccataatgggacattgtttactgtatgtagttagttctattctaaagtcctgtaaatatcttactgtagacttaaaatcaagaccagcagtgttggttggtctcacagcttgctagaaatgcagaatttcaggaccccagtccacattccccggtagttttagaatcccaggtatgtgtatgtaagttaagaatcactggtttagctcttagtcactctgagatggcatcatcagctgtaggtggaacatttaaaacactagtgacgcattaaagtgccaaagtgacattcttttgagaaaaatttttctgagctacaaatgtgaatttacaaggcctcagttttcagaggtcttcaagattttgtttttaatgacaaataatgtatgtagttctagggtataaacctccatttgtaaaatgttttgtctttttcctgtccttcggttccagctgaaatctccccttttggaggccagcatgcatctgtgggaatgtgtatgttttctctatacgtgttgccaaagggaatgctatgtttattttctgctattttatgttttgagtatttctagagtataaatttcaagtgactatctccagagccgatagcagtgttaatgttatatgtattcaaaaaaaaatgtttgctgaatttattttgaatgtaatagtctctagaataaagtatctgggctcattcaa

SEQ ID NO: 140 - DNA, 7533 bp, Mus musculus
ccagaaagaagacatttatttcctgttcttcacacgagtctatccacactagcattgcttcctccccagatagtccacgtgcattcttgactccaaagaactctatctcccagaggcctcgcagcaggcaccaactcctgtctccagggagcacacttccgcttcacctctgtgctaattaaaatgctcactgggaagaattaaagggtcaactggaagataatgaaggaggcgcaaaagagcctgctttattcttggcccttaggggagaagagttttgctctctttgccagtgcaatagtgacagtggctgccgctgtaaggcggcatagagttgagacatgtgggtcagagggaggaggctggcatttgttttccttagtttggagctgaaggacaccgcgggggtgtgctgggggaggaacaggctctggacactccccaggttgggcacggggcgccccagcttccgcacaccctaggtaaggggtggaactgcaaaatcgctgtggattggccaaggcagaggtgtgcggcaatcgctgattggtcgcggcgggggcgtttactgttgtgcgttccgccctgcagtttgaatcagtaagggaggaggtcaggtttagaaatggagagtgggaggtgggggcggggtgagcaatgtctgcgggggagcgtgtgtggtgtggtttggttactgtgccctgggcagtttaaagaacagtgatccggtgttgggatttgggagcagttgtggctgtagagcctgagaacattctgcagaattatagagactcagcagaagcttcttgtgtgtgtgtgtgtgtgtgtgtgtgttctggcaccgattgtctaactacctctgaagccttaaaggtggagagctaaggatgaaggggtgtggtttgaagctgtaggctgatgtgaggtcctgtaatgatttgaagtatgaaatttttttgagcttcttaggaaacttgaaggaggcacaatgaaccatggacctgagaacacatacacacccccctctgtgtgtgtactcaagcacttatctcagaattacaatgaacatgttatctccttgtgcagagtgaggcgtcttagcttctagccatcatctttctccaaagtcctatttctttttgtctcatttgagacaagagtttagctttctcacttagggtgcttttttatttgcaacaaacctcctgcctcagctaggcctggcttaaagtacactttctctgatccactggcatttacagtgaactgtttcttttttttttttttttttggttttttgagacagggtttctctgtgtagccctggctggcctggaactcactctgtagacagagttggcctcgaactcaaaattcacctgcctctgcctcccaagtgctaggattaaaggcatgcgccaccacacccggctgcgctgttcctttttatcaaagccgtctggcccgctttgccactgatgatagttcctgtgaatgtgcattgttgttcttgctttatttttagaaaagcgttttatagcaagcagtggtggcacacctttaatttcagctttggaggcagaggcaggaggatctctgtaagtctgaggacaacctggtttacttaccgagctagttctaggacaacctgggctacacagagaaacactgtctctagatagatagatagatagatagatagatagaagaaagaaaaaatgttttaaactttttgtgtatgtgtattgcctgcacatatgttagtgtatcatgtgcatgccggtgcctgtggaactcggaagagggcacagaatcccttggaactggagttacaggcacttatgagctatgtgggtgctaggaaccaagcccggtcctctctaagagcagcccagtacttttaactgttgcgccctctttccaacctcttttttttgtttgtttgtttttcgagacagggtttctctgtgtagccctggctgtcctggaactcactttgtagaccaggctggcctcgaactcagaaatcctcctgcctctgcctcgagtgctgggaggcagtgttttaaggcagggtcttaccagatagccctggctggcttggaactaattaggtggctcagaatggttttggactcacagagatccttccacctgtctcccaaacgctgagcttaagacgtgtgccaccatgctcggcgacatatacaaaatttagaggtctggatctgttcccaggggttagagcgcttcccaaacattcacgagcccacggattccatactcagatgccaaacaaaagccaaagtaaatgcctagctgggagtgagtgtggctgtggtagagcagggtagggtggaggcgaggagggagagagtgcggcaggtcgggaccgttcccgcgcaggatcttcacagcagagcctgggtccctgtggtcccagaactaaggacggcctggcagaagtgaggctcgacacagcagccatctgcgggagggggcgtgagcagggcggggcccgaatgcctttcaccaggccgcgccccaggcgggcacagtcaccagccgcacacaccggatcatggctgcagccacactaggacaggtgggtgcgtggccggccggcgctgggggctctgggggacctgatgcggggggggcgcacttccgggtggaccactggcgcgcagcctttccggcttggcgtcattcctctgtgcctcgggttccgctgcccagcacggaggcggatggacccccccttgggaagaaagacggggctataacgggcgggcggcagaatgggtagacaggagtggggcgcgagaggtgcctgaaccgggagctcggacgtggggagccatggaggaggactataatgggagaagtacagggtggggtggatgcggggaagttgtggctggggcatgcagcctgtgtgtgttaaggaccagttgctcttgggttcctttagacaaggggcccaggacctcttgggacttagtgtatggcttggcgcagggtcttgggtgggaattgaacccaagatcttatttcttggaacaaaaagcacatgtcgatgtgtgcagtgtctgaggctctctgtacctggttttgtaatcccagtcaagtttctgtctgtcaaaatgataaaagatcctccagaccagaagacttcagtcagtgcttaccgatggtgtcaagcggtgtcatagatggagaatctatgatatttcgtttgtttgtttgtcttttcgaggtagggtttcactgcatactcccagctgtcccgttgctctgtagaccaccaggttggcctcgaactctgcccgcctctgccttctgagtcctagaattaaagtcctgggccaccactgctgagcttgagagtctgtgatcttaagagaacgtgataaataagtgtggaaacagctggccataaccttgggggaaagcgtttgctgttagctcccacctgcttatcagaagttctcgctccaggctggcgaattcctgaacaaacctttaagtcccccagttcttagtgacagacagaaatgttctatgcagatggtcttgggatatgacggggacaagaatctaggctctgactgtgtggtggccttggatggatacagcattgccatactggaccaatctctaattctaatgggacagaactgggttctgaagacagttttaccctgtaatggagacactttgaacatgagcctgctcagagctatgagtatctagtggtgagtgtccacaaagtgaaattttggagtatagaggaacctgctggctggggtttgcaaggactgtcttacagggactagcctagactggcattgggatactctgagtctgaaagaaacagcccttcaactggccaaggacaaccctggctgtagaggggaacatgtttgggatggggtcaggaaacagccctgagctgtgttaggacactatgttgctctataagggactgtcctgaggtgactggttgtatctgagccttggacttctacaaatctgatggagagtctgtcctatgatgaggacagcctggggctatgtgaggagatagcatggtgtagggacagttatctgagacaggacaacaccttactatgataattattttgcttacttttggcgtgagagtggagctttggcaagaacacctgatctttgatggatactgtgtttcagttctgggctgctgggatgtgaaaggagcatgggcaaaccacagggaaccctgcccagcaccctcccctttaatctctgaactctgcttccactcttttctacttcctgtagcccccacccccaacccccatctagcttccttctttaagcttaattcttatcctatggtatgggggaggggtgttctttgagccaagagaagactactgttggccttacagaattgctccaggaagacaaaggtagcacttccgaggttgcaagagctctgtgccagctcagactcatcatctcttgacacaatgccttttctgtgcctcaaggctgtgtgatgtttctctccctccattcccctggatctctctctctctctctctctctttctctttttttggttttttgagacggggtttctctgtatagctctggctgtcctggaactcacttttgtagaccaggctggcctcgaactcagaaatccacctgcctctgcctcccaagtgctgggattaaaggtgtgcgccatcaccacccggctcccctggatctctttagcttgggctgggcttgagcttttgatcctcctgcttcaccctcccgagttctgtgacgacgatgggtttgtgttaccaaacccagtttagagtttctttgactctctgcttttcccttccctcctggtattgcccacccctgcccctttctccgttacattttggttgcctgtgggtcccggggaatcagactcagtccctcaggcatgctgatgggtctccttacccagtaagtcatctcagtcctctctttataatcataactctcttgacagctctcagtctccggttcttttttttaatgagacagggtctcataatgtaggccaggcaggccttgaactcagagatctgcatgtccctgcctcctgagtgctaggattaaaggtgtgtgccaccacccttgtccctcattcctcatttcatcatcatcatcttatgacaaggtcttataggtcagactggccttaaacttgctacatagacaaggatggccttggagtcctgattcttcttcctttatctcccaagtgctgggattgcagggtttctgtgctgctggggaagaaataaacccagggagtcctgcatgctaggcaagcatcctgcaactgagtacaaccccagctccatcttttctctccagcagctcagtatctcttttctgcattgttcagtttttttggctaactctactaaaaagtaaaaaaaaaaaatgtattcttggtttcctctgctctcctgccttcgtgctggctgctctacccggggcagttgtctcgtccccacactgtgtctgatgcaaggtggcagtgttaggcaagcttcatgtcaccacacagagacaatgaggggtcatcactcttagatcaccccagaagcccttgggtgccacaccattaaacccgcatttcatctgagggctgggagctatggacatcgttggtgaagtgcttgccagcaaacctggaggcccgagtctgatccctgtaacccacttggtgactagactggttctgtcatgtttgcttgttgttgttttgcttttttgcttttttttttttgcttttttttttttaagacagggtttctctgtgtcaccctggctgtcccgggactcactctctagaccagactggcctcagactcagagactcatctgcctctgcctcttgagaactgggattaaaggtgtgcaccacccctgcccattgtgactcagccctaaataccattgtttggtgagctggagactgtagagagctgagccaacctggcaagctccaggacctgatcagagtccctgcctcaagacaggatgggctggagctacggtcacatacatttaactagggaggcagagacagaaggctctctgagatcaaggccgttggctttgtctacacagtgagttgcagtatagccagggctacatagtaagaccctgtctcagaacaaacaaacaaacaaacaaaaaaaaaacgggtggaagtcacccgaggaatgacatctgagtttgacctccacagacacgcacagatgcacatacatgccgtcacgtggtgtgtgcacatgtcaacacacgtagagagatcttatctgagccaggtgtggtggcacacgtgcctgtcactctctctggtgcaggctctgaggcaggaagatcctaacttcacgcactgggctatagagtgtgtttgaggtcagtgggcaacttagaccctgtcttaagccctctcccctccaaaaaaggaaggaaggaaggaaggaaggaaggaaggaaggaaggaaggaaggaaacaaacccatgtcctggcccagacttatccatacgacatttgagactcacccattgatcagtgacctctgcaagcctctccatctcactggcctctagcagcgggaacaggctgttatcctgtcttcctcaaactaaggactcagctgcctctccatggtctgcagagaaaagcatgacaccaaaataccaggacacgtcccccctccccccctgtgcacaaccagccctgaattccatgctcaccttggggaaggtcagcagggatgtgtgccttgagcattttcaatggctggcacgagactgcccttcagccgctgactgtgtagagcacagtagtcactgcccaggttgagggtattccagctgtggctgggtcggttgtagcagcggcagcaaccagctgactgatactcctaaagagtaataagccttagggctcctgtctgagggaagcgtgttggagtgttgtagttgtggttctgagggaagaaggttaaggaggacctctgggtctgagggaggaaggttagggaggacctctgggtcggagggaggaggtctggagctctgggtttgatagagaagttcatgggccattactcctgagtctgagggaggagggtcaaggagcccggttcccagggtctgagggaggagatctgaggtctgggctgatgaattctaggagaaacaggacctattcttttctaactcttgtcagtttttgtgccccctcaccccaagccaggagtgttcccttacctgctcgctgtccctggtcgttgtcccgtctaagctgtctacaagctgcggccaaagttctctagtagggaggcacgcctctgtcgactttgccctgcatggtggatggtggaggggctggagctgactttagttttctagggataggcatcccggtggggacttgggcagagcacaggctgtctagaatgcactgagact

SEQ ID NO: 141 - DNA, 6731 bp, Mus musculus
gcgtttgcagttgttactgtattatgcagtaagacgacactttggcttcagttttaactcttgatacaaatctccctttctccctgctccatttcaccacgcctttacttaaattcttcagtgtcttgtcaaacctagctctgtatcagatgctagactattcctaacattgacaaactggagttgaactaaaggctccaaaagggaaagtttctggtcttaatagtcctgtaagagcaagatttactgaaatttacttgactgggtaaatggacatctgagttacaaacaggatatttctcctgtgttcagcaaaacaggtgtggacaagtgcagactttagacagccgctctgcctgatcagtgggagccgttaggatttcctgcagacggatttcattggatgcatagttaatgctgtgaaacgtgataggattaatgctgtattggtggatttcttgaatagaattttgtcttaacattccttttttgtgtggaggctttattttctccatttgtagctaaccagctcaggttttttggttgctttttgttgttgttgttgttgaactgagttgaatctgaagaaatctgctcaagaccaagtgctagccgatggagctggaaagatctcctctgtggacaaagcctcagcccgggtgatgagtttggaggtagcatttacaatcatccatggctttatcgagaaggaaaaaaaaaatcatggccttaacacaaagggtgctgtgtagatatggagttcatttgggagacgacctgaacaccatactgacggactagcagccagatgcctgcctaggatgctgacggttgtgaagactgtcccctgtgattggatctttgaaagcttcagcgtgccttcttagtttctaggagcattagttctcttctcactcggccttgcagcttaaaggaggaatctcttcgtttctgtgactacgcgcgcacatttcagtcattcctttcccacacgtgacccttcaagaggaaacagatttggatgtatatgacaacctcggagcctttgtgaagagagtgatttctgtgacttttgaataaagccaaggtgataagcagtgagccccacttattgacagttttatacgcacttgtacctcattagcatcgccttcctcgaggagtagtttttatgtcatccttctttcccatcccagagtcaccctaagggagagttcctctaagtaatctcagacaactgtacacgcttctcccacaatgctttggtgctgttaccttgagatggtttagggagtcatggaggttttctgctgtgtatgttatcatctgttaaacttcgaggtgttttggttttttttttggttgttgttttttggttttttcatttaaagcaacattcctcagtgtaacagtacaggtattccttgcttggttcctggtgtggctcttaacctttgtttgtttccctcacatatgaaaacagacttttaaaactgtccagcactaatagtttgaaattttccatctcccatatgacaccttgcttttcatttctgcgcccttttagagaatgttggaagttagggaataccgcttttgtggttcaactttattttcttctacattggaatatatttcggccgtgaaaacttggggaaggaggagtttgaatgtgtatttttcttttcctactgaatgtattttaactacagagccctaaactgagagagaacaacaacaacaacaaaaaatgcatattcacaaactttgtggttgggagggcatttgtcagtctgggtgtgggggaagggagaactgcacaggaagttctgaagtttaaaatacttctgaccagctttggctcgggagggtggggctgtttgtggaactgaaagtgaaaacccttttcaagcaatagcagagagtgggtcccatggacaaggttccagtcccagaacctggaactcttaaacagaagaaaaagctgaagcggcttgaagcagcttgagcagttgcttcttgctcctggcttcaagacagagcattggagactttctccccttaaagacctgcatttgcgctttgtgtgttttgtttttattttatttgggggacctcatgggaaagggcttctgcactccttcctttgtgaaccccactgtgttcttgtatcatcgtccttctccttttactatgttgtaagttacggttttcattaggccccatcacatcttctttactgtaaaattattaaaaggctgtttccaagtggggcagctaatgaagttctaattattgcagacatatttttgagatgtaaaacactttaaagtgaaatgataagtctcttggaggcgagtgaggaataacatggatgtaaacatttacatgggatgcattcggattctgctgtgtgtattgtcttttggttgaaacaaattatgaacagtgactaataataaaaagtcaatactcaatgatttaaactttgctgccttgcttcttggatgtgaatcagaagcccaagatgaattcttattccaaagctttgagctacaccgagccttttaatgttcctttgagcagaaatctcacctagagaagaaacatttaaaaaccttgtagatgttttacacagagaaaagtccaaagagcaagtggacatttaactggaatgcagttactgtcaggtttgttttctccacataggcgaatcctcaaagctctgaagccactatgatgaactatgtagcaagggtacccatgttttattataagttagggttcgtgttttgtttgattgattgcttggttgattttggtgagttgttttggtgacttgatagagaaaggcctaactagcccaaatgaatgacattccatggcttattttgcataacacgtgaattccttttttacttgggaggcaggtgaaagggcagcctctgttgctgtaaaggtgttgttcctcaggagccattctgcttgttatttgaaatagtcactaggacctggggttcacccattagacaaagctgggtggctattgtctccacatccccagggctgtgattacattagacctgctttggggagttcaggtcctcatgctggcatggcaaattatcttcacaaacttgataacagttttttgctgaaggttgaaagctcttggttttctcttgactctcacaatccctaacattcccttaattgagaatgaagaagatatgacagtttccaggttgaagagggggagggtgtgggcctgggtaggttatctcctttatgcagcagtgccctttggcactgtttgataacatttctataaacttgttttctacttggagtagttaaaatacatcgtttctgtatttaagtttaactgatggaaatctaaatataattaggtgaaactataaaagccacagtaaacagacagtagatgtttacttaacagtacgatgggttgtgcataggtttaaatgtcattccagaactacaagattaattttaatcacatgaatggcttattattctgtgatctcctccagttcagctgtctttatatgtggggggaagaactgttcagtggttggaggtgcagcttagttcttgcctagcttatatgaagccccaggcacacgttaaaaggagaaacagaaaaaaaattccttcaaattttgaaatcaggtaaacattggaaccagaggacacaacgcctagacctgcttatcctgtggtagcataacattggggttgggcctaacgaagactttgtgatcactgaaagattgggagctaggtatcagtaaatagatctgaacttccaggctcctctacatagtctgaccttagcgctctttctcgacggtgttctggagaggtagtgggcgtgtggagcccaataggaaggagaggagggatgctaatgcctctttgccttagtatgatgggtagtgaggagcctgcagtgatggcagatggttttgtgtatacacacacacaccccacacacatacataaatcccagaggaatttatttttagggttagtctcagctgttcaccatttccagaaatgatggttacataacacttggcatacatgttgccttgacctgggggagagcaccaattgtgacctttgtgacagtgtgctatgttaatggcagtccataatctgaaaaggagacatcagctgattattgctgattaactggatctgaagtagtggggacctttaaaggtagctgcttagaaaaaactgattctctgagaccttccgagccagtgctcttgggctatttttttttttttttttaataagtggtgttgccagtttgaagtagtaaatcttagcttctagcatatggattcattttaaattgatggtgtaggctactatccagataaggaaaaagataaccatctataaaacattgctgttccctagaatgaactcattgctggacttgggacaccaaagtgattaagtcacatgcgatctgtaaaaggtaatctgtagtacctcaagaaagtggcttttggaaaccatctccaactatttccctgcccttggctatctacttctgtcttcatgttggtgcctggtccattcaaaacaaaaaaccaaaacaaaaaaccagtgtgtttgctgtgaaatcaaccagggttagaaatccaactaaatcaggtaggtatctgaaataatttcaaagtagaaagaaaaccctgggatgtagcttttctttcaccttttattaaacttcacagagagaaaccatgcttactgtagtaaaagaaaacaaagaaaggaagattgggactgtggtagaggaaggcaaaaaaaacgccttttatagaagaaatgatttgtatgaggcagaatctttgaagcaaagttttatctttctttttctttttttagatttatatattgatatatgtcagtacactgtagttgacttcagacacaccagaaaaggatgtcagatctcattatgggtggttgtgagccaccatgtggttgctgggatttgaactcaggatcttcggaagagcagtcagtgctcttaactgctgagccatctagccagcccgcaaagttttatcttgacatgtcaattagctccaaattgaacaaaacatcttaagacagggcgggccaggtctatctcgaatgctgttgcttttaagcctacagttaaaatactccagacaagtagttgcacaggccaaactgaagcaatgggtaataagtgaccctttgcccggttatcttagaagttgttttgctttttaatcccttacaagttggctgaatattcaacacatacataagagaggaagccctaaaaatgaagagatctagaaggcttcttacaaaatgtaggagcagtttaatgctaatcaccttttgggaaacctagaatttcagaattacagtggctactatgaatctttaatatgagttaggctctttgttctgtccaatccaccttgataatggccaggcagatgttaatctagttcattcactccttaagaaccaacgcaagggtctagagagatggcttagtggttcagagcactggctgctcttccagagaacccagggtcaactcccagagttcacctgtcaatttacaaccatctataactccaggtccagaggatccgacactgtcttctggcctctatcatcagtcatacacgtgttgtgttgcatagacttaatacccataacaacacggaagacccacctgaagctgggcatagtggtgcacatctgcactggggaggtggagacaggagactctaaaagttcagggccagctttggctatatagtgagttcgggtctgcctgggctatgtgtaattttctgtctcaaaaaaaaaaaaaatccgaaagaattagatcaagtaatttgtacatgtatagaatgtatagatctaataatgagtataattaacggggtgtggtgacccacgcctttaatcccagcacttgggaggcagaggcaggcggatttctgaattcgaggccagcctggtctacaaagtgagttcccggacagccaaggctacatagagaaaccctgtctcgaaaaaccaaaagaaaaaaaaaaaaaaaagagtacaattgagatttggaattggaattaggcagacttataatttggcccactaaccacaaaactatctttcactccaggaacaaaaagagtcagcttttaaaataggtgaattaagacttgcaaaatagaaagcgggcttacacaccatgttactggttgagtggttgaggacgagaaaggaaatctgatactttgattacaggaaaaggacactgaactgtgcctggaaagcttagtgtacttgaggtggtttgatgaagaaggtcgccagctatccctaagaggtgagtataagcaacagttctttcacccccagtgggtgccaggggacaagacacatttgggagcaggaagcgtcttggatggagaattccagcgccgcccatggtggagggttgtatcttgtctattttaacaggtgcaggccttacctgtcacttcctctggccgcttcttggaggatccagaaagtaccaaattgctctccctgcgccctggtcctaggagctcagggtggagcgcagcagaggcttactccgcctgcagtggcgccagcctcccacaattctactccggcctcgccaggctgac

SEQ ID NO: 142 - DNA, 38999 bp, Mus musculus
gccagtgccccacactgaggactttattagttttttaattttctgtctgggtgcccctgctgcatcaaactttccacagctgttaggggctgttgagtgcgtagcctctctgggccccttctctgtccccaccccctcttaacaacatgggaaacttctggacccatttgcaacagagagactctaaaacacagatacattgtctcttgtgagcgattgatgcgggtccagctgccaggagaaggtcttcggaagaaaatctccgagtttgcaggttccttgacttggaaaaaggctgtccgtgcagtatgagaacaggcaggtctggaaccctgtagaccaggccaagaaggaaagggatattgttttctttttaagattaacttggaacctggcccagagcttgataccgggttcacagtgctcccttctgagcggacatcaggagagcaaccgagaggatttgtaggcgttctcctcacaggtttacagctgaagttctgtgcaacagaccaggacaattgttcctgtctccccctccccattccccccaccccaaggcaaataaacgcaaatagagtccctgctagcagtcctggaatgcccagcagagcccctatgaggagcaacaggccacaggatgccaagtcacttataggaagcctccggctgaaggggccaaggaaggcttgagtaaaagggcctgagggctcagggaaccgatagcgccctcctggctccagtgccgccaatttgctttctagtgtctgcctttaagctccgctttgaggagaccttatttgtggggtgaatgccaaagcccaaagaggagaaaaccctttggtgagaccggcctggggaacaattttacctctgagatccagtcggtatttggggttaatccctctgtggattgactgggttgaaagccctgagcaggtcaggggtccattaccgcttgtgtttacatataaacttcctggtcctgggagacaatcagagccaaggggggaggagaagggaagaaaggaaagagaaatttttttaaaaattaaatgacctgccctctaaaaataaatcagccaaatgaagaagagctttgctgaaccaaggttggatttcaatgtccatgtgtaaatatttctttaaggttttccattcattatctgtatattgaggctccagcatcttttaaaacagaatttgaaacagaattttgatacacatttccctgaaccagcagcaggaagaaagagtaagagtcagaggcataaagccaccaacatgccttgactaggttttgctgggttgattagatgtttattacaggttgctttggtgagagaaatcataaagagaagctaaaaattggggtctttaaagccaatgtgaatctactgaaaacatacatataagggaatgaaacatggtgataataccagatagtaccagataaccgagaaaacaaagaagttaagaaaaaaaaagtatgtattttctcaacatgctcagaagatgaccacgcaaactgtacagtggggttgggaacggaagagactgaaaagattgcaaaatggctgttcaaggggcaaggggacagttgctttattagatctctactctgagcaacttgtcaaagactattcttagacagcaaacgttctttatttttttcctttttttaaaattccaagaagacacagatttaagggtctgtcccagatgtgtctactaggaagactactagaaatctctactaggaagctgtggagctctactgcctgagatgttccggtaagtcagaacctaggatttacacccacaacaaagcagatttcaaacacccactcctcactgccctcctgcagcttttaaatgacgaacgagggctgggtttggggggtggttaggttttttttttttttaattaaagatatttctcactatttgctcttgacaagtaaaaaaggaaagcatttctcctataaaggagacctcaaaggagtctgaaaagacaagcatctacattttggttttcaaacagctatgtttggtctactacagaaaaaaaaaaaaaaaagccaagcagtggctttaatctgccacttgggaggcagaagcagatggatctctaagtttgaggccagcttggtctgcagagtgagttttcgaagaacagaaaccctggagggagggagggagggagggagggggggagggggggaggggggagggagggagggggagggggggagggggagagagagagagagagagagagagagagagagagagagaacaaaaatattactttgaattttttttgtctaatttcttttcctcagtaactcatcaccagctcatatcctccacacttggctattccctctcattatcccatcacctgagtaaggacagcttcctgacaagttttagcccaggtccctgcagagcacctcccagcaagaaagtgactgttccagaaggagactgaaagctgagaaagaatgacagcaaagactcaacaaccaaccagccagagcagagcccaagttctcacgcccaggggctcagaaatgctgccactgcaggagatgtttggaagggtcacagacacggtggcccttcctgggggacagggactggtgttctcttcacgcctttgcagaaagtctgtcaagaaggtgaagcagttactagactgagcgagtgtgatggagaaagaattcagggcccagtggcaaacatcaggctttgccagagatcaagtggtgagtcaccgggtaacatcagactgagttatgggcagaaagaaatctaacaatgctctttggtttcaaaatgccaagcagctggactctgggtcctatcatttatgccccaaatcagggcacttttgagagaaaaaggggtggatgtcaattataattatattgggggagcccatatgagcagggactgtcccagattaatgtgttcatggctgcccctacttacagtctcccctccaaagccaaggaatcaaacggtagcagccctcagaatctcctccagacaaagctcagctgacttcttgcctgcaaagaggcaatcacagtgacaaagggtgggctctgggggaattcacataattgaatagaatcaggaactgggcaagctgctcttagagctcttagcatgtctcgtagacttgttaaatgttatgaaattgaaggtggtgagatgcatttgcagaatctacatttaaatttaagaatagaaagaatgagaggggagggaggagagagggggtggagaacaagacggagtaataaagttagtcacacaaaagcagggacttctacttggggtaaggaaagagaccagcaagggagagaaaggagaagtggggagggaaatggagagatagataaaaaccaaaagtataatggcatgtatgtgtcaccatgtcatgaagtgcattatttgatgtgataactaaaaattaatttttaaaaagatgttgaaaagtctattgggctgtttctcatcagtaaacatcagttcttcccaaagcatttaaccccatgagatctttgtccagcagacccatctaaacctttggaggcaaagtccagagtgaagggctgggcatgcaggccttagtgtcccacaggtagaagcctgcaaggcacgtgaggcttcagtcattgttcaggaggaaggagcagatgttcatttcggtgaggtaatggagcaacctgccaaagcacagccagaagacttgtcgaaacaggtctgcagcctttcccacgccaggtgcagggagcctttgagttcgtgctaatacactggctggcttccccagcccaaccaatccattactcacgtgagaagaatgttcactgcatagggaggaagtgggaagcccgaccacaactcaactcacacacaaagagatcctctgcttctctcagcagtgacctaaggcatccaagcagccagtgcatcttcaggatggtccccaggagaattgggcagtacagtcatagctagtccctaaacaattggggttatgttctggtagagagctgtggcaaggaggatgtcttagttaaatttcctgttgcagtgacaaaatgcccttgacaaacacaacttaagggagaaagggtttattttgtctcacaggccaggatttagtccatcatgggagataagcaagagcctgaggctctgctcacattgtgtccacagtcaggaaatgagattggtgagcacttgtgcttggcttcctctttttcatacagtcaaagatcccagcctaaggaatggcaccgcccacagtggacaagtcttcctacctcaattaacctaatcgagttaatccaccacaggcatgcacagaagcccatctcccagtgattctagatctgtccaagtagacagttgagattaacaatcataggcatgttgggtaaccacggagaccaagagtcagaccagaggctacaggctgccaccgggtgtgtggtgcagtcatgtactcagtgagccttgggcatactggagtcccaacctgcctcatgaaatcttcccagggcatgtccttataactgagcaggggtgtcctgaagacagtcatggtgaagggttcagacttctatgacccctcatgggagttaagatgcccctcccttcctcctcctgcacctgacttgtacccagctgttccttggcatctaaacgcattggtactctcctgttcccttgtttctctaaacccttacttttgttcacatcacccttgcctcctttgaaagtgttagatggttatacccatctgagaggccacctgctcagctgagaaggatgtgcctaacctgtctctacccatgctctcaagtcaagccttggctgagtggctgtgttaccttgattggcaccagtgatgccatggaatgtcttcacccatgaggagattcagaaagcctgaaagcaggaagttgtcccgtcaatctgtttgtcctcagtgtttgtgctaataatgtctgtcatctgtcacatagccactgtccagctgttgtggagtcatggggtagcacagaattctgtagggtcactttcatgatttgttttcctgaggcctcaaaatctgaagcttgaaaagaagggcaccaagaaaatgtctttatgctagagtctgaaagacaatagtcaaaatagtcaaactacagaaatggactgaggactttataatcatagaagatggaggggggaggaggagaaagaggaggggggaggaggagaagaagaagaagaagaagaagaagaagaagaagaagaagaagaagaaggaggaggaggaggaggaggaggaggaggaggaggaggaggaagaggaggaggaggaggaggaagaggaggaggaagaggaggaggaggaggagaaggaggaggaggaggagaaggaggagaagggtggagaagagtggaggaggaggaggaggaggaggaggaggaggagaaggagaagaagaagaagaagaagaagaagaagaagaagaagaagaagaagaagaagaagaagaagaagatgatgatgatgatgatgatgatgattatggctggaatctactaccgtatcctctcctctccccaaagaactaaatatatttggctaatcctgttgggctacatatctctccacaaagcaggcaacagcctgttccatgcagctcaaggattacagattttaaaaggaaagagaggaaagaggtgaagattgatgtgagaacatgggaactgagcagaggtagcattcgggaggtaaagagaaggcccagaggcttcatgataaaagtgcagaattgcaagagaccccgcagtttttgctagagaggaagaatcaagtctatggaggtgcactgtgtgcacagggtttagtacaaaatcaggaggcagtacaagagagcatctttgagacataaggctgagtcagtgagcctgtgttgtgttagtcctctggtgagtttccagcccctcccccacgaaaaaaaaaaaaaaggacatggcccaagatttataaagaatatacccaaagcattctgtgcgcttctcaaggcagaaggtaattgttacgagcaaatctacacaaactcttgtgccaagatcaacaagttaaaaataaaatagaaataggaaaagaaaaaagggatactcatcagaaaccagaatggtcctccccactccagtacatccagagggaagaggaatggacgagccgcaggcattctcctgtggagctggagccagcaaggctgtcctgaaaaatgcttccaccccacactgaggaacccctggaaaccggtcaagccaatattaggtggaagtagatgttaactctgtaaaattaagtcctctaggacttggagatctaggctcactccatatatctcagaatcacctccatgaggtctcgtcatattgttagccagcccctgccccatcacttcagagatcttgatacaactttgctacatcagccaaatgttttccctagagagtagaagaaatgacaacagggaaggtgagcaagacctaacagaattaatggttcctctggtacacagagatgagtctgatgttccaaaccaaacatccctgctcctgtgaccttctgtcatctgtgttcctgtcgcttgctctcctggctaaggtccgggagatatctatggtcagaatgaagttatgataaccggaaccagtgtcattcaaactgacaccatatggcaacagtgccgctaaagctgggtcctcatgcacatagactgaagtgtaacactcttggacatatggaaagggactcctgatgctacctgtcaccttgtccccaaagccaactgaaaacattatgttgctcctaatgcaaacacacagtgggcaggggatggtaatcaagccccagcagctgtagtctctctccagaaccaccctctgttctcccccccgaccccccccccgaaattctgattctgactgggatgagatataacttcctcagagcctttccatcatctgtagttctcagtatggatggctcttcactctctgaagggaatctgtattccaaagacactcatcatccccaacgcaggaggctttacaagactccgtggaagtctggctaagaggcaccgaggaagcaacattacatgctggttaacagactgaggatcccacttaagcaggtccccccaactacatacagtatgatggcctaatccctgggcctccacagcccagcctaccattcccctacttctcaggaattccactggcatctcagagtgcagccatgaaccagattcttcaaaaaaggcaaacagtctggaggaattaggaagatgtagctgcataagaaattggctcctgaagctgctccctggcagtggtggtgcacacctttaatcccagcactcagaaggcagaaacaggcgaatctctgagttccgggccagccgggtctacagagtgagggggaaaaaggctccttttatcactgtaacatcgaacactgcatggaagattaaacaggtctgtttactgacataaacgggcctggcattatttaattgtctagatggggaaactgaggctctgagaagagaatgtaaattatccccattgatatagttagccagaagaggggtagattagaattaaaacctccaattgctgtctgatgctttatagtagcatactcgcagttatagcccaccaccacccctgcctcaactcccaagttaacaggggttccaaacagcccttgtcctgtagctctacccctgaacccatgatggcgcagtgacatcctgcaaataaagaggccccaaagaacagacaaccacaccctgggacactccaggcgctgctgactcaggaggagcattcccacgggtgaccacagcctgctccaggctgttgcccaggagacaaaagaatcagcacagagctgcctgccctgcccagactctcagggcaatagctttagcccagaagctggcaagcgctcaccacttgggtgtgactcggcggggtgcccgggccggcaagcctgtccaggtctccattcctagtaacacactcatgcgtgtgggagaagagtcatcagcccagctgcagcccaatctccgcagctgattggaacaggggatgtcagaaatcttcaccagaccgagcctttttctgtgaggttacttgaatgtgagctttaatgccattctttcgaagagttaaacagcaggctcatagatgcatccgtgttctaaacaagcatgtcttctcatccacactaggaataggtgccatactcctccaccctggggagacagtcctgtggtcattactgagcgcaggtatgtgaagcaagatggaaaggctccagagaagaccaagcagcctcccttcaaatcctactcttctagttatttgtttactcacttatttattatgtacttacttgtttgtttttgaggcaggggttttctgtgtagccatgactgtcctaggaactcactcagtagagtaagctggcctggaactcacagagatccacctgcctctgcctcctgagtgctgggatcaaaggcatgcaccaccatgacttggcctgttctcctttctaatagctgtctgaccttaggtacagaagttggcatcatcatacctaagcttgcttgcttgcttccttccttccttccttccctccctcctctcttctctctttatattttttctcttattttctttttgttctcacccactactgtagtagaagcttatgcacagaatatgggaataccaagatcagggatataacctacatcatttcagaaagagacaattattgatcttccctctttgtattgagagcaccaggtgcaatcagccaggtctggttcaccctgaccccaggtgcagagcacatgcctgtgcgaagcctggagtcttccaatagctgtttcaggcagagttcaggcaaagacccagcaaaagggaggttggcttggcctgcctgtcccttgtaacctctctgctttctcatctgtgactggagaatgctaatactcaactcactgagttacgatagttaataagatggtgttgtcaaggtttggatagtatgatggaccttcactgacaaccaaattggattaaggacactggtaagccacattctcagagatgcctatgagagcatccagaagggattaatggaaggaaaaaaacctgtctttaatgtgcatagcactgtcccataggtctgtgccctggactaaataaaaagagaaaaaggagaaggccaggtaagtgctgagggattctccttctctgtctcctggttcattagacgagagcagacagacttttgttcctgcctatatacccttcccatcaaaacagactgtgccctcgaaccataagccaaaagaaacatttcttcctgaactcagttcttagcaggtattttgttatagcaacaagaaagtaactaatactgaaaattggtattggcctgtggggtacttgccaggataaacctgaccctgtggttcttaagctcttagaactggtttacagaaggaatgtgaaaaaatttagagcctcagaatagcagagccctagaatgccaaagcagaggttaatgggccattctggtggagtgtgggaaggataccagaatcctgagagaaatgcaagcctcgctcaggaggattctcagaagaataaggaatctattgggaactggactagagacgattcattttacatctggtaaatactacagatatggctggcctgtgtcctgaaaagatcatgaactaagttgtttgacagagaacaattcaagacagtatgacattcagctacagcaccgttactgttcattgtgttccatcagatttacagggagaattcaagggagaaagatgagaaatgtgaggtttggtgaggcaagaagtgtgaacttgtgtgtgtgtgtgtgtgtgtgtgtgtgcgcgcgcgcgcattcatgtttgtttatatcctggtgtggagtcagagggcaacttgtgagaatcagttctatacttctaccatgggaatcaaactcaggtcctcagagttggtggcaaacctctttaaccactgagccatctcactaaaaggtacagacaaggtgggcttgaagaagagtatctgtaagccgggtggtgatggcacatgcctttaatcccagcactcgggaggcagaggcaggcagatttctgagttcgaggccagcctggtctacaaagtgagttccaggacagccagggctacacagagaaaccctttctcaaaaaacaacaaaacaaaaaagaagaagaagaagaagaagaagaagaagaagaagaagaagaagaagaagaagaagaagaagaagaagaagaagaagaagaagcatctgtacttagtactactaaagagaagccagagttggcagtgagaaaacaggaaaggctggaaagctgccttgagggcaagaccccgtgcatggaaagtgtgtaacaaagcaaacgcctttgaaaaaagacttccaattgaaaacagattgaacagagagcaccaaaggcatccagctgtatcagagccccctggcaatgtattctccacagtcagccaggaagacactcagagaccactggagctgtgatgcaaggggggcagactgttacttgagcagacagcaagaacttagtatcattcacatgatgactgattttcataaatgcaaaaagcaagattgaggggtcaaagaagcttacaccaaggttccgggaagctgttgaggccagggacaagcagcagggctggatctgcagggaactcctgcatacgtgatgctaagttgcagtcgagacacagtgtatcatgatattattatattatatagtgcattatctaaagcaggggacattcaccaaggaaaactatagacactgagtagacactcaaccacagtcgagatccgagctgggtgtttccagacgcttgacccacttgtctagagaactgacatcaagggctaacccagatttgcaaaagaagcaagatcaactcattggatcaaagggacagtagattaaagaaggataccgacaagagggacagtggatcacacaagtgacagaactcaaggaccccaattattatttggggcttcctttcatggggttcaattgaagaagggctagctactaagtgttctagtttgggtggattttatattttgattaataattagggtatatgatactttcttcactttgaatgctccttcccacaatgcatctgacttaaattatatgcacttgccatcatgtacaggcatgagatggtaaatagggtatcatcccaaaaagtttgcaagatgtgtcttactgttcacgaacccaaaaccagttcaaggcagaccagtccttccagcactaatacccaggtattagggagaatatactaaaatagaaactgtacaaacctgattataagcaggggaggaaaaacttacactattgctcagagacgggggtaccagtcgcctgatgtggaggtgtgtttcaagaggttttgaagttattagaggtattgtttagaagcagatgcaaatgtagtatgttcagatgaaggaaccaggttttgcagtattataaggagttggtgtgtataactgaaaaccaaatgggatcccaagctaaactatctcctaagcttgcctgtctcagagccagcccaagaggaagatcatatgtactacaggaacagagttggggagacaggacttctcaacgctgttggagcccagatgataccattgcaagccccagatgctggatgcagatccacagggatcatacctcccccacttgccttcaggcttgctttgctgttttcctagttctttcccttttggaatgggaatatttacttagtgcctctgtatattgtatgtaacttattgttttattttaaaaggtgcatggctaagagtttgtctcgagtgccagaagagatcctctacttttaatggtattgagactgtcaaagactgaggggaagttttgaggtggaaccaaatatatttttgcattatcaggtggtcacgagcctatggggatcgggagtccaatgttgtcttagttttctttcctgttgctatgttaaaacatcatggccaacatgtggtttggggagggaggggtttatctcactttacagcttacagttcttcatcaaaggaagctatggtaggatctcagggcaggaacacagagctaggaactgaagcagacaccatggaggaatctgcttaggggttgctccccatagcttgctcagcctgttttcttgtacaatccaggaccaccttcccaggggtagcaccttccacagggagttgacccctctcctacctttcccatcaggatgggctatagcctcaagtcatgagcccaaataaatccttcccttcattgcactgtgtcacagcagcaagaacagtaactaatacaggtacacacacacacagacacacacacacacacacactgcctccacctttactacacacacaccccccaccatcatcaccatcatcatcaccaccacctccaccacccctgccaaagcccatgtactgcctgaggtcatgttcccggatgaaactcttcagggacagagcttttaggagctattggattgtaagagtcttgcctttgtcaagggatatgcccattgacagattcaaaattcgaacagactaaagaaagcaatagaactgtgtggatcactgtctatctgcaggtgaggggaggcacaagataaggtgagagcctgtgcttgggcagtggaaaaggaaggcgggctgagaactttacagatgaggacagagattcagagagagagaggaagggaaggagaggaagagataagatggatcctgtaggagaggaagaggagccagagccacacagtcctgggagtcataagtattgggaatttcttagctgattcttagacgattaaataatagtagggtgcatctgccccatcaagtggtatagcttgtgtttatatcaattgagctttgagttcactgggtgggcgttttgtgggttgagaatttactaatataaatctgaccgataaatacaagcctgtggagtttcgattttaccgggttacaatccacaacaagagaacttgtgcatggggcagcaagaccaccggggcaagagagtagctggcgatagtgtgggatggtgtctgtttaaatatttcccacatcagaattgtggagaatggattatttatttatttatttatttatttatttatttatttatttatttatttattttgagaaaagggtgacaggggtgtggctttgaaggacatatcttgtctcatgattcctggctaccatgttgcatatccactagtctctatagtatcctgcttcacttcaggctcaaagcaggccgtctagccaaccttagatcaaaactgctgtgctcagtgacaggaaattgactaacacaggtggccttaactaaacccctgaatgaagcaaggccttggcagataggagccatcatgatgaggacatgttgacttaactctttccatttctcagtaaggcggaaatgattatgactctattttacaagtcagaaaccaacttcagcagcgttaagcgagtttgctaagacctgagtgctaattagaagcaaacttgaggtcctgaacaggtgagctcgcgtccagaccaccatggtcttatttactttgcagatacaaatgcttcctagacaggcactcacctgggacggggggaattcaatgtgtttcctgcttatcaagtgcaagacgcttggtcaggctttacacatgttaatgtaagtaaacaaattattctgctttaaatcaaaatgagattaggtcttttccaagtgttgaaagccagaggaaggcaaacagcacaccacccctagctctctttgccctcttggggctcttctcattcctctggggatctggaggcctggcaagctcctggcttctgcaggcagtctgaacactcttagcactaccctgttcacatcacacatcagttataagaataagccacatacgagagtaagggggagggcttgtttgtgtgtttctgtgttggtttgtttcattttgttttagtttggtttgttttcttccaccttattcagctaaatttagaactattgtcctgattccctttctgaacaacagcaaaagcaaagaaaaaagcaaagccaacaaaaatccaatttactctctttaagaaaaaagattgttttgtttcgttgtgtttgtttcttgcttttgtttttgacacagcaactcaatggactcgaatacatgtaactacaggcaatgagcctgaataatgtacttccggttactaaacaagcagagaaaagagaccccaggagaaagatgttccatcttcactaaaacgtaaaacgttgatttagaaaaactatacttaaaaaccaaagaaatccacttaagtgctttttccagaaaagttggaaaacaaagttttccaaagtttgaatattttttacataaaataaatttgtatattaatcttactcaaatgtaggtcatatagttatatagatctcaaaataaaggagtctatcagggggctggggacatggacagcagttaagaagaaccaaattatgctctcagcatccacatacggcagatcacagacgcctgtagctcccgttccagggaataggacacctccgacctctctgggatcctgcacaaatgtacacatacctatacagagactcacacatatacataatttaaagtaataaaaggtatcttttaaaggtatttttaaagaaaggtatcagaatatatagaatatgagggggaatagatctagaaccctctgcctcatagacaccccataatataacaggttaaatttgcacataacccaggcacatattctcttatcactttttaaaagttaactttttgatgtgcacataacagtaggtatccatggaggccaaaagagagccattaaactccaagagctgaagttccaccactgaaaacagaacctggtccctcccataagaagagcggtatgttttaaccactgagctatttctccagtctcaacacacatcattttaaattgtctttaactaccagacacaatcaaaatgctatataggtattttctgcattgtatcatttagagattcatgaaaagaaaaaaatatgtagacatgttgaagaaatcaagatttttttaaataaaagatttatttgtttattttagatatgagtgctcttatctacatgtaaccctgcacaccagaggagggcatcagatcccagtacagatagttgtgagcctccatgtagatgctgggagtcaaactcaagacttcttgaagaatagacagtgttcataaccactgcaccatctctccagccctgagtgtagataggtcttgaaaagatacattttcctccacaattatctgacagtatgggacctggaggtattaaggaggcagcttaattaatagtgattccctttggagcaaaggttagtggtggcttccttccttcttcgtgcattttatttaaagatttattaattaattattgtcattatttgtgtgtgtgccttaagaggccagaagagagggtcaaatcctatacagctgttgttacaggaggttgtgatctgtctgaattgaataccaggaatgtaactggtttggggtccttcttctgtaagagcaggaagcacccataatcactgcaccatctctcatacatttcatttaaaaattgcatatgatgagaacattttataatctagaaatacataaacattgttactttagtttaaaattagtaccagggaaagaaaacgtgttaatgttaatactcactaatttaaatctatgtaaaactctaagaattttaattgaactaaaataataaaagtgctagttaggaataatcaaggaatttccaggcagtggtagtgcacgcctttaatcccagtactcataggcagggagatcactctgagtttgaggccagccgagtttacagagttccagggcagtcagagctatatggacaaatcctgtcttagaaaaaaaaaaagaagaagaaaaatcaaaaaattaataaattgagaatcaaagggaagttacaaacaataaccctttcctccaaaaaagaaatgaaatacatgtagacacacaaaaattaagaaataaacttcagcgctttctggtccctaaagcccatccatttcccctcctgggttccaagaaacataattaactaaactctgtttcataaatctccccctttccctatcttttcaagtttcactaggaaacacttcaaccacacagatgaacagaaagcatagaacaatgaatatttatatgctttgcaaactatcttatgctttccattgccgtgaagagataccatgaccaaagcaactcttataaaggaagacatttaattggggctgacttacagtttcagaggcttagtccgttatcacgctgggaagcatgacactacgtaggcaggcatggtgatagagaagcaaagagttctacatctttatcctaaggccaccatgagaaaactgtcttctacactgggcagatcttgtgcataggaccttaaatcccacccccataacggtgcacttcctccatccagcccacacctactcaacaaagccacacctcctaacagtgtccccttcccatgggacaagcatacgcaaaccaccacacaaatcttacatggacttagcaattccatagccctttcctgttttttgtttatttattgtttatgtaatttgagatagggtcttgctatgtagtccaggttatcttcatactcaaaatacccttaacctgagtgctaggattaaaagtgtacactaccatatccacacagcaattctttatatttctattttaggttgatctataatgcatttgcctgaacatttaaatattgaagacactagtaaaccacccataaatactttagtatgtgtttctaaatataaaagcatttttctttcaaagagcaagccagtgacattcaggagtatcaacaataattccattatatctacagctgagaatctttgtggcacaacaaacactgcaaaggaagtaaagagctaggagagtatggagaactgcaaacgatgtcctgcaaaagcagaattaagcaaaactcttactcttgcctcttgtcttggtcagggtttctattcctgcacagacatcaggaccaagaagcaagtcggggaggaaagggtttattcggcttacacttccacactgctgtccatcatcaaggaagtcaggactggaactcaagcaggtcagaaagagctgatgcagaggccatggagggatgttccttactggcttgcttcccctggcttgctcagcctgctctcttatagaacccaagactaccagcccagagatggtcccacccacaaggggacctccccccttgatcactaattgagaaaatgccttacagctggaactcatggaggcatttccccaactgaagctcctttctctgtgataactccagcctgtgtcaagttgacacaaaattagccactacacctctctatgggatatcagggcattgacaaccttccccaatacactacagatcgcacataacattgattcaaagccaaacagattttcttgatggagaccttggtgggcagtagtcctggcccatgcatccttgcaggagtattcatgctctgatctgggaagggtgacagaaacataccgctagactctaaggccaacgaaagtgcttctttcccagtaacagcgttggaacccaatgacctgtatcatggcatcctagatcccaaccaattatggctgtcaccatccttcctttcactaccaagttccccaaaacctcaagatgaccaaatgggttggctcaactcaatctggctacactaggatcagtccttcctagttagactgaatgttattccagctgttggctcccaaggatgagtttaggtgccaggaaattacagtgtttcaaggtgagaagcacacaccctacctctgccccaccacagtccccataccaactcccaacacaacgtctttcaagatactctcagccctctaagcttagctctgtctacagacattcttttcctttaaaatatacactttttaaagacttatttcatcttagtaacttttctatagctgtgatatgacagcctttagaagaaaggaggaattgtggcttacagtttcagagggtgggagttcgtgaccatcatagaggggagcatggcagaaagtgggcaatcatggcactagagcagtagctgagagttcacaccctcctctgtaaagcagagagcacactgggcatggaactgagacttttgaaacctcaagtctgtctccagtgacacaactcctccaacaaggccatatctcctagcccttcccaaatagttccaagcaattgggaaccaagtgttaaaacataaggactgtcttagcgctttagtgctgtgaagagatataacaaccaaggcaattcttacaaaggcaaacatttaattggggttgtcttaacagtttcagaggttcagtctgttatcatcacagtgggaaccatggcattgtgcaggcagacatggtgctggaggagtctagagttctacattttggtccaaaggcaaacaggaggagactgtcacactggtcaaacttgaacatatatctgagacctcaaagcgctgcttccgtatgtgacacacttcctttaacaaggcctcacctcctaatagtgccacgcccatggaccaagcatattcaaaccaacacaagagcctatggggatattctcatccaaaccatcacaatttgatgagggaattgtgtgtacacataagggctgtggaagccagaaacatcagatcttcctggagctactgttataggcagtagtgaaattccagacgtgggttctagaattctctgcagtaagcttcttaaccacagagacatctctctagccttggtgctgttttgacattgttatttaactatttgttgttttcactggactgagtcccttgagagcaagaaccttgtctttttctacttgtatccctctgtggttggttgaatgcaggcccctaaaggtgtctgtacaagactcagcacgtattaagtaaccttattaggggttgaagagatgcaattaagtctttcccgtcaaaactattttgcattgccaggtggcattaaatccaaggatgagtatctgtccagagaagagatacacagaggagacattcaaggagtggacactggcagaggctagagtaacaccagtcacaataacccatagaatgcctggagctgccagaagctgaaattgacagagaagggctcccacctgaacctttggaaggagtatggcctactaagtccttcattgcagatttctgaccttcagaactactaagaaataggtaggtaggtataggtaggtaggtaggtaggtataggtaggtaggtaggtaggtgttgtggccgaccagcagctcgcaacaaacggttcaactgagatggcaactcgggctgcaagagaggaactagacgggcagaagaaagaacgaagtcaagtcaaagtcactctgatcaaagctcaattttactgttgcgacactcagttatgaaggaagggggaggggacccgattcccaccaaataatcttgggatccagtagcagggttagcacgtgtgtggctccaaacagcaaagctgcacggtctagcagtgggcgtggcagaatgaatgagcaggaagctccacccctgaacaaacaggtttcaggctgggggaagagaggtaggtaggtaggtaggtaggtaggtaggtagacagatacatagatgataagtagatgataaatgacggagggatggatgggtggatggatggatagatagatagatagatagatagatagatagatagatagatagatagatataaatgatagatgacaggtagatagagagagatgatagacagacagatggtaaatagtagataacagatggatggtagatagatagatagatagatagatagatagatagatagataacacatagatgataaatagatgacagataaaagacagatagataataaatgacaaagaaatggatagatgatgatgatgaagatgatagatagatgatagataatagatagatgatagatagatagatagatagatagatagatagatagatagatagataactttgtaccaaccatggaaaagtagtatacctgagttataccaagaagctaaagttcatttgtcaaattgaagaaatgaaagagctgggcctgtggctttgcaccttcttcataccctacagaaaggaaagcatccccgaaggtggccggactctggttaacaaacacccaaacctcactattgtagcgtcaaatgaatgatttgatccttttaatgaggtgctttcacctccctgcacgttcattgtccttccctcattgcttttactgtaggcgaatgggttgacttttgatgtatcgccagaacacaataaattatgagtctctttctttaaggttggaaaggggaggaattctacttccctgttcagttatttcaggcaagggcgggagcaggttctgtgccagcagcatccggattatgattcaggatgtacagccaaaggcaaacagctcctctgtaaattcaatcacataggaagaagcaaaggcccaaacaagaaaggccgggttctctttgtgtgcacagccaaggggtcctgggaagctggcaagggattgatgccctgtcttaagcaaaagctaaactgagctcaagaagtgaccttctagaaacttctgcacatagcccacataaggctggagctaatctggcctttcaggagccacattctagacaattcaaatgtgctggcgtccctctgtgggctaaaaggatggaggtcaaccagaattaaaatgtattttatttctaattatgtatttgtatgtgtgtgtgtctgtgtgtaggtttgtatatgtgggtgcagtgcctacaaaggccagaagagggccctgactctactaaagctggagttacagacggttatgagctacttggtgagggagctgggaatcaaacttgggtcctccataagagctgtatgagctttaacctgccaagccatctctccacacccaaggtttttgttttttgtttttgttttttttgtttttgttgtttggctgtttggttggttggatggttggctagttggttgtttttaattatgtacaaaacattcactttaaaaaaatcacgtttccttggaaatttttctgcatataacttctatgctattgtatctacaaagggtgcaggtgatgacacccatgggtataatcttttattagtatataatgcaagtcaaaatggatagtttttaatcagttagtcatgacccaataatgaattaagaagttagtttagcaagaggtaccagaatttttatttatccaaaggagaagaaaggggatatatctgagtacattgcacatattttgtagcagtcttaatgagtctatcattgactccggcttatgatagataatgtaccttccactgtactatgatctaaaatgtgtaacagtgactgccttagaaaatcagttcctgggctgaagagatggctcagtggttaagagcaccgactgctcttctgaaggccctgagttcaaatcccagcaaccacatggtggctcacaaccatccataatgagatctgacgccctcttctggtgtgtctgatgacagctacagtgtacttagatataataacaaataaatcttgaaggaaagaaagaaagaaagaaagaaagaaagaaagaaagaaagaaagaaagaaagaaagaaagaaagaaagaaagaaaatctgttcctttagcccagaaagcatcttgtcacatcacccaattcttaccaggtctgtttcttgtcacatgagacaattcaccagggacaatttaccatgtaccttgtgagaggctctgacttgtagatgccaggagtcatatggtctttctggtcatacctaaagctcaggtcttggtcgtcattgttgtaccttggtggaacctcaaataaccctgctgtcctcggtttattgccagttgctatgataaattactctgataggagcaacttaaggaagaaatgatttattttacgtcatgattacaggtcttaacccattattgtggggaagtcaaggcagctggaaaagcagctagccatacccacagtcaagaacataggaagagtatgagcaagaacttcaggcatgctcactttctcatacatgctcagttcttatatagtcatagacgcagatctagggaatggtgccacccaccatgggcaggtcttctcatctcaatcaatgttatcaagataagcccccacagacatgtccacaggccaacctgatccacacaactcctcactgagactttcttcccagttgtggtggtttgaataagaatgttcccattgctgggcagtggtggcacacacctttaatcccagcacttgggaggcagaggcaggtggatttctgagttcgaggccagcctggtctacagagtgagttccaggacagtcagagctaccctctctgttattttgataaagtactgtgactgaagcaatttatagaaggaaagagtttgtttaggctcatggtttcagaaagagagagtttagaatggagctggggcagaagaggaaggaaacatggcagcaggcagctagatgaaaaacagatcatatcgttaaccacaaacatgatgccgagagagcaaactagaagtacagcaagggtgtaaattctcaaggttcaaccccagtgaccacttctccaaacagcaccatcaattggggaccaagagctcaaatacctgtgctaatgggaacattctttttttttgggggggggggtgtcgagacggggtttctctgtagttcttgctggcctggaactctcaatgtagatcaggctgggttcaaactcagagatctacctgtctctgcccaaatgccaggattaaaggtgtgcaccaccatatccagctttgccttttgcaatttctgatacagacaacatacagagttcgtaaatttagtcttcgaggaggaaaatgaactgccttgattcctaccaccattaatcttctttagttttctatgccaatggtccaatctccctcacagccatttattttacccaggggagggatgtcctggccttcattaaagatttttctctcatttctcagtttgctggctctcatagcaccacaatccaatgttctgacaaatgtcccacatgtgccttgtcccctgaacacctgtcatagatttttgggcaggctttctgatcgttcacgattaaaggctagacctgcattctaatcacagattacagctgggttagccagtggaatggggccttagttttggtgtgattccttgctatctcttgatgttgatcaagctgcataacagacaagcaaagcaaatttcgtaaaaatcaggatgaagcagatgtccacccaaggggagttgttggtgtccactgtcttattcagccattagctgaatggcattgctcagttgctcctaggctatctcaggaacagacttcaaaattctattttgtttttttgagtgccctcataaatctgtgcttgccaaagaagacgcataaaacagaggcttctggggaaaatacagcaagactaatgtgttaagtgattctcgacatcttagaacagcagaaaaattaggaaggaagggaggagagcaggagaaaaattctagccctgggctggcagtggctgacctgcactgtgccgcagattttctcgctgctgcatgagcacagacaagatcagtcttgtgtttcttgccagcagcatcgtcttgcttgctatagctgtaagcccagtcaggccaaagagcatatttaatggaagcgaccgtgcaatcgaacacacagccctgtacattctcttctacctgttctggtttggatctgaaaaatcctccacaggcttatgtgtgaatgcttggctcctcaacctgcaaacttctttgttagggctgtggagccattaggagttggagcccggccaatggaagttagttagccttgcaagttagacccccactttgattctggcctgtgttctgtttcatgggccaccaccgtactggtgacttttgtagtgctgtgataaaactccacaaccaaaggcaacttaaggaagagagtgtttattctggtttatcattctagagggataaaagttcacggtgatagactggaggtgtgacagcaagcagcaggcacggtggcagaaacacgttgctgagggcaaagagcagaaagagcaaactggaaatggctggaatctttagatgcttaaagcctgcctccaggaacacacttcttccaacaaggccacaaactcacatttctgccacctcacaaagccctacctcacatttctgccatcacgcctctaccacacctgcctattacggaagactggaattcaccagactgggatctggctgagactgtgagcccaaatatatctttcttgcctccagtcttatctgttatgtattttggtgacagacaacaatacaagacaaccaggacaccacccaaaggaaggattcaatacccaacaacacaccacagttgcatttgagaagactctattttatatatgtgggtctgctcttctgagtgtgtatggggggatcagaaaaatgccaccaactctgtggcattaaatatgtatgaggggactagagagatgagtcagcagttaaaagcactggctactcttctagaagtcccaggtctaattcccagtgcccacatggcagctcacaactgtctataacttcgtgtacacacacacagacatgcagtcaaatcaccaatgtacataaaataaaaataaaaataaatcaagtctgttgtaaaataatttttaagccctttgctggtatatctgtagcatgttaatgagaaaaatatcagcacttccattctacatgaaaaaatatgaacctataattcagataaaaataaaagccactaaaatttatgcccaatttatttattagtgatcaagaatatatatcaaaacaaaacatatacaccttagtcacctttgtaactattgatcacagaaggaagacaatgtagtagagagataataaatcaggcattcttctcgactgataggacctttctgagagcaatctcgtaatacaaacctatcctcatagcatctccacacctttctgatactaatgcccattctgtgaacatatcgaagggaaataacagatgtgtagacatgcatgtaaaaattctcatcacggtagtttttataacaacaatgaacaacagcaacctaatcaactaatggcagactgagtgtgtcgtggtggtggtcaatatggggtcacatctaaatgtttgggaagttggcaatggtctggggagatgtgggttctaaaaataggtgtgcgcttagaaaatctcagtattggcaaaaggtaaagagaggcgaggctggagggaaggtgatcaggctacagaagagatggtctcctgcgacagaagagaggacacgtggagagtcactgttagatatcttatggtagagacaggaagacgataactcccacagaaataaacacacatgcaagtgtatacacacacatacacgcttaaaaattatattaaaagtctttttaaaatggccataaaattgtgaatcagaaaacattcagcaacatcccaaaaggtaatttccatagggtgggcacaggcgaaccctgaactcttctctgaggtttctggtcactaaggtgggtcgataaggtattgctttaaagaatgccagaaggagaaatgtgctgttcggtaatgattagtgtggggaggggcatgtcttacactctgactttttaaagtttctatcaaattcaataaatcaagaaccttctcttagaaaagagctctggcaacatcagcaacgatatagaagcacacaaaagcgcattcatacagagtggctctcatgacgtcttatattgtgttatagctcagagaagaacacgtttatcagacataagaccctgggttcaagtttcaattgctagtaagcaccagggacagcagaagcagaatgtcaaaaccatttcacagccagcctcagctaactacaaaacaggcagttaagaggactaaaactaggggcttttgtcttgttttactcttattttattatttttttaactgaaatttgggattctagacaaggacacattcaaaggaagtataaaacactcgtttaaagaagggacacttgaaacctggagaaagagacttgacccaaatgtatttggaagctattgcttcagtatctacgtcagtagcttgtctatggacaagcacacagaggtttccgagacaggttcccatgccctccatatgtgtgagtagaagactcctgggcttcctgtgtgcattccaaggctgtgctagctgggaaagcaaaggatggttcatttctcagccatgtcagggatcttgtcatgtacccagtccatgctgatgacctactcagagatagtacaatagaggcttgcctccttcctgaatgtgtgcctacatgcgcatccaggtgtgagtgggacatggcttcaacgtctggtattggtcacagtgttgtattaataggaccctggtagggaaaggggtttgctagtagaactgggcttgaattttgctttcagttttaatctatgtttctccttttcatacttagcaaaacaaaaccaacaaaaccaccatagccttagtggagcaaggttcgttcataacactctcaggcctatagccctcctccaagtctgctgattcaacagtctggagttcatcaattccttcccttggggcctttgaaataactataattagcccttatctggtcactaggatacaagagaataacacaagggagtcaaaggactataacctggggggaggtctgtctttgcaccaaggactacaggtccctcaagcaaagactatttcctgctagcatcttgcatataaagttgagttggctgttcattggtctccacagctaccaaccaagaaacaggttctggtttggacagaccttcagtgaacaagattcctcccagggtgctagatgaagggacattgggggaggagggaaagaacccgaggctggatagaagagggctagaacaatgagtggtgcaaaaggttctttctgatggaggtatgtgagtctgctcgtcctcacagctaccacaggcacagtggcacacttagtctgcttagagatacactgcccgttcagcaagatcacactcatacctggacatcagtcataaaggaactatgtacaccatgaaaatcagttaaaaatctacaaaggagcgctccctcctctcctcttacctccacccagagcccactgtggaacatttcccagcacataacaacatccacatacatgctgcatgtgaccatgtcataccttgtgaaaggtgatggaagccatgccccacccacccctccagctgctacatggtgggcaccaacagcccttacaaatccctttccaggaactgccttaagcgccaagggacagtcattgcccaggcctgggcctcctcccttctctggggcaatatccttatcaactaatcacttaggaggtgggatggaacagtatgaccagttccatgtgagataactttaacacaagtgcgtgcattcacgcacgcgagcacacacacacatgcacacacacacatacgcgcgcacacttctatcctgcatagtaaagggaattttggctggctctagtatttgtattacaaccagcattcccttctggcttccactgttgaaagggagagagggaagacacctggcacctcctctcgcctttccccatgtgattctcttccttggtatggaaggatccgtgagctttgtttcacacctaatgttcaacaatgtcctgagcaagtctgaggacatgcctttcattgagcctttcaagtctcaggcccatctggcatgatgatgccagtatccagggagctagggcagaaggagcaaggttgggggtcagcctgggctacatggtgagttcaaggtcagcttggactatagattgagtcactgcctcaacaagtaaatgctaaacacagcagcaaacatctggcctaagagagtctctaagagagaacgagattatcctccttcctgtttatcccgcctcacctgttcctatctctctttcttctgcaactccatatggacatcttaggtcccctgatccaatttcctgggctttgatctcttgatttggttcttatgactgggctactttcacatttggttttccaagccactttttaaactcacccaatggattattttagtttaggatgcatctgagttctaggatgccttttacattttttgataatgtttattttattttattttatttttttgttcccatagcactgctttctcttcttctttcctggcttgacatgttccatgtgttagcttccgggcgattccactaggctcctcccaaggacttagcaagggcatgggcatcacctgctgcagctgggtgcgccggatggactgcacataaaaggactgcccggcactccagcttactctctgtccccacgcgttcctggccagtctctctcttcccttttctgtccttctctgtgcccatcctcttctctacctgcatggctctgttcacacctgtctgtctgtctgttcatctgtctctctagtctatgtgtctactcatctgcctctaccctttctcacaagcccttactcccttccctgcccccaaattaactgcctcataccagatctgttgcatgatgtgatttctcatggggaccccttggcatgggtccaccaggtacccctcactgcattatatttcatagtacactggagacatcactgcactctatggctcagccctaaagttccatatgcctgccaggggtagagtatagtggggaaccagccagtatagcaatgtgtcttagtcacttttctattcctgtgatgaaacaccatgaccaaaacaacgtagaaatgttaggtttacttttattattcaagagtatttttgcctgtgtgtgtgtctatgcaccacatgcatgcttggtgcccgcggaggtccagagcttccatgtgggtgctgggaatcaaacctgtgtctttcacagcactttgcccttaaacatgagcaaactctccagcccatgaccaagacaacttacaaaagtaagttttaggcttacaatgtcagaaggttagagtccttgatggctgagtgaagatgtggtgagcagaacttctgaaagctcacatcgtgatctgcaagcaggaaccagagagtacactagggacagcgacagtcttttaaaactcaaagctcatccactgtgacacacttcctctgaagatcaatgtcccctaaatctttaccagacaagttccaccaactgtcgaccaaatattcaaacagaagagcccaaggaggctgttctctttcaaaccaccacagaaggaattgcctcatgggccttcagtgcagaggtagcacacgccatccccaccgccaccgccaccacaccccacccccccatcaccatggaggcatcgggatgaggagctccactcttttcaggtccagcttctttctgttcatctgagttggtgaggatggtccagcacaaagctgactcacctttcccctggggccatgaatgtgaaaggccaagcataggtctcaccacagtgagcatcatccctaagctttctagcctctggtacccagagaagaagcccccatccagccatctctgtcctgtctccatcaaacctggtataaccttccacactgatgtaagtccctgggcttgtgtattgaatatttggtccccagctagcgccactgttctgggagctgggacctagctggaggaagtgactctgcctttgacggttaggcctctccttgatcccactctttctctccacttcctgtctcccgcaaagtgagcaggttctgccacgtgctgccatgataccctgcctcatcacaggcccagatccaacagacccagaactgtagaccaaaacctctatagttccgagctaaaataaatctccccacttcagtttttctgaggtattttgtcacagcaacaaaaggtctaacatcccctcacttctccaggatttacctctatgggtcccaccaggaaactatcaggtaatgagtctaccacattaacaaaacctagataatcctcccacccccccaccccccaacgtcttttgatagaaaggacacacttgatctgctgtccctgactgactcctcatttacgactaaaatgatttaacttgtgtttgcttctgatatctctgggggaaaaaaatcttcaaagttgtaagtgtttaagaaatatcctgggctcattggatttcctttaaaattgtgtttatggcccagtaagatggccaagtgggtaaagctgtatgcctctaagcctgacaatcttaattaaaacctcagggtccacaaggtagaaggaaagaaccaatttgtcctctgacctccacatacatattgtggtatagttgtgcatgcatgcacacacacaattaaacaaacaaacaaacaaataaatgtaacttccaattaaaattgtgtttataaaggaaaaagtggttgaaaaggcagtgtatatggatgtgttatgtgtgaatgtctcccatatctacaggcatattaaacaaaaacaaaacaaaaatgtctgcgcacgggtaaataccacaccgctatcattagatgctatgtttataaataacatatctttttcttgcctagatcatttaataattcttactgatgaaagacaagatcatcattctgcccagttgctgactcagcaaaacacgtgagacatggacactgttggacgactctcatagacgtttccagaatggcagagatggttaagcaaagcctcgcatgtccatcccagagtctataaaatcagctcccgtcttctcagcggctcaccaggactgttgttggcaacctgtggaggcaaaagaccagaggcacctaggaaggaccccaccgaggatggcgctgcgcaaggccctaggtctcctctcaccatccaataagagcaccagtgtcctgtgtggtctctcaggacagaatcactcctggctgtttggattctagcaccacccaactttaagttacctggcacttaggggctgctctacaaactctggttggctaaatccattctctgctcacttgacaacacagcgtgtgttaatagacagctctgctgtgttacagccatcctggggcttgcaacaattctatctggctggcatggagactgaagttcaagttgcacggggagatttcctttcaacagaagggctcacgcttcaaggttctttgtagagatctgtgggccctgtaggttcacacagaagatttctttttaaggatctatggtctgtggcaatgggtgtggcccggaaggagttgttagtctcccgagatggtgacatagaaaggactgtattggctgtagagagagcccaaggttctgccagtgtccttctggttccaactgtatgacaacctcggttaggcaacattatgtaaagttgtccgcttcttccaaagcgttcctctgccctgaggtcatctctaggcctattaaggttcccttcaagattgccaagtaacgatccaagggaaagattgggtgtgcccatgcagcagtcctgaggaaagcatgtagatgctggggaattagtacaggagaggcttgtggacctgtgtcctccatctgtcccacaggcatctatctggaaggcctagccccaggaagagatgcttttgtgggaccggtgatatttaaagggcagagatattagcctctcaagagagaggtaacattagagacatagtatatagggccgggtctgaatgtgctctgctttgtatcaggggtgagggctggacagcttggggcagcagggcaggtctcagggaagctgagagcagtagttccttgatggccacagaagggttgcaatagtttcggaaccagaatgaccacatgtgcacataccagccgaagagcagctcccgtctgaaaccacttctaagccgagctgcccctctggcagaagctagaatcccattgctgcaagccacattttatggagttcttttattagtctcccatgtaacccatagccacatcataaaattaaataccctattctgtacatcaagtccactgacttcttgagccctgattaacactgggcttttccttctggggttgtgttacagtaacgttgtaaccgacagtgaagaactctttgccaggagcagtcaaatccttcaggctcacaaggcttactctcaaatcacagtgtgtcatgggtgcgtccctctttctctgaagtctttttttggcagcttttcaataatgcctctctgtttctttcatcccctcttctccttccatccgacccctcgaattgccttagagctgagtgtccctagtgcttgcacagagtcacaggtcagggtagccccaactcacccctgagaataaatttagcctgtggctaatatcccagatggagaagttatctttagcctggcagaggtggagagtcagtccgggccatggtgcaaacagcagagttaggaggggaggggagggaagtcagccccccacacctagcctacaatataccattcaagtgtgctcctgggtgacagagaaataaaagtcaccgtgctttccaaatcacgaagaaacacctgggaacagtgatctgattctctccctactatgaacagaaaagatgtctgcattgtgggtcagccacataaaacctcaaacacatgttctttaaaaagagcatcaagccaaggtaatttccagccttcctcattcatatctgtttactgcttgttcattagttttgttgcctgcaggtgtaaaggtttaagacataaggaaaaaaaatgtgtgggagaaaaaaaccctccatggaacactcatgtggcttgaattaaggaaaggaccaggaatattctattttaaaattggaataccttggttcactccaggagccccaaaggctgaactcactctgatagcaagaaaatgctagattccaccggaggagacacttgccttatgatgctttggctgttctggtggcacaagtctataatcccagctacttgggaggctgattcaggaggaacacaagttcagggctgtctgggctacagagtgagttcaaagccaacctgggcaactcggtgggaatctgtgtcaaaaacaaaggggggaaaggaagaagatgtgctaggagcacagctcagtacctggcaggcatgagaccttaggttcagttcaatctctagaactactgaaaagaagaaagaaagatgaagagaaagaaagaaagaaagaaagaaagaaagagagagagagagagagagagagagagagagagagaaagaaagaaagagagagagagagagagagagaaaggagggagggagggagagagaaagaaaggagggagagacagaaaggggagggagggagagagagaaaggagggagggagggagagagagaaaggaaggaaggaaggaagagagagagaaagaaagaaaaaagaaagaaagagagaaaggagggagggagagagagagaaaggagggagggagagagagaaagggggagggagggtgagagagagaaaggaaggaaggaaggaaggaaggaaggaaggaaggaagggagaaagaaagaaagaaagaaagaaagaaagaaagaaagaaagaaagaaagagaaaggaaggaaggaagaaaggaagaaagaaagagaaaaaaagaaaggaggaaagaaaggaaagagggagggaggaaaaaagagagagaaagagaaagaaagaaagaaagaaagaaagaaagaaagaaagaaagaaagaaagggaggaaagaaagaaaggaagaaaggaaaagagagagaaagaaagaaaataagaaagctaaaaaggatggacggagggaaaagagaaagccttcttctctcactaaaacccttccgtgtcagtcggtacccagagactcctacttggttttcattgtagaacaattcattaaaatctttttgtcaaaacgtctgaacacttgtggttattattagggtaaatccagagccgaggctgaacttgagctggggtctgacatgtctgagcatgtctgacagctgcgtgagaggccctgatctccagggaagaagcctgtattgtgggacagaagacagagccccagttaatccaggaagacggtctagatgctgggatacgagactggtttcaggatccttccatcacatgagctttggacttctgggagcaatgagaccatgagaaagaattggaaagactatgtagcaagatctcatgtgaagcagagcacagagcttggagctctgatacgggaccatcacacagtagggaaaaaagacagggtcacaagtggctagacagtcccgtaggatcaggccccagggatgcttggccctagcaagcctttcctttaagaaggccatggggtacagtacccctggagggtcattggtatttgagaacctaagaaaagtgagcttacttttagtgagctcaacactaagcctcttcactttggtatgggcttcaacactaagcctcttgggcctttccttctctagacttgatgatgctggttgcacagaggctggacagagtcgcctctccttgatcttacgtgcggactctctgattctgctgctcatctctatgactcctcctcccccaaatgtaacacagcggagtaaccacagaacatgtgtaaatacttccctgagcacctacccaccaatgaattactgtatctctatcagttaccatcctgtgagccatcctgacagtctattgacacttattaaaatggcttcacagtatctatccaagctggggggccaactgtgacttctccttggatctttcttcaactgtccttgcttcaaccatgccttgcctatgtagtaaggaagaggtcgggaacataggactccacactgtcttagtacctaacatcgttcggaacgtgaaagactaaatctgcgattctcaaaaccaacggactgtaattctcatctccacatcaccatgtaaacgttgcctacaaatgaatccacttcgtaacaacctttaggatcatcatataaatacaagatattcaatcttttaaaaaaagaattgagagagagaggtgtctcacatagcctaggcttgcctaccaactaggcttcattctgagctccaaagacattctcaatgatgagaacttgtgccttggaggaagataattaattaagcagtatgtgactgggcatagaattttctttgtacggctgctttggctcatggtttgagacagggtctcactctgtagtcctggctgacccagaacttgctacatagaccaacctagctgtccttgacctcatagtgatcacaaggcctgcctctgcctcccaagtactggattattttattttgttttgttttgaccttgactcctatccagtcaaaactgactcctcgttttattttatgaatcttttgcctgcaagtatgtctgtacaccttgttcaggcctgatattcacaggagtcaaatgaaggcatcaaggtgtcctgaaactggagctacagacaattacgagccaccatgtggttgctgggaattaatacaggtcctctggaagagcagccagtgctcttaactgctgagccacctctttagcccctaattctacttttgaaagtatatttatatattactcttccaattaatcttcaaaaaaaatctagtttaaaaaaattaaagcaaagaacaatatacaaacctaaccccctaagcaacaggcctagaaagtgccttttgctgatgctggaccccgtaggatcagatgtccagcatgtcctggctccatcgactggcttgctgtactcaaaatggcttgcgcaatgactggcctggctcacagcccacacaatgctctcccccataactagggcaacatgacttccgtttgttgactcgtctctaggtccaggccctgggactaatcctgtttcttgtctggagggatttgaagggctagcagcttgggttgcttaggctcagccagcctggttgctaggcttgttctagtctttgtgttctcttggcagagtggtctaggccttccctggtggggacacagatgaccctttttttttttttttttgcctgtctggtcttgaaatccatgaagggataaatatgacacctgtgagatgagccagccccccatgacacacatacctatgtattcatcaaccacagttaccaaacaccccttgtgtatacaatagcaagccaggcttgggtcaaagcaagtatgaaggggaggactttactccgtctagtaacacagccccaaggcaggtttgattttagggagacaaagactgagtctgggaggaatcagaggaagagatcagatggttgtcagacttctgaggtgctagaatttcagcagttgcaagccgaaggttccagggcaaggaagtagtctatgaaggcaaccctgtcgtcacagaactcagagtcgctggccttctgccctcccactccttagagaagcagaaggtgaacacagcttgtccccgagagtcaattttatgaagggcttgttctgtctgaaacacctaccttcccaccaccatgtctagcgaacatctacttgtgttagctatatttctctgtgccgtgatgtactacctagtaaaagcagcttaaggaagcaaggttcacttgggctcctgctttgaaggaatgccatcagtccatggaaggcatggccatctcagtgaaggaacaaagatgaacgctagtgtttagcttgcttcttcttcatactcagtccaggcccccagaccataggagggtgctgctaacattcagggtgggccttccctctttaggtaagccgccctggaagcatcctcataagccccagccatccaatctcctaggtgattctaaaccagtcaggctgacacatgaagacacatgacccctgttttcaagaccataatacctcagtgaccttctcaggcaggataattgtcctgttcaccgttctcggtgctaggaaggaagggaaatccagacgttaagtgagtgggctctgattctatttatttaggttagtgtgtgtgtgtgtgtgtgtgtgtgtgtgtgtgtgtgtgtgtatgtttgtgtgtaggaatcaaaccctgagccaggaccctaccactgagctgcacttcctgcctctaaagtccagttgaagttcagcccctgcctttctgagtcattttatcacacagtgaaatgttctggctaggactgtcacctccctgaggtcaccacaaattaaggaagtcagtaagaccgaggcaagtgccagcctcggtgcctgctttggagccttataaccctaggctgcagttactctgtaatccaccctttgcgactctgagaggccccagaccggagctagtaattctgaatttatctctgaagcgattaaagatattctcgctgcagagacttagtcttcttaagggatgggcccaaatgcaccgggagaataaacacacacgaaaagaactgggaactggaaaagtaaaaaacaaaacaaaacaaaacaaaacaaaacaaaaacccacagggtcggagttgccaaattcagaagagaaatggctcctgagcccctttctacggcttcagctgggatctggacgctggattttccaggctgccctgctcctgccccgtgccaggtcacagcgcggccctcccacccacgcgggccagcagccggccaggctgggcgcggcaggaaggcgagccagctccaggcaccctgatccttaactgccgcttccaaagtcccggctgatcctaatcagtgtgggaaaggagcgccggggcccagcccgccgccggagacgccgcctcttttcataaactttatcgccgcggtgcacagcccctgataaagcaccataaataaacgagcaggcccgagtgtgcggctggccggaggctgccagagcgcacgccctgcctcggcccgcagctcccgaggagaaatgaatcatgcgccaagctcaagagggatccgagctccccccatcccagcccctgcaatcgcaatgctataaataagaaggcaagcctccccctccttggcagcattcaggaccactaggagtttccttgtggctgccggccacccttctggcctgggagctaggagtgttcttgcttaccctcctgcttcaggtcaagttccttgggcctgggttgagcctgggcatgtggctccattatcac

SEQ ID NO: 143 - DNA, 1932 bp, Mus musculus
aatcagaggcgggtcaccctgctgctcggtcctcactacccttgttgcagcccggaaggtccccctgcccgcagagcgaccaccaaacctcgcatgtgctcgatctttgtctcaggacgagggtgcagaagctcgggcaacggggcgtctcccgtctcccgcagaggaacctcggccactgcagccggggaacccgggcgaagtgcgtctttcccagagatctgctgagagccgaggcccgtgactggtgagagggccgtagaagcgggtactgaaaacaaccactgaactgtggttgttttgtttggttgtgatcatttttgttttaggaattcccgatcctggaagcctgaggagagcggatgtccacggcgggatgtgggagtgtttgctggctgtagaatgccgggtagaaggtggccccgggcgagctgcggtcagggagagcccggctagcctgggggcctgaggtgagaagaatgggattctgcccgggtgggatccggcccaggagtctcttccaggagcacctccacaaaccccgggaggaaggttaaggagactccagatctggtcaactcctgcaaagtttccggcccttccatttatggccggagaaaattgccaggaggcagattcacagtggcaaaagggaagtggccgagtgaattatcaggataatgtcatggatgctctgtctcccagttcctaccgaagactgtttggaataaagaactgggtattttcatcttctgccctccaggcccaggaaagaattcagccattccctctccctttgtcttgaccttgggagttggggaggtggggagactctcgggtcaagttcacttttcgtcctttatcttttcgaagaaattagggcagtagtttgattccaagagggggtagctcctaattgtgacattgtgttggaggagggggaagcgttcaagaaagctttttaatttcaatttgttgctccgttctcaaccaccggcgtcgcgtgctgtgaaggagacacaatttgaggagaaacaaagtggttcaattgggggaaaaacatttaaaagtgtcttaaactaggcactcgcctggttctgtgtttgttgggtgctgcattttgatcaaagttaagcgtttacagtattgggcacaaatatttctgcggaaactgacttagagggaaaaggggaccaaaatgcttcccctgaaggttcggattacacacaatgaagtaaattccacaacgttcttaatgggggagagtcaaaatacagaaataaaaataaagacatattctctagttcccatccacccaccatcacacaaatagaaaaccgggattggaaaattcttacaaaacatccccgcgttccttctgtctgccagtgatttaaatttggagcctctattactagctagtttttgatctccagtgcctgggttctgactctcagtgctgtgcatccaagcttgctttaaaacgtgcctttcttgggccataagcggcatcccagcatcccaggtgattgcagtttctaattagtacttttaaaatttgtgatattaagaaaagagttgtcaggttttaaggaatccatttctctagtggtcatttaggtccagcctgttctccaaaactgccttttcttcctcttgattgacagagcaacatattcgtacagtcaagtattttctgatatttgactttacttctacaaagtacttccaatacataacaatactttccaaagtattaaaatactacaaagaaaacaaagtccataccataagctgccatctcacaagctgccatcccataaacttccatcgcagaacccgccatcaaagttttcaaaggtttaatctctgatgtgttttgttgcttgttctttattctgtgtacaagtgtatttcaaaatcgattttttt

SEQ ID NO: 144 - DNA, 18338 bp, Mus musculus
tcttcgccccgccctgacagcgagccggaggagccgtaccttctaaggtcatctttgctcacctactcatcaaaaatccagccctgttatttaaaatccgatttcctgggagtcttcacgtgggacctttgggatggaggaggtgggtttgaccgcaaagggcggaagtgggcgggacaaggaggcaggtttccagggaagagacagtaaagcttgtggaggaggaccttgtgatttggacaagagatcttttccacgagatgcacaggaaacaaagtaatagctttttctcggctgcttttgctttgaaaagaccattgaaggctgctgaaaatccttgtttacaggatatgttactccaagaacatttgtttgggtgtgtttgggagggagatccttgtaaaatgaattatacatttattgaaacattaaaaacagcactgtagttttcctatctcctatgctaatgctttggacgtgatggtctaaaacattgagggagtggctaagtagctaatttaaaagctactctgctgtgaacttgacaaccagatacccaagtgtcttagaactggctcttgaggacttattttgctcaatttttagggtaggctaatttctagatgacatgcaagtgggactttgatgatcaggtaaatacagaatgactccaatttttccacctttccatgtgtccacaaattttacagtacctgcatctccactctccctgaatctgcattggctgggggaatggtattgagcaaagaaaaatgcaatgaaacttgataagaagcccggactggtgggcaggagggaataatggagaacaaatgtagtacaatgtagaccaggaacaaagccaccatactgacttccttcctggctaactcagaattgctggcaagggtcaggttggttcacatcagcaaaactgccccactgacccatcggcctaaaagaaagaataagtgattgccacctcattttggtttaaattgataggcagcaataacttaactgataaagatggcaacagacatctccaaagacctgttgattatcataaaggcactggttggttcatttgaacaggtgtgtgccgtatgtgggatcagcattgtaatttaaccgtggtagagaattatcttgtggcacctccctctcccttcccttcctccttctcactccctcctccccattgtcctaaacatccaaggtacagatccttctcatccatctgctttcatcattacaatcctttagctactgtcacactcattatctggtcctccaagccagtactcacatcacacagtggagtgagtgtggtgtgtgtgtgtgtgtatgtgtgtgtgtgtgtgtgagtgcctatttagtatgctgcgggctccttaaatgcgcaaatcatttttctaagtcataatgttccatatctaatattgtgtgactgttcaagcagtgatcatgggtacctttaaagttttaaaatctaatttttgtaggcccttaggagacagaaacagcaggattgccacaaattgaagactagcctgagctacatacacattttcagggaagcttggttacagcgtgagacattgtttccaaaggaaaacaaaacaaaagaaaagttaaataatattgtaattctcatatgttcctgatggaatttaaactagcacaaccttgggaaatggactgacagcttctacaaaagttgaatatagttaaacatggtagcagatacctttaattccagcacttagaaggcagagttcaacccagtctggtctacacaggaagttccaggacagatagggctatatagacagatggtgtctcaaaaaaaaaaaaaaagctaaacatactacaaccatatgacccaactgtttaagttatctatcaaaaagaaatgaaaacattcatataagcatgagagaaattgtaaataaatattctatagctacagcggttatatttgcaatgacaacaagcacacctgtacacatcgcaaatagcctaatgtgagtgggaaactagccagtaataaaacgaagtgaactactgatagatgctataaaatgactgagtctctgagaagtgaaagccagcctctccttgtacataaaatatctggctaagagaattaaaaggaaatgggagctggagagagggctcagctggtaagaacactggctgctcttccataagaccagggttcgattcccagcacccacatggcagctcaccagtgtaactctagttccagaggatctggcacccttgcacagacaaacatgcaggcaaacacatcaatgcacataaataataataaatcttggaaaagaaaatctagggactaggaagtagcacatagtgacaaaaagtgatggtgtgggcacggaggggcaagaaaagcaggtttcaaggacccaaaggaaactggcataacgactgttttcagttttgttcctgatgtgactttcatcacatacactgcatgatatgcttgtggtggtttgaatatgcttggcctattattaggaggtgtggccttgttggagtaggtgtcactgtggtggtggtatttgaggtcagatatgcaagctccacccagtgcacagagagtacccttctcagtgcctttgaatcaagatgtactcttagctccttctctagcaccatgtctgccccaattaaatgctgtcttttataagagctgccttattcatggtgcgtcttcacagcaatggaatcctaaccaagaaaacacactagatgattacaacctcttatgtgccaattatacctcaataaagcaattaaatcctgtttgtcacttctacaaaaccagtcaagatgcatagtagttttttgtttgcttttgttttctgagaccaattctcactaggtagctatacctatcctagaactcaccaggctttgaactcacagagatctactcacctctgcctccccaactctgggattaaaggcatgcactactgtacccggcagatagtatttttttgttttgtttttcaagacagggttcctctatgtagctctggctgtcttggaacttgctctgtagaccaggctggccttgaactcactgagatccacctgcctctgcctcctgagtgataggattaaaagcctgcaccacaacgtctggacttaaaacagtattttttaaagtgcggctaataaataggtttttttgtgtgttatattatcacaaaagcacagaactgaagaaaaaaatcatatttttcttcagagaatggtcacagataaaggaaagcagcaagggctgaagagatggctcagtggttaagagcactggctgctcttccaaaggtcctgagttcaattcccagctactatatggtggctcataaccatctgtaatatgatctgatgccctcttctgacacatgggtgtacatgcagagagagcactcaaacacattaaataaagctttaaaaaaaatttagaaagaggcaggaagaacagacagactctaaacaggcacactctgatatataagaggggcctttgaaaggatgtaatgtttccataaccagaataaaacctgaattgaactttcggttccagagcctagaaaccaacctgtgttgttataaacccccaaatctgtggtagttgaaaacggtcaaactatatcaaatttggaggaagagaagatagcaaaagccccagatatcttaaggaactataaaaaggaacaattttatatacaggcaaaaaaaaatttttttttggttgtgtagtcctggatgtcctagaactcacaaatccacctgcctctgcctcccaagtgctgggattaaaggtgtgcgccaccacacccggcttatatacaggcaaatgagttggaccatttctctccatctggttcactgtttcatttattttacttagattgtttgtattttgctacttagttgccttgccgcccattaacacagcccagttccactctgaaccccttttcatgtccttgactgaaaacccctctcttggaaatactaacaaagtttttggctttttgggtttggttttgttttgtttatgactgagacagactctctaccctaggctggcctggaactcattgtgtagctgaaagtaactcagaactgatccttctgtttgcaccttctgagcgctgtgattacagtgttagggctcaggaatcgccgaaggaagaccccggggactcatatagtatacaagatcaaagaccatttattctgcagaaacaaccagcattcgggggtcaccaacgcgttaaaatgacaacccagacatagatactcaggcctcttttatagggaactgggagaattttccagaaggactaggtaatgtctaatgtgattggtaggggccaaagcccagactttagtacaattttggttggctactatgatagggttagataatctaaaaccccattagtgggtgccagagtgccgcagatggactgctttcctgaattatgaatgattaatcacaggatgggctgcccagcacagatggcctatcctgagataagatctcccattcacgaggctagcttcaggctgttccccctgtgggggattttattatcttgttcctggactttggggtctgctgctggagcagatgacctatggccgagtttcatggtctgttcctggagcagatgacctatgacctagtttctgagttgagacaaaaaggaatgaatagaccccatagaccctttcaatccctggaatgcaccagtttcaaactgtttcttgactcttctctccacttttccaactaaaaagcccttcctgaaactagcatccaaggttcaaaaacagtaggctgagtgtgtagctccatggtagaatgctgctctgacttgtgcaaggccttgtgtcctacagagggacttttccaaatcctggccagagtaactccatcttaaagctgttctgtgtgccaccctgcaccaacacaagccattctctccaaagttggacggtgttttccaagaccaacagaattgctgattaggacaaagtctggttttgtttatgttttaagttaccgtagtgagtagtcatcactactgcttttagtgctctgaacacaggtttgtatttattcagctgtaaacttacagccatataaaataacttcatgtgcatgacactgtaattgctggtgacagaaatgttccatgttatccatagtcatataagtagcctaatccatttttattttaccaaacttgttggaatctttccttggtctgtctgcgccctccttatatgagaggaatagatgtttctttttctcattaattaaaataacaggttggaggggaagaacactagttttaaaaaaaaatgctgtatgtgtaaaaggattgctcatatctgcagcgacaacaacaaaagagcaaaaatcatataggaccgtaagaaagattttaatggcaagattcctggtgatgcttagagtactaaaagtgtgctatggtacttgtaatttttctgagcttaaaatataaaatatgcaactcaaaatatgaaaaaaatagaacaataaggcgttctgtgaactaggagaggaactcacaggatgaattccttcacatataataaatacgcctcctgctgtggtctgaatgagaaacgtcctctaccaactcgtagatttgaacgttgactggagttggtggcagcgtggggttggaagcttcagaaggaggagctgctgaaaatgcacgactggcggcagtagcaggactccctgcttccattctgctctcagggcatacatacgatgtcatcagccagcatctttcctcctgccacgccctgtcctccccaccgcgatggagtctccacccttctgaaaccgaaagccaacatactctttctcctttaaacggcttttggtcatggtattttacatcgcgacagaagagtaatacagaagtgtgggtgagaaaggcagggttgttgcggtgaagagccagtgttaattttgaggggagtgtggaagacactggagccgtggactagaagacaggttaaaggttcacataagcagaacttacaagttcagccacttccttaatggagttcagccacattcctcaactgttcgctacagcaattctaagagtaaagcaggaagtggagggagagctctccaggtgtctgaggggaacaaggactgtagcaactaggctgaaggccacttttgcgatgtgtttataaggaatctgattgcctattctgcctatttcctgagtattttcatgatgaggctaaattaagaaattgactattttcatttcaagacaatataaaattgagtatgggattatggtttttgctaatttttcttataaagaaaagtctttcctagcaaaaactgtggaatgtatatttaagaagattcaaacctttgtttgtacctctcttgctttgaaagacgtttaatcaattgttttaatcccctgggattaaccagttgtgcaaaagcctccggctcatctccttttccttcatttcttctgtgcaaactctttttgaactaaccaatctcaagagaatgggggtggcccaccagatgggggaaaagatagtcaccaccccactttagaatatagaataaaacccaagtgcccttcccgccctagcatgtttcctcttcccatccgactcttactctagaataaagctttgccttgtggggacacttcaattgcagtcctagcaactagctgagtagaatgaactgaaaaacgtgtggcttggagaggaaaagagcaaccaagcttaaagctacagccaagccctgtgctgaaaaggtaatagttaattaaagaaggtggtgggtgccattagagagaagcctgtggctcagtgttagaatgagaagggttacctcagggcaagaccccacccagctaagctttcaaattatggaagaaggcttaatgggtttcctctaaaaagcagcagcatacagaaacttctgctactgtagaacacgggtggggagggttctttcctaaactggtaacttgtggtcaaaacaggaacagtaccagcctggtctacagagtgagttccaggacagtcagggctacacagagaaaccctgtctctcaaaaaccaaaacaaacaaacaaaaccaggaacaatataccttgcaggctaatgggaaaccaaaacaggaaaaaaaaaatatccttcaaaagctaagaataagttcctgtttgtaaagaataagtttctgtttgtcctatgttaagtccttgtaagtaaggatttctatctgtaatttagaaagttccgagccggacatgacggtgacacacctttaatcccagcacgtttggtgcagaggcaggaagatctctgaggccagtcttgtctacaaagtgagttccaggacagccagggctacacagagaaaccctgtctccaaaccatcgccctccccccaccgtgccgggtggtagggcacaactttaatcccagcacttgggaggcagaggcaggcaaatctctgtgaattcaaggaccagcctagctacagagctagttccagaacagccaggactacatggagagtccctgtctctaggagagagagagagagagagagagagagagagagagagagagagagagagagagagagagagagagagagaagcagaagagaaggactgggggggggggttgtttccgcttgtcctgtgcaggcgaaggtttctgtttgtaaagaataagtttctgtttgtgcatgtgttaagtgcttgcaatttaaggtttctatttgtatttaaaaataagttcctggccgggcggtggtggcgcacgcctttaatcccagcacttgggaggcagagacaggtggatttctgagttcgaggccagcctggtttacaaagtgagttccaggacagccaagactacacagagaaaccctgtctcgaaaaacaaaaaaaaccaacaacaacaacaaaagttcctgtttcttagatctgctctaactgctttgcaactccagcacacaatgcacagccttacccttgttccttcttttttattgtattttttaatgatttatttttatttgatatgcactggtgtatgtatgcctgcatgtatgactgtatgaaggtgccaaatcacttggagctggattttcagttctgagtttgccatgtggggaatggggattgaatctggatcctctagaagagcagccagtgttcttaaccactaagccagctctacagcctctcctcttccttgggctgtataacagccaactctctagcccttgtgaacacgttatctctcctataaaagggaatttaagccgtcagcgggggctgctctcttaaaactgaatttactgtaagtcagctggctggctagtctcaggtgcatacccaaatgcagctttattggaaattgaggacttcatcttttctcctcttaactcaaaggttcaatagtaaccaaatctagcagtgttgtccatatggaactggttttggagacatgaaaggtgaaagaaagaaagaaagaaagaaagaaagaaagaaagaaagaaagaaagaaagaaagaaagaaagaaagaaagaaaggaaggaaggaaggaaggaaggaaggaaggaaggaaggaaggaaggaaaagaaagaaagaaagaaagaaagaaagaaagaaagaaagaaagaaagaaagaaagaaaggggctggtgagatggctcagttggtaagagcactgactgctcttctgaaggtcctgagttcaaatcccagcaaccatatggtggctcacaaccatccgtaatgagatctgatgccatcttctggtgcgcctgaagacagctacagtatacttacatataataagtaaatcttaaaaaaagaaaaagaaaaagaaaagaaagaaagaaaaaaggagaggattttacattctttctctacagactgaatcactaaggtcaagccatgtgtgattaggttggagtccttgagagggcactgaatgaagtccagatggtgttaggcctatgttaagatggaagtaccaagatgctggggctgccagggctcttagacatctgccaagcagggctacatacaaggatacaagcagcccaagagaaacatttgtgttttggagggcaaagctggagcggcagagcatttaagctcttgggaactgaagacacagatacttgacatggagctacaagatttgatgtttgtcctgcggggtttcagactagctttgacccaatctctcctcactatgttcccattccttccttttgcaatgggaatgcatattttgtgcctttttatatttaaactatgtaatttgcttttttgttttttgtttttttatttttttattttactcgagtcacaggtaagaggttgccttgagtttcagaagagactttggacttttgaagtgttaaactcttaaaagactatggggacttttgaagttggactacatagttttgcatcatgagatggccatgaacttatgtggtccagaggccagctgtggaggtgagtaagaagtgtcccctgcaagctcatgtagtcgagcatttgttccacagacgggggtactgttcggggaaggcatagaactcttagcagatagaaccttgccgaagaagggggcaggttttgagcgtttatagccttgccttacttcctgcatgttctccctgcttcctgcatacagattttaaaatgtgatcagccagctccctcccgctacttacctgctgtcctatccccacacgggctgtcttatctctctgagataaatgaaacttactggtcctcaaggcaaatctattttatcacagtaacatgaaagtaaagaatacatcccctaagccagatacacaagtaaactaatacatgtaacgtccaaagaaaagtccttttctccaaattcaggtggcaagacaaaagccagcattcctcaggaactcgtgaagctggttcccctctaggaaagagccatttcccttacctctggcagaagggacatatgggaacctgtgatgtttattagtaccagagagcatgctgtccgccatgctctctcagtatcccaagtatccagctcttctctcaccgcctctcctaccataaaccttctccagctcaggagctcccctcccccagctgctcatttccccctccaaccctgctgtttcagtgaggtgttctctttagtccctctctctgggttgtctcttattcctctctttttcttcacctttcccctccccaggtccagcctgctggccatggtcagcctgctactttctttctctctctgctcccgactcttcctgatgcctctggctagtctctctcacatctacaacgaaaaccttctgcttaaccatatcatggagcagtcatgttgtcagcttatacaataaacatctgctgtattatgggctggaatgataactcagtgattaagagcacttgctgctcttgcagggagccaaggtttgaatctcagcacccacactggacagttcatacccacctaaagctgcagttccaggagatccaatgccaccttctagtctccctgggcactgaatgcatatggcatacataaatatacttaggcacaccacagtacacataatttttttggagacaagttatttttatgtagctctgactgtcctggaactcactgtggagaccaggctggccttgaactcaagagatctgcctgtctctgtctcctgagtgctggaattaaaggcatgcaccaccatgcccagcttgtgtataaataaaacaacaaaaatgcgatacattgggatgatttagaacctcagaatacataagaattccaagcatagggaaaaatcaacacagactcagctagaaatgttactttattttaaaacatatacagaataataaatattattgtaaaacttaagagccttttttatctacataaggcaattataacatgctatgactacttctatgaaggaaaatataagcaagtcttagacactgatagatatgtgtgtactaactggaaacatctcccccactacatttatgtgaaaaagcttttacagaaccatcatttggcattctttttaatttgttgctctcattatattcatttcatgaggaagtaataattatccttttaaaaagcaaaaccaggattacaactgaaatgccacacctttaaactttcataaagtgcaaaattactgatgaaatgcaaggcattgtgacaaaagaagccttcgggatgtgtcaaggggactctttggcgttagtgtttctggagttcctgacatctgcctggcatcagataactgagtatcatcaggactaaggtaccctggtaagctggaagttcagcttgtctcatgagaaattcaatgccacagaactgatgggacacataggctccacatacagcacacaacccaagcagaccacaaaggaactcatcatttcatcataatttggtcttcccattatttttgaagtccatgttttatttcctcctccaacaaaatatgtaaacccttaaaacaaaaattaaagtcttatggaatcatgcaaactttatacccagggttctcctcacttgcttggtgttcagggctacatgctctatagcacggtgttgatcagactccaacatttgcaagcttcccgagcagttctgagcatggggctcccacctgccctttccagagagtaagtgaaggtactctcagtttagaatcaattttgtaggaccttcctacaactttcgaggtagaaaaaccgaggcacagaaaggttaaaaaaatccacacatatatccacaaatcaggagaaaattaggggaaaaaaataagaattggaattggaaagatggctcggtgcttaaaagcacagggtgctttgcagagggctcaggttgagttcccagggcccacatggtggagcacaacctgaagatgctccagtttcaagggatcttctgccctctcctggccttggtagatactgcatgcaggtggtacacatacatgcagaaaaaaagcccatataacatgaaataaatataaaattttaaaaacaaacaaacaaacaaaaaataaatacttcctgtctccatgggcctataactatacttttaaattactttgggtacatttgaaagagatgtttatttacatggtcatttttttctatatatcaatttgtaatagatatcttttgatacaacagttgttacttttaaaaatattcttttgctgcatttaattgcatatgagaaatgtgtatgataaaaagtgagtagtggtattgggctgaatgctcattactatttctataactcttaattttcttgcatggataatatagtatacagatcttgccagatgcgaaaaatcacctatgagcgaaattacagactcttaaaattcaccagtgacaactatcacgtgtaagtgagaaatataaaaaaaattatgtggtaaactggctgatggtgtgactagtgagccaagtagccttttgccaactcaaattaacagaatctagcagtgactataagtaaaacatagggaaaatgtggctatgtccttagaaactctgtgctaaggagctgatagtacagttttggtccctgagaaggcttaacaccaagattctctccagccctgcttaacagactaacaagctcctttgtgtcagtcacactgagaatacttccttagatctaattcataccgtcatgatgccttttaaagatcacaaaaatactgaccaagacgcagtagctatccaagagaggagcactgctctgctaggcaagtctggaataaaagtatcactgctaatgaaaattatgaatatgcaggaggcccagtgtaatgacatatgcttgtaatctcagccctggagaggttgaggaaacacagttcaaggccaccctgggacacacaacaagacccttttaaggggatgaagagagaaaaaatatgcagcgggcaatagttgacgctcactaacacttgtttcaacaggccgtctgtttttctacacctaaaagtcacgacatgtgagtacctgacagaagcctagcgacaagcttctaagcattcagcagagcaccgaccacgaactggaccgttaggaacaaaggaagaggatcggtgactgcaggtttgagcatggttctagctaagtactcacgagcaggctagggatctagctcgagggaaaaactcttgcctagcatggataatgcccacgtctgaatttcctggtagcacaaaaagggagaggaaaacagatgtgagactcaatgagagggaaagatcaatatattactcctatgattatttaggaaatttttaaaaagcagaaaaatggcttaaacggtagaaacgaaatcttatagttggacagagggagcagtgaaatatgttttattgatattttcatagaaccaactatagtgatagtctcagtgatcacaatgagacagttcctctccaaaggttccagtgtaggcgtttatgtcttcctcctctagaacacacacagcctttgtgcagaccagaaaaatgttccatatggagctgggctccagtagttatccctacctgattttatacttgatcagtacttacaacaggaaaaagccttttcaaacggaaagatatgtataagcaagggcactgtccaaaaggaagaggagagtgatggcttaaatgtcttccaagagtaattctctaagttgttccaaaattttttattttaatgattttaaagattgggggggtgaagtacatagtaggcatgttttcttaagttttatcagaaagaaaaccccaaactatatgataatgaaaatgtttcttataaactcacttttcgagagaccagtgagagattcttttgcattctagattctccccaccccagagctctgacttgggaaattatattttcttttgcatttccaagtgaattgtgaaaaactggatttgtataatagtaagtatacatccatgtgcactacattaaatttgaaaattaggccccattcatgatcgttacttggaagttaattgtggtaacttgctcttccagaacaaaagcatgaagcctactggagcaatctgctaaccagatgatcacctgggtgatccggctgttccagaaccttaggagaactactcatactatacaatctcgctttacacgtgaaatgatagcctttggatattcatggtatattgtagactgaaacttcagatatatcaacaggtgcacttaaactaactccatgggacgtagcaaaaatgaacaaggtaatttccacattataaattaattcactgtactattatagctatattcttacctcagaaactttcgtattaaaattatacagatcctgctgcataacactttccacttatgttctgttcaataaattaagttttatattactaaagatactagtgattaaaaaaaaaattcaagagctgggcagtggtggtgcatgcctttaatcccagcacttgggaggcagaggcaggcggatttctgagtttgaggccagcctagtctacagagtgagttacaggacagccagggttacacagagaaaccctgtctcgaaaaaccaaaaaagaaaaaaaatttcaaaagctgacacaaagaagaatgagctcgaacgtttactaactactgatttatgcaaggttttcaattgtttaaatcactgtgttgctgttcttcccaaattactgactgatacacaagatcattattcatgttttcactttattgagtctgacaaatggccagaaaacagattcctttatgctaaactactattttactctttttttcccctacagttcagagaactattatttgggtcttttgggggatgggctgagacaggatttctctgtatagtcctggctgtcctggaacttgctctgtaaaccaggctggtctcaaactcagacattttaatcctttggggattaaaagcatatgccaccaacatccggctataatttggatctttactttaaaaatgccccttctacctggaaaagcacatttttgtcttagtggggagtttaattgggtattattaaaattcatgttctccttcacctaacttatttattcaaccccattctttttaacttggactattccattcagataaaacaaagcaggtagaatatacagcatcgtaataagatgctatattgtgttgccttgtatctttctccaatttagtgcacaggaaggttactatggaatagaaggaccgatcatttctgatctaaaatactgcatgactaacaactattttccatttaagaaggttgttttgttttgttgtttctctttgatgctggctatgaagcccagagccttgcatacaatcagaaggtttaggaagaggctcagtaagaaagtatagaaggttctatcatttcaaatgagaaggttacattgttttcatctttgctagaaactcccttagaaaatacacattacactttgtagaaaaagtcctaagctgtgttcctggattgaggtgcttttactttttgttttgttttgttttgttttattcgagacagggtttctttgtgtagccatggctgtcctggaactcactctgtagaccaggctggcctcgaactcagaaatccgcctgcctctgcctcccaagtgctgggattaaaggcctgtgccaccaccgcctggctgaggcactttttactaaactcttgcagtgtgtactaaagagacagtctctaatgtaacaaccttagcatcaagttcaatactttatttcttctgaatggacacaatactgcctgaaacagaaagcaggtgtttttcataatgaatccaagtaacagaggttaagtgcaaattaaatatctcttcatacttactcagttgtccttaactggatgacaatctacatctgggtcacttttcaaattgtcctctagctttagatttttgctaccttccactgaccatagtatttttctaactactttacgtatctgtaattagaacagttaacaatgtacacaataatagttaaattaagttaaaataattcaaatgataaaggcactaaaactgatgtgagctatcggacagtcgccctgtcgatggaactctgcgtcattgtcattaactcctctctctctgcttacctcggctttgggggtacatgtaggagagcctggttgttaaaggactaaaaacaactcgattcacataccgcttatttgagtaaaatacctgaatgctagacatgcttaacacaagcacaaagtcactcacgtttactgtagagagccagatttcacttccttttccaaggtactctaagaatctgctcccctacacagactaactagaaagactcatccttatcttctggtaaatcatgttaaaatgttttaaacaatcaatgaatgaaagcttctaggttaatggaaatgaaaacagaatttgtctcatcagagagagtttacacccaaccaaccatcgggagctctgtgctgcagaggtctggacctcaccctggtgcaaagcctattgtccactggattattagttcacaggcaatgctcaccgagagtctcttctacgtgacatgtagtaagaaccacagaccccctccaatgcctgttcctcaaacccccaccccttggttgcatcttagtctgttttcatattggatttgttcatctctccaaggttgaagttgaattctttgaacacttgtatgaggacaattcccacggagacagttgtaaatccacaggccatgcccaagaagtccaccaggcccacattgctccactcccggaagaggatggctgaagccagtaggaccagcgtggtaaacacaacgtagtagatggccccaaatacagaggagtcgaagcactccagggccttgttgatgtacctgaattggacaatgatgctgcagcccaggacagccaggagcaccaggcacaggcagagggctctctgactggatggattgttgtgcaagatgtcttgggctgccagcccaatgcccttggtggaaggcacagtgaaactccccagcaaggagcagatgctgatgtagaccatgatgttggtgggcccgtgggctggtgcgatccagaagatcaacagcagcagcatgagcagcacgatgcacaggtagcccacaaacactgcaagacagatggcacacagtgaccagggaggccatccccccaaacaccatcaagaggtcagagctgaaccagggcccgatccctttccagccaccccttcaaccagggggagagagacctaagggaggacaggtaaccaaccactcaatagctctaacttaagtttattaacactcactaagtccattccacaaaaaaagatgagacggttatgtagcttagtggtagagcacttgcccaacatactcaaggccctgggtttgatcccaagcgtggtaaaacagaaaatgtatagctccaagctactgcagccacaagggtaatgttaggccagaagaactgttgccttcccaggaatgtccatgcctaggaatctttgccttgagttctttaccattaaagacctcattataattctgcctctggttggatacaaccctaaccaggctacaactacccaatgcccctccaaatggaaggaaacatgctctaatgaaaaaaaaaaaatccatccccaggactcccaggaccaagcctggagtagctgaagaaactgtgaccacctccatcgacaggaagcccttcatagctcccaacagagctgtgaaatgctgccctaaagtgtcataactactaatatttatatgacctactccattagtatcattaaaaacaacaacaaaaacaggtttacaaacctgagatcaaacagacaaacaaaatccaacaacaacaacaacaacaaaacaaagtggcagttggagagatggctaagaggttaagagcactggccagtggcacttccagaggttctgagcttaacgcccagcaaccacatggtggctcacaaccatctgtaatgggctcaatctgattccctcttctggtgggtctgaaggcagctaccctgtattcatgtacacaaaatacataaataaatggttttttttttaaacaacaaa

SEQ ID NO: 145 - DNA, 77297 bp, Mus musculus
attctccatgaagttctgagctgcgagagcccagcaacgccctgaacccaggcagcctgtgagtaactgcacagccaggaagccaggaagggctgcattgaagaggtactggctagggacaaagtggctgaaaaccactgactactgagtcttgactgcagggggccaccgcgtcgcggctcccgcactgaagctctgggtctggggatctgaaaaccgcctcgggaactgttcctccccgcccgccagggttgtacgcccaggtgccaatggttctgggcaaccgagctcagcgcgggtagtggctgaccatgggagaggccaagctctcagcctgtccaaagtgcaaggccgggctattcccggacgtgcggaggcgcgggggcgggtggcacctcccggactgtcccagagtccccggcgcgctaggcgcacctacttgtgcgcaccagagagcagcgcttaccatggaacatggtctgcgggaggtgggtgtagtcatgatgactgggactgcagcaggagccggctctcaccacccataatcactcccaggaccccggtcatccaccgggtggccgcaaaccggtgctgggcagggcagttcaggcagctgactcctctcacccacgccacgcctggtccatccatcccaagaggggccgcatgcatcaccggccacccaggcgctctggctttgccataacttccgtaggatctgccggcagactaagcagggtactttcagtttctactttgcgctgggtcttcaggttcaatgtttgggtttataccctcagcgtcttccccagtcacctggaccaggatcagtggttgctgcgaattgaaagtagctcaggagaagccagctggccttctggatcagaaagattcggctaataggcttttcaaatgacttctaacctctctggcaactctgtgagactgggagctaaaaccgctggttactaatatgtccacagaagccacaaatgtgcagcagagaaagctcgctattgcaagtcagttccactgaggaggcgtcgctgcttctgctgccgccgatgtaagtcatcttaaaaaaaaaaaaaaaaaaaaggaagtgaaggatgattaagagggtcacgccctctgcccctctaggttctctagtttgttttttttttttttttcctccctgtcatctgtgcaatgcacctgctcaggtaggactttaagaacaaataattcttgtgagtccatccagtctagtatgtaagtggtagcttcagaaaaccaaaactcgtattagttgggggcacatagaagttctgcatagtaactatctcccacagttatctcctgacatagctaatcaccattgtgattgtttcattaaagtgttttgttttgttttaataataggcctgaattaccgaggggattcctgatttagtgttgtttcttataatcaggagaaacactgcttaggtgaaggcaggttgtgcaaaccagtaacaagagagatctgagatcaggaccatatctctcatatatctagtatttgctctatgccaggactcttggtcaggaatttacatgtattttggcatctggagttttctgccgaggcaatctgttttcttatctgcagttgaaagatacacatgggaacagaggcttccttaagtaacagagctaagttcacgtggctgaatttggataaaaaacacctgcaggctggcttcaaagagtctgcttggaatctcttgtggaagagaaccttgtaaataatggaggatacagtagactaagaagacgccctagggtggtgggtgtgctcttaacgctctggggaacctcagaaaggggtctggagctggcggttcctaatcggacatcaggacacgagcttcagattctgtctgttaacagtgaaaagaggcagagaggtactgtttgtgcatttagagtgtggaccataggagttctaactgggcactggcctgtggactctgcagggactctcactttccacattcaatgtaaaacctgttgtcttagtgcacttccaaaataaatcctacccggtgcctgcagggctgtttaaacacctctctgttgtctctcttgttgtcatcctgctcaaagcatcaggagatttgacagtacttgttatcttcactgcagccctggtctccagacagctcccatccacagagaagggctatctagaataggattaggctccagcgttgcagtatgacaggatggaagagagctactgtggtgagaaagcatttcaacgatggaacatggaaaaatgtccaccaaaaaaaaaaaaaaaaaaaaaaaaaaaaggaaagagaggaaagagaaagaaaacagggaattgctggcaaatgaaatcaggaaactgagcctctcaggcacacatttccaaaaatgtcattggaactcagatgtggagaaaagcagtagacagagatgaggctgcaggggtggttaaagactaactctataaacatgtctaggtttgtggcggctgtattaaactccctgaccatagggtacacgtaggtgtacaactgctcacattctatgcttttttccccccacctgttgttgggcttttcagaggagagtcaaagaacatccatcaaaagagtgcgagaggggaagtctgtcttccttcctagtacaatcaccagaaaggcttgtgcataggcaacattggagtaaaatgaggcgaaagtatctaaagttccaggaaaggagaagtaaatgtattttacaggactctgaccctcagtgttaagaatgtcttctgaaaagaatatttagaaagcatttggaatttcaaaggttagataaaaatggacacctttgaactacattgtattatgagagaattctaagaaaattagtgtccttttgaaaaaaacagcccagctctttaaatcagctattgctttttaaatacaaattgaacatacagattgacaggggtggatatttcatgaatttttagaatgttgataattaaataaatgaaataatatgtgaggcctggtacctgtaaccctagctgctcaaccagaggcagggagaattaaaagttcagttcctgatttgtttaatgagtgaaaccatgtctttaaaagtaacaaaataaaacaggactggtgacatagctcaaaggctgggagcttgcttaattttcatgaaccccctagattccatctccagtatcataaaaaagaagccagaagtggaggaggaggaggaggaggaggaagaggaggaggaggaggaggagcaatagtggtagtggtactggtagtagtggtagcagtaatagtaggaagaggggagggaggtgagggaggaagaggaggagaggaaggggtaggggatgaggaagaagagaaggggaggggtgatagaggaagaggagaaagggggaggaggacgaaaaagtgaagaaataattacaaaattattaacactgtataacaagaaatactgaaatacattataggatgctgacttagggcagaaaaatttttaataataagcaatgtttcttaagtttccacactttacaactattagtcaatatagttaattatttctctctctgttgtgcaggcctgctttgaactggcactctctattaaaacctcttggctatggaggcactatgcatataccaacatccatgatgaaaacttactttcttgattaattatctatactcattttacctgattaaatataacaattatctgtctgcctgtctgtcaatgcactatgagatctaaattctagtgtgctatattttctaaagttcctatccttctagacaaaaatatcaaaataggaaatacacacacacacacacacacacacacagacacacaaacactgtagatatgttaggtgtatagttgtctgggttctgtggtttgagagatccattcttggtctactcttatggacaggaacattttaaattacatttggacaaaggaactcttcactttgccttgagcttcacaaattcagttgctgaattaactatgcgtgttcacgatgggtagcaatccatgcttttaaggtgattgtatattgaaggggaaatgggtgtgccgtttaaaaattcagtgtgttgagaaggaaataatgaggcactattttaaccagagagtaaagggagtttaagcccattttattgtgagtgtacaagaagatcagtccactcttacagtaagaacataatttcctagcatataattctaaatcagatatggttcaagtatttgcacaaaatgaaatttgaacattactaattggcaatctagcatttatttgtgtgtcgtttttcttgttgcctttctaaataaaacataaattgacaatgatattatgtttaaattgcttctctccagattggaatttatcattttgctgtaactaggatatgtttgttattcatatcacatgtaaatgagatccaggcaattttgtcaggttttgctaataacacaaaagaaactgagaaccatgttcctaaacccctgtaaaaaatgtttcataaaactatttatttttgtggaagatatgtggaaattcaataataaaacacaattagtctcatggaatgaagtccagggcagggtgctttgaccactatgttactcagaaagaattttttttttttctgacaatacaattagcgattagcagctctgctgttgagatgtaaatgtagcatatcatggatggctatagccacggaaaataatgaagttatggaaaataatgaaatttaaatgctaaaagaatgaagaggtaatgcatgtggagagagatctttagacacaagcctcacagactagacagagaagcaaagtctgtgtccaccaacaaagccaatataatgacagacaagtaggagactcagcaccccaggaacatcagcgttttcaaaatccacaaagcctgaaaaggaaacgaactgaagctcatactcccttggattgcttagtcctgaagacaaccatacagagagatatctacagaataggtatctgtggggcatgaactgaggcaatgaagttgaggcaaaatttcagagatgtttggtagtgatgaaaggagcggtcccaagtttcacgagcatatcatggacaatggaagttttcaattctgagaaggatttaagcatatttaaaaatataatgacaaaattcggttcccaaatagcaggaagaatgaaatcaagaatctaaaatgacctgctatttttcttatattctcttcaggtcaatttcagtcttttataattctcaacaataggaatctattatgtatcaataatttttgactctttgaattattccctgcacactcacttttacactgctggcatcgcttggtccagtgttgctctgttaccttttagaaaacacagctatggagcaatacgtttgctttacttggttcttttgtgtgctatatgtctggcagtcgggacttctgaaatatatactagagttgggaatggactatgctttaaatttctgctgttatagtcagagaaattgtttctacaacaaactttcaataaaaaaggttttgaaaaaaactgagaactttctgcttaaatgtcttggtagcttccctttgtgttatccaattactatttgaagacacccagttgttttgtcttggataacagtaactgttccagtcagcctagaatgtgatgtagtcaaagattgccttctgagtcacagactatatcctgctatgtcctgtggaagaattcttcagcatgaacaagtcttgacttgcattgatcatagagaatcagagctcctaataaagctatgccaatatccaagaatgctacaatcccaactaccgacaggcaattaaatgcctaagtttctgataacatgctcagttcttacatctagcagaaattttaagttttcctaatatggaagactccctaatttaaataattttattgtcacattagagggttactttgtttttcttctccttcaagtaaaccaggtttatcctagcatattttattactttagattcttggagtaattgtaaattcttacataggatgtggaatgattaggtatattataataattgcattaataatgtagtcgagagggatattgtacctccatgttcttagatatgactgttacaccatggtatgtatcaattaccaggcatcccaactgccatgaaagtaataacatgcatgtgcgcacacacacacacacacacacacacacacacacacacacacacacacactggaatctcaaaaggcagaaatattaagtgattgaggtttttgtgacagacaatgatttttggagagaataatgggatgtgacatggtgctggaatattgcatcctatgaaaagaagttgtttactttgatttcctttgtgtctttgatcaattagcagttctcttgatatttagaagttttctaagcatgtctctctcttttgtaatctcttcctcccacccttcctccccctgcccagtgtgtgtgtgtgatttgcccctatgttatctggtgaaactttcattctcagaaaactttaaacttccatttaacgctgcagagatggcccagcagctagaatccttgacaggaatgtgtaatgacctaagcagcattcaccaaacccatgagaaagctggtagtgtatgctgtgtccaacattcctgtgatgggaagggagacagagacaggagaattcctggaagtgcataggccagctaggctggcttatgtacaccaggatacaagagatcctgtctcagaaaaagtataaaacaggcactgacaactaacaacctctgacctccacattcattgtcatatacccctcctgcctcctgcatatacatgcacacactcatctaaataaaatttaaataaaataaagtgagatctctttgatggtaattctaaactatacaagattattaaatttctgaagcaaattttatggaattgagggctttaccaaaatcaaatattttgttggcttcctatttgatctctgtaagcttttcgatacccatcctttattgtatttacatgaccatgtggcctaaaatgagaccaaaacaatgaaaaacaatattattgtgcacatggttttactggctattcaagcatagtcctacagccaagaactacagatatttgcaggcagtgactgttattttctaaaacctaatgcaaccaaaccaagcaaagagaaacagcacaatagaggattgtcaagaactttaaaaaaaactaagtttaaaaagttcttagaatatagaaagcagctattagtctggtcacattcttagtttttgtttttgttttttctttttttttttttttttttttttttgctgtgatttcaagctgggcaggagctatattgttctttcataaccttaatattgctggggtcttaacccaaaagctctcatcttgttggcctgaattagacttgatgcaactcttttctttttttaaaaaataggatttttggtgaattttaaaccaccagagacaaaatttatgaccaacctgttcttcaaagcaaacttctttggtggcttttttctggccatttcacttctttaagcatagctaattcaatacagcatatcagcaaatggaattaactggaaccctgcttccctatgaattaaaaggaagctcaagcagtacatatttctgaaggacactgttcccaagagtgtctcccacacacttgtgtcgctgtgtgtctcacacttccactgaggtgcaccagcaagtctctctgcacttgacagtggtggtagtacatagcaataaagtccaactggcaaagacacacaacagtgatgtttgccttccatttgcctgcggaattccttgacaactatagtgattttatcacgctaagtgtattatgatgatacaagggaatttagccatcctgagttttatttatgagcatcatatctctgcttggaaatcgtcaagattaacctatcattctgcttctcctttgtggccattctttgagttcagaacagttaaccaaatagcactatgtaccatgcaatattctacatactcaactacatcaacatataattatcaatataaatcctacttaatcatattctttaaggattatatattgcaacaaaatttaaccacagagtcaatacagatgctatcttttaatttatagattaagtaaatttaaagaacaaaaaagtaaaaaatgctcagtaaaatttctatgtatgccccatggctaaattacactatttaagatgtgaaactttaactaccttggttgtgatgataatttgtccatatataggtatcctgtatgtatgtatatattaacccaaagaaaatcacatgatgcatagttgtttcacagtctcctgtgttcagctaccaattgccacgtttctatgttattttctttccttatttgaaagaatccagatagtggaagtgaatcgaaagacattcatcacattgcacttcagtttcctgtagggttcagtattagaggcttatgttgtatatgacatgacttaggtcaatatgtcttcacacttcatttccatgaaatgattctttttaattttttgtctgaaaataatgactttcagtatccaaatcacatatattatataacacacaatgacttacttttacatttgttgcttatgcagttcttatagattgtaaatacaaatatttttccaaacaaaagcttcaaagctattgtttaacatctatttaaattgtgcttaacatttatttattatttcttatatcattctccaaaggacaaatgtaatatgaaatgctatattctaaagtgagctaaataataacctttccagtaacggttatttgatcaaacacatggttgaactaatttctctcaatgatacttaaaattagttacacagaaatacaggggacagaagttttgtgtggaaaatttttcccattttacaatttttggcctaattagtaaatattttttctccatacttgagtataaatatctttctgtgtactagctatataatttgtaaattcctaataattttactgctaaaatgacattacaggttagttttagttttgatgcaatattacaaattctctttgagtatgcttccctacatgattttacatgacatgaacaacacatgtgaaaaaaccttctcagagaactctcaagctaaacacaagtatatacaagtatgcacggctgctgagctagctctccacatcctggccttcctagtgtgtactctaaattcaatcgttgcccaggatctaaacctggaaaaaataaaggtaaccactgcggcctactgatagcaaccgctcgatggtaaccatgctctctcaccactgcagctgcccctgatagaatttattatagctctctgaatatagagcttttaacgaagatgttaagacactgttgtccctctttccagggcgtccagtttcccagccatgtcacacgacacaaaggatgcttcatgatttatgtcctctcatgacacataggtgccaaatcttcatatgcagtccttttagccagcatgtcccgtccatttatccttaaaattatggttaagttttttttcttggatatatggcaacccatatgaaacaagtcatttttcctttccaatacttatcagctatactctgttttgacagttttccagattgtaatatactggagacctagacctttattttggtagtgatacaagttgaatgtttgtcttgcattaggtatttgatgcatatcttttgactagttccatggtattggctgctgcacaattaggttttcacagttttcaaaataagacacccatcttgtttgtggttaaatactcagcgggtactcatttgattgagcatcgcatatcacattagaggtgggtacatacattcattagaatgaagctactgtacatgaatgaagctatgtggagcatctcacccctcaggaacttaaaatgcaaatgaactccacctttaaatcacattgaatttgtgatttatcagaaccaaaagtattaactaacatataaaattatgactaaaacatattctaactttaagagatagttccttccatgggtttaatagatattttttttaactgggaaggataataatgctacaagattttctcttaaaaattgtgtgcaggtaaacttaaatcaacgtatgtgtgtgtgtgtgtgtgtctgtgtaagttgtatgatctaataatagaaagataattaatcatgaaagaacattcatatgtttcctttaaagattattatgaacttgaatgtattcatttgagttgtaatgttagctttgctcatttgatgttcctactgattctaaagaatacaaaagacatatcctgttgaggcaagctatctagaaagcattccagagttttattccagggtggcctggttttatttggaacactgacttatggaagctatttagtttcaacaatgtttatggtgactcctagtagtttctaggtggccctgtaaatacaaaatccagttttgcaagtgtcttggcagatagaaggttgtattgcaaaaactgcatctataaaacatgttttataaactattttcacagttcttttgatagtggttttgaggttcatgttggaaattataaataaaaataatctcaaaaataaaaataataataatttaaattgtggatgagaagttgataattttcaagctacagtaattgattaatagatataagttccaattaatctgtttatattctctccatattgtccaatgtactttaaatattttgaaaatatctcatgtcacacatatttcattcagccatccggtcagggtattatgagcacaggaaaagacttttctaaaactggcaatttatattgtgacagacacacactgaatgaagagtaggatgagtctctgtgcatattagccattaatataaatactaaaattatcttgccatgctgtgggttaattctttatgagtttccttcaaaattccatcataaatgtttgcacctattaaattactcagtaatccattcctcagaatgtttcttgaggatcaaagatggctttgtgaatgaaggtgcttgctggcaaatttgacaacccaaattcaatccttgtgactcctataagcagattgtcctctgacctacacatacatgtcactcatggcacacacatacatataagtaaatacaatacaaacttaaattaaatttaatatataaatataagtaaatgaaataaaattaaaatcaagtatttttttttaaatttctcataaggtgggtttcagaatttcagtatattattttttaaatgcttgtgatttgataatgggcttgatgcttgaaaaataataaaacagatttaataattctctaaaatatagtgagtccttcttggagaattcacaagtccaaatgagcccagcagccaggtaggtgggatgaagtgtggatccagcctgctggggactgtgtattcacagagctcatggctggactgaggcagggtggttgcaaactgacgttactaggctttgtagtcttacaggttaggctgagggtttgcacagtttacggaatttcccagagtttaaatgatgcctctatttttctgactttataataattcccttccctaatgctttcaatctgtgtaagccctactcagacccttcaaaaattaaaattcctttaccccaaagatctttttgactaatttatatatagtttaatgcaaagaataagtgcagtggaaaatatcatgggctcttcctgcacacacagtttcccttgtgatactctgacatgcttctccctccatatcatttgtctgcatttaacatatcacaaatttacttgattattttcttttcttgctactacaatataacagcatgagactttttagtttccaatgatatagcctcaatttctagaatatttatgggcaaagaataagctcttgacatttagtcatacaaatcggtgttccacagataaacaactatagagagaaactggctgaataattacacatatttaaccttgacaagaaaaagcataataataatggaatctagtgtattagtttgtttgttttgtctataagaaatgcttatgtgcatatctccttaattttgttctcagaaatatcctattttttaaagccagccatagtgtgatttattccacctcctcaaatcaggaaatgacacaaatatcccatcacttgtaagctcagacctagacatgagaggtgttagaaattgaccaaaggaagaaacctgtagtatttgaaatagcttatcccacaaagagtattcagtccacattagactttccttttctgaaataatgtattgtaaatgcttataggcatttattttgttttgtaatcatgactgtttttgaacctacagctcagtatgttttaacagccatttcttcttcaatttcattctgtattacaatgctctgttacagtctatctgatgtctacccatgagatggtagactctcccattgtatcccccaagtctctgaccctctttaccatattttccacttgtttttttttttttttcttttcatgcttcacactactgtcttctaatgtttctgttattaatttgtttacttttagcgtgtatatgtacatgtgtgtgcatttttattgaccaagcattcattttataaatgcaaagtccatttgtggcaagtcatgaagtatttgtggatgtaattctctttgtttaatttcttgtgccttttggttaccctgtggtctgatagtgattataaccacaatgtgttctggatatgtattttaaacttagtttgtaaaaaataattggagttctagtgtgataactagcttcctttggaggggtagttcatttcctttgcctaagtaactcatgatatttctggttagggaccatcttaacctgcgatttttggctttatacttcacaaaccatccacttttgaaactaagctaaaattctaaggaaggattggttcactttgttataacttactatgaagagacaaaatttagtctctcaggttaaaacagtgaatgtttggagtattctttttttcacagcacccagactttgactctagcgttatggccccataatatccaaaagtattgagttcatcttcagagacatttttttgtgttgggcttagttgcctgagttcttgttttctctgataattctgtttttaattgcttagaggtactttcatgaatttccctttatttcacttattcttcctcacaagtttgttatgaattcctagtgttacaccaagacatgctgatttctattttgggaagttccttaaaatctttttatcctttccccacttgtttgcaatgtgtttttgattatagacttttatgttgacaatattttcccttaagttttcttaaggcattatctgtagttttctagtacacagtcaatattatagagatgtccatttcacagcaggatttgaaggaggaagaacaagagaacacagggcatagtgaaactgaggctcagggtatatcttatatgtcttactggacaaaggaatacaaaacacaagtctaagttcaacttggtggagaataaactcagactaggagtaaagaagtatatacaatttccatgactgttcacgctgaaggatgttttgttattcttatttcagaagaaactgagatatagagatggcaaacaatacattaaaggatgttgactaaagaaaagactgcttacctccctgtgtgaattcaggttgtgctctgaactcctacttacacgttcccagtgagcgtgctggtcaggtagaagaaggtaaaaatagcaacaggggcttgaagcaattataaaaggagaaaggggagaggctggggtggaaagaaagagagagagaatcaaagaaagaaaaaattattctgcaaagttgatactgatagtctctttgtaaaatcagacaagagtgacatgtagcttgtcgatatttgaaagagaggagatatgctgtcaaagatgcttggcttataggaggctgcagctataagaacccatctcatcacagttactggaagacataaacagtatagaatagaatagaatagaatagaatagaatagaatagaatagaatagaatagaatagaatgaaataagttactgctcaagtggagaccatcatgatggtttgttgtaaaactggagaaagtgcttttgcaagttgtagaaactataaaattaacttttaaaatttgtcgttggtgaattaagttgggttgtgtagggaagttgctgtgggcatatatcatggtcagtttttggaagagtggcttcagatcacttcaaatttcctaacgaagtaggaaatcccagcagagagtgacatcaggaagatggggatgggtcagaattagcaggagagagaggggggagggagggagagagggagggagagagggagggagggagggagagagggagggagagagagaggaggagagagagagagaggaggagagagagagaggaggagagggagggagggagggagggagagagagaggaggagagagagagaggagagagagagagagagagagagagagagagagagagagagaggcagttctgagaactgccatcctggagcatgggtaaactgatcatcatgcacaaggaatgttgagtgggtataaaggcgtctttctagcaatgtcacctccaacctactcatccctctagggctagtgaaaaccacattaggtctgaggtcctgactgcctgctccctgcctctgcttctgaagcctccagcagttactactcccttcaccagttaaactcccctcattatactttggtttgttctgcactatctttttctataaatgtttgcacttcataaatttgttcatcattgcatcaataattaatagtgatggtgaagccatgttcagcaaagctcaaatttgtttaatttgtttaaacaaagctaaactttgtttaaaaacaaatctacttgtttctgcaccaaatttgtagattagggttatagaaaaatgattataaattagtgtaactttttcattgatgaagtaatgtctcaaccatgaaaccttttattcagaaatgttttatgaaggaataatagtgtgggtgtttatggacatgatgtgaaagtcccttttgtagtttctgttcgtatatggacagaaaggaaaaccaaagacttgagcggggatggggtggaggagcgattctgccattttaaagtccatcaacttagcaaaaatactttatatttgtgccaggactttctgtgtcacataagaatgatgcatacaagaattttccagccaaggtagatggagtctggatatgtccactggcgtatatatgtccaggcttagagtattacaatgagttagaagaatgctttttttcaatgccctaaataaaaataattttgatttcttttataccatcttggtcaagttttgctttaggtgtacactaactttatgagatatcttcccccttttctctctgctcaatgacatgagctctcctttgaagtctgcactttcctctgacattgtggtgttaaatgatggctttgcctaggctttcttttgttgttaatttgctgtgcaacagtttgattcttgaaacacgtattttaaaatattttcaaatgtataaacagagaaaaggaagatagcttatgtcaagacattaactcatagagaatttgaagaagaaagtaattctctaagtaatagtttttatctcatagatttataattctctcaacactgtggcttttatttaattttttcttccattccatgaagaacataccttttcatagaatatgctaaggttgatttgtatgttgtgatttctgccgtactttaatgaactgttcctcatagaataaagacagtgaaataacccattttattcctttagtaggataaataggttgtctatggttctctttttggtttcttgatttgactgcagtcctcaaaattaaatataaattcagttatgctgtacctggggaatgtatggaagggatgtggccatgacaatctctatttttgcctctttctgccctgtatgtgattgtgagatagaaaatgtaggatatttaagttttaatgtgttgtgtgagttctagaatgagtaagttggcaggctatgcagtgattgtttgtcctggattgatcctgggttatttgcctatgtaaactagtgaggtaaaaacccaagcagaacaaatgccccgagactagggactagatgctattcatgtggtgacctgagttttctccttctgcaagttgcacaatcgagttgtatatgtttatgaaattttctcaccctagaccatgataatacctttgccactgtcaagtcagagaatatctttaaagaaacatggatctatgtgtgttgacacaaactcctaacactgagtcagtaggatccacacacaatcctgggacaaactggactacacagagagccctaattttatccacaaaatgaaacctgtctcagaagagaaagggagagagaaaaagaggaagagagacaaaagagggaggaagagagagacacagagagaagaggagcacaaaagggggaaaggaaggaggaaggaaagaagggataagacctagagtgaaacccatcaatctactttatagtattaaaatgtattaacaatgatgttaaaaagagtaggtctattcaacagacactgacaacaatgctcaagagtgcaaaggagagtctgtccagattttcagtttacatagcctggggcagagatagtccatggcaaagatccatctttctcaaggttgccattctactctgttctctagtgacccacctattttgagacttgaaagaccttgcttctcttcattggtacctagatattttcagaaaaggagattgcgcatctcttaatacttttttcacaatgtctctacttactataattgataactcatgccaaaatttgcaatctattgttggcagcatttactagttttagaactagacagcatttctgtctccattgcaattcttctggatttttatctatgatacatgtcttagtttctgagaagacacactagacggttttcacaagaagtccctgattttttctctttcacataatgagcaaaacatctgtgggcacttgatgtctgaatgacaaggtggctctcttctcatgaggaatttcccatgagaagtaagttccccagaccatattcatgtcaagattatttactcaaggatatttagcaccattgtctcacaatagagtattatatttttacaagacagtcataatgtgctacatatcatcagccattttgaacccagcatgtttagtgttatctataaagtattacaggtgaaaaataagttgttagatagaacagactctgggtgacactgatgtcacagcatcattttacttctgtaggtaaaacaggtaagaggaatgaataggccttctgcacataagctaaccttgcaaagctagtcatgaaagcaatctcccccttccggctcatttgctctctcttccttagcaaacacttctaccttgaatgcgatattgaagaatttgcttgattcatcacttcccatatgtgaggatcagcaaacggaaataacacatttaactagtagtttagagggaatagtaatatgatagcacggatacactaaggtgcttggattgctggcactatcctttaatcccagaacttgggaagcagaagcagacagctctctgagtttgatgccagcttggtgtacacagtgtattccaggctagtcaggtctacatagtgagaatatgtctcataacaaaacaaaacagcataaaaaatgcatttaaggtatcatgttaaaatgtcatacattgtcatacaatggaattggtagatcagcagttttgaaggataatcttgtcacccatggatgcactgagaaatatggtattatatttcctaatatttaaaatttgaagacttttacaaagatttattattgttattgatgagtgtgtatgtgtgcattcacgcatgtgagtgcttatgtgaaccacaagcatgcatattgccaaagaagccagaatagggtgtcagattccatggcctctgcaggagctgaagttttgaatgacctcttatagttctcagtgtttaaacattaactactaattcaatagtgttgagaggtgaactcttaacgaggtgatcaggccatgaggctctgtactcatgaacagattcatttcatcattacaagaggaggtttgtcatcgtgaggtcaggttctctaggacagagtatagtcagctcttttggttactggaaagtacactctatggctgtattcaattatgtccatcacagaatgggggaagaggggataagtgatggcattagccagaggaccagggtgtcttccgctagacattgtcttgtagtcatgacagagaaactgtacccatggactctcaacaacatggccacctgagcaagatcggcataatggctgtactggtctacagtgtcaacatgctcaggtaaaatttcacaattttccagcatacctagatggggaaatacaaacaatcaatggcttcatctaagacaaagaaaatcagtcttttggatggttttcctgataagctatccaatttcaagtggtcagccataggtgcaagtacataatgagctcattagtatctctctgtgtgtatgtgtgtatgcatgtatatgactgtgtgtgcttttgtgtgtatgtgtgtaataataataattagaaaatgtcataagtttgagatgttaaaggatacatgggagaaattagaggtggagggattgaaatgatatgtgaaatgattagcaaaataattttttaaaaatagaaaaggtctatatttacaaaatgtcatattaaaggaaattctgacaatgtcttagacaaagaggacagccatagggaaaggctaaatttccttagaaattatgtaatgttgagagaaatatgcacaatgacacctattctaatgtcatcatccagaaatggggagcaggtattggaaatttccgtaaaagccactgtctttataaagtagcaaagaacttggctgaatcattcccatgtgtgaaggctttgtggaaggaagtgcttaagaccagtgacctggaacaattagtggaagacatttctaagtggaatagtcaaaaacccatagccttcttgtaagtgatttaaactgaaagagaagacaaaaacttaggtattttataattagataatttataattatataattgataattaaaaggaaacaaggatgaagggtgatgttgtatgcagttcagagatcttcaaggctgccttaaactgtcagagccccaatgatctagaagggcaaaattactctggaatccatgcctcagtgcagtctgtggacttgctctctggtgtcatggcctcaggactctgctatctacagtcttacacagttcttggctattttagctgtacctcagtatgccttagggtcatcttgggtaatgggtctagaggacacttttagtgctaaaacctgaaagggatccagtggtgccaatttagcaaccatgcaggacagtagccctgcggggaatgacttctggcacctacatctagaaggaattcaacagcagtctggagactcaggcacagacttgttgcaggagaaggcatagagctcatagtttataggatatttttctcacatttggtttcaatggctttgttttatgctttgttttgtatttggggaatggacttggagttacatccttgagcatacacatttcacctagggctttggagttgagcctgatgagattgtgctaaagcatgagtcagaatcaggtgtaaagacactgacattgctgtcaatactgactcagtagaagaccaacacaggccaatagaaataactgacatattacagctcattccttgttctgaagttacgaataccaagcaatactatccatgctcctccaggtgggtccttgatggtcctggagagacatgccttgaggtaggactcatttgtaaggtctgcaagagactgacaagctacatgtgttctctggagtcagacacatggaactggagtccagaaagccttcaagttctaatggacaaccactaattctgtaaaactcggtaagatagagggtaggaatcagccttttttaattttttatttttttaattgcaaatgatcatgacctgtataaagagaaggcaatctagagcttgggctagtggtatatcctccctggcatcattacgtgaatacatgatgctagcatacagtaatcctggcagggccctaaagaaaacaagaccagattcagttaaatactgatatttcacttgattacatgaatctctccacagcacatattggggtagagaaaaatatggcagaaatacaccatttggcttatactctcatcacagactaaaactcagaggttgcagattaaaaccaccaatgaaatgaatcactagagtcttaggtggccaggctgatatttggtagccttatctcttgattatttttttttttgccaccattactcctgctccattaatctgggtattaaagaatgagaggaatggtgaggtctcctccactgcaaagctgggcaacaaaggcagggtagggttggggacatgagaagaaaaatagatgtttggagagaagtcaatccacagatgtctgcgacagtatgtgtgtgtgttcatgcctgtgtgtgtatgccaggaacaggtttactaagtacttgtgagcctcctgaatgagtaatggcaaccagacccaggtcccctgtacgaagaacaagtgctcttaaccactgagacatctctccagcttgggtaaaggcaactggacccaggtcttctgcacgaagagcaagtgctcttaaccactgagacatctctccagcttgggtatattttatgcttcttagacgaatagtatatgcagacagaatagatatctagttgcaggtatcaataggtcattatacacacatgaaagaacgtacaattgtataattggaatatatatatatgtgtgtgtgtatatatatatatatatatactaataattgatatatgtacatagtgtataaatgtcataacatctgtatcaatgcatacacatttatagtgcatatgttagaaaaatacagaaaactgagatacaaagtgaataaataaataaattaacggataaaaaaaaatgaaagaacacagaggtactcctgtcttttaagagatccattcatagatattgtattatgaagttttaccccaaatatgctctgctaaatatcaatccctgagtatttttggcagagagaacaagaaataagaattttattgtgaaatgtgcttgtgactatataaaacagacttactctggttgctttccctttacttcctttttttttttttccttctcatcttccacccatgtctaatctgaatcatgtcttaaagctgatcagagactgcattttcctctcttgggaaatggctctaaaattgtcttgtggaaacatataggaggtcaaaaatacgaagataacttcttggagggttcattcatgttatctgatggctgcgtccttaaagcttggcaactttcagtatctcaccccagattatgaaataaatagctcaataattacttgtgaagacttttatcacaacactcacttaatagctaggggaacatactaaagaaaaaagaacccagtttacatgacttgattattgggacaagctccacttttctgtttgtctttaaaatagccctggctattttaaagacataagcagacacctttgtataaatatgcatgatgggagaattcaggataattgtattttcttttcacaatatggtaatttctgagaatactcaaattctgaaagtttatcctagaaatctgagattagtttgaatctagtttctagttagaaatttattttagtttgcttaagaaagaaaatgttcccttttgaaagattgtagttattaatgtatagcaataaaaattgatttcgatgaagaacagaggaaatacatgtgttcattttcttcatggtgtccctgaattaatctagtgaatgaacaggatctttgaagaatttggtgagtgctgggaagaagtactagactccatactggtgaagaatttctgaaaataagatccactgtcttagaaaatctgctttgaggacactgtctcttctagtatgccccaaagggagacaactgtggagatagaaaccctaggaaagaaatcaggaagcatagatgggaggatcagcaacagaatacaagagatggaagagagaatctcaggtgcagaagattccacagatagcatggacacaacaatcaaagaaaatgcaaaatgcataaaggtcctaaccaaaaccatccattctcctgccacaaaataatcaaaacaacaaatgcactaaataaagatagaatattaaaagcagtaagggaaaaaggtcaagtaacatataaaggcaggcctatcagaattacaccatatttttcaccagagactctgaaagccagaagagtctggacagatgttatacaaaccctaagagaatacaaatgacagctcaggctactatacccagcaaaactctcaattaccatacgtggaacaaccaaagtattccatgacaaaactaaattcatataatatctttccatgaatccagcccttcaaagaataataaagggaaaacaccaacacaaggatgatgccctagaaaaagcaagaaagtaatccttcaacaaaactgaaagaagacagccacagaacaaaataccaactctaacaacaaaaaataacaggaagcaacaattacatttccttaatatctcttaatatcagtggactcaattcccaaataaaaagacatagactaacacactgcatatataaacaggacccaactttttgctgcttatttgaaacccacctcagggaaaaagacagacacaccctaagacaaaaaggcgggaaaacaattttccaagcaaatggtacgaagaaacaagctggaatagccattctaatatcgaataaaattgacttcctacccttctgtaaggcaaaagacactgtcaatatgacaaaaagatatgggcacaggggaaaaattcctgaacagagcagcaatgctttgtactgaaagatcgataattgataaatgggacctcataaacttgcaaagtttctgtaaggcaaaagacactgtcaataagacaaaaaggccaccaacagattgggaaaggatctttcccaatcctaaatcagataggggactaatatccaatatatagaaagaactcaagaaggtggactccagaaaatcaaataacccaattaaaaaatggggtgcagagctaaacaaagaattctcacctgaggaataccaaatggctgagaagcacgttaaaaaatgttcaacatccttaatcatcagcgaaataaatgcaaatcaaaacaaccctgagattccacctcacaccagtcaaaatggctaagataaaaaattcaggtgacagcagatgctggcatggatgtggagaaagagaaacactcctctattgctggtggaattgcaagctggtacaaccactctggaaatcagtctggcagttcctcagaaaattggacatagtactaccggaagattcagcaattcttctgaacatatacccagaagatattccaacttgtaataagaacacatgctccactatgttcatagcagccttatttataatagtaagaatctggaaagaacccagatgtccctcaacaaaggaatggatacagaaaatgtggtacatttacacaatggagtacttctcagcaattaaaaacaatgaattcatgaaattcttaggcaaatggatgcatctggaggatatcatcctgagtgaggtaacccaatcacaaaagaacacacatgacatgcactcactgaaaactgtgtattagcccagaaacttagaatatctaagatacaatttgcaaaacacatgtaacacaagaatagtgaagaccaaagtgtggctactttgctccttcttagaatggggaacaaaatacccatggaaggaggtatacagacaaagttcagagctgagagagaagaaacgaccatcaagaaaccattccacccaggggatccatcccatatacaaccaccaaaaccagacactacttgtcagcatatgccagcaagattttgttgacaggacactgatatagctgtttcttgtgaggctatgccagggcctggcaaatacagatgtggatgctcatagtcatctattggatggaatacagggcccctaatgaaggagctagagaaagcacccaagtagctaaaggggtctgcaaccctataggaggaacaacagtatgatctaactagtatcccccagagctgtgcctctagttgcatatgaggcagaggatggcctagttggcctccgtgggaggagaggcccttggccttgggaagatcatatgccccagtacagggaatgacagggccaggaagcaggtgtgggtgggttggggagcaaggtggagggagtgtacaggttgctttggggatttcatttgaaatgtaaatgaagaaaatatctaataaaaaaagtgaaaaaatagaaaaaaagaatgaaaaagacatagtccatcacattgctgtggtaaggagcaagttctgagaatgaaccaaagccgcactttttttaaaaaaagaatttttattaggtattttcttccgttacatctccaatgctatcacaaaagtccccaatacccttccccccactcccctacccaccgactcccactttttggccctggcgttcccctatactgaggcatataaagtttgcatgaccaatggtcctctctttgcattgatagcctactaggccatcttctgttacatatgcagctagagacacgagctctggggatactggttagttcataatgttccacctatagggttgcagatccctttagctccttgggtactttctctagctcctcctttaggggccctttgatccatccaatagctgactgtgagtatccacttctgtgtttgctaggccccagcatagtctcacaagagacagctatatctgggtcctttcagcaaaattttgctagtgtatgcaatggtgtcagtgtttggaggctgattatgggttggatcccgggatatggcattctctagatggtccatccttttgtctcagctccaaattttgtctctgtaactccttccattggtattttgttcccaattctaagaagggtcaaaatatccacactttggtcttcattcttcttgagtttcatgtgcttcacaaattgtatcttatatcttgggtattctaagtttctgggctaatatccactaatcagtgagtacatatcatatcagttcttttgtgattgggttacctcgcaaaggatgatgccctccaggtccaaccatttgcctagaaatttcataaattcattctttttaatagctgagtagtactctattgagtaaatgtaccatttactgtatcattcctctgttgaggggcatctgggttctttccagcttctggctattataaataaggctgctatgaaaatagtggagcatgtgtctttcttactggttggaacatcttctggatatatgcccaggagaggtattgcaggatcctccagtagtactatgtccagtttttttgaggaactgccagactgatttccagagtggttgtacaagcttgcaatcccaccaacaatggaggagttttcctttttctccacatccttgccagcatctacagtcacctgaatttttgatcttagccattctgactggtgtgaggtggaatctcagggttgttttgatttgcatttccctgatgattaaggatgctgaacattttttcatgtgcttctcagccattcagtattcttcgggtgagaattctttgtttagctctgagccccatttattaatggggttatttgattttctggagtccaccttcttgagttctttctatatattggatattagtccctgatctgatttaggataggtaaagatcctatcccaatctgttggtggtctttttgtcttattgacagtgtcttttgcaattttatgaggtcccatttgtcaattctagatcttacagcacaagccattgctgttctattcaggaatatttctcctgtgcccatatcttcgaggctttttcccactttctcctctataagtttcactgcctctggttttatgtggagttccttgatccacttagatttgacctcagtacaaggagatagaaatggatcaattcgcattcttctacatgataaccaccagttgtgccagcaccaattgttgaaaatgctgtcctttttttttttttttatttcactcaatggttttagctcccttgtcaaagatcaagtgaccataggtgtgtgggttcatttcagggtcttcaattctattccattggtctacttttctgtcactataccagtgcatgcagttcttatcaaaattgctctgtagtacagcattaggtcaggcatggtgattccaccagaggttcttttattattgagaagagtttttgttttcctaggttttttttattccacatgaatttgcaaattgccctttctaattcgttgaagaattaagttggaattttaatggtgattgtattgaatctgtagattgcttttggcaagtagccatttttactatattgatcctgccaatccatgggcttgggagatctttccatcttctgagatcttctatttctattgtgatggctgttgttttcctaatttctttctcagcccttttattctttgcatagagaaaggctattgaattgcttgagttaattttatattcagctacatcattgaagctgtttatcaggcttaggaattctctggtggaatttttagggtcacttgtatatactatcatatcatctgcaaaaagtgatattttgacttcctcctttccaatctgtatccccttgatctcctttagttcttgaattgctctggctaggacttcaagtacaatgttgaagaggtagggagaaagtgggcagccttatatagtccctgattttagtgggatttcttacagcgtctcaccatttactttgatgttggctactggtttgctgtagattgcttttatcatgtttaggtatgggccttgaattcctgatctttccaagacttttatcatgaatgggtgttggattttgtcaaatgctttttcagcatctaaggagatgattatgtggtttttgtccttgagtttgtttatataatggattacgttgatggatttcagtatattaaaccatccctgcatccctggaataaaacctacttggtcaggatggatgattgttttaatgtgttcttggattcggttagtgagaattttattgagcatttttgcatccatattcataagggaatttggttctctatctttgttggatctttctgtggtttaggtatcagagtaattgtggcttcatagaatgaattgggtagagtaccttctgcttctattttgtggaatagtttgtgcagaaatggaattaggtcttctttgaaggtctgatagaactctgcactaaacccatctggtcctgggcttttttttttggttgggagactattaatgactgcttctatttctttaggggatatgggactgtttagatcattaatttgatgctgatttaactttggtacctggtatgtgtctagaaatttgtccatttcatccaggttttccagttttgttgagtatagccttttgaagaaggatctgatggtgttttggatttcttcaggatctgttgttatgtctcccttttcatttctgattttgttaatcaggatgctgtcctagtgccctctattgagtatggctaagggtttatctattttgttgattttctcaaagagccagctcctcttttgttgaatctttgaatatttcttcttatttccacttggttgattttggccctgagtttgattatttcctgccatctactcctcttaggtgaatttgcttccttttgttctagagcttttaggtgtgttgtcaagctgctagtgtgtgctctctctagtttctttttggaggcactcagagctatgaatttccctcttagaaatgctttcattgtttcccataagtttgggtatgttgtggcttcattttcattaaactctaaaaagtctttaatttctttctttattcgttccttgaccaagatatcatcgagaagagtgttgttcagtttccacgtgaatgttggctttccattatttatgttgttattgaagatcagccttagtccatggtgatctgataggatacatgggagaatttcaatatttttgtatctgttgaggcctgtttgtgaccaattatatggtcaatgtaccatataattatgtatatatcatggtaccataaggtgttgagaagaaggtatatccttttgttttaggataaaatgttatgtagatatctgttaaatccatttgtttcataccttctgttagtttcactgtgttcctgtttagtttctgtttccatgatctgttcattgatgaaagtggtgtgtagaagtctcacactattattgtgtgaggtgcaatgtgtgctttgagctttctaaagtttctttaatgaatgtgcaatttggtgcatttggtgcaattcagaattgagagttcctcttggaggattttaccttttatgagtatgaagtgtccctctttgtcttttttgataactttgggttggaagtcgattttattcgatattagaatggctactccagattgtttcttcagaccatttgcttggaaaattgttttccagcctttcatcctgaggtagtgtctgtctttttccctgagatgggtttcctgtaagcagcaaaatgttggctcctttttgtgtagccagtctgttagtctatgtctttttattggggaattgagtccattgatattaagagatattaaggaaaagtaattgttgctttctattatttttgttgttagtgttgacattctgttcttgtggctgtcttcgttttgtttgttgaaggattactttcttgcattttctagggcgtggtttccctccctgtattgtttttttttttttttttttttttctgttattatcctttgaagggctggattcgtggaaagataatgtgtgaatttggttctgtcttggaatactttggtttctccatctatggtaattgaggctttggctgggtataatagcctgggctagcatttgtgttctcttactgtctgtataacatctgttcaggatcttctggctttcctagtctctggtgaaaagtctggtgtaattctgataggcctgcctttatatgtcacttgaccttttccccttactgcttttaatattctatcttttttagtgcatttgttgttctgattgttatgtgtagggaggaatttcttttctggtacagtctatttggagttctgtaggcttcttgtatgttcatgggcatctctttctttaggtttgggaagtttccttctatcattttgttgaagatatttactggctctttaagttgaaaatcctcattctcatctactcctattatctgtaggtttggtcttctcattgtgtcctggatttcctggatgttttgagttaggatctttttgcattttgcattttctttgattgatgtgcctttgttctctgtggaatcttctgcacctgagatcctctcttccatctcttctattctgttgctgatgcttgcatctatggttccagatttctttcctagggtttctatttccagcgttgcctcactttgtgttttctttattgtgtctacttccctttttaggtctagtattgttttctttatttccatcacctgtttggatgtgttttcctgtttttctttaaggacttgtaactctttagcagtgttctcctgtatttctttaagtgatttattaaagtccttcttcatgacctctaccatcatcatgagatatgcttttaaatccgagtctaggttttcagatgtgctggggtgcccaggactgggtgaggtgggagtgctgtattatgatgatggtgagtggtcttggcttctgttagtaagattcttacatttgccttttgccatctggtagtctctggagattgttgttatagttgtctctggttagagcttgttcctcttgtgattctgttagcctctatcagcagactagctctctcctgagtttcagtggtcagagcactctctgcaggcaagctctcctcttgcagggaaggtgcccaggtatctggcgttcgaacatgcttcctggcagaagttgtgttctactcaccagaggtcctaagttcacatggagagtcctctagggatcttgcaggtatccgctgaccctgctcccaaggtagcccggtgctggcgcctaccagaagggacttgtgtccctggtcaggcagggttttctgcttccctaataaatgctgtctcaggtcccacacgattggattggaacagaagttgtgtgccactcaccagaggtcctaagaccccgtggagagtactctggggaccttgggggtgtctgctgactcagtgcccaaggtgatctggtgctggcgctgaccggaagccaaagccatacttttatgagaatgagtttttgttaatttaaaaaaaaaaatatatatatatatatatatatatatatatatatatatatatccccaattaaagaaaccctcatgggattctttctctttaaataaagtctatcattgctactcagtaacagaagaaatgatataaataacatacacactgtacaacatattggttacagtcatgtaaaatgtcagtctcttcattgttcttgaggccacaggttttgtcttgtttgtgagcctcagaatagttttctcaatttttttttctagaattttgtccattttaaaagtgtttttctttaactaatttatcttccttttttattttttccaggttgttttcagtcacctcctctgttaatattaatgttgagacagagttgaacaggctccatcatgtctgtctctctatggtcaacacagttgtcctcattgctatcacctcctgaaaaaaaaaagatgttcatatagtaggggaattcacttcaattgtctttattatatttaaaactgtgtatggctaatgcaaaattacattttattcaaccaccagagggagcctccaaatctatggactttccccataagaaatagtactgaagtggtgagtttataagttttatgtttcacaatttaaaacccagggcattccatttcacgctgttgggtttcaccaggggtttcatacagaaagtgcctgagatcttttcctgttatacacatcacatcatttggttaacagtttttatatagtcaactatttttgcatgattttgattgttttgtagtttgaatatttatgatatttcagatatataatttaatttttgatactcaccaatctcttccttcaagagaattttcatcccatacaccttaggtcctagctttaatttttctggaatatttttagtctacaaattgatgattcttgttcatattatttttgcaaccccaaactgagagcttaccaaatctcttcattacatattaatttacttttatatactgcttatctggccaggtcttatcatcaaatatttaagtggagtcctcgaattctagaattatgagtctttttcatagttggtgatgtcagcctaatacgtgtatgacaaatagtgtcaacatgatattctcaggtcgtttctttccatcatctaaaatttcactttctctcatagagaatcaagtgtttgaaaaactttccacaaatattatgtgcacatgatatgtgaaaggaaattatccaatgctttcctgaaggcagagctggctgtaacccataatgagagtgctagacctcccaaaaccattctttttcagttagttatcatgtccttgtagtttctggggtctctctctgccccatctccatccctcctcatatagactcatgcatgcatcatgaaactctcaccacagtagttaaggtcgcaaatatgtccactatctccaagaacttccttttgtctcctatctcttgttataagatcacttaccttagtagtccaacactagggagcggcagctttaagtgtcccaaagtttttttttttctttacacagtaatgtcatcaatcttgttttgtggctgtgaaaattgttgtgtacagaggttaaacaaattacccaaggtcacaaagcagatgagtgagatctgggaacatatccaactccaaactgcagggttgacatattatcttccattgcttcccacagctgccgtcaggccactctctccccctgcattaagtaaaagccagctattttaacttgcattcctgagttgaagtcaatggagtttaactgtaattgctagaatgttacctcggttgaaaaaactatgaataatgaatagaggtgaaatagatccatcccaagtcagtattagtgacatcacacttcttctctaaccgcttactctcctgaaactgcttacaaatgtgcaatacttccaccatgtttgcatgaagacaccacctgactctcaattttttagaacaagtatccctttgatatttgcataactgaataataattacaaagagcttgatatgtgggtaaatataggcgattttcaagtaatgaaaaatatgaagtacataatcttgctgttctgaatttttctgtaaaagcacagatggtctccaacaaatctatataatgactcagtcaatgttaatcttctagaaggcaaaagagttcatttaccttccagcttaggaacctaagaaatcataatgttctgtcagccacaagcagagtcagtaggcctcctacttcatggagatcggtccctgggccagttgtttctggtttttttcatcacagacacctgtgagcatacaagtcaggcccttcagtgtgtagcttctttgaatctcatcagctcttgtggttcctgcattacttgaccataccttcagacacagctgaaggcctagttttgtgtgtgtgtatgtgtgtgtgtgtgtgtgtgtgtgtgtgtgtgtatgtgtgtatgtgtgtgtgtgtgtgccctcaggttcatgttctgatctaatgcagacgcttgaatgctgcctcctcagcctgccacaggaggtagcccttgactaataaagaaacagtcccaaggaaatacagtttaaagatcgttacaacagttaaagggtttctccacagaacaaattttctgatattagaaaaggcctgcccaatgaataaaagcttttccacactccttacattcatatgattttaccccagcaggagtagccctatcaaacaagggggggaactcatgcttgaaggacttctccatgtaccttgcattcaaaggatcttttcattttatgaacaactttattgttattaattttgctgcaaagaggaaaagcgttttcacagtctttacattcaaatttacactgtgccagctataacattattgataaaattaagactggtcatttaggtaaaatgatgtgtgccagagctctattaaaaggtctagtttgttgtagatgtgtatctatgtggagaaactattacttccaaacatggatatgtgtagtttaatcttggttaaatataaataaaaattgaaatagactttaaatgggtagcatagtcatgttgtgtcttgtgacttgaataccataattcaaggtctgtggtgtaactgatgtagtactcagcacaaaactcaccttctttcttgacttatatcttctttgcatcatgtgaactgtgtaattgggaacagcttcattaaagatgaggccaggttgaaaaacaaaacaaaacaaaataatgaaacaaaacaacaacatcaaaaaccaaaaccataagtacaacaacaaaaagacattacaacagacttccaaccccattgcatttctaatagtgcattgcaccagtatggtttatttcacttactgaaaaataaacaactctcattaattctgaagatctatgagatcagacagcaattaagctcatggttacaagtgttttgtagaaatcaacctcttgatgtttatgtttttatacttttatttcaaatttaaaactatgaatatgtttcactcaagtgccccaggtttgcctcaatctcacaaataaataatgcattttgtagaaaaatctgtcccagtggagaaaatgcttcaagcattaattttgacttgacttggagtcagtggttttcatcttttgtgatacattttttaaagcctgagaaaaagagcataaagcatagttactcttaatgagatgagccacatgcaaaatttagaactctcaaggctgtgaggcacatgaagaagcattcttcctggtgcctgctgagcataggctagcctgtgctctcccaattccatttttagcaaaatagaagcaacctataccctgtactcatctgctacaagttaaaatttaactcctttacttaccaaactacattagttgtgctccttagttttttgtgtctcagaaaaacttactgaaaatggaagtacaatttgtaatgaggtaaatatggataatatttcttgttctgcatatttaaaatagcatgtaccatacgatttatttaaaccaaactcttttgtggcatatttttccacgaaagttcaacatttccatagtaatgattgagatttcccctcactaatctagaattcttcctaggaagcccatttctcccatgcattaataaagtgatctcttgtgagactatgccggggcctagcaaacacagaagtggatgctcacagtcagctattggatggatcacagggcccccaatggaggagctagagaaagtacccaaggagctggggggatctgcaaacctataggtggaacaacaatatgaactaaccagtaacccccagagctcgtgtctctagctgcaaatgtatcagaagacggcctagtcggccatcagtggaaagagaggcccattggtcttacaaactttatatgcctcaatataggggaaagccagggccaaaaagtgggagtgggtgggtaggggagtgggtgggggagggtgtgggggactttggggatagcattggaaatgtaactgaaataaatacctaattaaaaatgaataaataaataaataaataaagtgaatctcagtttttcttatctattgaaaggtgcccatggagcttaagttctgttatgaatgaggtgaaacaggacatgcagaatgcttagaaaaggctcttggctgcaaataatcactagaaaaatggttagtgataagggactatgtccaaatatttacataagaaaaacaaactattttgaaatttgagtggctaaataagtaaattacagaaaaagagcaatttgagggccaaattttaatcagaaattttcaatccagagtcttgaaaacaactttatccttcctgaattttataggcatatcatgggttagaataaagatcaatattttaagaataaattcattagggaatcttgtagaaactctgctaacccttacagaattgaacaaaagacaaatcacatgcttgggtttctcttgaacttgctgaagttaatgcctaatggcaaggaagttatttagcatctcaacaaggcaaagaacatcagtcattacagtactaagaatgaggatcttgtgttgagaggctagttttataagtaaagtcagtgtcaaaacagataagtcaattagtatttaaaaagaagcccacactatataatatagaagagagactatcttaattttaagcaatggagatttttctatcaggtaacttaaatgagctcaaaaatctcccatttgggccatgaagattgcttactgggtaaagacacttgctgtcatgcttgatgaactgagttctatgcacaggaagaaggaaagaagcaactccttcaagttgtcctctgacctttgcatatgtagtgcaacatacgaccctacaccccaaatgaataaatgcaaataataataataatgaatatagaacttcacaaataactttcttttagtctcaaagtccatttcttgggaaaagttgaatggaccacttaaatagtgctgttatataagggcatcactgagggttaaaaaaccaaagagctagaaaattgattgggaaatagaaatgaaatacatagttttctctacagaataaatcaaaacagaaagttttcccaggagatctgtcttgggctcaggcaaggagaattcctgagcacagtagaaatgaaaaaatgctaataaactaaggtagaactcactgacaacagcagagaaatgtcctatggataaaggtaaaagacaaggaagcatgtgtgtgttggctgttgcaaacagtgagcaaacagataacacaaacatttctgccaacaaagggtaaccacattggtttgaagttcagattacactacttgtgttgatttagcaaacaaaatatgacatgcataaaattcttcagtaaaatgaaacagaaaggagacattataaacagcgtaaaataatatgattaattctgtaagcagaaaaacagaaatgctctaaagaaggttagaagagagctaatatccaaaatatataaagaaatcaataagttagacatgaaaactcaaataactcaattaaaaagtgtggtgcagaactaaaaagagaatttctaacaaaggaagcgccaatggcaacaaaacaaaacaaaacaaacaaaaaacaagcaaacaaaaccccccaaatgtttaatgtggtttagtcatcaggaaaatgaaaatcaacatgactttgagattctaccttccagccatcagaatagctaagataaaaaactcaagggacagcagatgctggcagggttgtacaggaaggggaacgctcttccactgctggtgagagtgaaaacttgtacaatcgctctggaaatcaaactggccagtttctcagaaaaattgggaatacttctctctcaagacacagctatactgaaaaagtaaaatgtgaaaacaaaattctaggcctttaggcccaggcttgggaatgtgacctttgtgactcaatgctccaagttatgctaatcataaaagagatagagacattcctctacccatccgcttcctgggttcaaggagtattcattcaaagagagtcaccctgacccaccctgaccattgctggaacccgctatgaaaatgtactattgttaggggctcttagaaactgtcttgagaaataacccacacaattaccaggtattcctcgtgactcttgtgactttgcactttcttgtgacttgtaactggtatttttggtattttccaacaacgcccttcccacctccttgagttgtggtttcttcctttaaatacccctgacccagaaactcggggcgccacagtcctctacctctgcatggtgtatgaccgtgggcccgagagcgctcttgaataaaaatcctcttgcagtttgcagcaagactgtttcttgtcagtgattttggggtatcgcctctcctgagtcagaacgtgggggagtcctcacgttgtgggtctttcaataccactcctgggcaaatacgcaaaaaaatgctccaccttaccacaaagcatcttatgttcatagcagctttatttgtaatagccagaaactggacacaactcgtatgaccctcaactgaagaataggtatagaaaatattgttaatttacacaatggaatactactcaactattaaaatttgcaagcaaatggatgaaacttgaaaatatcatcctgagtgaggtaatccagacccaaaaggatatgcatggtatgtattcacttataagtggatattagccataaagtataggataactacgctgtaatccacagaccacaataagccaaataacaaggcccaagggaccatagttgaatctctctcagaagggaaaacaaaataggtatcagaggtgaatggaaggagggaactgctgggagagggcatgagtaggaaagtgtgtgggtcatggagtcaggtgtagggagagcagggaagacagaaagggaatttgccagggggtcagggataatctccaggatgtgccagagagcagggacagaggtgggggcacggtatctatgggggagactctagttaagattcctagtagtgagagataggatcctgaaaggtccattcctgtagccaggcaggactctcagtggagggataacaacagtaacctgtagcctccctcagccctgaagcaggctgattcagactttgacctcgctgccactgagaaggaaattacctaaggtggagccttccgacctagatggctcttttgttccgccacctgccactgctctctccaagacactgctacctgctgagaagcacctgatacattccaggaacatcctactttccatatcacctacagcctggctccagacaccaagaatgggctggcaggggatgagccttccccccttttataagcacactctcttagtaaatggaaggccttgaaccgaatcatgtcttgactccattaacttcccgccatctaagtctctttcaccccagcctgcctccctggtgtacccggtccttgtaagccgcaggtcggcatacaacagtaacccacccacaaaactttccactccaaagtatgccctgcctccaagtcatgcagggacaaaggtagagcagagactaagggaatgaccaacaaatgactggcccaacctgagaaccaaactgtgggtaagcaccagttcctgaaactataaatgatattgttatgcttgcagacaggagtctaacataaactgtcctctgagagactccacccagcagacaatgggaagagatgctgagatccactgccaaactttagatggaactcagcaagtcttatggaagagttagggaaatgattgaactgcacagcaagaccaacagactcaactaacctggacacttggaagctcccaaacactgacctaccaaccaaagagctagggcatgttggagctaggccctatagaaatatagcagatgtacagcttgatcttcatgctagctccccaacaacggacccaacagctggagtagttggccttttcctggatctgttgcctatatgtggatcccattccctgaagtaggcagcatctgtttgacctcagtatggaaaggatacacctagtccttcagggacttgatcttttgggtgtcggggaggggagagtgatgtgatacccagagatggctcctccttctcagaggagaaggggggggatgatgggggaaggacctgaatgaggggatattgggaggagaggggctgatattgtgatggaaagtagataaataaataaacaaacattttacagaaaaagtttatggatataaatttacaatcaaaactaaagttcacaaagagattaaccatggtaaatgagaaagattgtggtatagattataccagaaattagtatattcagtacagataatgaatatctaaaatcaaaggagcatgtaatcaaaatgtatcaaatgtatgtgatcatgcttctcaaagacaaaaattaagacgatgaagagaaattactcagagttgaagtttaagattttttttatagttgattaaaagcatggatccttgtctctgagattcatgaattatccttatacagataaaattgaaaatgaaatcgatgctttaatacatcttggttttgcaacataatacctaaagaaaagagatatttagaaagccatagagacatgaattgacacaccaataaaatcagcagaatatgtttatagtgaggagtgaaaaataacctggtgttttcaccactcttcataagggaatacaaatatcccaagttcatgtaacaaatgtggaacagatatatataattggaaataattttttttcctacacagaatacaaaatacaataaaatgaagaaaaaaaggactttgtgtatgaatactcaagtgaatataagcaagaatatggatccatgattataatgaacatataaaatggtgtttatattttgaaataaacaaactgctgagatgtggaattctacacagcagaggtgtgaagtgtggaatgggactcagacacaaaatgtgcaaaagcagggaaagaaagcaatttctaacttggcattttaatattaaaagttttagggtagctgtgattgtttgtatatccttggaccagggagtggcaccatctaaaggtgcggccttgttgcaataggtgtgaccttgttggaatgggtgtgtcattgtgggtgtgggtataagatcctcaccctagttgcctggaagtcagtcttccactagcagcctttggatgaagacatagaactctcagctcctcctgtgccatgcctgcctggatactgccatgctcccaacttgatgataatggactgaacctctgaaactgtaagccagccccaattaaatgttgttttttataagacatgcattggtcatggtgtctgttcatagcagtaaaaccctaactaatacagaagtcatatatagaaacatataaattatatgaatactttttaaaagtataggataaggaaataaaatgagaaaaaaatgtagacaacatcatgatttgcctttagaacattgtgtttttttaattaggtattttcctcatttacatttccaatgctatcccaaaagtcccccctaccctccccccaacccctacccacccactcccactttttggccctggcattcccctgtactggggcatataaagtttgcaagtctaatgggcctctctttccagtgatggccgactaggccatcttttgatacatatgcagctagagtcaagagctctggggtactggttagttcaaaatgttgttccacctatagggttgcagttccctttagctccttgggtactttctctagctcctccattgggggccctgtgatccattcaatagctgactgtgagcatccacttctgtgtttgctaggccctggcatagtctcacaagagacagctatatctgggtcctttcagcaaaatcttgctagtgtgtgcaatggtgtcaacgtttggaggctgattatgggatggatccctggatatggcagtctctagatggtctatccttttgtctcagctccaaactttgtccccttccatgggagttttgttcccaattctaagaaggggcaaagtgtccacactttggtcttcattcttcttgagtttcatgtgttttgcaaattgtaacttatatcttggttattctaagtttctgggctaatatccacttagtgagtacatatcatttgagttcttttgtgattgggttagctcactcaggataatgccctccaggtccaatcatttgcctaggaatttcataaattcattctttttaatagctgagtagtactccattgtgtaaatgtaccacattttttgtatccattcctctgtcgaggagcatctgggttctttccagcttctggctattataaataaggctgctatgaacatagtggagcatgtttctttcttactagttggaacatcttctgaatatatgcccaggagaggtattgcgggatcctccggtagtaccatgtccaattttctgagaaaccaccagagaaattcccagagtggttgtacaagcttgcaatcccaccaacagtggaggagtgttcttctttctccacatcctcgccagcatctgctgtcccctgaatttttgatcttagccattctgaatggtgtgagatggaatctcagggttgttttgattttcatttccctgatgattaaggatgctgaacttattttcaggtgtttctcagccattcggtattcttcaagtgagaattctttgtttagctctgagccccatttttcaatggggttatttgattttctggagtcaaccttcttgagttctttttatatatattggatattagtcctctctctgatttaggataggtaaagatcctttcccaatctgttggtggcctttttatcttattgacggtgtcttttgccttacagaagctttgcagtttcatgaggtcacatttatcaaggaaatggaatcataatttaagacacatagcaagcagaaaataaaagggcagaaagttccaactgaatcaataatcagagcgaatagcatgtatatgtatattataacagtagtaaatataaatttgtcatttttcacaattaaaaataagtaacatattgagaaagcatcagctatatgcaatataaggtcaacaatttatggattaaaaaggatgacaaagaaaaatttcctgaacagatattaactagaataaacctcataaatgtgatctaataaaaaggtaaggcaaataaataaaaataaaagggactattacttaaagactaagtgcccacttaatcaaatgaccatacatcctttggctattgtctcatgtgcagttagcattttattggccttgtttatttttgcttgtgtagttggtcttcttagtaattgaagaagttatgctttacttctagtattaattatatatattaaagccttataaatattttgtcctggatatttttgtttgcccttttaaatgtttatattattgttaaggattggtgcagagttttttttttttttttttctggatggaaatgaggaccacattagtcatggcatagtattcctgagcaggttagcatacctcccatctaaagttgagtgcaatgaagtgttcagtgaaagaacagcactcttttaagtgtttccaagattgagtgagtgctgtgtttgactcttatgactacaaagattccaaagccactgaggtagtagctccttaatacaaggaaggggttcagatagaaaatgagatttcatatctcgggtatactaagtttctgggataatatccactaatcagtgagtatatatcatttgagttcttttgtgattgtgttacctcactcaggatgatgccctccaggtccaaccatttgcctaggaatttcataaattcattccttttaatagctgagtagtactccattgtgtaaatgtaccacattttttgtatccattcctctgttgagggacatctgggttctttccagcttctggctattataaataagggtgctaagatacaatttgcaaaacacatgaaactgaagaagaacgaagaccaacgatgacaccattgcatacactagcaagattttgctgaaaggaccttgatatagctgtctcttatgagactaggctggggcctagcaaacacagaagtggatgctcacagtcagctattggatggatcacagggcccccaatgcaggaggtagagaaaatacccaaggagctaaagggatctgcaaccctataggtggaacaacattttgaattaaccagtaccccggagctcttgactccagctgcgtatgtatcaaaagatggcctagtcggccatcactggaaagagaggtccattggacacgaaaactttatatgccccagtacaggggaatgccagggccaggaagtgggagttggtggttaggggagtggggggggggggggtatgggggacttttgggacagcattggaaatgtaattgaggaaaatacataataaaaaaaagacaaaaaaaaaaaaaagaaaatgagatctcaaatctttagacgttgaagaaacatttgaatatgcagaaaatgactatgataaatgtcaagctgccagccccttattttttgaaggtctctggcaatgtctccaaatgagcagaaacaaaacttatttatattgattgcagaaggtaaattcacactatcctgtgtgaatggaaaaatatccattaggaagggctgggaccctgatcttcaaagtaatagagtttgggagggtatagacagttgttagtgaacttctgaatgactccacatcaattagaaggtgcagtttgtcctttccatgtcagaggagcccagcttatggaagactccttagcaacatttcctggtataattgccttataagatgactattcataagatttataccaaacataataatcattgtcaattttcaggatattctagaaagatatatgtgaaaggactagaaatgaatgaaattctactccaaaatgaacttttaaagtgtatgaacttttagagcaaatgcattgattctagtgaacctatcagaagtgttgaatatgatgtgctactttgatagaaagaaatgacacacacaagaacacttgttccttggttggtggctttgcttgtgaagttatggaagttttaggaggtgactcctgctggaggaagtatgctttcatgtgcaagcactgaattacttttactatttaattttatgtgtatgggtgtttaggctgcctgtgtatttatgtatcctgtttgtgtcttgtgcctgcaaaagtttgaagagggtcttagatccctaggaacaggaatttaaaatggtagtgtactaccatgtgggtgccaggaattgaacctgcatcctagagatgagtagccagtgtgtttaactgctgagctatttctccagcacctcactaaagggtgaaggtggtgaactttgagatttctgagcttgcaacttccttacctctgccctgatgtctgcataggaaggcatgatttctcagtttcttgctcctgcagacatatttgtcacttgcttctgcaccttcccttcctcagaaaacatgcctaagtaaacactttattttagaacataattgaaaaacaaccaataccaacaggtactcacatcctaaaaatatttagattccaacaaacagctgtcagtggaagaggccatcactaattgggccttcccaattatattacaagataatgcaatatttatttgccagaaactagctggaaacatttggtactctgtttattagggtggaagcttcagttcactgggatttttatttgggctaattaatctcatgtacattatgttaaagtcaactttcacattagaaaagaatttcttgatctacataacatgaagattttcaagctgtgtgtgagaaccgtatttaagaattcctgggccagagagatgagtccgtcttcaagagaacatgcttgttcttccagagtaccaagtttgttcccagtgcccatatcaggaagctcatagttgcctgtaatctttcttttcaggttactgtagggactcatactcacagacacatactcactactcctctcaccacacatacaatatgtcttaataaaagaatatttcctcataattatacacacacacacacacatatatatgtatatatatatatatatatatatatatatatatatatatatatacatatatataatatttgggtgttttgactgcatacatgtctgtgagccacatgcaggcattgcacagaggccctaagagtctctcagttgccataagactggagttacagcctcttgtgaacacccatgtgggtgttgggaattgactacttgtcaagcaccccctcttctctgattcctggctgcgacaactcattccccacttaccatgatacccctcatatccaaatcaatgaagccatatgatcatggaattacagaggatatttgattaataattatagtagcagcatctattttgtatgtcatatgtgaatgttcatgtacaactctacaatatacagtagagaattatgcacaaacaaaaatgaatatacttgaatctttgattttagaatggatagagttaggatttaaacaaaaatattatagctcagattttatcttctagagaactctctgctctttgtagatatatgttaataatagcttacaaagaacaataagaatgttgggaatcaccacaagtaactaacattgtcatataatagatgcatatttccatcaaggagagattttacaattgtttgaagaatggtcatcatcgaaagtattttgtatataaggtgaatgctatgaaaaatgtcactcctgtgacctagtatgtgtatggtttttgagcttattaaaatcttctgccttgagatcttgtcttcaactattatcccagtattctagatatcatcacatacatctacactgtggtttctacacctaaggctctggggaatggcagaataaggggcacaatgatcattagagctggaagacaagggaatctgttgtaaaataagcacccaacaatagaattgcctgaacaagatccatactgcaacactaccatttgactgccaatatggatgggaggaaatcacacaatgttctccatttagatgaagagacaatgtctgcagagagggagattaatttcctacagggacaagctcccaaatggcctttctatcacaggtgtctaactctgcatacaggtacgtgtaagtaatacaaaatggacttgtgtgtattatcaggattctctaaagtataaaagctaaaagatattaaaggagatttattagactgacccataggatataatctgtgtagtccagcaatggctataccacaagggaagggaaaaaatctagtagttattcaaatcatgagactggatgtttctggagtcccagtctggtgctggagtctaggaagattcctcaactgctgctgcttttcagtctccattggaatcctgaaaaacggatataacagggtaaatgaacttgctactgagagtgggggaaagcaggaaaagaaaaagcttcctttatccacatgcttttatttgggctgcgactagaagatgtggtccagactaaggtccatcacaaataatcctaagacaatctttctaattacctttataggtaccacttaccaaagttaaaccataaacaaataaacaatttaagcagatttatataaccctggtgaactagaagctgtcattaaagtctcccaaccaaaaaagaaaagtaaaacaaacaaacaaatgaataaaacaaaaacaaaaccaacaaaacaaacaaatgaaccagggccagaacagaattctgttttcgcacagaattcttgcagattttcaaagaagatgtaatggcaatattcctcaaattattccacaagatagaaacagaaggaatattgccaaatgcattttatgaagccacatttaccctgatatgcaaaccacataaacacccatcaaatagaattacagatcaatttctctcatgaaaaactattcaataaaatacttgcaaactaactccaagaatacatccaaaagatcatccatcattatcaagtgggcgtcatctcagagatgcaaaaattattcaatacacaaaagtaaacacccgcaatccacatataaacaaaatgaaagaaagagtcacatgatcatctcattaggtacagaaaaggcctctgacaaagtccaacacacttttaagataaaattcctggagagatgaaagataaaagaaaaaatattgcaacataataaagcttgtttgcagcaattccatatcaagttaaatggggagacactcaaggcaattctactaaaaccagggacaacaggttgctcactctctccatatctatttaatagagtatttgaagttttaactagagcaataaaacaactgaacaagatcaaggagacacaaaatggagagaaatcatcatatccttatttgcagacgataagatactatatatgtgacactaaaagttctgtcatggaactcctacaattgataaacactttcatcaagtggctgaatacaaaattaactaaaaaaacaaacacaaaacagtagccctcctatatacattgacaagtagattgagaaaaaataatcagggaaataacactttgtagtagccacaaataatatctttgtgtaactctaaccaagcaagttaaaaatattatatgattaaaacttcaaatcatttaaaaattgaaaaatatatcagaaaatggaaagtctcacatgctcacaatctgtaggattaccaaagaaatattgccattctgccaaatgcaatttagaaattcaatccccatcaaaattccaatacaattcttcataggtcttaaaggaaaatcttagttttatacagaaaaacaacaacaacaaataagatagattagcttaaaagcaatcctaaacaataaaagaacttcttaccattcctgatttcaagttgcattcattataaaggtataataataaaaacatcatggtattggcataaaaacagacaagttcatcaatagaatcaaattgaagtttcacacataaattctaattttttataacgaggccagaaatatacaatagcggaaaagaaagtatcttcaacaaatgatgctggtcaaactggaagtctgcatgtaggagattgcaaataaatccataggtatcaccctgcacaaagctcaagtccaagtggatttaaataccttaccataaaagaagatacaatgaatcactgggaaatagccttgaactagtggcagagaagaaattttcctgagcagatcactgatagcataggcactaagtttaacaattaatggaaactcatgaaactgaaaagtttcttaagataacactaggacaaaacagcagcctgcaaaacgagaacatatttttaccacccaatgtctgatttaacttaaggcccactccacaaaatgaacgcatacccgatactgcttgagtcactaagaactagatataagtatggaggacacctggagaacaaggatccctaaatcaacggagcttatatgaagtcgtggtgactgaagcagcaaaaatagtgtagacatgagtttgcaccagggtttgctacatatatattatagcttttaggttactatttctataggactcttgattgtgcacatgagtgagcctctgattcttgtgacgtctgttcggactcttttcattatgttaggttgccttgtccaattttgctgcgataatttttgttttgtcttgttttgttttgttatatttgattttatctcttagaaaactgttcttttctaatgagagacattaagggagggaatccagatggaaagggaggtggggaggaactgtgaggaatagaaggaggggaaactggtatcaggaaagaaaagaatgtatgtatgagaaaatcatctatttttaataaaaggttaaaaaggaaggaaggaaggagggaaggaaggaaggaaggaaggaaggaaggaaggaaggaaggaaggaaggaaggaaggaaggaaggaaggaaagaaataagatagaaataagaaaatctctcaagctttagttgattgcaggtgtagtcatgttgatagctacaattagccatctataaaattgggaaagggtgaggtcacttggaggggagaagtgtgtaggactgatgcagatgcatcactcagggatgaagttctccgaaagaaaattgttaagcaaataaattaataacacaatctgcaggagattgaaaaaatgggatgagataggttttctcctcttcatcttctattttatattctgaacacccagcaatattgaacaaaatgaatttatttatttaatcttaaattaaatattggatgtcgtatggggaaatctgtcttccattctgatataggaaatggaataccttgaagcatgccctcttccttatgatcactgtaggcagattaatggtccacggagtagtatcatgggtatttaaggtgtacctgagaatttatgttatgaattgcttcaatgaaatgaatattagtgtaaaaatcaaattcaaacactaaattttagttcctttaaagtaacaattcttttacattcttcaaattatgtttttattaaaatatggtgatgtggtcatccaggttcactcagatcaaatatttgtggtcaatgccttttcttccatataattaatgaaaaataaattggaaattaatagttaattatcctatctcttaatatgttggttttattatctgtttcagttcttgttgtctaaatctcttaaacttaaagctaccttccctgagatgtgagaatacccttacacaataataaaatgaaatgtggctttcatttggtagatggcagtattacccgtcagccgaacggttgtatatcgctgctgctgatagaatgacgtgctggtgctgaagagggagcatcctgccaggaaacagaggagcagacccgttaattccccagcagacacgaaaagtgaagctcctaaacaaaggtaagcaaagacgtgtgtgtgtggagacaggggaatgggctccaagcacagcagagcatagttacacatcagttaagagaagtgctgtaaagtaattaaaattgatatagcttggcattcagtataagtaaacttcagagatctcatctcatcatgcttatcattagaaaaataaggaaactaagaagctaaatggctttgtaaaaacagtgttgccacagaccgagctgtgtcgggccccctcaatccgtgggaaattagtagtcccagcaggtgagcatggagttgacaaggaaagggtgacaaacagacacagacacaaggtagtgctgtatctggatgtactttttttccaagcaaacaccaggcttttaatacagaagaaaaacaagaaggctaggcgaatacatgtgtcaaggtacactggttcttaatagaaagcaaagaaaatatatacataaaaagatggcgggagccaggccatgtttacaactgagaataggaacaacccttaattaagatcagctaaacacagaagccaggtgaatgctctgatacaatgctagtatattgttaaacccaccaccagggttcctttagtaaatacctgattatgctattccttgagcctagtgaaaaaacctgcaccaggggaattccttctactaaccctttcatgaataatactacaatccacctatttcctaggccattgtatattcctgtgtttgggtgtgatttggctattgtcctaagtaattactatggagactagtcctgagttttctagctctattcaagtaaattgtaatgcctgattattttcactgtctctaccagaggtaaatttgaatgttactgaataggtaacattcttactgaattccaagttcaggatcagctcaaacactttctaggaaccattggaacactggtggaggcttagctatatgtcaaaagcaatccttaaaggcacttagaataaaacaatactgaaagagagcacacggatccatacaccagactaatgcggggacaggttttgggtatgcatgctattggaatgccaaggttccaggaggctaaatttttgtgaaactctttgcctcaggactgcttccaggtttctaaacctgtaatgggagtcactactggagtggatgtagcacagtgtgaatagttttaaaatgtcaaaacaggcaatcatgcttatggttctgatattaatgtttcacccacagattttaatacaagttagaaaatttctgcttaagatatacacttataatatttcctctattgttttattctctaatgcagtttaatttcaaatagttattaaatgtctactattacaattaacttgaagttgaaagaaatgctgtacctagactgaaagggggcttgtattgggcacttttctgtcactgtggcataacagttgagaaaaactgctaaaaagaagaaaggtttattttgtctaacagtttcagagtaccagtccatggtctgttggttttgatggttttgggcctgtagtgaggcacactatcatgaaaggaacatgtaggaaaaaaatgcaggaggcaaacagaatgaggcataagagccttcttatctaaatacaaagaatacccagcgacctaacttcttctcactaggttcaccattttccaagagtggcaagggctatctggtgactaagcttttaacacatagaattctgaaggtatagttgacccaactataacaacacttctaagttatcaaaagcatctgatatacacttgaaagaactcagtggggaaacccccactcagctcccgattcggcgtgcacccaagaatcacgaatagaacacaacaccttgatgtaacaacaagaggttttttaatggcggagctccgggtcgaaacgtatctcacattaacaggagacagtggattcgaccacgaggcttggaagctaggggtttttatagaaaaggagtggggctggggaaggaattggcacggtttcacatgattggtccatttaaacatcagcagcctgtaacatttaacttaggtcagaggggtgggagctagggaggcgatgggcttgcccgggcatgtcctggtctgttctgctgttttctcagccccaggtttcaaagctcacaaacaactctttgggctatttaacatacattacatgaattacagttttatttcctttcacactcacatccagtctgctgagagcatgcttctaagtctgcctgactataagattcagctatgatacacagaaagtataaattcatgtgcttcagtcatggataaagaatcaaagacaattaggtaataaatattgcaggtatagtagttcagggagatatggtctctaagattccctagctttgctgagattaccaggagggcttttaaaaatcaaaaatgcctttaacctcccaaccccttgtgatcactacagctgagacagcattgatttacttcttcaggtgtgcctttgcatttgggtttactttaatttatgtacctcagagacagaacaagttttcgggactacttttctgttgagtccggccagcggcccacatgtctgggttctagcctgggaggtatcttggaatctggaagaaaagagggaaccaggtggcgggagaaagaatggaaccaagacatcagtctgatcaaggttcaaatttactattctgagacacggggttatgaagaagggggaggggcccattcctgccaaatcatccttggagtccagtttcaggtgaccacgtgttggctccagaacagctaggcagcaggtagtagcagtgtgagaggcagaacgatagggtggcaggctccacccccaatgctctctagtgctaacagtcaaacctgatcagccagatttcaggctgagcgggggaggttacatctcctccctgttgttaatataaaaaagaaagcctggactgaggcataaaatttatttatgctctatggttctgcctgacttcttagggcctagtgaagaaacctgtctcagtgagatttcctaacttttctcatggtaaacccttatttggataagactgtcctttctgtcctagtaaacatcttgcagactagacctgaggtgttggctccgtcttttataatactaattagttactgaataggtaacttccttgctgaattccaagtagtcagcttacacagtctttctagggcgttggaacactggtgaggactaaactgtatcaggatacaattttaaaaggcactatagtaagataacactaaaggagagtacgtggatcctccttaacagccttgggtgacaggcagggaacagagaggaggcggtgatgaccggctccttagcacaaagtcatttggtttgttagggtggaaggctgtgaagggcttgcccttttcatggtatggtatccaaactctctcccccttttgaattaaacttaataaggccacacttgactgaggtgatcaaatgatcttctcatccttggatgagtgggcattaaccatggctgggggagcattgacccgattccgcccatgggtgctgtcacgacccacaatcatggctcttggtatcttttggggaggggaggcagagccttagaaagatactttggttgtaactggaactagataccaacctccatccaaacccggtgtgtctctcagggaactcagaaatggtcaagttggaccttcccctgcagtgcttggcctcgaacccatgctgttacccatattgtattcgtattatcatgaaccagcatgcacagttctgagtactgtgcagctcccaagggagaattgtcaacctcagattcagcaaagcctttacaagaattatgtcacttgtaacaccacactttgtggctcttaggctatattaggagctggaggtcaccctcctcctccctaatatttacacagcctgaggaaccaaggggagcttgcaatagcagcaagggtgcaaaactggagaccagttaagagactaagcccatcttatcagaataaaaaccatattcttctaatatctgaaatttcagcctttctatccctaatagcaaaccttaatctcaaatcagactgaaagccacaatatgtgctggaatgcctttagaatggaaattagtagctgccacctgcacactcttgggagcagggatgcacgcaggctgcaatcggctgaagggtgttgactgacctgcttgaaagacaaaatccagacaatgaaaaggtaacaatataaagcttcttttgggaaagtccaggtactttattcagttgcaaattagcaaggctcaagctcagtctccggcctcctagtgggccatcgtgctctattttcttctttgtgaaaaaaacacagactgaaaccctaccccagattagaaccggatctggacccttccaatcattagttagtgggtcccaccattataccctggcataagaattagaagtaattggatgccagtggcgattccctgcagactttaatatcagtttgcaaaaaatttagaatgaataaagcaaaggcaagatgtgcctttggtgactttgggggatataactgcccctgttttgtcttaaaaggacagagactctctggaagtgggggctgtgttctaagttaactttgctaggtaattaagaattttagatatttacaataggaatctttaatattggagtaaatattagaccagtccaagattgagttagaataactggtcacattgaagaaaagagaaaaatcattatgactctattaaatgactaatcttactaagtcacaatatacagtctctgatgttcttttgccataaagttaaaagacttgacactagtccaaactggaaaaatggcaagcaaggacgggttgaagacatgtaatttagcttccttgaaactacagtcagggcactgagtcaactcaactgccagctcgtcacacgaattaaccatcatggttctgcagcgttctgtggagagaacctatgtttttcccttccctaataataaggtagctgtttaggatcaaaccataagccaataagtagatccttttaagatactataaagcataattaaattctttgacatctaaatttcaaaattctaaagtaaaagtatgatttaaatagtgtgcacgggaatgcactaaataatatgtggggggatataatttctcccttctttgtcttttaagaagttaaagttttaaagttttaaaatatcttgtccttagaattaataacttgttgacaaaacatctcaaatacttgactgtattcatgtaacaagggcagtgactaattgaactttcaattgtttctcttaaggagcggttgtaattagaaaacttgaaaagttaataatagtcacatgtgcataattcatttatttattaactagaaataagagtatttatttgcagcaatttattaagtaaaggtcctcaagaattaacactattatgtggaaacaagtagtaactgaggacactaagaggaaagaattatacatgcacaatttttaagaatactaaaatattatcttaaaccatgactgctttgaatatacaaagaatgaggttatatatccaatctattttatatgtacgacctatagactgcctgagatataaatctagcatggcattgttttaagatgtccaggcaatccagaacaatttattaaatgcctaaaaaccgccctcttaaaaggacagcatttttatatgagttgtatatgcataagcaattgcaaatttgagaattaatagcatttgagggacgaacaatcttaagcaattgtgagctctgagatataacattgacaatacacaaattaaggtttgattgttcagcattttaaaacaccatctccagcacacaactagattatctgtgctgaaacaggggaaactcaaaagaataagcatgtgatctaatttacatgtatttacttcccatagaggggttgttttcaaacacaataattgggatgtatgcatgtatgaatttatagaagatacaaaagcatatataaaaacaatttttaacttatcttttgggatattaattgtcaatctttttaaaatgatggtatgtaataggtcaattattaatatttcataataaccaaattaattgttgtattgaacaaggaacatacacgtaggtttttaagacaaagtttttgttataggttttctaaaaatatacggatatactttacaattctttattagtaccacagtggttctaataggatgttgaaactgtgttttgaggtgaaaaccatctcgaccttggccgcctgcccttggcagcctgccataggccttcctctcaggcagaagaggctgaaggcagcccaatctgttttaggccagaaaacctaccctgagtcttagtgggaaaaatctggctaccccagtcaggacatatggaggctcatggggcaaaggtgaatgcggccctctcctgagttcactataaagccgtctgctttttggtggcctctccaggaaaactgtgtgtcttaaggcccctccccacagcagccagaagctagctggcttcacgtgggccaacgatcggctggaaggatgagaaaaatgactttataataatgtttttttcttgtaaaacaattattgtgagcacgtttaataaccaataactaaaatagtcagctaagatttaattaccattgattataattgataagaattaaaaaagcttttctttattttctgcaaactaatgtgtgttctttgccagttaatttgtgtctcactaaatagcacctaataatggctaaagttttcttgtagtgagtttaaggtgaggtcttagccaattaacatctcctggaagcttttaaaaataaaaatttgaagcaaatcaatttttcttttttagatgttttggaccacgattttctagtataactaaaaacccaagtattaaaagatattgcctctgaactaagagctccttgtgtgagagcaaggatttaaagtaaacttcccttgagaggcaatagctaataaaatacttctacttagaaaacaatatacactgaaagattaaaactcttggcttcttgtatagaagcagaaatgataaaaatttctcacataatgtagatcaatatttagccatactagaggcaaaatattccagttattacaaactcactagaagcaaaacctttacaatcattaagatgcaaaggagagtgaaaaaaagaaacaaactttcagatctataataactatataaaaggtaggcaagccagattgtaatgcctttataaattttacagtccgatagacccttcataaactatgaatttgaactttattaaaacagcatctggctagatctgtaaaggtgttcttttagctaaaagaatatctcctggaggcaaatctccagagcttctcttatgcaccatttgcaagacaaaggaaagtcacacaaattgagcagaagctgctctgagcttagttcctcttgccatgaggacagatattagaattactaagtttcttttgcaacattaactttgggaaagtaaaacccaatttcaaaacaatttatcactttagaaatcaacattaaaactttactaatacattgcgaaatttggctttctatgccacgtgcttgaaaagactcctgagttgccaattttaaggctaactctctgttaccaatgtaacaattatttaatcttaaccaataacttaagaactgattgtgaaaacatgcagagcacattaacaataaaaaacaaacaaacaaatgaagtagttacatttagaccaatcaaagaatattaattttctagctacaatcataaaataaaaagcactttatcattagctaaatgcaataatcacaaatgcagagaattttcttaggacaaatcatctatcagcttattctgctccaatatcaggttgtaaagttaaggttgtagactctcgctctctctctcttttttttttttctttaaagaacagtttctctagcaggggccctcctgccgtgtgcctatttcttggttaaagcgtgtggccactctcagctttgatgaaccaccagataaagttttagccatctttattatccaacataaaacatagaacattcattcattcagactggacgtgaacatacatgaatggaacacgtgaacagattggtgcaccagacattagacaaaaacacaaagagggcagagaacttctgctgtaaggcccagagagaacaaagcagggcacccctgaaatttctctctgcttctgagacattttcctcccgcatgatgcagtttctgactgcggccatccgcacgattattaaatcccttttattaaaccctttcttttctcgtgcctaaaaaaagcagctcctggaagctgtgactaactgcctgttatgttcttgctccttataatctcactgctgaacctaagtaaatttagcatgcaggtttagcgccatttcaacttagcccgtaccaaccttctccggtacgaattttccttatttattttcttcttccatggagctccacaccagcattgcttcttccaaatgtcctctgtcatttcccagccccgcaatgggcgccaatctgttgaggccggccagcagcccacatgtctgggttctagcctgggaggtatcttggaatctggaagaaaagagggaactaggtggcatgagaaagaatggaaccaagacatcagtctgatcaaggttcaaatttactattctgagacatggggttatgaagaaagggtaagggcccattcctgccaaatcatccttggagtccagtttcaggtgaccatgtgttggctccagaacagctaggcagcaggtagtagcagtgtgagaggcagaactatagggtggcaggctccacccctgatgctctctagtgctaacagtcaaacctgatcagccagatttcaagctgagggggggaggttacacttttctatgctgttggttatagaattcaagaaaatatcatgaagaaaatatcatccaaattttacattaatacatattaaaaatctgccacactacaagtatttcttaaggttatcaaactggttagattattatttatattttataaatgtaagctttgaaatataagaagcatgcttagactcataggacttgaaatgcataaaaatactaaaactatgtttgacccaagtgtgatagtacacaactataatctcagtattgggggatggagccaggagaatcagaagtgcaaggatatcctcagttacagagaaatttgaagccagcctgggctacacaagacttttgtcttaaaaagaaaaaacataaacaaacaagcaaaccaaacctagtttgcttgaatgtgaaatctaaacctttgctattttggtgactcactttggacttgtcgtatacctgcagagactatatattctcacacagagtatcacctaaaagggaagaagtgacactagaaaactatgttgttgttttttccatgtaaaagagtgaaatgaagaacagaaaggcaagagataaaatctgggtggtgaggtagacaacaggagcaagcatacgagaagagaaggctgactctggtgagtgaggcattggagtctcaacctcattattactgagataaagggatcaagcagaccagggatgatttagaatggacagccttgtgtacggaaaccaccttggattgaagaatcggtgctcaaatatttacctaggctttggaggttaaacctttttcaattttcattttgctagtttctcttaatgtattaccctaaattatatagggcatattgaggccaatgccataattcccaaaaagtcctgaaactgctgaacagtcactgtgctaaaactttaagagtatagggtaatctttgtttttttccagcaagtggacttccagagcttcttgactagccaaacagtgcaaacatttatcctcaaataaaatgcttcaatagacattgcatctagaatcttaattcagtaacacaattttagcacttttttgaacaaccagagaatatagttgggtgttggccacctaaaaatagcttatctctcttattacatgaaggagttatacttattatcataggtcttctaaacagagcagccattagaaaatagagagtatgtgagaatagaaagaagggagtcacgaaaactttgactcttaaaaacattggttgaagtgaggtacctgagcacagaccctgagacgtaactgccacttaggttagctttctatagagcatacattttgtcatagccacaatcacgagatggtgtcaaacacaaaggaaactctatagaattattttgcatataattgaataaaatacccataataaaatttcaatgtttatcaatatattgtaaagttaggaattctttgttctttcgattattgtttaaacatcaaatgtgcccagtgtctaaaatgttgcagaagtatattttgtgcttatgatacaatgcaagcaagataaatgttccctacaatcaacccaataactacacaaatatgtaaaggatatgtgttaaattatatatattcaattatatgataaatacaccagtgtgtctgctaagaagtccttagatttgaggaggaattttgttttgttttgttttgttttctgagacagggtttctctgtgcaggcctggctgtcctggaactctatagaccaggcaagcctcgatcgaggaggaattttttaattgaacaaaattttatagacacaaaaagaagataaataattaagaaagtatatttaaattcaaatctacgtgaatctatgtggggaagttcatttgtaatagtagaattgtaacttagcagaaaaataaattccggcttctttagtaaataatgtagatgtgaatatctgtttactttttataaagtactggaaaactattaatgaagatacacacacatacatacactcactcacacacacacacacacacacacacacacacacacacactcacacacacatattctttatttgctgtgaagaggtaccattaccaagaaactcttataaaggaaaatacgcaactctggctggtttacagtttcagaggtttagtccattacactattgtcatggtcggacacatggcagcatgcaggtagagacagtgcttgagaaggacctgtgaggagccgccctcacattcgccgttacaagatggcgccgacatcctgtgttctaagtagtaaacagataatctgcgcatgtgccggggtagttttccactccatgtgctctgccttccacgtgacgacaactcggtcgatggtctgcagccaatcagggagcgacacgtccgaggtggaggacaatccttcataaaagggacggggttttgccattcgctcctcttctcctcttgctcctgaagaagtaagcaataaagcttttgccgcagaagattctggttgtcctgagcgtgttcttgccggtggggacaaaagctcgggataggacctgagagttttacatctggaaagcagtcagtgggaagtgaataatacactgggaatggcttgagcctctcatgcctcaccccagtcccaggtgacacatgtttttttctctaaaaggccacacctattccaaggaaaaactgaggacagaaaggacctatacgtctaaagccacagacaacagagagcaataggaaaccgtgaagaagagggaatcatgcaaatgggttcctgtctaaggaaccaagggaagggttctagttaattttcaaaagtctggaaggtgaacatggaagtctttaatgtgaacagaccattggtcctatagctatcagaaatgatacagaggtgtaattatatgtctattctctgtataaaatctgaagtataaataatttgcacttgaaaattgtatataaaatattagcacatttaagatttgtatatggagtaagacaattatctacctggatagatggggaaatgttattattttatctcagtatctggcaaaggttcagtagctcagccgagaaggacacaatagaaataatgatttgtcaagactttacaccaatttcttcactaaactgtcagttcagttgcataataggaatatgcacaaaatatgagacattttataatgttaaatatatacagttgataaatgacagtacgttaatactaaatagacttgttatttgtaaaaatggaaatagtttgattattctaaggacatttgcaaggttattatttttaaaatgacaattaaaaataaatgtatctattttatgcatgtgaacacactgtcactctcttcagacattggattccattacagatgattgtaagccaccacatggttgctgggaattgaacagggaacctctggaagagcagttaatgctcttaaccactgagcaatccagaagatgtttcaactggcaataaggacacatgctccactatgttcatagcaatcttatttataatagccagaagctagaaagaacccagatgtccctcaacataggaatggatacagaaaatgtggtattaaaacattgagtttatgaaattcctaggcaaatggatggatctggagggtatcatcctgagtgacgtaacccaatcacaaaagaactgacttgatatgtactcactgagaagtggatattagctcagaaacttagactaccaagatacaatttgtaaaacacatgaaactcaagaagaaagaagaccaaagtgtggacactttgccccttcttataattgggaacaaaacacccatggaaggagttacagagacaaactttggagctgagatgaaagaatggaccatccagagactgctgcacccagggatccatcccataatcaaccacaaaatgcagacaccatcgtatatgccagcaagattttgctgaaaggaccctgatatagctgtctcttgtgaggttatgccagtgcctggcaaatacagaagtggatgctcacaatcagctattggatggaacacaggacccccaatggaggacctaaataagtacccaaggagctaaaggggtctgcaatcctataggtggaacaacaatatgaactaaccagtacccccagacctcatgtctctagctgcatatgtagcagaagatggcctagtcagctatcattgggaagagaggccccctggtcttgcaaactttatgtgcccaagtacaggagagcaccagggccaagaagtaggagtgggtgggtaggggaacgggggtagggaaggtatgggggacttttgggatagcatttgaaatgtaaatgaagaaaatacctaataaaaaattggaaaaagaagaaaataaatgtatctttttaacgtaataagtaaaaacagctggtgtaattataatttaaaacctccttggataagacagtatttgttacccagaacctgagtatattcaacctagtgtcccatggaactctatttatttacctaagtttctataaagttattgtagaaagctattctttttttaaattaggctttactgtggattacaagggagttcccacaaatcaatctcccatatggatctgtcaggcaggttgcttaatgtcaagtatcacaaactcaataactgaatctttatccagcatggagatgaaactgtttctcatctcatattacctcagcaaaagcaagtcacagacccgtaaaagcagataaatcagatcagctacagcaagccaatgtgtccgtgtgtgtttatgttcacacatagctttatgacgctgaaatccagtctatgtactcagcaagttcttacaaatagcctccagtagaagttaatgcgcagtgatattgctttttcaaatatgttctagtacaatgttatagtgtaatgctttggtacaatgtaatataacagtatattttcaagtattttgtatgtcaaaaagattcttttaatcactgaattattgaattgactagatagaaagaaaaggttttaaggactagtagaaatatctagtcaactactgaaaataattaagctttagaacagtgcttctctgaggtgcatgaggatgtcatcattctgtccatctcttttaagatcatttaactttaatggatgttataaattttcccatgattaaattcatataacccaattaagtgtaaaagtaaaaggaatagaattttgttagattttcatagcaggacttagaaatattctgagattgctatattttctttagagaactctcaaatctgcaggtagaatttattctaaaaaaatcgcacttctacagctaggtgtgatgatgagtccttgcattccttacactagggagactgaagcagggggcgtgggggggggagagtcttgagttctaggctaactttggttatttagtgagttcaaaaccagtcttaaatagtgaaacctcctgccagaaaaaagtcgaagcttagaagaaaactacagtctcagagtcagactgtaggagctcagagtggacttctgagtggaaagcagacagttgaacaatcaaggtgcacaggtactttgaggaacccagatttttggctgtcattgttttgtatttcagagaaagcagacatccttctggtggtcctaacctgaccggatgtttattttccatagtaatgcacttcatttattccttagtttgggagttgaagcagctgattcctgttattgagttagggaaggctgaaagaatctgaggagaagggcgaccctgtaggaggaccagcagtctcaattaatctggacccccaagatctcacaaacactggaccaccaaacagacagcatacaacacctgatatgaagctcccaacacacatacagtagaagactgccgggtctgtgttcattcagagatgatgcacctagcccttaagagactggaggccctagggagtttagaggtcaggtagggttgggagtggggacatccacgtggagacaggggatggggaggacgtatgggatgtgaaagagttggaggatggatgagggggagggggaataaaagatggagtgttaaaaaaataaataaaataaatttaaaaaaactaaatggttgctaggaaagacttcgaggcctgtgcttaggcaaccctactaggactctgacttcatgtatgaaatgactcaaaactctagcattttaccttgttctcattttaggaagtctgtgctacaaatgagtttgcattttggaactccaggctgtgggactccaggtgctggaagtataagcaattctgtttccctttcctggcagttaattagcgacagacacattgtactaagcatagtgtgcttaatttacagacacataaataactgacatattcctttggcatttcaacatgagagagacaaaactttctcaatggctcttatggatatcatatccattctgagaatgagctagtcaggaaccaaaatgaaatttaaaaataagcaggggtgcagaacaagataatttatatataacaagagcaatgcatctcctaaactagggatattttatttggttgtgtgttttattttacttttgttttaatttattgtgtgtgctagatgttttatttgattgtgtgtctgctaaatctctttccatttgagtgtgtatagtgatgagcaatagcccaatgggagaagtcccacctcagagctagcttgactggtccctaacagatacctgttacctttaaccccatcactctgttttcctttgtaacagttgtatatattttaaaaaggtgtatgtgtgtaggggggagggcattttgaaaggcctagggatgcctattgtaaaaagttgtgtaaaaagaagagagtgttcggcagcctcctcctctcgctaattggcactctaccagagtgactttttttgtggagggttgtgtggggcactgtcaactcaagacatcatctaggtatgtgtaagttgtaggctcaactacttcagacactgatttggggtcatgattaaggactccacattttaaatatgatgtaaaatccaggaaaagaaaagggaaaggactaggatatagataagaaatattgaattatattcctctttctcttgatgttctctgaaccagggcatttgttcacatttctctttattagccttgggaaacaatgtttctgagatggattgtgtctcagtacataattaatatagtcctaacctagttaaagcattaaaatcaggcaatagcctggcaagccacactgaattatgaatcccaccaaggtatattgtagccggtggttctccaccatctctctctttttttaaattaggtattttcttcatttacatttccaatgctatcccaaaagtcccccatgccctcccccctccaccatctcttaatgcatgcttgtcctccacactgtgcctcgcttacacagcagaagaaagagttaaacaccatcttttgtttctatttgaaacctagaaagggttgctttctgatgggttttcaccacatgactacaagcccatctggactgaaagataaagctttctctgaatcccataaaggacacgcatgggttccagcccagaaacagtactaaaaggcgtctaacaatttgttgatgctcagtgtcatccaaagggttcaatatcctctgcatccttagagaattcacttacaacctgagaagtgcaataagctggtgttaaattagcacctctgtttgcttttttcttagacttgtcaaaagaaagattaatgagcaggttttctgcactcaactatagcttttcttagaggaatgtggtgtctacatcaaaatcccatttagatgcagaaaaactcacttgcaagcaaagatgaccttttcaactttcttctagtttcccattcttatttttttcctagcaagcaaacatttactcctatttaggtgtccttcagcaaccttcccaaccctctgatgccatgtattattgtttgagtctcactaagtaagatggaaaaaaaatgagagttcagcaaaggtggaaacaatgagagaaaaacctgtggggtcattttacaaatggaatcgctaaatagcagtgcttcttgctgggtaatagcatagaacctttaaatcacagagattagagacaggaggtctggcaggtccccttgtctacctcctgtagcagctttgtgcatttcccatgaaatgacatgagtcctgagcatttgctgtagccctggggggacttgctcctgggtaatatatatccctgttgagaaaatttcccagggaactggcaagcttgtcttttgtttaatatcacattgttctgcatcttttcagcctttggaaatgcaatcatacttattctggttcctccgtccttaaaaccaacaatcttgtgacattgtggcaatgctcttgccttcttgtctaataatttgagcctattgataccaatttgtgcctcatagtactgtccttacaaattagaacctattgctgaacctaaagccaagagttattcactctatttccattcattctgaatggcagatgtgacccattcttcatttgtgtgtgtatccacttctatgaaaatgatggtattaaagccagtgattggacatcatgacttcaataagatgaagatcattcttattttgctaaagacacaacccaggttcactatctcatggaattaaatgctcactagcttgtctgactatgtgaggtagcactgactttgagtgtttcaaagcttgtgcagagtctggcattgtggttgtcccttataaatacattgttctatctttaggtatttaaaatgccacacattacagtatcttcagaatataagccccatatttttaagttaagcacacatttcctctgtattagaaatgaatgtggaatctccacttaggagtattgctgggcaaaagtcaaatgaatattaaagaccagacttcacttcaatacgctctgacttgttcaatggaaagacttttgcactcatcactatcatgtggcctctggtgatacactcttcatcccttaacatttccactaaggattggtgtaaggttttacccataatacatcagggctaagttacaacatttagaaaatagtgtagggaaggctttggggcaacaaaaaggccatgcatacagagagtttatcatgtaaattatagtttgaattcttgggattctaagtctcaaatttttttggtgtgtgtgtgaatgggtgcctgtctgtttgtctgtctgtctgtctatgtgcatggttttgtgtgtgcagttgcatgactgtgtgtcagtgtacatgttgaggccagaggaaaaccctaagtattactctaaagtgctacctaccactattgagagtagatactgaatcttccattggttggaaacacacaaattacactaaactgactgaccagtgagacccagggatccacctgactctgttccccagcttcaggatcccaaaagcaaaccaccagagtaggcttcttatgtttatgctgggtccttgctatgcacactccagtgaagtttgcttggaggccaagaggcctgggagcactcacaaggcaaagagttttacggaaacttacctcctggaactttggtgttctcataacccgtatactcataccctatccccaaattagtctggtgtgtggatccacgtgctctctttcagtattattttattataagtgccttttaagagtgaattctgacatagctaagccttcgccattgttccaacttcccagaaaatccttgaagtcgacaaacttggaactcagtaggaatgcagtgagaaggttatctattcagtaacattcaaatttacttctagtagagacaatgaaactaattaggcattacaaagaacggagctggaatagctcacggctggtctgcagagtgtttacttgggacaatagccagtcttacccagacaagggaattcacaatggcttagagaataggtgggttcaccatgaaagagttagggaatccccctgagacaggtttcttcactaggctcaaagaaacagcataaatcaggaatttactaagaacccctggtggtgggcttaacaatagactagcattacacctggcacccttcttagaggtaaacagcagtgcctggtccccaccttcttttgatgtatacattccttttgtattgtgtcactgtaactcggtgtatgtatcttgcctctgtgtgttgcatctgtctgtccatctgtctgtcattctccgactccttgtccatctgcaaccagagacctgtcctaggcagaccaagagggtctgcggcagttcctcaggtcctcaggcttgcaagactaatcagtttatagccaagctgcctctacatgttcacccctattaaattgtctgatctctccacttagtggatttttttttcttcacccaatagctcaaaatacaggcattatagtatcccagagtcaaaactcttccaactctacaaagatgctaagggaaattatttgtccttacttctgaagagtttgctaaaaatgggagatactcatgctcctgggaaacaactaaacaatgagaaaagttttcatgatattttttcaagaaagtcagaatactttggggtacaacaaaatatccccttatccaaccaaaatgatcttgtctcaagcttttctactatagaaagaagactgggggaggggcagtaaaaggagtgggagcctgagacagaaactcggagtaggtagaaggcagtgaacagagggcactcaccaggtttcacacacattatcttgtctacttagcacctaaatgattttcaggtctgtgtgcctcccccagctcataagcttccatctacatgcactgctcttatttttcaaagacatgtggtattaatgagacaataatgttggtaaagtgttctaatttctgttgggagctattaaggcaactcttgatctctgaattgggcctctccccctgagaagaaaagggggtcaaaagcgggccaccaacacatggattccgagaaccacgggatgttctagccctaggtcatcaccgatgtcctgaccacaccctgataccaccaagttcctgcttccccgtgtagctgccaaaagaaagaatttctattgcccccccctcccataagtacttctccttttgcttgtattgccctacccctcccactgataagtatctgtacttccccttttgcttgtgcatttaaaccttggacctttctcaatacattggggtcttgatacaacttcagaacggtttccctgtcgttactcgtacaagacccttgtctctctctaccccccatttggttattaggaggaggtcccctcgagatcctcgaataactggacctgctggacgggtcaaatttcctttgagaaaaaaagctatacaactttattgttcttgttggtcctatgtaactaatattactcacatttatttcatttagggaaataaagtctaaaaatcaaatgagtggatttattgcattttggattcagcatctttgcacatgtggatactgacataaaaaagttgcaactaagatcttgaggccaatagtacaaaccttaacccagtatgtgcggtttctaatgcttgatgacctgaggggtgagaagtgagaagagacttgataccctagtcttctccattaactcattgtcaagcatagaatgtagcaacaattccctcatttcttgtggaaataatagtagataaaatacaaagtatttatttttctgagagaacagggtttcctctccttcatgtgtaaagggcaggaaaactacaaaaagaacatagagtcgtgaataaagccatacacaaacaagaatgctgggactacaggttccagtactatctttgtggagcactatatttatgctcatctagtcacttagaacaaggaaagagtagaagaataagaacttagaattttatgtggcaattacattcttagttatcatttgactgagtttgggttttgttgtgtgtgtgtgtgtttcaatatgttctaacttgtttgcaattgggatagttgtgcactttgttaagtcaggacctatgtttgaagtagaaaggaccatctatgtgacactgttagtaacacctttactgcctaggaaaatgcacatcttatgccgtgccaatagtttcttgcacttggagcttggtctaaggcaaagtatactaaaacattattctatgccatttactacaaatttccataggtaaatctttctaataattaaattttaccttgtatttctctacctttggttggaaaaaaagagtaacaaataattcttccaggatgggggaagtaaaaacattgtaagtctttggggagtttcttaaaacaattatcctaatgaatgcgctgctagtatgtaattaatcaaaacttagttgatgttttgcactaaggggcatatatgtctgggacaaaattttgattgactgatgtaaaatagaccagaacaaattattccttcaccagagtaagggacgaacaaccccaacccaaaataaaaagcagtttttcccctccccagccctgctttcctgctgcctgcccattatacagagatgactagaaatcagaggcaaacacaggaagtgactagaaagcagggcatgtagacaagtacttatggaaactgaatatttgaacttagaaatagcttttcagcctcatatctcctgcttttaactcttttctacattttcaattgaaaagcttcattattacctcttgtgcatattctgagccaactctcttggtatcttgttcactttaaccaaactattttcataattaaaataagagaaaaatatacctttgtaatgcagcatcttatatttaatttaaacaggggaatgcttatttctgtgaaagtctagtacaatacagatagtaagtgttgagtgtattgcttaagtggattcattgaattaaacataggcttaactacctttcctggaacagaccttgtaacacaataattcacagtagtgtagtggaagggaccataggttagtgccatagcagtgcatgcgaacaatgtcatttagaggcagaatagagagctgtggagtcattgattgggaaggagcaattcaccaggaaaggcatgaggaaagctcacagcactgttgtgacagtttgctcttaaaggataagtgaaaccatcccacattcgtcaaagacagttttcatgttcacttgaagataatggttaggagaactcagcaaatagcctggacatttcgagtctagtttgtcaaaactgaagagaaatggcgtaagctgaatcttgaatctggaaactctatctagtatataatcttaggagagtgcataaggtgctgttctctgggtatcaggaaaccaatgggttttgacctcaaaacaacattttttttgtttgcttttcttttaaaggaaaaaaaaatccctatattcttgtcacaaaaaaaccctaatgtctattatcccaaagtatgtatcatgtttggggctgctaactggagaaccatagactcaatggcttatgaggaacagaaaactgtttttacatatctgcagattgaaaacctggcactgggtctcatggagccctctgcccccatgttacactccttctgctcatgggataggcaaaagaaaggtgactctctgacctgaactcataggaaacctaaaccatttgtccatgacagcctccctctcatcacaaactcttactcagcgtccacacctttaccttgagtgtatgatttcagaaggactgtactttctacaccactacagacataaggaggtttctcagtggcagtgaggacaactagcagagattcttaaaatatactcaaatgtaattaatgttggggtggagggggttggcatagaattggggttcttatattatatcattaagatgaaagcacaggagtcaggtgagaatttgagttgtctagaacaccttttctttcttttttcctttctttctttctttctttctttctttctttctttctttttgttatttgtttgttgttgttgttttcttttcttttctttttttgagacaggatttctctgtgtagccctggctgtcctgattctcactctgtaggccaggctggccttgaactcaaagatccccctgcctctgcctcccaagtgctgggattaaaggcgtgtgccaccacacccggtgtagaacaccttttcttaagtgtcaagaatttacttaatatatcaagaatcatgggggtatatgaaggaggagagagctttaccgtgtgtccgtacagatgactggaattggtttcccaacaccccatgatggcactgcaactccagttacagagtatccaatacttccttctggctttggggtcaccaagcacacaggtggtacatgtatgtatctgaaaaaatgcatacatacatataaaatgtaaacaagtaaatcctaaaagcactatgtagctctgcaggctataacaattgataaatatatctatatttatattggagctatgtggtggcaaagtatattgtcctgatggaaataaaatctttttttgacttagtagctgagaaataaaggatagacacaaatatggatgaaatcagcatgtaattaaagcagtagatatacatattagaacaagaatgtttgatccaaaacaattagacagttctaactcaacaccctgccatatacagaatgtgcaaagaaaagagtggtatagccatgaggtatccagacaatagagcatggattgcagataatgaagtgaaagcaggtgttgggaaagagggcaacatgatgtagcatagtatgtactctataggattcagataagactggaataaatgattatatatagcattagaatgctactgctgggtttgatgagaaaaaacatttattgatggtgttgaggctagtcccttcatatccaatctcagcctctgcaaccttcccaccaaagaaaaccaaaaataaacagtagccaaagaaaacaaccaaccaaccaaccaaaaactaacctcccaccaaaaaaattcctgccatggaaattgtagtgtgttgcacagtataccctttgcccaaaacagctttattgcaaatgttcattgctatgatatttgcctggttcaaggcctgtggcttccactgcagtatctgactgagtgttgcttcatgttccatattgttaatctagatagtttaacaagtagcaatttattcatggactctttgtttggctcatgtgatctaacaacatttggaagaaatttactgaaacaaatggcataggctgtaatgaaacagctctatatacatttcacagtaatatatttttgggggggtagtgaattgataaaaaacctgggaggaggctggggcacaagagagagaaaggggagagcaggaaacagtggggggagcatggaggaagactcctttgttacagctggccacaggctgcattattgcataaacactatgtaatttgactttcctattgtgacttatagcatatgaaatgttagtcagctactgagtaaaactcaagacacaaattgtgatgggcttttctttcccagtaatttcttttgtttcttacagagtacatagctcattgattgctttaggacaatcaaaacaaacctcagaaaattctatggaaggagatacaaagacaaaattcggagcagagactgaaggaatgaccatccagaggctgccccacctggcgatccatcccataaacagccaccaaacccagacacgattgcagatgccaacaagattttgttgacaggagcctgatatagctgtctcctgagaggctctccaagtgcctggcaaatacagaactggatgctcacagtcatccattggatggaacacagggtcctcaatgaaggagctaaagaaaggacccaaggagctgaaggggtttgtagccctacaggaagaccaaccatatgaactaaccagtacccccagagctccctgggactaaatcaccaatcaaagaaaacacatggtggcactcgtgtctctagttgcatacgtagcagaggatggcctagtaggtcatcaatgggaggagaggtccttggtcctgtgaaggctctatggcccagtataggggaatgccagggccaggaagcagtagtgtgtggtttggggagcaggggcagggggaagcagataggggatttttggaggggaaactaggaaagggaataacatttgaaatgtaaataaagaaaatatctaattaaataaaagggggagggaagaaaattcttaccaatctgtggttgtacactaagaggtttcattgagaaacatggcaaagaaggaaaaatatcttgttttatttttttaacagtcatcaacttggaccttgtcaagcacattccagagttgcatttgcagacagggaggatgatgtatatggaggatgatatagatgcagatctcctgagaacttgtggagtctgacatgtatcccacatgacctggagcaggcaggaataatcctaactttaaccgacctgctaaccttgctagtttattggtgactaaggtgggctttgtgatagccattttatactcagagatgatgtgaaggagatcaaaggtgctttaaagagggctttctgtcaggagcaggagaaagacctttcatgaacctagaaacaattttcttgatgtagaggactgaagtccgcagagctgttgcaagtccgcaggcagccagcactccaagctctggaaaggtatagtcttcagagctctcaactaaaacagttatagccgagaaatccgtgagagagagctagagggcaaattaaaagcctgatggctcttagaacattttctgcccacaatcactctgtgccactttaattttttcattctgacagggtcagaaaggagggcaagtag

SEQ ID NO: 146 - DNA, 4951 bp, Mus musculus
gagcacaactactaaaaaacttcaaccaacctccctgaaagaccaacctctagggactctagcatttatataccctctgaaaagtccccagaatttcaaatgtcacacaatcgcagaaactatcttcagctggcaaaactatgcctctgctagagcatgaggcaaatcatagtcagctgctgtggacaatctgaagcagcccccaccccacacctgggattaaaatgaaaagacagctttatatttgtgattttaaaggaaccaaaattccaaaattgttactacacatctgggtacagacctggactctgggttctgatcttgtctttcttgttccctctgtgctagactcatctgtagctgaagataaatggctctcagccttggaaggaacacggtggttagactatgtcaggtatgcctagccttctaatcatggttaataattcctacttctccagccttctcttgacttaggcttcccaatggccttccatcaatccgcctgttttccaagactgttactgttgttcaggagcaggagcaggcacttgggaatctgcttctcttccaatacattactcccttcttcatcacacgcccttccaggtcttgtcttcgaaaggccagcgacatctcagtattagtgacatctcgggtccgttctgtagtgctccaaggtgagttccttgagccagctccttccattccttacctctgtccttcctgtgattggatggtgtggaagggagcttccttgtgcccctttagtactagcatcttcctgtgagtgccaattcatccttcagagctactcagtcccctactgtgagagctgtccctaattccaagctggttttagaccttcttgctccttcctcagtagatggggaaggggcagggtgagaagggcactgggaacactggttgggaagtgtggctctgctttctctgtgacaatggctgtttctagaagttgactcatttgggttttcttgtcacttttctgtgccctctcactcctgcctttccccactttcttttatgtgcccctccccctttccccgtgtttcctcttctcattccctcctgccctagtttcttggacccccttctttgtttctttgtcacccagagcttggggatcgtgatttcaatggcctcctctcctcactcgtccagctgcttttggctccggaagcccggacattgtttggtttccagtcactagtgcagcgagagtgggtggcagctggacaccccttcctgaccaggctcggggacactggagccagtgaggaggtgaggacactttaggttttctgtctggagtgggttaacattactaaagggaagaggtgagaaaatgataaggcctagcccactagacacaaacccggtctgaatgggctgctgggctgagtggacactcaggagagtcagccttgaacccctactctactctcacttcctgttttaatccctgccctccttggtgtcctgttctggctcttgttctcccctttgtcaggtgcttgcagacacccccatgcgactgttttctcttctcaggccccggtgtttcctctcttccttgactgtgcctggcagctcctccagcagtttccagcggaatttgaattctctgagttttttcttcttgctcttcatgatagtatcagggttccggacaccctcacctttctgagaaacactccctgggagcgcgggaagaagagtggacaggtcagtgacctctttttaatttgttcctgttgagcatttcaaactttggaatttggtcttggtttaggaagcttgaggtttggggaaggggttggggggggtggggtgggtgctcactcttaggatcagatttttgttttgtatgtgatgccagaaataggaggtaaggtttataatttgttccaggtgtaggacagggacacaaactggtttaaccaaccttgtttaaaatttttgagtttgtgcacatttatgcgtgtgaccgtgaccgtgtatatgtcatagtcctgtggaggtcagaggtcaacctcaggcatcagtactcaccttccacctactgagacagagtccctgttgcttgtctgctgcttactccaggctggctggaccaggaacttctagggattcttctgtctcttcccccccagcatcctgtagtagcactgaaacggcaggccctgagctatgtgtctggctttgtgtaggttccgggaagtcaaactcaggtcctcagtctcaatggcaagtgcttttatccacaaaaccaatcctgagctcaaagcacccatcacccgtttctttgtttcctctatttagttcaactcgtacacacaagtttacacccctgagtactcccagcccctagctggaagctctgctaacttacatctgtctgtctgggactgggatttacgctacagcaaggaacagatatcacagttccttaatcctggctacgatccggagcattgcccagacagcaggttctctagacagcaggtaagatacctacacttcaactcccttgactctctcaggttcccactactagatgagaatgacaggatatccgagtccctcagagaaagacaccactatcttttatagctgtcacttgcagccagccttcagcaagacagttgttctagaatagcagacaatgttcttttgatattcattttggttcatgtccatatattatacgtttctctaaaatcaacccagtaagcccaaaaccctagtctgctgaggagaagggaggtcagagggagggggccgcagtttgtcactggaacaatgagtcaggggcagctaggtatcccttcccacttctcagttgtctgttgacttcttctcttttagcaaagcctcatggttcctggaccccctagttctatgtggctgttctctagagggaccctgaccccactgaatcagctctgtccttggcaagacagctcctccttgctggcagtctcttctcattggctccctcgacctgccagatcctccgaaagcctagctgaccaggaatgggggctcccctcacattggggagcttgccctttacctcccgggctactgctgcctggatatctgggaccacagatcaggttctggaaacgctgttacctgaggggcaggcctgaggtccaggtgagaagggaagacagactggatgggggagaatgagctggaaaggcaaagggctggaggaactggggagtagcattgcatttttcaaactgggcccacttgggataggagatggtgagaaaactgcctgtggcttggatcatgtagaatctagagcactgttagaagggaaagatcacttaagactctagaagtaccaaggatcttagtagaaaaatagccgggtagttgtggcgcataccttttaatcctagatctcaggaggcagaggcaagtggatctctgagtttgagctagttccagaacagacagggctacacagagaaacccaactggaaaaacaaaacaaacaaaacaaaaaacagaaaagggggaaaaaaaaggaaccaggaagcaagccctgtaacagtcttcctctgtgcgctttgcccctccccagatgggctcctcagctctcacagtctctgcccttcaggatgagctttctcaccttcaggaactgttaagacaatggacaccaagaatatctcccgaggaccagagcaagaaaagagatccgaataccatcctctctcagatctgctgaaactgtttgttagcgtcgttctcagaggcagggcaggggtctctgctcatcttcctgtctgaccttgacgcctcagctttggcattccagtctgcagagttcacttagaaggcccgtttctgtagcagatggtggcgctaccaacctaaaggtctcccgatttgtttgatttctggggctattttcatttcttgtgatttgaaaactaagaaacaagaccagttcagaatgtgattgccccttttcccaggcaattctgtaccttttggatggccgtcaaaactgtgacatgagagacccttttcatcagtcccaacaatgatgtcctagagacctcattcgcaacctctctacactactttgaaatcttttcttagtcttctgtgggaacgaggtgaataagggagaaaccgtctcctcccactgtatattttcatagcagcgtttctatttaaggagttcattaaagcacagtatttctacacattgctggtattttcttgtgttgaatgaagatctcagcaaagccgtgggggtggaggggagggtgtgaactgagaaaaacacccaaattattgtaaggaaataaaggatccaagtcaggcgtggcctggaagaaatacacataaaatatgggggaaggggtccgcacaccttttttgagacatggtctctatgtgtctattaggccagctggaactctgttttttgagacaggttttctgtgtggccatggctgtcctggaactcgttctgtagacctggctggcctttaactcaagagatccatgtctgctccttaaagcttcgataccagcccgcaacccaacccggtttcgtgtcccagatttcccaagataagcggagatttgacacttaggggaaaacaaaatacctcaggctcaagtctaggccgagggcgagtctgcacgagcgtcgtggacctcactaaataataggtcgctccagaaggcagtcctggccctgcacttaggacacaactctgcgtcacagaacgtacaaagcctggttttgcacttgaatgtgcgtttggggagccgtgtgagcctctaacagtctggaagcatccggggctttagttaactgtgtcgagacgggctgagcacatccgttccgccccgactacagcagcagccctagagcgcctttcccttccgaaag

SEQ ID NO: 147 - DNA, 7364 bp, Mus musculus
ttgggtaaaaatctgaatgtattgtcacaaagtgaacaccagtcttatatagtacagaaaataaaaggggtaggaagtcacagcaggcaaagtacattgaagttccctgacacaaaacaaaggaatgacttcaaagggacttacaggaaccaggtaaatgtttacagtaatgataaagcagtcctgcctagggttagctaatgacagctaaggatttcacaccctagtcagaatttgtgctactcctttgagccttgtgaaggctagtaccagggagttctgctctagcagaccttctcacgaataatgcaataccacaacccccctatttcctaggccttagtaaattcttgtatcttggctgttcttttaagtatctgtgtagaatctccatttgtcagaagaatttaccaacttgcttctaatatgtaataaagcctgctacacctggctgtagagaagatccctgtctcagtgggattccctagctctttcatggcattcccttgtttgggtgagactggctactgtccttagtaaacactctgcagaccagccctgagctgctggctctgtcttttggaatgcttaattagttactgaataggtaactttattactgcattcccaccagattccaagcttgttggcttctggaacattggaacactggtgggaggctttagctatgtcagaattcaatcttaaaagacacttataataaaataatactaaaagagagcacgtggatccatacactagactaactcggggatagggtatgagtgtacaggttaatgagaacgccaaagctccaggaggtgagttccttttgaaactctctgcctcgtgagtgctcccaggcctctcagcctgtcaagcagacttcactggagtgtgcgtggcaatgtgtgtcactgcatctatttgcttttccagagccttttctttggctcttttcctcctatttgtttatgtcctattattgtttgtttttgttttatctaattttattttattttgattttttaagatgcctatttgtaaaggaaggaaggaaggaaggaaggaaggaaggaaggaaggaaggaaggaaggaaggaagagcgtgaatttgggtgggtggggatagggaaagatctgggagaagctgggggagaagaagccataatcagaatatattgtatgaaaaaatctatttcaatataaataaataaacaaataaataagaaggggtagggtcagtttttgcaagtctccaaaggggtcttccagccccaatactccagattaaattactttaattctagggaggcaacatagctgtacttaggaatcaagatgaggctgcccactgatgcttacactgttagacatgttcctgtgaaaccatttgctcctttgtgggtttcctgtagcttttcatctgtatacacacgcaccacatccccgttagccacacatccctgaggctaggtcttctcatcttctccctttccacatcctacaggctgctacacagtggccctagactcagctttgctctcccctcagggctgactggacaggcagtgaaccgccaccctaccaacccacattctacgatggctggcagattccacagccccgctccatggtaagggttgcttagctctgagatctatgaaaagcatttccagtccagatcaaaatcacaactacgaggtgggttatatgggtacctgttggggaggtgagcaatggacaaaaggcagctgttgcaggcctgtactgggctggttagttagcccctccctgccactgtgctggctgcctcccattctaactcattctggttttcttgcttacagatgcccataacaaaccaggattcgatttccctccggtatgtcagtcacatgcttagtggattctcgaggtcccagggagggagggtcaggacagaacctttgcacctgtgaatcccagagaccattggccgggggcacaattcctattctccatccatcctgaatctgtctctcatgtcagaggttctaggatgaggagcagcctacatttccctcgggatgagccatacaaccataaccctgaatacgaggactcaaacctcccactctccagccccagccctggcagagcagccctgaaaatgcaagtcctgtacgagtttgaagcaaggaatgcccaggaactgactgtggcacagggggagattctggaggtgaggcccatgcttgaagccaaaaaagaggcaatgggtgggaagtacaattagcctggagtgggtggcttacagatagagaaggaaagtgggaaaggtcaggcggggaaagacacggtcttgggggcagaggggatgggaggatggaggctctgggggctaatgtggtgattctcggtaggttctggatcagagcaagcgatggtggctggtgaagaacgaagcaggactgactggttacattcccagcaatatcctggagcccctgccagctggagccccgagaggccaccgacaaccatcctttagggtacttcccacgctggggtacccagaagccctgagtcctaagtcagaagtcagaagtggtagtagggaggattaggtgacaaacagagacaatcttagttcagtttaatcaatatcattgcatgcttcctcggtgccaagttcattatagggtctgaacaaagattaggtgagcgtccctgccgaactaggaaaccagaaggtgagataagcatcctgatgggatctcagtagaagggacccaatacaggaggctgtgtatgtttgtaagatgggatgacctctgacttctagtgctccttgattccaggccccaatgcttcgcctgagctcaaagcctgaggaggtcacagcctggctacaagcagagaacttctccactgtgtgagtgaccagtcccctgggggatgaggggcggtgagccctgtaaatgggagaaccacaggctccattcactctcagagttagagagtgtgacctagcttccactgtacttgatgactccatcttaggctttctctgctgaatgaaagctgcttgtctgagcctagggtaggtcacccagtgcagaggccatatgtagtgaaagagaaagagtcaagggtagcaaattctggaagaacttgggctgcccaccttagccacccttcccttccagaccagtcttttttaaagtgtttctgccctcaaatctcggagttctgtggttcactgagaccaaaccactaggtgtatccctgtacctgcagatacctaattcctgtaaccccaactttccttctctacacaaatactaagacctagaatctgcccaccctacttctggtggattctaccattgttatttacagcactgtaaggaccctcgggtccctaatgggaagccagctacttcacatgagacctggggagctgcagatgctgtgtccacaggaggctccacggatccaggcccggctggacgctgtcagaaggatgctgggggtgaggaagctctgggatcctgactcctattcagaggaatttaattctcctggggtgagaaagggagagctggggacactaggcatgggctattcctctggggactcagctccatccgttcaggtgtgtcttgaagttctaatcgcattggtgatataaactctggggagtccctcactaggaaccagccccatctgaattgttttctcccttcagatgactcattagagaccagctcgaatacctctaagaccaaggacctctcatgtgcaagatggagtatttggtacccagttagagcccctggaagtcctctttcagttagtggcaagccacatatcctggatcacaaagcaaagaagatgaacaggtccagacactgaggcaaatggtacctcattgggttggagaccctcaccggttactatttattttaccccacaccctaagttggcatacttattcccagtcttactcctgatctctttagtcccaatcctgccaataaaaagcatcgtttaacttgttctatgaccctctccttgccatttattctggacctgatgggaaccaaagccaagagagagcagggagttgggatgcaaagcatgaaagagcaacaactctgcaactgaaccgaactgaaccgaacagaacagaacggaacagaacggaaccacagctaaccaaaccaagctaaactaaactataactgaactaaagagaattcactgtaacctagagcctttggggactatggtacattctttctcctctctaaataaactccaaaatgaggctacatgcaccacctctgtcctatggggcacgactcacaccctaatccaaagtttctagtccaactgtaggcacagcgtgtcaccgagacaaagaatactctgctgacagctgcaggctttcttcacactggttggtgatgcagaggagtctcgagtgaggtattttgtgctctccttgggagctttgtctttcaagcaatggttgttaggcaagtcaaccttgagctccctcccacctgtctcttcagtggcagtacacaggaacattgcactgggaggtgacggtcctcaggtccactgtgtaaactcaggcatgttggtccactccttggctctctgtcctagggttaaatgaagagttagggctgtctatggcttgtactctctattggtgtatatagtttacttccggctcaaagctcatggaatgaattcttctccatggaagagaagctatgcttcaattgagataccctgttgttaaggtttgctgttctcatggattcaagagcccctaacaggttcttaagattgtccaggaaatctcttttggctgaatttatccaagactgtaacatcatcccgagctaaataccttattttcagatggactctatcattcactctcaacttcctggcctcacaaaatcctcagtaacactgagtatgaaagcaaaacttttacctcaaaggaagggggtggggggagagggagggaaaggccttcagagttgttaggggcaaggtagccaattcagaaaagttaaggtcttcgaatggaaggagccactatcccattggccttggcccatcttaaagctgaaaaccaggggaaatctataggattaggaaaaaaaatgtgctctaccccagtgttcacctaccttcatagaaaagactgtggcaaggtaagaggctctaaagttagccaagcacagggagccagcaaaactaatgttttaggccatcctcagtctgcatcctggaccatccagggaacttgagtggtccatcaatcttctccaagcttcaattccttgttctataaactgggcagaacacctaatcacaaagttatttagcctgaattgggatatatcatgaaacaagtagaatacttagactactctagaagttttagactcgtggctcaagttaatttgttgctggcttttgttttcttgggaggaatcaacccaggcattatacagtcacatgtctctgtaccatttcttctttattttagaaaaatgtccttttacaaagtctgaagtttgagtcagttaaactaacggggagacataatttcccacacccagacttggggctccgggaggcctggtgtcttagtcaggatttctattcctgcacaaacatcatgaccaagaagcagttggggaggaaagggtttattcagcttacatttccacattgctgttcatcactgaaagaagtcaggactggaactcaagcaggtcaggaagcaggagctgatgaagaggccatgaagggctgttccttactggcttgcttcccctggcttgctcagcctgccctcttatagaacccaagacacccagcccagggatggtcccacccgcaaggggcctttccccttttgtgctgttttactccacaatatgcttatcattttccgactaacttgtggatcctgagcatcagaatgaggttacctggggctggagagatgactcagcagttaagagcaccaactgctcttccagaggtcctgagttcaattcccagcaaccacaaggtggctcacaacagtctatagtgggatccaatgccctcttctggtgtgactgaagagagagagcgacagtatactcacatatataaaatgaataaataaatcttttttaaaagatgaggttacccttagtggagttgtgttttaaatgtaaggtactaaaacaaaaaaatagaagacatctcaataattttcatactacattctgaaacagtatatattgggctacgtaagtatactatggattcattgcctccttaaaaaaaaaaaaactagaagcaaaccatttaaaaacaatcatatgtctgtcttgcattatactgctagtgaacattatgatctagatcctatacactccccacagagcagagagaaaacactcacaccctctgtctgtctggctgtccataccctttgcaacctgccccaaatgcttaatgttttgactcctcccataaaccagcctaactcgacagcacctgctgtttatcttgcatagctatttgtcacctttcggtgtttgctctaccctcctctttcctggagtgtcctttgaggcatttccaatgtgcatgacctatcctttttcacagtggacctgtttagtgtccccagcctccctcagtcttcacagagccatttgtatcttacatagaaaatgtttctatccccaaagtaccttatacctgaatcgtttcctacctcgtagttttatgtgccagctcaactgtgcaacatgactcacgcttcccgggtaactaaggtccaggcccccactgccagaagagtagatgaagcatcaacagccctgggagaagttcacaccggaggatttcaggagccgcagcagctgcgcctgcgcaccgcccactgaccacgcggagggcgggtggagcatagagcgagagaggaggagacagttcggtcgcgtcagcccggcccacagcgtccagtataaagttagccgcccacagtccatcgctgtatccccgaaggggctaagatcgcccaaaatgtcatccaagtctatggttctgggttactgggatatccgcggggtgagtggtccctcgccagcccagcctctgggacagagaggtgcaggcggccgggcgggggtcaggggccggtgggccgatctccagcctacctatggggtccccaggactgtgggtagaggaataaggtactggaagttcccgggcgtgagcgaaggggctgcctaaggacaatttccctggacaggacgcaggagcttggcagcgttgggttg

SEQ ID NO: 148 - DNA, 2671 bp, Mus musculus
aatcagcaagaggctttattgggaacacgggtacccgggcgactcagtctatcggaggactggcgcgccgagtgtggggtttttaccctttttatagggctggggctggggagcaaaaagcgtgggtacagaagcgagaagcgagctgagtggttagtttaaatcaaggcttggggtatttcctggtcatttggggaacctgaaactgaggtgggactttttcagaaactgttgctggttccgctttatctgggtaccatctgttcttggccctgagccggggcccaggtgggtaccatcggttcttggccctgagccggggcccaggcgcttgaccaccgatataccctttttggcccttgtcctagtattattcagccttgatttttaactgttaatctttaactgaacttccttgtaacttttgagaactcagctctggtactttttcatgccttgcaaaatggcgttactgcagctagcttgctaagccttatggtggggtctttcattcccccctctttctggaaactgaataaaatcttttattcacgtgattccactgcttctggatctattgatttgagttggtgatactgttgggtcagaaccagggcctgcaccaccgaaattctgtcttttacaaactggaccaagcggttgagaatacagggtccgaagagtaggattaataaaagtactatcagagggcccataatggtggatatcagggtcgtgaaccatggggacctgttaaacagtccctcaaaccacccttgtcctgattcgaacaatttttgtctctggtttagtctctctcttagcttagccatgctatcccttactacgccagtgtggtccgcgtagaaacagcattcttcttttagggcagcacataatcctccttcttttaggaacagcagatctaatcctctccggttctgtaggaccacctcagacaacgaggtcagagacttttctagggcactgactgatttttctaaggccccaaggtctgtatgtatggctgcctggagctgctcgaattgtttggtggccactagggctgtagtccctgttcctactcctgcagctatgccgcccatagtaagtcctcccaacagcagggccagagttaatgacaccggctcccttttatatttggtttttctctcaaactggccataaacataaccaggggagtggtaggtcacctttggccagagctcaaccaggacacagtaatcggtggtgaggttgagtacagtagtagataggcagggagtgagcccggtgttgcaagcccagatggtcccggcgggagcagccagatagtaggacccgtcgctcgtcttctgggtggtattacacagggcctgatgggttttgggaactgctcctacgcagagtccctgtccggtcacttcggacagggtcagcttgtgttgggaggccacggagcagttagctggggcagaggtatggttggagtaggtacctaggacggcaaccccttcgtagtaggggggtcccgataccagacacaaccagcactcttgggttttgtcaggactggtgaggttgagtgcttggtaggctccgtctaccagatttagtagcctgtctcctgtcccaggctgttgagaaggcgggggagccccaggtaccatagagaccgtgcctgaaggaggatgatgaggaggcctggggagcatgatctgcacgggttgggatgggggtagctggtcagtgatcacgggattaggcccaatggggacgcggggtcctacattgaggacctggcgggtcaaagagaaccgggtcaccgggtcggcccttgtggatcgatagagtcttagtccccaaactttgggggcatcccagctggcctttttacccgcgtcagtgaattctaagactagggggttgcatcgaccccccggtgtagcaccctggacgccactggagaccgaggaatcataacaggggccctgatccttaggagtgtttcctcgcttaagggaaattaggtcccatgatgatgagggcttccagtatgcctgtccagtggtctcacatccccatttgccacagtagccctctcccggccctccacaccctattggtacagtatgaccggagcaaacatagaagtcatacagtcttgtcctttttcttcttccgggagagcggcaaccatctccatctgggtcgtcccagtagtctcctactaaatcacacaggtcaaaatatagtttagggaaggtgtctgtcatcgtccccaggagggaggtggcgttagctgtttgtcctgtcattaggttggtaactctccaagtaacattgaagacctggtgagggctgtcacgttgtcccgaggctcctgcccccactaagatccccataactatcagggggccccacgggttaatcttatctttaagggattttgagaacgctggaccttccatgctgttccggccggaggagttgtcgccgcctttacgtgagcggcgtgtatccacgcagagatgccgtctactttgagagcggtgggggtggtcagtaggacggtgtagggtcctttccagcgaggttctaggttcttagtctggtgccggcgtacccacacggcgtcaccgacacggaaggggtgtggtatcactggctg

SEQ ID NO: 149 - DNA, 1909 bp, Mus musculus
tcgcgcccggggcccaccgcaccagtgccagttgttcacgttggtcccgtcctcccgctcctccacgatccagcgcgggtccccctggccccacttggccatggcggcgctgacgacgacggccctggtagcgggagcgcgcgggtttccggccagaaggtctgtgagccgatcgcccgcagctcccagaaagtgccagaagtccccgccccgggccgccccggccacagcctgccccgccccccgctgtccgctccccgcagccagctccaccccacatcgactctgccccaagcccggttacgcccccaatatgccacacctctgggcgccgccctctgcaggcttctcccccaccccacccccgacttcgccccgcctctctgccctaagaccccgccctatgcctcctggcgctgtcttctgctaggctcctccccgacttcgccccgccccccggtcctaaggctccgccctggccctagccctccgctttgtaacccctggttcgccttgttcttgccgctggctcctgctgcccagcgaggcttctggccagggctttctacgaacgaccgagactccgcccagggctcgtaccagagcgggttgtccattttctgaggcccttgggatgggagctgcgcaggtccctaagcagaggcccgcgagggtttactgaaagaatgctttttttttttccatgcagtgatcctctagagacaaaagatcgtgcttgcaagtgcctgggattgtggatacagttacaataagggtttattaattctttccatcgtttttcaccttctagcaaaaactgaagccaccatctggaaagtgtttcttaggagattattttaacaaataaaataggtagttcaatgggagatggggaaggacctggctgctctgtgcacttgccattcagtggtctgcttatcagcaaaacaagctgaaagggctatggtgtttattggagctattgcatttcgatgtgttcttcgagaagttacatcattcaaactgctgaagcaatgctgtgacccccccccccaaatcaaacggcattgttagttcaactgatcataccaaaggcacagctgacagaaggcaagactctagcgatgattggcgtgtactttgtgtgcctacttttcatccagttcttctgtttgctcctgataaaacatttcatgataagatttagatatgttcatttgaacctgacagaaaataagacttctgagggtagaagctgctacaatcactaaaatgtataaataccaaaatatacaagaactactcccagtagaaataaatttactggaatgtaactcgattgtgagtctaggagaccaatggaccctgaagcactcttcagatctgcgatttaaaaatgacctccaataagacattgcaaaaatgggaaagaaacaatggaaaaagtaaaagagtggggaaggtggccccgaaagaaactgtcctagaaaaagtactgggtcaatagctagtgaacaaaaccatggtgttcccacaccccctggggggggcatttatagaccataacaataattgagacatttaagcaatttcagatgtccaaagttaattgaagctttctttaattttcaagaaatgataaaacaatggaaaaagaaaatccttgcctggcagtgagtctgaagacagctgatcaaaggggaagaagtccagccacagatggaagagagatgacctggacagtgggctgcagtgggaaggaagccatgatttcaggacatgaaaagtggagtcacacgaggctcactgggtgctggtgggaggcagaggggtgtacccttaaactgtaattgtttggtgtaaacagactgaatttgtgtccttctccaaaacatgggcttgataattg

SEQ ID NO: 150 - DNA, 31341 bp, Mus musculus
attagaaccctttatatttgtctccaaaatggcctattaatattagtatcaaaatataataaagcataaataactttaaaagttctatagtctttttaaattcaattgcattaaaaagtttgaaatccagtctcttaaaaaacctctgaactcaaagtctttctactatggtctcctgtagaatcaaaaatgagcttattaaattctttctttcttcaagagggaagaaccagggcacagtcatagtctgaataagggaaactcaaactcttaactgtgtgtaaataactgtgtccaatgcctgagttccgcttaccattaaccttctggggctgctcctccaaaaggcttcggctagttttctggctctaatggctacaggttgtctcgtaggcttagacaggttgcactccaccattgctgcttgatggtcttcctgctgtattatcctcttcaaaatagttggctattctaatgcagctgggctgccctttcacaaataacctctcctgggctcttctttttcttactccttcaatccttggcttcacttgcttttctggctgcactttcaccaatgccctctcctggcttctccaggtgccaagcctcagctgctctctgatgatttcatgcctttaaagccagtactccctgggggcccaatctggctcctgtagcagaaataaagggttacttcatcctcgcagcatccctttggtggtctcgaggagacacctcccagaagatgtcacctcagtaatgtggtctcttcttaatcaccactaatttctcagctccagctgaccagcataagttgtaaaagtttcactgttgcagtagtagtggtctcttaatcgtggctggctctttagcctcagctcaccagaaccacaaagtcttaattcaaaatagaaaatggttctgatagtctttcaacttatccctgaatttcacaagtcaggctatggttatggtagccaatgccaggagggttttctgaagggagcagagacaggaaaatcatgagcttaaagccagcacaaaaagaggaaagacatccactttaagcattgttcacaggagagaatgaagtttttcattagcattagtagagccattttagcaaacttacttgtttgtgttggtttttctttattaatgccagaaaaaacccaaactgatgagtctaaaagagtcttcaatggcagatgccagcaagcatggtgttggaacggaatcattattttttgataaggtaagtaattggtgacatttgatatttttgttaaagacaaatggcataagtaattgataacatttgatattagttgttaaggacaaatggcaattgttttcttttaaaagtgtcaactgatagggattatctttttgcaggctatttgacttttgtttaatttggagacagactctatataacccaggttgcctttgaactcattttttacttcgcctaggctggtctatagtttctgatcctcctttggcctcttaagtggcactacatgtagcctacgtgtagttgtccgtccacccattgtgtgtgtgtgtgtgtctttttcttaatttttcttttttaaagaagtatttgttttgtgtgtatgggtacactgtagctatctccagacacaaccagaagagagcatcagatcccattacagatagttgtgagccaccatgtggttgctgggaattgaactcaggacctctagaagagcagtcaatgctcataactgctgagccatctctcaagccctgtctgtttctgttttctttctccttttattctctaaaggttagaatctcactatacagccttaactggcctgggacttcctgtgtatatctgcctgcttttgcctccatagtaccaggagttcaggtgtgtccccctgtgctgtctgtcttttactagtagtgctagtcgtgaagcccagtgctttagacatgctaggtgtgtttccgctgtggagctttgattcgacatttggttttgagatagggtcttataactgcccagatttgcctcaactttgccctgaagccaggaatgacttttagctactatagatttcactccttcctcctcccagtaggctgtagatatgcactgtatgcccagcttgagaattctattggaatgttttcaaagatcggtaaggtgtttttatgcagtagctagaggtgaatttttgataagacaccatgaatgctacttcagtttgacttctgtatctgattttgtccttggcgtcaagttgatgattagcaagcaggttccacagtgaggtaggcagctggtgggcttctcacaggacacaagtctgaattggtgtagtcattgttacactatcttgtacctctgggtatttgcagaaaacaaattatttaatagccttttctgtctctgtgactttaagagctatcctgatgaaggataatggtaatattacatacacatataactaaaagagtgtatgtaatatctcaaagtcttttttaaattcagtaaaagaaatggttatggatgatacagaatttgtatgtgtttatcattttggttgagtgatttgattaggctattaggctattatagctattgttggctatctctctactttttcataggcttaaaagctgataaattaaaaaccaataactggcatacagtacaaaaaatgtagtctgtcaaggattgtccatctgtgattcccagtgtgttctgtgtggtgcctcctgcaccacaggaggacataatctgtactaacaaacaggtgtgttgataagtcctgggcagaagatgcacagtgctaataattgtcttttagatctaaaactccagattcatagacctcgttatgtagttgtacattttctgtaaactgttatacattctacaactttgagtctttaagaaatgttttcaatgctgtgagtagaataatagcctatgtgcatgtgtgtgagagaaaacaatggtgtgtgcacatgaaaggcagggtttcttcgttgagcaccactgaccgctccagacagctggccctggcgcttccaggaaatctcatgtttatgcctcctatcttactgtaggtgtgctgacagttcagatcaaaccctcctgctgcttctggctttgtgatttctggaaatccctcctctgacctcaaacttgcttggcatgtgcttcattcattgaaccatcttttagtcccttgtttgtttggggtgtgtgcattagtgtgtgcattagtgtgtgggtgtacttgtacctacctgttcctgtatgtcagtgtgtatgtatgtgtggaggccaaaggtcaggtgggtgttgtctcttctaccttattttttgagataagaactcactgaacctagacctcactggttgcctagtgtcttagggtattattgctatgaagagacactgtgactaaggcaactcttagaaaggcaaacatttagtagttggggctggcttacagtttcagaggttcagtctgttatcattgtgggaaggatggcagcatccaggcaaacatggtgttgaaggagccaagagttctattctacatcttgatccaaaggcagccaataggagactactgtatgacacttggcagtgcttgagcataaatattacctcaaggtcccccaaaactaaagtgaatagtaacgcagcctgtgtgcgtgtggacactgtgcctcatgtgcacacttgcttcccatgcattctgtctgttttagattgtttagagagaggttacagcatcctattgtctccttttaaggtgatttctttgatcatatctaaacaaaatgacatcaattccttagtaaatatctgatcaaatttaccctgcttctctttataaccatttttcttctggttgtttctacaaggttcgaaaggctcttcggagtgcagaggcctatgaaaacttccttcgttgccttgttatctttaatcaggaggtgatctctcgggccgagcttgtacagctagtctctccttttctggggtaagtgaagtgaagagcgtgccccctagtactgtccatatgccaatgtagcagtcgttaagagtgtgtgattgataaaggtgttatcacaagtttcagcgtcagaagggcctttttaagccttgtattgtaacttttaggatgggaagacagctgggtgtggtgactgcactttaatcccagcactagggaggcagaggcaggtgagtttcaaaccgcctgcactacataccctagctccaaaaaggaaaaaaaaggtgctggcacagtatcagctatgatgcagtacttaatggtctcttgatcatctgacctgcactagattatagatcagggctcttaattgcatttgacatcctgagaattatgtgaacagtaaagcaatgttcttgatcaaagaatgtctttttactgtcttgttggagagcattctgtaaggaaaatggacctaattgattaacgatgcttctcaagttggaaataattgtctttggaatttgtctttggtattggagttgtgatccaaccataagttgtaatgttgtttctcacgataactgtgtcccacctggaattgcttaccagcttttggtttggttcttcaggaaattccctgaattgtttaattggtttaaaaactttttgggctataaggagtctgtacatctggaaagctttccaaaggaacgagctacagaaggcattgccatggagatagactatgcctcttgtaaacgactgggctctagctaccgagccctaccgaaaagttaccagcagcccaagtgcacgggacggactcctctgtgtaaagaggtaagtgccggtcttgggtcttcagtttcttctaatgagggtagtggtagtaccagtatcagagtcttcaaagtctgcttgtcagggtaggtaccttttcctctgctactatatggggccccagggtcaatttcagttggctaggtacaatggcaagtgcccctatttatgtggtaaacgctctttcaggaaaggccaggatttatatgaattgtgaaatcatgaaccttttctctttttttaccaaaagaaaacttgtattcagaactttcactgtcatagtgtttctgttgctgtgatgaaaacactatgaacaaagcaacttggggagaaaactatttgccttaaacttcatcactactcatcactaaaggacgtcagtgcaggaactccaatagggcaagaacctggaggcggggtctgaagcagaggcagtggagaagtgctgcttactgacttgcttctcatggcttgttcatcctcctctcttatagaacccaggacaccagtccatggacagcccccccccccttatcgtttactaattaagaaagtgctctatagttggatcttctgtattgtcagttgaggttccttccttttagataactctagcttgtaatcaagttgatataaaactagccaggacatttaccaaatttaaagtttgggctaatgctagttgatttttcccctcttcatttttttattgagaaagtttaatcaccaataagtttttacaggcctttctgcctcttttttttaacctaaaggttttaaatgatacctgggtttccttcccatcttggtctgaagactccacttttgttagttccaagaagactcagtatgaagaacatatttaccgttgtgaagatgaacgatttgaggtatcttttgtcatttgatgtttgggaacaaggaagataaagaaagaaagggatatttagatactgtgtgtgagttagctttaaaaaaaaataatgtaagaggagacagctgatcctggtagtgcattgcaggaaaacttaaactgtaaaggtcgtagctgggatgggaagatgtagaatgggagtcagtgggacaagtctcctgttggtcaaagggactactgaaactaggcacagagtctgcattgcccagatgatggttactaagaccacaccagaagggaaagaattgtagtctgcatgtatctgacttagtatagtgatcacactgagttgactagttctgttccttcagatcgatgggagaggtctcttaccagattaacactgccagcattccttcttgaaaacatcatatattgttccccaccggctggcagttaccatcttcccccatcctagttacgtgtttatcactgataagacaccatgactaagacaagttatacaagagtttaacttggcttaccgtttcagagggtgagagtccatgatggtggaaggaaggaacagctgatagttcacattttgatccataatcaggaggcagagtgaggcattgagaatcactagtctttgaaaaccaccctagtgatgcatctcctccaacaaaaccacacctccttatccttcccagacagtctcaccagctagggactaagtattcaaacatggtgcctggggcttttcttatccaaaccaccacatacgtagagttaattatagaaaactacagatagatttatgaaagtgtagtttctctgtgtagctttggcttcctggaacttcgttgaccagactaaccctggactcagagatccacctgcctctgcctcctaaatgctggcattaaagatgtgcaccaccacttcacctggcttctatgggaagttttcaatcaagctggagaacatatttttagctaagggcagtttagagtacctataatcccttgagagagaaggcagaaggatctaagaattcatggccatccttatttgcataaacagttggatggctgcattggatgtgaagcagtaatacagtaccccaaacccttttactctcataactgtcttttaggattgtttccttactatttgtaacaggtttatacaatttcagaaaagttcataagcaagatatgaacacattttgtagtcccagcctttaggtggcagagggaacaacttgccacaaattgaagggtagtgtggtctacatagcaagcccttgtctcagaacgaactaaggtgcaaggaaaggcagtgctgtgatagctctctctgctcccactggcctctggtcagcagtgctaaacagtgtgcaatgggttgcagttagcattggtaactgctagtcagtttatgtatcagtattaaactttatgaattatgtacatggcattttttttgccagaaaataaccttatgatagttgtaggtgtccttgttcatattttactggtaagagatccttacataccttgtatggaaatcacaactcaaattgggaggagtttgacaccctccttattctcccagctctgctgtgttctggtgctaggcctgagaccctctttgttcttttgttttaagcttgatgtggttcttgagaccaatcttgcaacaatccgggttttagaagcaatacagaaaaaactttctcgcttgtctgctgaggaacaagccaaatttcgcttggataacacccttggaggcacgtccgaagtcatccatcgaaaagcactccagaggatatatgctgacaaagcagctgatatcatcgatggcctgaggaagaacccctccattgctgttccgattgtccttaaaaggtatgtatcttctggcttttgtgtgctgtgtgacaggttcagtgtcccattaaatagggctctagttttctacctgagtatctaattggaatttcagttctttcctcagtagctcaacactagggatagagtagaatggcagaacatacgttaggggttttgtggaacaaatggaacagatgttgacaggtgagggtgaaagacttgaggtgcagctcggtggtcgagtgcttgcctatcatgcatgagtcctgagttcacacagagaaagcctgatgagtgtatggtagagtgtagtgcgttcacatttcagggttgggctttgtttctgttggtagaagggaacttaggactgtttgtatactatgcttgatagggaaatactttaccctaccccagaccgcaggcgtttgagggactgtgatgtgtgtatgtgtcggggtgtgtatggtgtgtgtatgtgatggctcagaatgagttcaaacctgcaatcttcctccctcaccacatgccctctctaggaaacttgcgtttccatgagcacagtaaagattctgagtcataacaaagaagcaagttgctttagttagttgggagaactagttttttgagaatactccccaaaaccagatgtggttcatgcctatagtcctcacattagggaggcagactcaggaagattgctgtaagtttgatagtagcttggtctacatcatgaattttaagtcatccaaattttcaaataaggtcttgtctcaaaaatggtttcatgctccctcttaaaaaccccattggtgataccactcactttgtgaatattcatggcagccaaatttgacttctttgcctataatgtcaggattggggaagtagaaggcagattgccatagatttttagattagtgtggtctatatacattttccagtaagacttgtatcacaaaaataagctcccttaagaaaaaaacctcacttggataacaccaaggacattttttgaagcaccaacagcataggtctgagttttcatcaagtgtagtaagcccgcgacacactcccgcatttaaccctctcgattcccacatgctgtacttgtatcccttctcacctgctaggttgaagatgaaagaagaagagtggcgagaagctcagagaggcttcaacaaggtctggcgagagcaaaatgagaagtactacttgaagtctctggatcaccaaggcatcaacttcaagcagaacgacactaaggtcttgaggtctaagagcttactcaatgagatcgagagcatctatgacgaggtgagctggctgaccgtacagctccctcagctctgcttttttgtgttcagccttgctttgacttctacagttaactaagaactgccagttcttgtatcatggtctaccgtcttaaacctactactcaccgattcactcagttcttcctctggtttcccagtttaccattctgcctttaatgtacactcttctttttttttttttttttttttttccattttttattaggtatttagctcatttacatttccaatgctataccaaaagtcccccatatccacccacccccactcccctgcccacccactccccctttttggccctggtgttcccctgtactggggcatataaagtttgcaagtccaatgggcctctctttccagtgatggctgactaggccatcttttgatatatatgcagctagagtcaagagctccggggtactggttagttcataatgttgatccacctatagggttgcagatccctttagctccttggctactttctctagctcctccattgggagcccaatgtacactcttctaacaagacctggcatctcctctacctcacttaaaaagtggtagtaaccctgttattctgctcacttagcaggggtatggatggcacttggagcaaagactcagagataaatgtgaaattggtcttgctttttgtgacctgccttaggaggtaggaagcataagtgacatctatcaggctttcaaaagctggccctgagttttaaagaataaaaatagtaagtgaactttaacaaacacttaattgtttatctttgataatttgttaacctttacatgagaaattctttttttttttttaatactttttattaggtattttcctcatttacatttccaatgctatcccaaaagtcccccataccctccctcccactcccactttttggccctggcgttcccctgtactggggcatataaagtttgcaagtccaatgggcctctctttccagtgatggccgactaggccatcttttgatacatatgcagctatagtcaagagctccggggtactggttagttcataatgttgttccgcctatagggttgcagatccctttagctccttgggtactttctctagcttacatgagaaattctaccccagtattttaagtgctaaatctggaattttaaaggtaattctcttaagtcttcaatatatagaaggcactaatctttttatatcaagccaatttgtccatagtacttatgaatatttggaagagagacaaacattattaaggttaactcttgtatttcagattaagtagccactgtcatgtctctgtctaagcccaaactggcctagaatcttgtacccttcctggcttattctcccaaaggatgtaactacagataggtgccacagtgcctaaagtgcattttggttaataataaaaatgtgctgctaatgtactctttgtttgttttgagacagggtatttctatgtatcccttcctgtcatggaacttgctctgtagaccaggttggccttgaactcatggatctgctggcctctgcctcctgggtactaagtttaaaggcatttcccaccactgctcagcatttctggtatagtattgtaggtttgttgttgctgtatacatgtcacacaatgcttttatgtctgttccatcagaggcaagagcaggctacagaagagaacgctggtgtacctgttggcccgcacctctctcttgcctatgaagacaaacagatactagaagatgctgctgctctgattatccaccatgtgaagaggcaaacaggcattcagaaagaggacaaatacaaaatcaagcaaatcatgcaccatttcattcctgacctgctgtttgctcagagaggcgatctctcagatgtggaagaagaggaggaggaagaaatggatgtggatgaagcaacaggagcacctaagaagcacaatggtgttgggggcagcccccctaagtccaagttgctatttagtaacacagcagctcaaaagttaagagggatggatgaagtatataaccttttctatgtcaataacaattggtatatctttatgcgactgcatcaaattctctgcttgaggctgctacggatttgttcccaagctgaacggcaaattgaagaagaaaaccgagagagagaatgggaacgggaggtgctaggcataaagcgagacaagagtgatagtcctgccatacaactacgtctcaaggaacctagtgagtgcttagactgtcagctttatgcatggggtagatggctggcttcaaggccaccttaccttgaagtacacttagtccttagattggaactagggttcgtatcctacctctgcaacttagctggttgtgtaaccttccttgaacccatgaatgaaaccccccccccaaaaaaaaaaaaatggaggcagtatttgtcactttctgtggttgcttgagggcttaagaaagatgcaagcatggaaccttgtacagtatccggttcatggtcatgtgaggtgtttagtttgcactgtggacacatgagggacgtgggatccattggctaggttagtgagcagtggttcagatgagaaagaaacgtcacagttctttctattcataacatagaaattccttgttatgcttatggcacataaggaatcttttcagatgtgtgttagcatctccttaatgggcttcttggttcattcctgatatttctgaagaggaattggcactcaagatggtttgagacaaggcaaagggatagacaggattcaagggaaaggaagcccagaggctcatttaagaagctagctatcattggctgtatgctgggttctgccgcctccttccacataatgctttcattctgaagttgggtgcttaacctgtgagccagacacatcctcacaggcttcccttctttgctcttcacgaaatagtaaataactgctgtaggagtcctgtgtataaacctagtttcttatctgttgaactaatagcaccaggaatctgtttgaaaagcctttatctgttttagtcctagcttggaagaaacaagtagaatttacaaatataaatctgggcttgatcactgtcttatcctggacttatgctgaagcagcttattcttgagtgatagtgccaacttcatgccagtcatagtttgtggctataaatctgtggtttggactcttatcctagtatattttaaaggctagctccctgcttcctgggcttagacaaagtgatgtagtgtgacacaactcaaaccagtaacttgttttaagcagtgattgttcgtttttgcctgtaagatccaccccatttgtcccctttctaatttctccttactaatggatggccagtaatcagtaagtgtactttttgtagttaacatttttgatcaaatttttattgatgtgcaacctgtatgcaaaaaggaacacaaatgagaatctgcatttgtgtggggtgcatgtgccttatgtgcaaggaggctagaaaaggctatggccactgtgttatgtaccttccttctcgagacagcgtctcactgagccccctagagatcctcctctctgctgaccttcacagtgctaaggtgacaggtggtgacagccaggctttcacatgagtgctggggcaggggctcttatccactgaaccgtatctcctgccccacaaatagaattttatggctctaaatttttctataatgagcatactttagtcaaaaaaagaggtcaagaaaataaagccaagccccagtaacttctttgttctactattttggttttcagacttagaaatgagttttttttgtatttgagagtgggtctactgctataaaatgctcactgtcccagaacttgttttgtggcctaggctggcccagcaatccccttgcccctgggattatgtacatacatacatacgtacatacatatgtacatacatacatacatgagctcctggtgcccttcttagttactatgtccttttactagtaagattcactccagctactggttaaatgtttcatgtgcaacaaatacaattcatctaatgtaattactggagttcagtgttgcaaatctattttaagcaaagggactgtgatacaatcagagttattcattttcatagaggggttaatttgaataacttctgtagccaagagttccaagtgtggtagcatctacctatgcctgtcttctcttgtccatactttattcttcattgaggtacactcatgagcaactgtcccctttgtgaaatggttttgtgtaagtgaaggagccagcaacttgaaggactctcttgggatattttgctctcaggtgacagaactcagcagtgctcaaagtgtctttttagcagtcagtctgtgctggaagcgactgttagaagttgcagagtcactgttggttcttcgatggacagttctggtgattatagctgcctactagatgtcatctctgtagtgggttaagttggacatgtttttgcatatctggtattttgtcctttcagatggtatataggccagctgtgggattctgtattctctgtcctcgagcttgtcttagcagagtacagtcttacctgtctaatctttcctgtagtggatgttgatgtagaagattattacccagctttcctggacatggtgcggagcctgcttgatggcaacatagactcatcacagtatgaagattcactgagagagatgttcaccattcatgcctacattgcctttactatggacaaattaatccagagcatcgtcagacaggtgagagggtgtgttggaggttagcgctaccaagggaaggtgttctcagctaaaagtcacaaaggaaaagcaagatttctatgggaaaaggaaaagcagcttaaccatatatatagcagtgtttataaacatatgtctttgaagtggaaaggaccaagttaacatgaagtcttgtgtggcttctccttcagagacaataacaaacatccctttgatacactgacagcaaaccaaagaaatgattctagttaagtcttagtgagccattatgtgtgttggggtcacttaaggaacatgagcaacccaaaggcagtgcagtgaaaagcccactgtacacaaaacctgagtctttgaagctcctgcacagccagagggcagcttgacctatgggagagagtactttccccagaaattgtttctccttttagaagaggatcagaaattcaagttcatccttggtggggatgggtgtggagatggtttctaatttaaatttcaggggatttctgaattttctatttcctttatttcctgaaccttgtacattttgtttactttatgagtctggtgttactgctcagagaggatagctcaataagtctctctccagctcacagaactggactcttccagccctggaattggttcttaggttctcaatgtgcccctcctcagagcctgtcctaacagccatttgtctagaacacagtcctacctctttatttatccaagaagaaagcataggtgtagcttagccttttccatagatgacagtgattctgtttatttgcctcatttagtattaaaagtcctgtacagtgctctgcccacctcattatctgagactcagtgttagatttgtggttgcttttatgttttgttcctggaaattttaaatatgtggagttgtttgtaacaggatctcactatgttgtactgtctgactgagaactaatcctgtgtacttcctgagtactgagattataggtgtgaactacaacgcccagccaatgtgatactttctaactgtcatccttctgacagggagcatccttgtctcggggtttctgtggcggcattgttggcctccctactgaggagtaggaaaagccagtaaaataaatgtttcataaaccctatgttatttttaaatagataattcatttatttagaagaatctggttataaatttatgttaacgctgtcaacatatttttaagaactggaaatgggagttgcctccagaacccacaaccatgagtttttaagacatgtttaagcttttcatttgaactcttcagtgagttttgtctgattatgttttctttttatttggtggtccctttggttgaacaaatatcaaggtcaggccatatattcgtcttaattttctcaggctggggctttatttagctcaattggtagagttaattgccaagcatgacaaagccctgggttggattttctgtaccccataaaatgggtgtggcactactcacctcagcgtttggaggaagaagccagaggaacaaaatgtgaaggccatccgcggctacatagggagttcaagggcagttccccatacataagatctctccaaaccaagaattctaagtaggcaggctcagtcatcttagctacagaaccatgatacaatgtcatcctgtgaagccttgactaggaacgcttcccttcgtcccaggcttctccactctagtgcttctctgcacgtggacactcagcatatcagcatacacttccggcctctccatccctcgagacttgagcacctctgggcttggtattacctagctttcccatgcggtgcttctctttaacagcaacaacaaaaatcttggaaaaatcatccctacatcatttctggttacctgatgaaatacttaatgtatggctgtacataccccatcgttgtctctggatttgtaatgcttccatttctaaagattctgagagaggcagatacctaaaagaggatgtgaatagagggtcagtggtacatagtcacacggagagaactcatgtcttggctagactgacttttctcactcttctcccccacttaaaactctgtgacgctttcactgtctttatcaagtcataacattccttacttcaatggtattgtccaagtcttttatacttcacaaagactgtatcttcctaaaaaatagaatggcgtagtaaccatgataacatgagattaactaagtaaaattgatgagtcagtattgaaatttacatttttgcttctctgctttttagggaccagttggtttggtgttaggcactgaatgtaagactttgtgcttgctaggcaagcctcatttcctgactttaaaggttttcttgttttgctgtatgtgtatgtggaaatcggagaataacttacgagagtgggctctcctgccactgcgtgaatttcagggctaaactgaagttgacagttttaccctctgcgccatttcttaggggacttttaatttcacaataagaatagtagagtgggaatggatgttacccactgtggcatttgttgtggcctgagctggtcccagcagcctttgtagagttaatataaggcactgagtctctgctaagccttgtctcctcccctcaacaacaaaacaggttcacagtttccaacacgtttaccttctatgaaaaatgagcagttaggccaaggatataactttacatagtcctgggtttcatataactcagtcttggaaaaaaaatagagttaacatgtacaatttgagggttattctgtgtgaatgcactaattagtggcctgctagtgaggacgctaccttggtgcaggagcttgaccttgaggcttggtctgctctttagttgaattcatgggggcaggtgacgctgcaccagttgcttttttgtttttgagacagggtctatacataggcctgggtgtcctggaactcactatgtagaccagaccagtattgagctcagtgattgcctgcctatgctgggattaaagtgtgggccatcatacctggtgtctgctgcaacttttaagtttaggaatcctagattgagcctagcaagtagctcagcagctaaaagcacttgtagttcttgtcagcacccacgtggacgtccatgtcctcctgtaactccagttccagggaaaccagtgttttcttccagcctctgtctatgggcaccaggcataatatagctgacacaccacaagcttacacacaaagcacataaagaaaaataacaaatatttatttaaaaataaaatcagatgaatcttgttttcagaattctttgagatacctgtcttaactccaagtctcaaaagttttaatgtcttaacacaaaaaaatttctcacaatgggacatccctccattccaacatggttcacagggtaattgtagattggataagaaatacatgtgaaacaagattgtaaacagtttaaaagtacatggagaggggacacacaccatggagcctggtaaggtggtgcatacctgtagtcccagtatttgggaggtgatagtacttagcttcttaaattaaaaaaaaaaaaaaaaaacaaaacatgtttgtaagctgcctgcggacaggagaatcggccctggctcactggccggcctgtgctttgttccagctacagcacatcgtcagcgacgaggtctgtgtgcaggttactgatctttacttggcagaaaacaataacggagccacgggaggccagctcaacagtcagacttcaaggagccttctggagtcagcataccagcggaaggcagagcagcttatgtcagatgagaactgcttcaaggtaagagccgctcatcgaaccgtggaccccagtgctgctggctagactggtacaggctggactggggtgtgagccatgtaacctgagcaaccatttactagcaaactcgtactagcaaatgtttactgattttttttttttttttttttttttttggttaggattgatttttatgatttttatgctttctcttcatgtgtttgtccatcacctgaatggaatgtccccagaggccagaggcctctgtcctgtcctggaattgagttagaccatgtggttctgggagtcaaatccaggtcctcaagtagagcacccagcactccgccatctctgcagtcccatttctaccttaccatcaccagcttttcagtacctttcatatctcttcctttggaacaaattgtataatttacctttctacttacactgtgacaatctaggtttatagccttgaaattttagggtttgtttgtttgtttgtttgttttgtttacactttgcttcttttttgcagctaatgttcattcaaagtcaaggtcaagttcagctgactgttgagctcctggacacagaagaggagaactcagatgaccccgtggaagcagaggtgtggacagtatgtttcagagcttgtctgctcaccctgaattctgatgggctgtagctccttaggatgtttgtgattttgtttttagggtttatttgtgtgtgtgtgtgcattgtgggtgtgttcaaaggactaaagtcctctaaagagcagccagtgctcttaactactgagccatttctccagcccctccataggttttaagtgtcaggatgtttagagcgcaggctatatcactccctttggaggctctagtggtagtagccatttagagtcaatgcccccttttcatccttaataatgtgggtaacagctttgctggccttttctttttgtttttcttcctaaatagcagtaaacatggttcttttgttttgtggtatcatttgatacagcctcatgtttactttttagtaatagccaggctacatagatgatagaataagacagtttggcttacatttccaaaaactttgcttcaaaagctgccagaattctacatattaatgtgggagattttccgtgacactattttaccatttcttcagattatttttgataaccatcttaaatgtactatcttgctggctaacacattttaacatatgtatttcaataacaacatacatatctttcaggtaaggggcattactttttagttttacactgttggcgttaaaatagacaagcactttaccactgagctatgacccgagaacctcccctccttatttatttatttatttatttatttatttatttatttattggataggcttagtctcacaggtgagagaattgtttttgtatgctaccacagtgactatttattcttgaagtctgttttctttggacattttggtaacagattagactcgtgttatataggtatagatagctgttttcatgatcgtgtgtttatattcctagcgttggtcagactacgtggagcgatatatgagttctgatactacttctcctgaacttcgagaacatctggcacagaaaccagtatttctcccaaggtgagtctgcaaagtcagctctattggcaatatgtgctgcacacagccaggagtgtgcagtttcagggtctcggtttcctatattgttcatctgttctgtctgctgagggtcgtgttagagtgtttgctggcttacctgtaaaatctacagcattcaagaggtgagagcattagagaacctgtagttctccatcagcttgctgtgttagtatgctcatggctcagtgattcacttgcaggacgaagcattacagcaacactcagagaactacagttaccacaagaaaatacagagcaaaatcagcaagggaacaatgtgaaggagataggcacaagcatccaagagcccattcttaactcctctaaacgagtgttgtgtttggcagcacttccagcacttggaaaacagagacaggtggatctctgtgagttagatgccagactggtctacaaagcaagttacatgataggggtatatggagagatcccaatgggggggtggagtgagggaggagacctcacagacagacccttctttgcttgtacaaaattccagacagaagattaaatattctagtttcagtgaaccgcttttgttgtttgggggatgggagaaaggacccccacatctcttctagcagctttgtagttcttttctgtatagaatttttaaaaatttaccagtatctagacaaatacaatattaacattctgatttttgaagtagaaactggatagatgagccatgtatatgtttatacctgtgatcctggtactggagagattgtggcacaaggattgctaggagttcaagacaagcctaggctatactatacaactcgtctgttttagtcagggttctctaaaggaacagagcttagaaaatgctctctatgtatatagaaaaggtatttattataatgtcatacaggctctggtcctgctaatataacagtggctgccaatgaataggaaggtccaagaatccagcatttgtttggtccacaagtaggttctaatgctagtgaagaaatggatttgctagccagggcagagcaagtaggcaaatggcaaaagcttttataggcgtctagcagaaggtgtggcccagatctttgttggatcttcccagctcaaaagatctggattaaacatgtgtctccctgcctgaaagatcaggatgagaagtagatctactttaaattaagcaaaaatccctcagagatgtgccctccattttgggggagtttagttaattccagatgttgccaagttgacaaccacatcacacccactaataaaaggattgggtatgaatttttcctttaaactttgagattaaaatctctatcatagattcctaagacctatattcaagtgttactgggtttagtcccaaggagagcatggaaagagcaggcacctgaagaaaaggtcttcccaggttccacacacagtgatccacttaacagacctgtagcagttgccacgccccttgaagtaagatggccatggactctcttatcttatcatgccacaatttgagatttgtttcgttgggtggcttttgatgtttcacacagggtctcattatataatcctgtcaggcttggaactccgagcctttgccttcgagaatttggattaaagctttgcaccacagtttcaaacactttacaatcgaaattattttccagagctagaaagatggctcagtgggtgaaagcaattcttttggaggctggaagatagctcagtggttaaagagcactgattgctcttccagaggacctgggctcaattcccagcacccacctggcagctcacaactgtccttaacttcagttctaggggctttgacacctcacacagatagacaagaatgcaaaaataccagtgcacataaaataaaagtaaaaggagataatttttttcaaaaaggcacttcttcttgcagactatctggggttcaattaccagttctcacagcatagtccacaaccatctagttccagggaatgtggtggccccttctgaccacaggcaccaagtatttacatggtgcgtgcatgtatgcttgcatacagacatacatacatgggatcaaaatgctcagacatagaaagtaaatcttttataaaagcccattttcctttattctggttagtacatggcaacagtagaaattaatttttacttaattgaagttctaacagtttagggcaaaaacctatttttcatttgcaagtataggactgtataacaataactcaacaaacttgaagtcatctaattgaaaagtgaaaatgggcatgtataacaataatttcacagattttttacttctcattatatttatgtgtataggggtattggcacatgagtagggtgctcacagaggacagctctgtgggatcccctagagctggagttacaggaggctgtgagccacctgcctgggaactgaactgggctcctttacaacagcaataagtgctccagccctgtaacagaattttatttttgttgttgttgttactccccccccccaccccctccctgagacagggtttctctgtgtagccctggctgttctggaactctctctgtagaccagactggccaatccgcctacctctgcctcccaagtgctgggattaaaggcgtgggccactactgcctggcattacagaggcaaaaagatcctgagttgcagccttgagaccttatctcaggattttttttttttttttttaattaagaaaaaaattacggggctggtgagttggctcagtgggtaagagcacctgactgctcttccgaaggtccggagttcaaatcccagcaaccacatggtagttcacaaccatccataacgagatctgactccctcttctggagtgtctgaagaaagctacagtgcacttacatataatcaataaataaatcttttacaaacaaaacaaaacaaaaccctcaggctaaagggatggttcagtggtcggtcaagagcagtgactgctcttcttggggtcctgaattcaattcccagtaaccacatggtggctcacaaccgtctgtaatgggatccgatggcctcttctggtgtgtctgaagacagtgacagtgtacttagatatataaaataaatcttttttttaaacttaatactaattaaaatggcaaatatgaccagttaacaaagggtcatactttgactttcatgtaacttcttgactttttgtcccaaatgcgcacaacatgcttgtttttcatttaactgtatctactggtttatatttctatctgaaatatttgaattgaacatgatagttcatttttctcatgaggtttagagctcaccaaacaaatctcagatttaggcaatcattagagaacaatgtcctattaattatgaacttctagaaaggacttggtaacttttctaagtatacagtagaggccaaactacaaaacaacaacaacaacaaaaaaaaaaaacaaattattttttttctaatttaaaatacaaatcaaaaaaaaaggaaaaagagaaaaaatacaaagcaaatattgatgagtttaataatacacttttacaaagaaaggcagagtaagcatgacttttggttttttgagacagcgcttaactatagccctggtcgtcctggaacttattggtagaccaggcttgtccctaactcagcgagatctacctgcctctgccttcagatgtcaggattaaaggtgtgtgccacctcatccagaaaagcatgacttgttaaaggccagattttggttttcagtgatttgtctgtcagctagagagggagggagggagggagggaggcagggaggcagggaggcagggaaggaaggaagtacaggtatgcatgtgccatagagcaaagggggaagtcagaagacaactaacctgtagagatggttctctgcttctgctctttgagtcccacaacttagactctgtttgatgatgggcctgtcagcaactctagtcagctaagccatctcatctgccccaattcacattcctttaggtcttgatgcattggtaggccttgagttcccaaaataatctttttactcattgtgatcatgctagttacatttgccatattgcagattcaaaaccaaaaaccatggagttgtggctctatcagtggaatgtacaaagctctgtgtttgacccctaggctctataaagcaggtgtggtggtgtatggcagtaattccagtactcatgcaggaagttgggaagtaaatgttatccttaagaggccagactctgtctcaaaacaaaaaacacccagatactaagcctagcatgttttcatatatcttactgaaaagctattttttaaaattttgtttgtttgcatttctttttaatataaatgaaaaaattgtagcctcacttaggtatacagccgtagagagtattttcagattgtaggttctattcttcaacacagtaagtattccataagtgggtgggccagatggtagaaaatgctaattgtgcgtgcctgatagccctcagttccatacccagaaaagtctctggtggaagcagagtgccaattccctctgactcgacacatacatgcacatacacatgctattaaatttttaaatacaagactttacaattggtaatatacagtgtctacaacctttgtataccattagcaaatacaccacttagaaatataaaataaaaataaccaaaaattttttctaaaagattttataaacaatgtaactacttcagcatgtccattagttaaaaacagctttgtttggtgtccatctgtggtcagaacaaaaagtttctaagtatggtctgtagtccccagaaatagtagcatctatcccactcacccccagtgttgggaagggcatattgtggctcatggtttaagacaggatagagtcagtcttggtggggagcgtgagttccaggacagtcagggctacacagagaaaccctgtctccaaaaaacaaaacaaaacagtcttggtggggaaggcatgaggacaggaggcgaagcttctccgtccctcgtaaggacaggctatctatactgtcagggctggcctccagctcttaatcctgagcttcctgagggctgagattacaaggtagctgtgctgtgcctcgttgtttcaccattactcttggactgccaatccaaatgttttgggaaaggggcaaacaatattttactacgaggaaaatagttttgatctcatactgctcctagtaagatcttagaagtttcagacctaagtcctcagacctaagaattgctgtcctacaggggccagtacacatagctactcgggcaatggcttttattatcagtatcattaatgtttgaagatggagtctttcaatgtagcctaggctaatctcttattttacagtccccctgcctctgcttcctgagtactggaatttcaggccttgagtcactacactaagcttggcgggtttagtagcaaagtataagatataatgtaattggctatctgataatttccagtggagattggagagaccgatgtgaacgaacttacatccttaagatacaaataggacatctctgggaaagacataaagtagaccaagtaatttttttgttaacctagtttagatgaggaactccaatttagaggcagtgaaagaataaattggaatactttgctctgtagctgttaaagagaacaagacaaatttgtgaactgaagtgcttaaaaaggttgagaatagcatcacaatcaaggttgaagcttcaagttatcatatatgtaaattcagtgaaaccattgcacatttgtatatacatatagctaaaattgtaagtattcttgaggcacataaggaaagcacatttggtaggagccgtgggatctgtatatagatggtctatcaacttaaagggatttctgctttgtaggaatttgcggcgtatccggaagtgtcaacgtggtcgagagcaacaggaaaaagaagggaaagaaggaaacagcaagaagaccatggaaaatgtagagagcctggataagctggagtgtaggttcaagctgaactcctataagatggtatatgtgatcaaatcggaggactacatgtaccggagaactgctctactcagagctcatcaggtgagaaatggtgactgaaatttctctgcatttcccccagttctacagaactggtattttttttctctctctgtaaatccctgtttctgggaacaagtatttgttgtgtaaggaaatgtattcatttgctaaggaccttataacagtaccaccaacttcctgcttttaagaatggaaattgttgggatctatagttcagtggtagaacacttcccagcatacctaaggtcatcttggcatggttcccaaatacctgctccccacactctatatatcatcttgaggttctgagacctagagccccaagatttatataccaacaactgttgtgttttgaagcctctgaggggagaatggtcattggtactgtgctgttttaagtgttcctgggtcaatcatggtctttctcttttatgtctaaaccagtgtcacactttgaaggatgagtgtgtgggtgaaaatatcaatgtgggcatgtgggagacagtttaacctacatgagctggtgaatacctcgtgggactttaaaaaaaaaaaaaaacttccgatgtttacatttcaaacagtttctcattttttgtttgtgtgaaccctgttttcaagaaccatcttactaattatgtagcttgtgttatagcaggctctgggatacaatcacaaactaaggcaggtctttctgtgcattaccaaggaaatgaaaatgttagggaactgacatgtgagatttcattggtggaaatctcaaagacaggatacctgaaaccaaaataacaaggtgaagagttaagggagaagtgttttaggttttgttttgttttactttgctttttttaatctataggaatatactataattgtcttccaacacaccagaagagggaattagatcccattacaggtgattgtaagccaccatgtggttcctgggaattgaactctagaagagcagtcagtgctcttaaccactgagcccactttccagcccaagagaagtgttttttatggaacaaaacatgtaaaatgcaaggctgggaagaaggaaaggcattggcatactcgtaaaaagtcaaataaagctagtggctgaagctgagtgctgtagacattagtgtagttcagtgggccatgctttgggttttgctttagatatactaggcccatttatttactttgtgtatatattcattcatgtttatgtgtacttgtgttgatgtgagtgtgcattgccacagtgtgagtgtataggtcagaggacaacctgtaggaatctgttctctctgggctcaggggatggaacacaggtcattagacttagtgccaggcacctttactcactgaactattttgccaacctctcctttcccccattttttaaagataacattctagaggactgggtagattgctcagtggttaagaacactggctgttctttcataggactgagctaggcttctgcaaacattaggcacatacatgctataaatacagtttcaggcagaatgactggtgtacaaataaagtaatgaatctcatcaggccaggtggcatatgtctaatcccagcactcatgcagcagggcaggcaagctgctcaagttttagcccagtctatgtagccctggtctacatagtgagttttgggccaaccggagcaacatagtgaggctctgtcttaaatacatacatatatacataaatattgttttgtatttgaagggcttatttgcctattttatctgtttcttctttctctcttactttcattttagtcccatgagcgtgtaagcaagcgtctgcatcagcggttccaggcctgggtggataaatggaccaaggagcatgtgcctcgggaaatggcagcagagaccagcaaatggctcatgggtgaggggctcgagggcctggtaccctgcaccaccacctgtgatacagagactctgcactttgtgagcattaacaaatatcgtgtcaaatacggcacagtattcaaagccccttaactgcagagccagagcaggtagctcagaggtgtgtgtgtgtgtatgtgtgtgaatatgtgtgtgtatgtgtgtgtgtgggggcatgtgtactcatgtacactgaagaatcaaggaagatgcctttcaagccaccagtgcaaccaggcaccagcaggatacacgaaaggaatgcgaatggatggataccttaggaagctggaactggcacttttcccacgggtactacccagacccaacagggaatgaagtccatgcaagcacagagacaggcagcttgcttgcacacaccagcagagctcaactacaacttcctatgacctgagcaaccagatgctgtccccatttggatggatggatggatggaggtgcatcttgtcactgctccttttcccacctccaaaaaagagaggggaggggagccaggatttgatgataccctgacttgagcacagctaagatctctgttagattttatctgagacctgtttggctttggaattaataacttatggatttggtttctgagtccttgaagttcaccttcttccctcttctggttctcggcctcaacaaattccagtcagtcctcctttttagctcccatgggactgttttgtacctgcttctttactagtctgccctagtgccatccaccagcttctctctcacacgcacacatgcacacacacacaattttaacttggtttttcttttttgtaaataatgtacatactgtcaattttttattaaagaaatatgctttgatgtgctagcataactgctctagcttcttgtgtaccatagtaccatgtggcttcagatttagtacctataaacagatgtacaagacatttattacactttttaccaaagggagataccattgtagtacttttgtgtaaaacttgtctttcccccaacaacttactttctttttcctttttttttttttaaatgtaaataaagcttgattcttaaggaaataagtaacataagtcccttgtcctctccaaagagctgttgtaaagttgggactggctttaatttctccaggttacaaataggattttgctttaaataaataagtacttgtaattgtcaaattaacatatcaacagtgaggccagtgggatggctccatagataaaagtgtttgccacataagcctgacaagtttgctctctggatccaatagtggaaggcaagatctgactcccaggagtgctgtgccctgtggcacctgagtgcctgttcttgtgctcacgcacaggcacaccgcacctaggctcctatttcccctctcaaagttctaatttcccttactgggaataaggctacaattcaggataccgagccaaagagtcaagtgtatttgtagaaattcgaagggaatgaattttacattgcttagcaacatacaccaacaaatgcttttaaaattgtagcgtgggcctttaatctcagcactcagaaggaagaaacagatctctgtgagttcagagctagcctggtctacataacttcaggatagccagggccacaaaaagaccttgtctcaaaaaataagattaagaaaattttttacatttatttgtatgtgtgcacatatgcatcaacgtgcaagtgtcaaagtcagaacaacttgtagtcagttctaggacttgaattaggtttcaggcttggctgcaagcgcatttatttgtgctagtatccccatccatctcactagactccacttcttaaaagttacatttaaacgtgatccataacattggggtggggtgggggctcaaatgtggttggcctggactttctgaacaacagactagctgtcatagaattcgacagccatcacctagcaagtcataaccaggtattttatcttccatttaaaaatcctcagtcctggggtcagtgagatggctcagctgggtatggttcttgccactaagcctaaagacctgagttttgagccccaggccccacatatcccacccccaaccaaataaattgtaacaatgtttttaaaatccccaacaccaccataaagaaaaataatttgacttctaggttttcaaaaggtggcacagtcctttaatcccagcacttgggaggcagaggcagggggatttcagagttcaaggccagtctggtctacaaagtgagttccaggacagccagggcttatacagagaaaccatgtcttgaaaaaaaaaaaaaaaaaaaactcatgaattttgccttggactcctgaattctgggaatacaggtgtgtgtcaccatatcctgcttttagggtgtttttctcataggaggacaaggaaacttggaagtaatcaagcctaatgggaaaatgtagggcagtggctgaggcagcatgccaggaagaaagggtctggcttcctcagctatggttcacctctccccctctatttccttaagactgctggcctagaaggatggggagcatgggtctgaccagcagcagccttggcagttgctacctatgtactatgtactgcacctccctgcaggtcagggtaagatttcagggcccttttaggagaaaaagtccttgtgaccaataaaacaagggactttgctcaagttttgacaagttattttaattggcattgtatatttcttacttgatcatttttctgggtaacctgcatttggaatgtaaacctggttatttccattaaagcaggctagttagattcctcctgtattattttcttccagactcctgcaaacgttaaagctggaggttagcattcaaacttccttgcacttgttgacctgcgttagatcaaaattctggacattggggtaatgggcaacggtgatgcatgtaatgtaatggaggattactggtgtgcaaagccccttttctgtatttctgaaaacacccgaagtagccttgcgcttttcatattatgcagttaccaatgcttgagtaagtgaagagaatggaaaactaaacctttcccatgcccttccaggggttccctccctagcccttccttcagaataccaagtagctcaggctgtactcaaaggcgctacattgtcgcagattactccaatttacacttcctggtctgtgaactttgtgcatcctaggcaagcactctccctaccgaaccacaccaccagctcaaacttaccattgtattttaaaataatttacccagctgtctgacagcaaggctgaggtgagaaccgcgaaggctcagcttccgggtttcactgggaggctccccagagccagcctcttgcaaaagccgtggtgttcccagaaaagctgctcgggtctgtaagctggttggatgccggaacctttggttccaagcggtgcaacgagccggcagcaccaaggatcttccggggagggaaggcgcatcgccatggcggcagcgccgttcttgaagcactggcgcaccactttcgagcgggtggagaagttcgtgtccccgatctacttcaccgactgtaaccttcgcggcaggtgtggtccttggcctaccacacccgcgcgctctccccttcccttccggagggaaacccaggccgtggccaaccgggccgcggaacaaagttcccgccactgccaggccaggggctggggagcgaacggtagaggttggtctgtgctgctgagctgccaggcagtcctcacggccttagccaagggagagcgtttccccagccatccgctggctcacgggtgggacaggggcggcttcgagcatgcgcccatcagctgctcctgcccaggctcttcggggacagctgctcggtgacactctccagcttcctgacgcccgagaggcttccctatgagaaggcggtgcagcagaacttcagccctgcgcaggtcggcgacagcttcggacccacgtgggtaac

SEQ ID NO: 151 - DNA, 7898 bp, Mus musculus
ctgctgtattgaattcttgatgttggtgattctgccacctcagtactgggatgacaggcctgtgccgccatgctgttcccttctctaaacaatgtgtaccacagagcagaaatgtgcttttaaggaagcccatgtaaggggtttgtgggttgttctaggttcctttacctagtagtcatatcatgctcaagatgttggttggttcctgtgtatatcttcaggttttctgtgcaggccgcatttggatcggtgcaccccaccccctcttggtgttagatgttctggatcttctgactttcccagttagtttattgtcacagctggtctcagttttaaaatgggaagaactgtgtaggtagagggtagggtgcagtctgaaaaacactgttctcctcagtattgttggttgcatccatccctttccttattacagttggagggcagccacacacccgaaccaaaggaaaatggagaacaaggttgtcttcagaacggtctttctctacccatggtagaggaaggggaggttctgtcacactctctggaagcagagcacaggtaagaataagatgtatggcatgtaagactcttaaaggtacttaaaacgtaagaggggtgtggccatgaaaacctaattattcaccatatatccctcctggttagactatttaggggcatagtcaagagcacaaggattttccacatatgtgttgctgtctcatctgagcagttactgtgaagtgtctttaaaggggctttgggatgcctgggaatcctatatatggaaccaactattaactgcaagccttgcatacatagagtaatctgctatatacagcctaccaagtttgactacttcctcaaaggaagcttcctggtagtgccctttaatacagttcctcatgttgaagtggcgacctccaccccaaccataacattattttccttgctactttataagtgtaattttgctactgctatggattgtaagtatttgacatgtaggatatctgatacgtgatccctgtgaaagggccactggattccttcccagtggggtccatacccacaggttcagaactccttatctagaggaacctgaaaggttagtgagattgtaagagttccacagtgctgtgaaattgaacaagcaatgaaccacagagatgcgctaatttgttcacaaggaacaaaggagtaatttcttcctcctctttgggtctatgaaaaggttccttgcagtgggggttttgagattttatttctaccatcttatttgttatttctactatcttttccaataggtcattttcccttaaaccatgaagcgcctccatttaattgtgagcacctgagtacctcgccctttagggagaatacaaagttccttctgcagtcttcattggctttggacagactctttctatgggtgctagtgggctgcacagtcaggcttactagcgtgttttccttgctgtctgtccttttgcctccaggttattaaaagcaatggggtggcaggagtaccctgaaaatgatgagagctgccttccactcacagaggacgagctcaaggagttccacctgagaacagagcaggtctgtactgagctctaagccttcagtgactcccagtgaaatgtttgcagtggccttgcctttaggaaatttctagtgtttatttgcagtttggggaccagtttttgctgacgggatctcgacaggtacatgcctttattcccagcctgggcttacagagttctatgtctcaaaactgtaaaacagaccaaaaaaaaacaaaaaagagccgggatatcactttatagtcctgggtagtttggaacacgctatgtagaataccttgaacctacagcagtcctcctccctccacctcatagttactgacactacagccctgtgttgactgtcaaggatgcactacatttaagaaagagacttaaattaccacagtagtatagcatggtgccagaccgtttctatagtaggaatcaaaaaagatagagcccaggccagtgaatagcagacttggaggatataggtgccatgctcacagctctaaccccttatcaaaaggtaaggtctgagctcctgagtcttgaaaaacactctgcctcgccctctgcagcataaatcctgggctggagagaagtagctcaatggtgagggtagcgtgtgtgtagcttttgaatagaaccccatgctggcttagaaccacatgtaattccgccttcaaaggatttgacatctccagctttcataggtgccacacatataattaaaaataaatatcttgcagggcagtggtttcatcccagcacttgggaggcagaggcaggcggatttctgagttggaggccagcctagtctacaaaatgagttccaggacagccagggccacacagagaaaccctgtcttgaaaaacaaacaaacaaataaataaaatctttaaagcttaagtggcggctggcaagtctcacagtagggcagcctacggcctgacatgagattttaccacttagaactattttagagccagagagtcctggcccacgcctgtgatcccagcgcttgggtgaggcgtgaggcaggtggatctctgagtttgaggccagcttggcctacggagtgagttctaggacagccagggctacatagaaaaacactgtcttgaaaaaccggggcggggggaacaggaactgttttagaaataggaactctaaacccgacacccatcatactgaactctagactgactttataggaaaggggggaaatgtttgggtggcccagctttggttgcatacatctttaagcctagaacctgaggcataaataggcagatttctgaatttgaggccagcgtggtctatatagggtgttccaaaactacaatagtaagactgtctctaaacaaaagaaattaaatccttgtaagtttgaaaagtactgctttaagagatgttaggtctcttgggaattcccctccacatactcctctagaccggtgtagtcattgaaggttttttattttctttctcctatgctctgtagctacgaagaaatgggtttggaaagaatggcctcttacaaagccgtagttgcagcctgtcctccccgtggagaagcacttgcattgcagagtgtgaggactcagactcggaaacgagcagcagccagacgtcagacgacgatgcctggaagtagagataaaatgctcacagtgacctgccccgctgagctcagccttgtgtttagagaatataaagtgttcttttccttttcttatgttgttgaatacttcatgcacaagggaaataatcatatcccaaagagagagcaattgtcttgcttagcctttgttttcttccctgttacctgcttaataggcatttgtgtggtgggatttttttaagcacacacacagtacctgtggggctgtgcacaagtgggagctgtcagggcagagatgcagggaggagatgctgctctgctcaacagcttctactaccagcccttggggactcacccctgtgctcaagcaatcattgtcaatgacaaagtgactattgaagttataattgtattaaattaatgctaataatttggatattttattttatttttggctgctgggtaacttagcccttaaccaagcatatgtggttgtttttgttttttttttttttttgttttgttttgttttttattttctctttttttttttttttcttttgggtacagctgtaaaatatttggatataggaaatgttattcttgcagccttgatattcagggtggattgtaaaatatgaatttttgtgagatttcaaagattaagattattttgataacattatttacagatttaaaagatgtggttaccacaagtctgttgaggggaaaaactactgcataaaataactaacgtcgaataaatattttgcatcagtttggattgtcttgtgtaagaaatatattttctttaaaattagagagtggattctttttttaagggaaatatttttagaaaactaggggaaaactgaattcagccccacctgtttctcttttcagcaaaaattcttaatgtggaaaaaacctgtgcaataaattattcataataaactacattttttttactgaaggaattttttagtgcccaggatttatcaatatacctgggtttggaggcctccccccacctcagttggttgtgttttatgtgtaggtgttttgcctatgtgtgtgtctctgaatgccatgctgcactgattgccagaggaggccaaagggggacttctgctcctctggaagaacagctctgaactgctgctgagccaagtgtccagccaccaatatgaatattttaaagaaggcctgacaagtgcttcctacttaattaaatgggtgcatgggggtgattgaatgaagtaagacgacagtggagatggaggaatgagaatgactccgtgtagggttagcacttgcccactaagtgtttacatcttccatacctagaaacacatggtgatggaagttgagaaatggtttccacaatttgttctccgagttgtatatgtgaacttgatatgcacatatacatacaaaatgaatgaagagctggagagatggcttagtgggttaggagcgcttgtggcttttgcagtttttatggttgtggttccacattttagggccaccaagatggctcagtgaacttaagtttatgtcaccaagtttgaggatttcggtttgattcttgggatccacatgatgaaagtagacaaatgactcccttgacatgatactttacctggcctacctgtgctaacacaaatacatgcacaggctaaatgttaagatatgttaaggaaattggcagctggaggtcatagttcattggcagaacatttacttgcattgcatggccaaggccctcgatttactacctgaaaccaccacaaaaggtaacactttcagtataatgctcatgtagcccatttttctaaatctgctggaattggaaggatggccccatggagcactcaactagctgctctttcagttggctacggttcaaaatgcaactagcaatcataacctaagccaccccaattctaacctcattgggaactgaatgcgttggtatacgtgcaggcaaaatacccatacactaaaaaagaaaaagcatcttttaaatctatgaagtaacagtttattaaggcagtggagagaatgctcgccttttatataatgtttcagagcacataaacatcgtgtaacttgctcctctttggatgtttggagagaactaccttaacagctctgtcttactgaggaaaggctgcttcagaaatgaggtgcatggatctgtgtagacgaattttaatcagggaacatgtttgctcttgaaaaggatcacatccaaaagatagatgtctgtatgacctcgctggatacagacatgcccttagtgtgatgaatcagaaatatctgaccaaatgagtcagagagatcagctcaggagcgaggattaaaaagaaaaaaggcaattttcattgtagtatgaactcagcaaggtctgaggctgaagtaggtttattttttttcccccaatttgcttttatatcattttaattacatgcaaataataagatcagttctaggctggagaataagcaagacaataaaactcccaagctcactgtttctaagtgcttatcaggatgaccaagatatctgagcctacttccctgtcctagcccaaagtaaaattcttgccttaagcctactactttgttctagccaaattagattcctgcctgagcttacttccttgtcctggcctaatgtcaaatcccagccaagtggccccacaaagctctccacagatgggcaaagcccaactcaggaaagaaatgctacttaagagcagtgcaggggggctggtgagatggctcagtgggtaagagtacccgactgctcttccaaaggtccagtgttcaagtcccagcaaccacatggtggctcacaaccatccgtgacgccctcttctggtgtgtctgaagacagctaccgtgtacttacatataataaataaatcttaaaaaaaaaaaaaaaaagagcagtgcagggaaaatccatcttggagttagttcagttgagtgtagtttagaggcagcttcaccaagtagagcacttcaatgagaagctaagagaagccggtttgaaccagttcagagaggactttgagacagaacagctgagttgagtcagccagctttgaggaagagctagagtgagtttattcaatagtctcagagcctgaaaacattttaggcatagattcgcctaggagatgaggatgaacgttgcttttacagatctgtgtaaaggtgacgataacttgaccagcagaaagagctcgtttaactcacaagtagtatccatctgacaaattgtattctccccaacgggtctcccagttctcattactggaaaggttcagatcattcctgtcccagaatgggaattagaaagactattccattgtgtggtgtgttaattctgtaaaagatgggtttatgcaaagacatactgctaatatgaggtttaccttgtgcggaaatgttccctacagtggagaattctagcttgaaatctgtccattttagagaacagctgtggtacagatgacagttgcctatcagaggctaaataggcaatgaagtcaaagccgcagttaattaaatacttggccaaactcactgtaattggtggaacaaactgacattttcacacctgggccccacccaaaggtggccaggcacattgcccaggcctgcctaagcctgtactcgctgcccagggagctagggcacctccccaaacataaacatacatttgaaggacctggcgatttagcagacttggtctattctttgtcccttttctctcttttctgtccagtccgccttttctcttttgtcacatcctctgtaggacgctggtgtctataagagattccattccatggccgattactcaggggaatcaggacttttatcctgtgaatcctgtgatatggttttccgctcctgggctctgttggccacacacaccaaacgattctgcattggccggctgactccggaggtaacacttaaatcacagccttcagtcgcgatcaaacgaggcaccaaggtaagggccgccagtggccaggggtaggttttccatcaatcattattcttacgttttttgcctccccgccaccagatcatggcacaagaaaagagccgtgatcaggaagccagcacatctgctctaaagaggctgacagaggaggtacacaccaatcatgactacaaacttcaactttacatgtgtagagatttacatgctggaaatcacccagtacagaaatagcgggtccgagttatttgcaggtgcagttgctgtccctacagaaaataggtccccgagcgactgagggtctcacttcccagactgcagggagccctggggagaggctgcgagtcttgcagggaacccgcgccagacgcatggcagaaacagaagcacagagccgggcgctggagcgtcgcggcgaaggtgagaggtaaggactcggccctgtcgctgtgctcggactcaccctgactctgcccatttgtccctcagaattaaaacggcgcctccacagcgtggcgggacccaagggaggattaccccgcccattcgacttggagcgcgagctcagagaactcaaggaagaggccaaccggacccggggagcactgcaaacgctaggtgcgcatttccaggcgctccagcttcagcctcggtgagttgccggcccagctttggtaggagt

SEQ ID NO: 152 - DNA, 5247 bp, Mus musculus
gatccttgtaatttacaattttattaacatttccacgattatataattaagatgaactgcatcttgctcatttttttcctttgtaacaggaatccaaaatctagtgattgaagcaggttttacttttcttgtgcatgagcggtgggttgtccagagggttgtggtagctcccctatgctcctggcatccacattcctttctttccattcagtcccatagcatgtgcttctgactgccttgtcactactggctgggtagcttcaagcatgatggtctcattccagacaagatgaagtagagagaacaagacgtgggcagagtggagagaggcacactggtctttatccattgtcaaaaccaaggagacaaacacactgagtatgcatcatgcgtttgaaaagcgcatatgcatggacttggacagctactaccaagctctccaactgctctagccaaggctcagtgattagcagctgaaaagcaagaatgaaatccagtgagtagcagcatacaaagaatcagcttcaaagactaaacacctaaccaagatatgtctggtatgtccaggccagagctgttgggaaggtacaggacctagataggctcatctacatgtgatgcctctggaaaacttcaattcctaccctagtgctcaaaataggtaccagaccaaagaaatctacttcacagagatggagacatccctgggtccatcagcatgatcggacaggtcttatctagctattgctgccacctagtggccgtcttcctttaatggaggccgaaatctaaatgctaagcatggtaggttccttgaggccaggaaaccacagagaagctggcgatcaacttacatttgagaaggttcaggaatgtgttctaaaggaacttgacttgaatttcatgtgtgtttgattcttcctgcctgcctcacgaggaccaccatttgtgaactaggaatgtggtctgcttgtcaaatgggccacttcaaagggaagagtgtgggaaattggaactatgaccacaggcctcttgtatcatgtaccacacctaagcttctggcattaaaggtctttgcaatggtttaacgaaggtacatgtgaagacttagcacacaagtaacactcaaaagtagcatatacacactgaagatgaaagattatgtggttcttctgcaaggggcagagtcactcagggtccttttgggccctgcaaaattagaggcccagatttccaaagaccgaagtatttctgcaaaggtaagtgtctatttgaattataagatttgccacaatggctctgtatatctagaagcaggaagagccatcggtttagtcaatggaactgactgtcataattcagtgaaagattggaacttggttcttaaaataacaggttggaatatgatggtatgtcaaagatccacttgtggttctggcccactttctatggcaactagacagcagactcgttttctaaaaggggtacagtaaccagataccagtcctttcagatttttttggttttttgggaggtttgggtttcactcagtgcagtgtcactgaaactcacattaagagctaaggggagggctggtgagatggctcagtgggtaagagcacccgactgctcttccgaaggtccggagttcaaatcccagcaaccacatggtggctcacaaccacctgtaacaagatctgactccactcttctggagtgtctgaagacagctacagtgtacttacatataataaataaataaatcttaaaaaaaaaaaagaagatgcgcacacacgtgtctgctccatcatttcctccttaaaaaaaaaaaaaaaaaaaaagagctaaggggaatctagaatgtggctctgagacctggggttgggactcatcccagcagctgtcctcctaattccttcacaggaagtgccacacacactggagtctggagctgcctctgaaacacaaaggaaggagcagctgttgagtagtctgtgatgatcggagatgcactgtgccgactcatttcagagacttttgaatttcctctgagcagctacagctcttgctctcggcccttcaggcatctgcacttctttttttttttttttttaaagatttatttatttattatatgtaagtacactgtagctgtctttagatactccagaagagggcgtcagatcttgttacagatggttgtgagccaccatgtggttgctgggatttgaactccggacctttggaagagcagtctggtgctcttacccactgagccatctcaccagcccgcatctgcacttcttattggatgcttcgatgcttctggtcacactaactggagtctttcttactcttgttgattttacagatgtttctcattttcttagtggacagctttatcacttttcttttttctatttagggattaatttgatcatttcctagtttcaagtagcattgattacatgttctcctccttagtgtaaaagttgttctctatcctttggggcacattcttttctggaagctttgaaactttttacattgttttacttcaaaattgttttctggacaaatctcatttcttctttgattcatgtgttacttagaagtatgctgtttaacttcagcatattggtgaggctattccaggtatctttctacattcctctctaaggtttcttacaaatttattctcacttcctgtcatccaacatatggtctaccttgaatacgccatattcattgtctagagtgatctagaaatgccaactacatcaagttggttgaatgttgcttataataagtatgtatttagtgatgagtgtgtgtgtgtgtgtgtgtgtgtgtgtgaggatggtgttgacacattcaaccttttagatttctggaagatgtttttattctttttaaataagttctgatgtgtatgcatgtttgctcacatgtatactacatacatgtacactacatgtatgtctgttgccatgaaggccaaaacagggtgttggaatccctgcaattgagtcacagactagtctttcgttgttgttttgttttttgagacaaggtatcactgtatagtcctggcctccaattcacagagatcctctgcctcccagtgcaccgccatggccctttataagagcagtcaggagctcctaactgctgagccatctctccaggctgacattacttctactaagagtttatctatagagataacttgacatctacatgataaggtcccacatcaatctacatgacctatactgtgttttatgctcccacaggacaacacacacctggtcacaaggggagtttgggacaaagctctacaagcctgcaaatcagcattaaccacctgtactgcagaagtttacatgggtgccattctggaaaactcacattaactcacaaaagcaaacaagtgagtgcagacaggaatgggactatcgtcccactactgttatttattctctcctcttctccttggttgctgtgcatgcccaaataatgtaatcattttttaaagagagagaaactatagggcatgtacaaactcatggctactgcacccaccatgctggacgatgaacgaataactgagaccaggaaggaattttttttaaaaagtcctagagaaaaatgaaaatacaacattccaaaatccatggaaaaattatgaaggtggtcttaagtgggcagtttacagctattggtgcctccagtaagaagttaaagacagcaaatgaatttacttaatgatacaacttagggccttggaaaaacaaaaacaaatcaaatcccaatccctccatgggaaaaaaatagtgccatcagggaagaaatcaatgaaatagaaacaataacaaaatactaggagtcaatgaaacaaaaatttggttaaacagctagatgtagttgttaaaccctcagctagactaaaagaagaaataggaattaattattaagaaagaaagaaagaaagaaagaaagaaagaaagaaagaaagaaagaaaggaaggaaggaaggaaggaaggaaggaaggaaggaaggaaggaaggaaggaaggaaggaagaagaccgttggtagtggcccactctggaagcagaggtaggtaggtgatcctctgtgagtttaaggccagcctaatctacaaagtgagttccaggacaggtacggtacacacagagaaattctgtctcaacaaagcaaaataaattagaagaaaggggggccatcacaacagacactgatgaagtgtataacatcattaggtcttaccttaaaaagtaacaccccactaagttggaaaagctgaaagaaatgggtgaatttatagatgcatatggcctacaaaaataacatgaagatgagcaattatgattacattagtaattcaaaatctaaaaacaaaaaagcccaggttatcagactttccagtgttcctccagtgttcctaggctagaaaaggaagagacattaccaaactcccttacgatgctcctattcgcctgataccgaaccaagatgaaacaaaactctacatcaatttccctgatgaacatagacacaaatattatcaacaagctacttgcaaacagaattcaaaaatacatttaaaaagatcattcacaaccatgaagctagttttagtccagagatagagactgtttaatatacatatcaataaatgttatttatgcctttcacgttaaagtctcaagtgcactcagaataaaaggaacctcagtatcgaaaaagttacacgacaaacctgtattttgttaatataatccaaaggtgtccattttctatactcttattcaatcatactagaagtcttaaactaaagccacaacctaagcagacaaataaaagaaaaccaggaaagaagtccaaacacctctatttgtagatggtatgattctatacacaaaagaatataaagaaactaccaaaaaaactcttaaaactgttgaacacagggctggagagatggctcaggggttaagagcactgactgctcttccagaggtcctgagttcaattcccagcaaccacatggcggctcacaaccatctgtaaatggaaccagatgccctcttctgctgtgtctgaagacagctacagtggactcataaataaaataaattctcaaatataaaaattgttaaaaatacattaagatgtgactgacacaaaatattcttttaagccggtggtggtggcacacgct

SEQ ID NO: 153 - DNA, 2079 bp, Mus musculus
gtccacttcacatgatgctggagaccatcttcctataaagaggaagctggacagaaaaagcatgcgttgaagaaggtcgccacaaggttcaaacgctgtcagcgttcctgtgagccctatgaagccggaaacggtaatcagtcccgctccgagaagctgttctgataagccctgactacacaggtgagactcagctgctttttatctgagctttgcttacagaagaacacgttatttaattctcgggcatatttcttcctctctgctccatgtgctccatcctctccatttggttagatccagagagattagaaagactgctgccaccaatctgcttatcggaacgcaggtcagaaagattaagtctgtcctacgaggcagctactgaatcccaacgaggagcctgaatcccaaccaagcaacgccttgaaacttccctcctcttacccaccctgaatctgcctaccatcatcaccaggcaaacatgtactgggaaggaaaacgataggtgacctaaagccagattctgctccatgaaatctgtcatgataaaaatgtttgttcagggtgatgcagtcgactgagacggagatctcgaactctctaattttttccctcagaactgtagcctctgaagggaggtaaattgcaaaagtacccccgatgcaaggagaaagggggaggggagggtgagaaaataaggcaaccagcataggatagatgaggtgtggctcagcaattctaaaaactctggaatttactagggggcagaaaaggtcacactgaaaagtcgagaggccgggtcatgtcttctcgcaatggctgggaaccgtgatcgtgtgcttctccacacttctttcctcgtggaaaacgcaaggctcttgacatttaagacccggcttcctcacgcagggtgtcgcggataaaagattggacacgagaggatgcaaagaaaaagcacatggaaagcccaccctccccggattggagcacgtagggaccagaagagacccaggccaggaagctcccggcaactgcgatactcactggcggataacggtcaaggcgaagcgcggcattttggcacaagacgcgtgagccacgacccggctctgcagcagcacctcgctgcgcctgactctgggaccactttgcctgcactacttccgtctgcacggcggaccggccccgtagctattggtcgaggcggctgaacgtcaccacagggttgccaataaaggtggagcctgaaaccggagaagccccgcccaggccagtggcgcttgcgctcctgcgcgccaacctgtgattggcgcctggcaggtgcgcgcggccccgccctgggttaacgccctggagtcttgccagagctagaccgccgcctgcaccagggacagataaggactgctttgattgttttatgctgaactgatttgaggaaggcgtgcaaggtgtagtgtgcctgtagtgtgccaaggcgatggctctcctctggtggttacacagccagactgcatcctttgagggttagctgttatcctttacctgggaagtgaggtcaaagtaggtatgtagatccaaaccaacctagtttctctctcaacttcttaaccaaagacttttgtcaggccactttcttgccttctgctttgctgagcctggtcctcccaaacattattaccaagtattttcgctaatgctgctatcatttataattaagttactctagagctctccactgatacctgttgtattaagagtttaattcaaccatttcttaaaataattcctattgtaatgaacgttatctctgttgcactgatctagaggaaagtcgtttccttaaaaacaaatgcagggacaaaggttctgtataaaacccctcgagaggggttggggagttggcttaaccctttaagagcccagattatttgctcctctggagaaccaggttcaaagcccagtgcacccacagaggcaatcaaacatctgtaactgcagttccaggaagaccatttactttctgctgacctctgggctcacgttatgcacagacattcaggcagagcacctagacac

SEQ ID NO: 154 - DNA, 20394 bp, Mus musculus
ctgttgttattcttgtttactgctgagagtattgacgtccataggtactaagtgttagaataggcagggcagtcccaggcaaatcacaccatgcagcaggtctcacatgggaggtttgttggcagaggcagcctatgggagagggtagaaggaaaaagggggctggtgtggggtcgatgggtcttttatctgggctgtgactcatgtacaaagggactcagtgggtgctgtggcagtggatgcagaagcagtactgtcacctagagatgatgtctggtcactgggtctaagagctggctataaagaccagtgtctgatgttaacactaagtgatttgacaaagacagaggtagagctacaatttaatatacataccatttgagtagctgcactgccaatcggactctttgttgccttgtctcataaaaccgtgtgctatggatgaaggatattgtattagttaggtttctattgctgtgaacagacaccatgaccaaggcagctcttctaaggacatttaattggcattggcttacaggttcagaggttcagtccattatcatagcaggaagcatggcagcatccaggcaggcatggtagtggagaaggagctgagagttctacatcttgttcttaaggcaaacagaatactgctatcttcaggcagcagctcacccccacagtgtcaacacttcctccaacaagacctcacctcccagcagtgcttctccctaggtcaaacatagccagaccaccacagatatgatgggcaaattgaaactagtgccgaagacaatggaagcttgggaagttcaggagagggattattgtgtgtgagggccagtatcactaaagggcatattgttaggggactgcaggtagtgcagggagcagacaggcctccaattcagcaacacctgaaagaccctcatccatagaagcagaggtgccacaggcaaggtttggtttcatgctgtcttgtagctaaagaaacagctgtcggggtttctgacaatggtgtcttagttgagaatgttaataaccaaaggtagtctgcatgaagtctagagaagatgctttgtatatttcagatgtgtaccacagactggattatagtaaaagccaggttcttccatcccagatgcagaactaactctctgccctagctaagtgtcagatgttaaagtatcggccatgcagttcacagttcttgttctagaagccacaaagactcagcatggatacagggggagctcatgttgatgtgaaaacaattctaattggaacgataattctcccacatattcttgttgcaaaggcatttcttactatgtgtagagcaaaagttattgttcagctctctgttaatgaaagaggaatgaagaaagttgatctcaatcaaacagtcatggtgcgtggttgatctcaattaaacagtcctttaaccccagcactttgaaggcagataaagatgatctctgagttcaaagccagtctagtctacatgtagagccagtttcaggacagcaagaaaccctgtcttgacaaccatcccccctccccacacagacacacaagaaaaacaaacaaacaaaaaattgatgtcaaataaaagaaaggacaataataattaagggagaagctagaaggagatgaaataagggcactaatgtacagtgtagcaaggaggatgttctagtgcatggcgcagcagaggagcctcactccacaacaacttactgtaaggctgttgaaatggctcagtggttaagagcactgactgctcttccgaaggtcctgagttcaaatcccagcaaccacatggtggctcacaaccatctgtaatgagatctgacgccctcctctggtgagtctgaaatcagctacagtgtacttacatataataaataaataattaaaaaaataaacaaaacaacttactgtaaatttaagaagtgcctgaagaggcattggaaggctctaaacatcaagtgataagacagtcataatttcaattgcattgatttgatcagcacatgttctgcacagaagtatcacactataacttacaaagacatacagttactacactggttattacatactgactgctgccagaaatgaaccctgccctgtgtatccctggcaagcattctatcctgagttacatttctaacacttagctagtctgcttgccaagatctgcttgcctgtgcttccttcatgctgggattaaagcagactgctacctgttagtaacttttatttgccaaatgtaattgtcttggaggcttgctgctgaattagctaaccctttctagttctttttgaactctggctggcagggtcaactcagctgttctggctcaaaattcctctccaagttgactgatttaaactggcttctctcagtttctcagtgaattgttctgcttggcctcaaactaacactgacaatctgttctaatcttctggctccttctcattctctatctcattctgtcttcacctgtgtctaacttgttctctctgcaacctgtctctgtaaaactgtcccagtaaaaactgcctctgaactgaagtcagtgaaactcaacccaactgcactgactttaattgctttcaactaaactgaacagaactacatcagccaagctgacctaactgaacttggtgctgctcttaagtagcctctctttcctggctgttctcatgagtgttgggcatatcccatctctgactcattctgccagctctttctctgatttttcactttgtccctcaattagacatcactctcaaacatgggtgcttccttctgcaatctaaccttcgtggtttgggattaaaggtgtatactaagggtatgtctgtattctagccagagggattaaaggtgtgtgtcctgtctgcattccagccagatcacacagacctaggtctttggatgtgatcccttgccagaacagccgtgctgctggattagaatttctttacagctatcatttctggtgatagagccttttttaaaattttcacttagggaagctggagagatggctcaacagttaaaagcactggctgttcttcctgaggacccagaatcaatttctagcacccacataatggctcaccaccatctgtaattctagcttcggggccttcaaaggcaccaggagacaaaataccaatacacttaaataaataaaactttgaaagatttcatttggcagcatactttttctcatggaaacaagcaggctgatggagatacaggtgaattaaagacagtcagtgggccggagagatggctcagtgggtagtgctttctgtgtgtggtgaagaatctgagcttcaatctctagcaccaataatagctgtacatggtggcacatacctgtaatcccagtgcttggagaggtggagacagtgctgggggcccagtggccaggtcgtctagctagaacagtgagctctaggctcaatgaaagagttggtcttttaaaaaaggttgagaattaccactttcctgatataaacctgtgtcctacacacacacacatttaaaaaatagttaaagaatggaactttgatctgcttggtgagtaaccccaggcacaggtttaaattgtattcatagatttcccctaaacctaacaaataactgagttttctcatgccatatttcttgcctttaaactgctgtggattatggaagaattgaaaaaaaatggtaccactgtataaagttaaacataaggtgtagtctaaatattcaaatatttatctcctgaggacaaacaaattgactaatatcttctacttaagaatatttgtcaagatttttttttcttttggaattaacaagcaaacagacaagtaaccgttaaacaggcaggtgcccaaccaaatgtattagattagctaatataaagcgggagtccagaagtagatcctaattcatgctctcatgacccaaaggttcatctgatagcatgaaagcaagccttcatcccttttgtcttccttctgggttacttcctgacaaggataagacgctgctgtaggtacccatccatcttctgggacctcccggaacgtgcttcgtttccctgtcttccctgcagaaactcatgtttgaggttcacagactaatttggctcatgtgttagttccctaaccagtcactggtcaagcatggagtctatgtatgggctagaggtaaagaatgtgaccacgatgggggtgggtagtgccccttgcaaaaagcttctgttaccagaagaaaaaggcagcaaaacagcaggtgccactaggccaagtagaagagaaaaagaactctcagaagagaaaggtttgcctaatgtctaatgcctaaaatgatatgtattatcctgtagcatttatgtgtgcgcctgcacacacacacacacaccctttactcgtccttgtcagattccacttgaagtacataatttcacccaaacaccctgtcattatccctggcaccctggctgttataagaagccatgagtgcccgggtatggagatgcatgcttgttctcctagcactccagaggtagaagcagttggctctctgagtttgaggctagcctggtcaacatagcaaattccaggtcaagtagggctacaataatgagacactgtcataaaaataccgtgaataaagataatatagaacagcctctacacagcacactaaccaagctttactccatgttgtgatcaatacctattaatgagattataatttcaggggcgccgttgtgtattgaaagactgctgcaaaattctcgacaatacagtattacccccagaaactgtggtccccccattcactgtcttctccggctgcccaggtaatgttgatgttaatatgtctgtttcaaccgccttaaaactgttttccgtcactaaagtaataggtaagacttctgtctctgatatgtgatttagcaacaaaatactacaaaaggcgtatgaataagtagtttttagtgagggtggtatttgttttttgagacagtggtctcactagctttggctggcctggaactcactatgtagactaggctgcctttgaactcagagatctgactgtatgtgccccctagagctgagattaaaagcatgtaccaccatacccagtgaacaagttgcacttggaaatcagtaactgggctcacaattttttaaaacaggaaataatcagaaacaaagaacaatggagacccagactggaagattgcagtgatgaatgttgctatcacagcagagtgattaaaaaatgtggtacttgtggggatagacgagaaagccttagatccacatatggtagagagatttcccaaacacctttgaaaggtttctcctcacaaaggttgcggtagggtctagagtgctggctcaggggtgaagcacactgatgctcttccacaggactggttttcattcctgacacctgtatggcagctcaactttttggaattccagttccagggaattcagttcccttttctgggctgtggaataaccagctgtacacaggtatacagacaaaacacctgtatacatcagagtaaataataacattgaaaagaaaagtttgctaggaacaaatttgccaccagcacgtgggaaggacaaagaagcatttctctcttgcctgggctctgagtggacgaaggagaaaggaaaatctccttagagatatgtgtgcttcatcttttttttttaagatttatttattttatgtatatgagtacactgtagctgtacagatggttgtgaggcatcatgtggttgctgggaattgaactcaggacctctgctcactctggctacttgttccagccctgcatgctccagcccaaagatttatttattattatatgtaagtacactgtagctatcttcagatgcatcagtagagggcatcagaccccattacagatggttgtgagccaccatgtggttgctgggatttgaactcaggaccttcagaagagcagtcagttctcttaaccactgagccatctctccagcccatgcttcatcttcttaatgtattcacattctttagtaccagcttcttatggtcactgaacactaatgccagaagacaaagaagccatcctggtatttcagatggaagtaataaagacttttttaaaaagcccaaatacctgtgaccatccaggttgctgtacatgagcaaactaagactggaaggtgtgctgtccccagtgtcaaagccttgtccagcaccaaagacccctcatttagagcctaaacttcttgcactgtgacaagatacttctgatttttcttttgtgtagtttcacagataaatactagacattagagtactttttttttttttttttttttgagacagggtttctctgtgtagccctggctgtcctggaactcactttgtagaccaggctggcctcaaactcagaaatccacctgcctctgcctcccaagtgctgggattaaaggtgtgcgccaccaggcccggctacatatttattttagagtattttattggcacttccatctttgaattcagacatgtgggcttgcaggaaatctggcacattaatggagagccatgtgagataaaattaaaccatgaagctggaaaccagaatggatcttgatcagaagccacaagctcagacgctactgcagccacaggcagatagtgcagtgatgaaagccgtagcccatcatggctgcttgacatgcatctgagagcatgaaagctgatgtttaaggaactgctaaaaatgggagttttatgtgatatagctacattttttaagtagtctaattattacataacgattaaatactgtatagtttggggcctggagaggtgactcagcagttaagagtgcttgtttctcttgcagagaaccacggttcaattcctagcacccacatgataactcacagctgtccataaacccagtttcagagggtccagagctctcttctgacttccctgggcaccaggcatgcatgtggtgcacaaacatacatgtaggtaaaatattcatacgcattaaagccaggtgttaaaggtacacacctttaatcccagcacttgggaagcagacaggtggatctctgtgagctcaaggcccgcctggtctacatgatgagttccaggacagccagcactacctagagagccggtctcaaaacaaaacaaaacaaaacaagaacactgtgacgtttgaacatgtttgcaggcctcatgtgcactttttatttgtagagtgcctatgagaattctgtgaggtttttggttttgtttttattttcagatatactcagtacattttgtaaatatataaaatatgtaggtgtgcttatgtgtttgaatggataatataggtatttgaaactgtacctacgtaagtgaaatcaaactgtttctctgtacggcttggaaactgccctttatttggcagtatactattgcgataaatagagacccacatcactcctctcgagagttacaaacttcacatactgcataggtgagtttaacacaaagcagtgaatcagtcccatagtacaatggatcattaaacggtgaacctgggcactattagaaactgctgtcctgacattgttttacatgtattgtgcaattgggcacagttatctctgacatacattcttagaagttgatttataagtacaggggtataaatgttgaaaactttgctaactttttattttatgtgtctgtgtccttgcctgcatatatctctgcactacatgcatgaagcacccagacctagagttacacatggttgttagctgtcatgtggatgttggtactgaacctaggacctctgtaagaacagttagtgctgctcttaactgccaaggcatttctccagccctctgctacctatttttaaagtgcatgagtggagacagcagcttacatacctctgtttcagaaagtttgttgttgttactgttgttgttgctgttgttgttttgggacaggtttcctgtgtatccctggctgtcctggaactcactttgtagaccaggctggcctcgaactcagaaatccgcctgcctctgcctcccgagtcctggaattattttattttattttatttcattttattggtttttcgagacagggtttctctgtatagccctggctgtcctggaactcactctgtagaccaggctggccttgaactcagaaatccttttgcctctgcctcctaagtgctgggatcaaaggcctgcaccactgcccggcaccaccctggaattctttttttttttttttaaatatttatttatttaatgtaagtacactgtagctgtcttcagatactccagaagagggcatcagatttcattacggatggttgtgagccaccatgtggttgctgggatttgaactcgggacctttggaagagcagtcggcgctcttaaccactgagccatctcaccagccccaccctggaattcttaaccatgcttgttccaccatggactgttctgttgtcttcttttgattcatctgtacccagtatcactgctttggtggattgagtttcactgtaggaatggcaggacagttctttcctcaggataaagataaggctcagtggggctcagtggggatgagaagcccttgtgtggaacaacccacagcagtcagagatgccctctctctttggatcttgtaagcaagttctgacctcctccagctggactgagagctgtagtgtttggttcccaaacaaactcagacctttccgaagatgtatgtacccagcaaccacatggcagctcacaatttcccataattccaattccaaggcatcagaagatgtatgtagtcaacagtcttgtcagtctgaaggaccacaaagttagatcctcgatagagagtgcaaaagtctttagactttgcacaaatagtagggttactggcctccctggcttccttgcttgactgggtctctcttttctcaggactcttctcaggggagctcccagagtgcacacaggagctgatgattgacgtcaccaaaagctactaccagaagtttctacccctaacacaagtctaatgtctctgcttcatatctttaattcttttgaactcttaagacgaacctggagataaagagagccgccagtgactacaagagctgtcctgtttttgacaacttctactctcccgttgttggctttttttttttttcaattttccatggctctgagcatttaagaatttaataaggctagagagatggctcagtggttaagcatgctggttgctcttccagaggacccaggttcagttcccagcactcacatggccctacgaccatctattactccagttccagaggatctgatgggtttctggcttccatggtcaccagacatatatgtggtaaagacatatgcagccaaaatatcctacacacctaatctgtcaacagttgccataccatcgtctgaggaggacagaaaggtctgttcctgacactctagccctgtggttctgcagatggttggaacctgcctggcttgggcctacagagcaacagcaccctcccagcatggagtcacatgacccaagtactgctcagaaccctgtcctatccccaggctacacagtccacacagatgacaggccactttcctgctgctaagatgggaccaataaccacaatttcttgtgccctggggaaagtgtgatttcaggcccaggttcctattggtggttagaacatgaggaagagacaggctgtggtgacgtatacccatcctcgtacctgggaggtagaggcaggaggaataggagctacatagtgagctcacacttgcctggtgggctacatgagaccctgcttcaaaacaacaaaaataaagtcagtaaaaataagtggtatctgttgttttaaggtggccttagttgtcctatagtagctaataaaagacgtaaaacatcctggtttaggctcattcattaaagaggggaccctacactgcagactgtgcttctgcaaaatcccaggtttaggtcttcagtgcggatggcttagtcaggtcctcattccttgactcaaggattacttcaccaaaaatgagtgtccgtgagccttgctctctagcctagatgcatttgtcctgtgtggaatttgttaacactcccatgcttcagactaaaatatttgtacttgaggtcagcctcacatttgcatgagaggctttttaagtcatcctgtggacacagcccgaggaagcggcattgccagtgcccctaactggttctgctcagagtcctcggtttagaggtgaagggcttggtccattgagttctctcagacagtggccaaacagttcagcactgaagggcaagacccagcaggggcctccttgatgtccagcttggtggggttggcaggaaaacctgagtgcacttgactctaatccaattcagaatgctttctgtttgtcatttgtcattttttcatgtgttaccaacgagtccaaaatggttgcttcttcctgtctattggtctagtcagcatgatgttgtcaatataatgaaccaatgtgatattttgtggaagacacagaggatcaagatcccttcaagctgtgttatgacttagggctggagagttactatttccttgaggtaaaactgaaggtattctgcaggctttggcaattgaaagcaaattgcttctggtggtctttatggatgggcatttgttagatgttttagtcagggtttctgctgctgctagaaaacaccatgaccaaaaaaacaagttggggaggaaagggtttattcatcttacacttccatattgctgtttatcaacaaaggaagtcaggacaggaactcaatcagggcaggaacctggaggcaggagctgatgcagaggccatggaggggtgctgcttattggctttctccccgtggcttgctcagcctgctttcttatagaaccctggaccaccagctcaggggtggccccacccacaatgggctccgccctccccccttgatcactaaatgagaaaataccatacagctggatttcatggaggcatttgctcaactggagctcctatggtccaggtagttaaaaaatggctgtctactaacagaaggttcaagaatccagcagttgtccagtctgtgaggctggctgtctcagctggtcttcagtatatgctggaatcctaaagatgtaggctctaataccagtgaaggaatggacttgccagcgagagtgagagcaagcagacaaaaagagagcaagcctccttgtttccgtgtcctttataaaagctgccagcagaaagtgtggcttagattaaaggtagatcttctcacctcagtgatccatattagaaatgggtcttatcactacaaatagtttaattaagaaaaaaaaaatccctcacagatgtgcccagacatttaggttttagttaattcctgaggtagtcaagttaacaactacgactagccataacactcccctaggagtgcaggttcacaagtgtcttgggacgggtgtgtgtgcgtgtttagatggggcctcactgtgacctggactaggaagaagtttctgatattaaggagaatggacatcagcagacaataagcagatcttcagatttactgtttttttctcttgtacttttgggacatgatagattatagctccagacttctaccattgcatcccaatggcaccccagtttgggcctagcaaatcccaaagaaagtgctgtctgtggtttctactgcaatgcttgtgtccttttggatcaataacagtggccaatggtgtttggccctgtgattaacccagtcagggtcatgacctttccttatgggaggaatggagtctattgccaagtcaaggtgctaagaagataaaaacagtcccgactacaaacagtagcaagtgtgtaattatgtgctggtagtgtttgagcatgtgctgtcatgagccggtatcctaggaagggccagctggactctgtctccatggtggctctcaccccatggatagtctgctaccaggcaattacacttccagagaagaaaaactttgttcttggaagagaaggtagatgggaaagacctttcccactggatagacgagaaggaggagtttggtttgtgttgccgagaaagccagacctcagttggatttcaggctggattctaagaccaaacagcgtcatcaagggcttgcctctctccaggtccctcctctgttttcctttgagatggctcttctttgtttctttgtttgttctttcaagacacactctctctatagtcctggctgtcatgggacttactatatatagaccagactgatcctagaaatccacctgcctctgcctctgtctcctgaggagtgctgggattaaaggtgtgtgccactaggcctgacttattttcagatactgtagtgcaactgcccacagcttttgtcattggtagaaaaagctcccctttgctgaaaactccctggctttggttctcattggtccagaccaaagagctatccaggctcatggtagctaggaagctgaaatacaggcacacactagatttagagttaatggctagtggttgtgggaagaagccgctacagaggtgataaatgtgcctaatagcctggttgtttagcactggtctcagcaaaaggccccatcagcttggacgaattgccataagcccatgcactgaaacacagaagtctagcaacagccttgtgcttttctgttgcccattagcatagggaggtgggagcctgaccacgtgctgtgaagcagaagatggcaccacctattcacttaaatacttccctgagcctacatagaggaccaggcctgcactggagagtaagattcagtccctgatcctggggaccttacagcttagtcaggggagaaagccatgaaacaagagttctctggtggaggtcttcgtttgacagttagtcatgatgaagtgtgggtgctggaattaggcatgtcagctctcattctgccatgtactcctcgctcagttatgccagcccatggcacctcggagctctcatctataaagcaagaaggtggtttgaggattttagttccttcactcatggaaagcactggttctcagtgagcactgcacaaacagccactagaactctcttcagaaagggaaagaccccgagccgaagccctgtagttaaaggcacagcattctgacctatggtttagatgtaaaataagattaatcacaccccaccttcctattcagactaccacaaaaaagagatgaagaaaaaaaacctcattgttttcttttcttttcgttttctttttctttctttctttttttaatctatgggacatcaggcactcaccagaaactatttaattctctcaactgtcaataaagtaggtattttcataacccaatttacataagaggaagcttattatcagggaagttgagtaaatttgcccagtgctacactccagacaattggccgagtagaatcaaagctagctgttatctgggcgcaaagtccgtcttgatgtagccattcccatgtcctggatggcaaaagcagttggctcagtgccaggcacctgccaggtgtgttcaaagctttgcatgcagaacccactactgcaagggaagaagagaccatacgcacttggcttggagcactctacctgctgcctgattattgactgttctggaatccttgcttctgatgtgccctgccactttcatggtgactccagccctgaagtgagaagagttggcctaggacagcttttctcttgaagtcagtttgtggacttttccttattaccaaattcataagacatcatgcagatgaaccatccaagaaaagacagagtaaaatccacaccccttgttttccatccttggctctgaacagtagctgttggttctttctggcctaccacatctcttttcagctgtatccatctcaactctgggtgtctggggtacatttcctgattctccatggagaaacaagcctgaggaaacagagccagaggagtgggaagaattaagacggagccagctgtggcagcatatgcctaggatcccagagtttgggaagtggaggcaggatgatcaggaattgaaggtcaccctcggctacagagtaagttcagggccagcctagacaacaagatatcctgtttcaaaaataataaaacaaaatatatgagaaacccaggagcggaaaaggcctattggggaagaatgagatacctggaatctgcacatgtgtgtttttcatttgaataacaaccgttatgattgtgtgccttatgcctggaactgatctcatagaacctttttcacaagatcttcaggtgtcacttcttaatttagtgctagaaacctacactgtcactgagccaggtcccagtcttctgccccaagctttttttctttgaggcagggtctttctttgtagtcctaggaatcttggaccttggtatgtagaccaggctagcttcaaattcatattcacctgcttctgcctcctcgctgctgaaattaaagacatgcaccaacattcctggcccaagtgcttgaagagacaaagtggggacgggaggagggagcgcatgcatgcgcatgctcaggtatataaaagtcagaatcatgttcataggtaggttcttaccctctacctaccttatgaaggagtctctcttctgctgctgtgctgtgtgctctaggactacttgtccctagagtttagggaagagtctcttgtctgtaggagtgtcagtattacagccatgcaccactccattgtagcctttttaactgggttcaaggactgaaatggaatttaggttgtcacttccctaatccactccatcccctacccccgccctttttgaatcaggtcttctccagctaagctggatggaacttgctacactgcttatgctggccttgaattcataatcctcctgcctcaacttcctggataggattttgaacctgtgccaccatgcccagattaatgtttacaatttcatcagggctaaatgatcatcccagtcagaaaaaaaaaaggctacaaaaattgcgatggcacagtgttttgctagtatgcccaaagtcctgggtttgatctctagctatacatacatacatacatacatacatacatacatacggatgtgcatgccatacatatatgcatacatatatgcatacatactggtagatataatttttttgttttttgcccctgtccagctgattggaatttaagttcttggggcgttggagccagggcaggtctctgtatcgtttttgtttttgtttttcgagacagggtttctctttatagccctggctgtcctagaactcactctgtagaccacgctggcctcaaactcagaaatccacctgcctctgcctcccgagtgctgggattaaaggcgtgcaccaccacgcccggcgttctgtatcttttactatgtctggaacctctggtaagagaacctgtagcaagaaaggtgaaaagctgtctctggcttgaaatgcacatttgataatgaggttaagtcactaatgagcccttgtggaattcacacatctggaccctgaaagctgatcattttctagtccgaaggtgcatacttttggggtagatccatctggactcttgtttttgtttttttcttttttttgttttttgtttttgttttttgagacagggtttctctgtatagtcctggctgtcctggaactcactctgtagactaggctggcctcgaactcagaaatccacctgcctctgcctcccaagtgctgggattaaaggtgtgcgctaccaccacccggtccatctggactcttaagacagacagagcacaaagaaagccttgcctgtcatgatgtgaactatagtgctgcagcaaagatgcctgaattcattactgtctgctacaagctgttcagtcccaacccaagccgagcttaactggaaggagataaattgatgagcaagctcttgaccctggaccctggaaggtcaggacccctctgtagagctcacaaccataaacacatcctaggtgcttgctcttagcatctgacttggagaaatgcctccaggaaagagcttggtctttgaagggaccctgtagaaccaggctgctagtcagctgtctctaatgcatctctcactagttatccctgtagaaagttgcacactgtaggaaggacccaccctagagactgtggccccctccaactgctttggacacagcagaccctgccccttcctaaaagattgtcttcctgcactgggctcattgttctgcaactttcctcaatagactgatgttcaccttccccattttttcccagtacataatgccagtaagatagggcgttgattcaagtagagctgtccccaggactgatcttttctaggtttctcaatgagcagataatcaggacaaaggaggtagaagggaaggaaacccatcttaacatttttgaataattcaggatttcaccttttatgagtttgcctggcttatacaatggaaagtagcgttcctctgactccggaggctggatgtccaggagcaaaggcagccgcctccttgctgggtcctcactttccctctacatgtctgtgacctaattcctttttaactgggttagggattactctaacactgccaccttagtatcttttaaattatgtgtgtgtgtctgagtgtgtgtgtatgaacacaagtgtggaagagaggacagattccacgcgtgggctcttgtgacctaccctgtgggctcagaggctctagctcaggtcaccaggcttaggggcaagtacctttacctactaagccatcttactggccccgacttctttttaatgtaagcagcgttttcaaggcctgtctgcacatgtagcccacagaagtcaggacagcatggctcagtcatattgtcaatatactgtcactgtttcctgagcacatttttctggccacattgcataaaaatattcatttgccaaaaaaaaaagattttcgtgtcttttacatataaccaatcctcttcaagacaaaaggctaagaggtgattttaaaaaaaatgaaaatttgggctggctgaatggggcccagtgattctgtggcacagggagtgacgacctgagctgggagctctatctgtttccaagactgctcccagaagcactgactgcttcctggaaggaaactcgcagtgcccccttcccacatgtttgagtctcagacattgatcccagctccagtgcgcctatgcagaagcctgcctctgtggacatgcaagtcaccaacaagcgaaactgtccttagaaagaccttaaggagcctgagatccagggggtaccaggcaggacaggaagaggtgtcctgatgaggagctacgctggggccttgacagtctaggccaacaattctcaacctgtggatggagaccctcagaggggtcaaatatcagatatcctgcatatcagatattattttacattacagttcataacagtagcaaaattacaattaagaagtagcaacaaggggctggcgagatggctcagtggctaagaacactgactgctcttccaaaggtcctgagttcaattcccagcaaccacactgtggttcacaaccatctgtaattggatccaatgccctcttctggtgtgtgtctgaagacagctacagtgtattcatataaataaaaataaataaatgtatataaaaaaaaaagaagtagcaacaaaacaatttatggtttgggggagtcacctcaacatgaagaactgtataaagggtggaagcatcgggaaggttgagaaccactgctctggactgactgctgggcataagttctgcatagggcaccctaacacggtaaattccaggggagccccaggatttgactctgattgtcctgacagtgtctccatcctggggagcatcgcctttccctcattgacctggggccttcgaacagctaaaggggtcaggtacctcagaaacgttctgtaatacacttttatggtcagtgggattgatttgaattggttaaatccagacccactcacaggcataattgtgtttatattgtaggttggtctccacagacttaataccaggatgtgggaggcaaaggcagatggatctctgtctcaaaaaaagttatcacctttatttggactgtgcatgagtgactgcaagtgtggaagtagaggacaattccactgagtgggctctggggacctaccctgtgggctcctggggtggggctggggcaggatgtggcacccctgtcatgtagattcactttccatgtgaaaggctaggtcaccaccaggtctgccagctcggctctcacagtgtcctagtaggatgcctgccataggctggattctaacttaacctttttacagaaccaaagatctcctgcatgccagctgattgctctacaactgaacagtatcatcttttaagttgtgtgtgtgtgttcatgtttgtgcctgtgagcacaggcaatcacatagagatcagaggacctccttagagacaggccctctctctcattccaccttgtttgaggcagtgtctatcagttggataatatgagctatcagcaaacatatgaacccagaagctgcagtagcacagagcataaaaaggctgttgccacatggctggatgacgtgagtgtagtccctgagacccatatacctaacctgcatggtagaaggagaaaactgactctcctgcaaaactgactctcctgcatgttctctgacacgcagaagcgtgtgcgcatgtgtgtgcgcgtctagcctagaattcagaggcctgcctgcctgttttccccagcactgggattgagggtgcatgcccactcctggcaagcttaagtttttggagacaaagctctgccttattcagaaagtacaatcgttacccagagactgggaaagacagcagcactgccattttttgctcaatccagcaattggatcttgctaagaccctcctgggggaactagagcaacaacagcttctaacggaaggtatcacttaagtgcccagataggcaggggggcaaagagggtgtctgggaacagtgaccagagctggccgtttttttctatgaaaagccacacgcctgctctgtgtggccactctttttacatgttgtaaatccatttttttttttttttcgagacagggtttctctgtatagctctggctgtcctggaactcactttgtagaccaggctggccttgaactcagaaatccgcctgcctccccagtgctgggattaaaggtgtgtgccattacgccccggctcattttttttttttcctaagtgaaggctgaacggacacttcggcagggcagacttggccttggtataccggcatgctagcactcttctaaccagctacccccccacctctgactaaaaaattaattttttctatttggggctctgggccacacaacttggaacaacccaggtaaccttgcatcgcggggcagacgtccggtgtttcttacatatcacagggcataggaatcatctgaaggtcttgtttgaccggcaggtcatgcctgggaagtttctttcctttggggttagtggagcggtagctgaggctgatctcggctaacttgtaatcctgaacccacgcccctcctttgccttcttagggaattccaggtgctgcagatgctgctggcctcctgcgttgttcaagagaagggttgagttacttctcaggggctgggagcccctagtgccacagaggagatcggtccgttgcgccgtgaaggtgcatctgcctgctgagcttgctcagttttgggtttatttaggctagccggggagagggctgtccaccgcggaggcggtgcactctcaagctaccggttggcctggagtttcagttctagaaggccgggtccggtggaggaaggtgttagatcttaacagttaggagaagcccctggaggaggcgcaggtgaaccacatgagcacgccccagccgaggagcagaaagcaggacagaatcctgttcttctagggatcttcacgtagttgcttcgttcctggtttcccaggcaatcctgagcaaacgcagtcctccagtccctgcccattaaaaatttcgccggcaagatcggagtttaaaggcggctgcgccgtagagcactcccatggtgccgcgcgctgggcgggttt

SEQ ID NO: 155 - DNA, 107100 bp, Mus musculus
cgcccgctcgctcgagctcggcgcggacccgcccgggagcgctcctcgcagcagctgcccgggttcccaccgccctaccgggcgcgagcgatcagactacctcggagggcgcgctcagacacccagatgtccggccacctcagtgggtaccctcggcaccctgtgatccgaccacccgcggaggcgcgctagccctctgggtgggcgtgctgggcttctctgcggcggaagtctggaccacagattgtgacttcttttctagcagtaggtgagtgcccagcgggagcgcaggcatgggatgccctcctactgtgtgggaaccccgggatcctctagggcacaggaggtttggtgtaatgactaagtcaagcttgcagaacaagtccgaagtcactcgccttctgggcctctttttcgagtttccccagtccctggtttgggaaagcgctttgatttgaggaattcttgtcttgagatacttgacaaaggttgaaaagacactcagataggagccgggagctctagctagctggcgcaggctgggtacacccggcgtgtttgaatgtggggggcgggggcccttttgagaatcagccctgggtagggctagggcgaagcctctgcgttggtcccgtcactctgtccccaaaagccacttgaaatgccaaggagagaagaaacagtggctgtagatgttgctaaccagctaaccccctccgtttctgatctacccctgtgctgcaggttattctgccaaggatgtgtgagacttggaagcgcctaggatacaccatttttactttatgactttttggcagaaaatatgcgttaaagtgttgaattacgagggaagatggagaaaataacttaattcgcgtttttgtaaagtttttgttttaaatgcaaggcagtagagatgtaggtatttgagtcatattttgcgactatacttttggctttatggtccatatgttccttataacctttcaaacaaaaccctagggaaaaaaatagaaataaataaaaaccaaggtgtgtgtgtgtgtgagagagagagagagagagagagagagagagagagaacacaggacttctggggaacagaagacaacctcctttgatgagtacagtgatggccaatttaatttgtcatgtgccactgaaggggatgtcaagctgataacatgcagactggagagaaaatgaagtaggagttgcccctagaggaagaaataagccctgatccaattacgctggggagagagctgaaggctagcccttctgcactggagctgagtcttctcagtggaggtggaagggtgcagtttgggatacaagctctgaattcagacacccagcagcataaaggtgtgtgtgtgtgtgtgtgtgtgtgtgtgtgtgtgtgtgagagagagagagagagagagagagagagagagagagagagaatgggtgtgtccaaagacagctcttacccatttactctagctgcacttgctgaagggttgagaggtgtgctgactcataaggctgccagcagagcttagcacagttagatttcacttctagaccttaaccacattatatatatatatatatatatatatatatatatatatatatattataaatatatataatatatatatatatatattcattcttatcagtctcctccctaggagattttccttgggcttttagattcacccccttcattttgataaccaccatctgcactggtgcacacatctcatttggcctgacacaaaggttttcatctcccttgtaacattagaaacagtgacagtcttaaccaccccattatgttcaaggtatttgtggagaatattggaaaaccagaatgtgaacaattcagttttctgaacagcagagaatctctttgccattacactgcaagaccagggagccccacccttcttctgagtgtctgcatgacaccagggaaggaaccctgcaattgcagcagtgcagggcgaggcagcatcgggctctgtgatgcctgtgctcatgtgcactaatgttggagaggggcttcgactcctgtgcagccttcaaaacctaatattactccacttcacctgtcagcttcgcaaaccagtatttgtaataactctgagaggctgattttgttggagaagacagagtgagaactgcttctaaactttaaggtcggggaggctgaaagacacgtcgagaacaaacatcaaaggcgttggatctcctgataagatttcttaataaaaataagggtttgggtttttagtgtctttttgtttgtttgttttttaatgaggttttcaggtaatatacagaataagccagcatgtgtgatagttaagcatccggtatcttcatgagaacaggaagaagaaataaatggatgcactagccctttactgcaagctccaccaagaagaactgagtcaggacatgccacatatgattagaggaagccacctctgcaaagacaagatttcaaatctataggaaagagtattataagccctttgaagaaagaggcgttctgaattcataattcctaattctcactgccaccgtctgtgtatcatccgcacagacagcagggctgaccaagaagaagagaaatttaaatcatttttactttctttaaaaaaattttttctctagaaagatgcccatttggctacctaccatccattcttaaagtagatacgttatttaaaaggaagaaaaagacatttctcacctgacagctagaatgagatagcacatttccagatctggctggacctgttagcacttacctcagccattattccgagtgaaaattgcatgtttctttttaaagcgataatttaagttcaaagctccttctgtccccccaacacacacaccttcccccttacattatcttcccctcttttaaatctacaaaacacaactacaaatcccagcaccttgaaggctttgagtccctggaacaagcaatcaggtaaattgtctgtgattgcaggtcattctaaaactcaaatcgatttcagtagcttcaggattcacaagggcagatcctggctctagcgctcagtttcaggattcacaagggcagatcctggctctagcgctcagcttggatgctagtgcctgggcagccatgcttcagagagtcttttcctaagacatcagtaattatctgaggaagctggcactgtctacttgcttgctgttgattttactgtgagaaggttccagaatattactgccttgagttcctacagtagatatataaactgcattgtgtgaggaacattccagaacatctcaatgaagccagcgacctggctgaattaacacctgccctgctaaagcatgccagcaaatctcaatcaatctctctctctctctctctctctctctccccccccccccccagagagatgttgctaatgaacacatctttttcaggacattggaggaaattaaaggacaaagggagggggcgcctgatatctgacttagagtgggcctctggaaatctttctcatctgcccacgtcacatcatacctgaatttataagtggtttgatgaaaacccaatttgcaaatcagccatttcagggaattttagattttttatgtatttgaaatttaatacatttttattctctctctctctctctctctctctctctctctctctctctctcgcatgtgtgagtatgtgcatgctcgagtgcgtgtgcatgtgtgtgtgtgtgtgtgtgcaagagtgtgtctgacagtaaaaagtagctttactttaaaaacctgaaaactgggtgtggtggcacatacagcactcttgaaagactaaaaagcagagcaaggaggattcatgttcaagaccagaccttgccttcaaaacaaacaaacaaacaaacaaacaaacaaacaaaacacagatgctgcaagccagcactccccaccccaacatttggaattgcagctcctttcatttgaaatgacattaaatcgttgcacagatatttctgcaggattcaagaatgcgccttgcgtgcacattctgtcaaatgcactcgcatcccacacagatgaatttactgctcagggttagttgattttcattttgaggagactctggggttgtcagaagcatttttatttgtgtctttcagtagaaattaggttctgattccatttagctgggctatctctggaccatcaagaccctccgacttttttcagtgtctcaaaatgtcttttttttttttaggatgctaatttgaaagcttggggtcaaaatactgtgggtagctttgctcagatgcagctcagatgcagctcatctgctagggtcagactgcttgttctccgacactcacagatttgcagacaaccctaactgctaatgttctggctgttttggtcttgcaggtgttgactggtccgactgctgcccttctgcccaagagtagttcaaactgtaagttcagcaaactaaataattaaatattgatagttttagagatctatactgattttccagtctgtctactcaagattccggcttcctaagaggggagcgagggtggagaccatcgcctggaggggtgtgtgacatggggacatttattgacaacccagcagtatgactttctatgaactgcttaggccattgcagccattggcccgcttccttctgagctctttcttgctacattgtaatactacgtgaagcttcgttgtagcttttgactgacttccttctgagctcttctttgctacattgtaatgcgacatgaagctttggcatctgggtaatgctgaattggtatttcccagatgtctttttctttctggatagccttgtgtgctctcatatcttggttcaagcagatggctcttaatatgtagatacctccagatccaggagctgaattctttggggtcggatgaaattctgtggttagcaatttaacgtatacactagccaaaatgtcggctctcagctgacgaaggctgtgcttatagaatactatactagtagcttataaaatggaatgtattaaagtacccaacaaagaggctgcatagggcaagactttacagacttcctgggactggttctgccttctctaccttatggggtgtcaagtgcttccaaatgtgactctttaagcaagggggattatctgtgctctgaagggattggtgctgggagagacacactgctgcttcataggctttgacatgtaacttaaaatattttttaaaaattctctggcacttaatgccttctgccagtggctgggctctgaaaagctggtttttaatagaaaaaacatttctcttatcttagcttctctcttgtttttctaccatcctgtgtctgcctccttgtctaaaccacaaatttctatatcattcacttcacttagaaataccacttccattttattcctctgtagcttattgctagagctgctaatagactttcaacacaaatagtgtattgatcactgaaatctctttcgagcttgactgaatatacataatggggtgtcaatcggaggaaaatctcataataaatggcaggcgacttatattcatgagaaaaatgtcttgggcagcacacaaaatatcatgcctactgtagcatgacaggctcgcctcaccggtcccggccggtctctgtgcattcatggtgggtgtttaatagggaaggcagggttagaatgccacgttcctgagtctttcctttgtttgtgtgagaggcattttgtacactccacagagtataaacatcttctagaagcaccgccagcaagaaagatcttttatacctgaggaattcataaattgcaaacaaatctgtttaagttgatgtatatttaaaatcagctactgatttatgcagtccatatttttaaattttttaccatgtgtgtaccagggcatacacacactgtatgcaaatattttcaatgcatgtatgggaacacacagtatatttagaaagaagcctgttttacataaattatttttaagagaaacccaacagaggaatagccatgcattaggaaagccacattttaatctctccaccccacccccctttaagcttgctgttggatggtatgtgaaggaattttatttttataattttatatgaaattctgcttttcctaccagaagtcttgaattatttctgcaaacccattactggagaggctgaggcaggagggtagcagtgagttcaatgacagcctaggctgcagtgtgaagcctcgtgtcaaaaagttgaatttccagccttgatggccaacacctttaattacagctcttgggaagcagaagcaggggagatcttgatgagttccaggtcagccagagctactgagctggtgagacctcatcccaaaccaaaacaaaatggtcaatcaatacaaaggacagggatggctgggtcccaggatcttgctatccagcaagcctggtttacttggcagactacaagccaaggaaagactctgtctcaaaaaccaaggaagataacacctgaggacaacagctgggattaaccctttaaccctcacactctaaggcatgcacatgcacatgcacctacataaacacgcacctacacacacgcacagtactaataataatacatattgctcttcctgatagagtagtctttgaaaaactaagtgtgctcagtgagaagggaccttcagggtggtaccatcagttgggtgatggtaggcatttctggcagggtctggttcctttatgcactgacttggcaactgtggctgctggttgtctatatagaatcctgctaccgagggatcataggaggtccacagcattagctggcacactgctccgccccatgacagaccagagtgtggtgttttctcaatcgattgggtgagatacagcccagttatatcggatatgccacctcttctctaagcaaatggagccaatgacttttgacattgccaaaaatcaaattttgtttttttaaatataataactcagcatatgcatgcatgcatgctcggtggtgaacataccacagtgtgctgtggaaggcaaaagacagcttgtggaagtcagttctctccttccaccatatgagttgcagggaccaaactcaggtaggcaggcttggctgcaagttctgatatgctgtggatgacgggggtggggaaggcatgcaaaaaagaaattgatgtttagagagatggctcagtagataagagcacttgccacatgaccatgagatgccagcacatatataacaagctggacatgatcatatgtacacctgtaacttccgtactcggtgtggacagagacaggaggaccattgaggcttgtgagctgccagcctatctccaggttcagtgggaaagcctccatagaggaggatgctgggcacacatatgcaccccacactcggtatcatcaccctgtaaatagatgtctgtttctgcttcttagagcatttaagatgttttaacgtgtgatgtggtgtggtttttcatggtctccacctcaggaggcatttatattagtcggtgtaccaatgagggcaggtaaggctgctgaggtatagacttgacattcagctccaaccttccctccccatagcaagaacttgcaccgtttcccctgctgctttgaggaaatgtttttcccttgtttttattgttttaagtttttagatagcaagtggatggggtacaaagtttgctgagaaaatggattaccagaaagctggtatttagacattcagggatgtgcattatgggtaagcttcccttactgttaaatgattactataaaatatgcctgatgaataatctacatatattattatgcatgtcagtagcttggttccaattaagaactgtatacggtgtgtgtggctttccagagtcagtcagctgcatagtttatacttggagactatgctggtgtggttttatgaaaggtaagtttaaactcagctgtaagaacaagcctcatgaattttaacctgcagagaagtacatatgcaaaagttggaagaaaactgggacttcttggatgtctgcgatgaaagagaaaattaaatcctagagaaaggaaacttggaaagaaaaaaaaaatattcccaaagaatttgagtaagaaatctgcatttgtagaccttgcttgtcttggatgttgggtggtttactggtgtatctcactaaaatgggccagaaaagaattaaatggtttttcccatggacttgttgtcatgggctgtagcactggactcccgtggtacattactcgctggatacattttctcattgaaaaacattaacatatcttttggctacatactatccagtttggtaatataaataaacacactacttaaatacattattttcttgccagttttaaacctatacttagactacagttttaaacttatacttagaacaaattggttagaatcaaaaacagcttccatatacccaccaaattttcggtaatactttcgcatcatttaaaaatatattcaaggaccaaggagacagctcagtcaacagagtgatctgagttaaatacctagaagccatgttagaaaagagaaaggggagaggccaggtgtgataatatatgcttgtgatcctagcgttagcagaaaggagagcaccctgggtgtttcctcaccagctatcccagctgaataagtgaactccaggccagtgagggatcctgtctcagaaaaacaaggtggacagtgactgggcaacaacccccgagggtgtgctctggcctcacacgaatgtgtatgcactcagaatcatgcacacacatgcacgtgcatgaggatgttcatatacacagtgcgcacacacacacacagtattcagcatcacctaaaaagccgcagaatgtacagctgtgtcacaagcgtgacgccaccacccctggagtttgctgttctgtggcacagcagctaagaaagatctagttcgtcgcgactgcgtttttcagcagcctaaaagcagcatgtttagaggtacaacaactggatagaaaggctgctgaaagtagtcctcacggccatgtaaatgagaccgaggataatgtagtagatgaagatgataatttgcttttaaaaacttgcaaggttggtttttaattccactttaataaaacacacatttgggtaaaaaaaaatttcagtgtatgtagtaatacagttatcgtcagagtagttgggtgtaaatgacttttaataatttagctttctgtttagtaaatagtttattttaaggttgtattgcttgcgaggggaaaattgagaggaatttgcttatggtctgcaactgagcatcttgcaagttggtcttcccaaggaaatactgaaactgaaaagcctacggcttaccttcatgtttctctcaaacctctagatcaccacggaagcaggaataatgtaatgtccgcagagatttagagcatccttatcaataagtgtgcactaaataagtataggacatacagtgtggagtcattaagtacactgatgcttaaatgtatacgtcatttcatatgagacaaaaccattcctgtttaaccgaagcccaatgcttagacatgcctaaatgttgtgtaaaattaaagacaacaggcttgttggtttccacttagttttgtgtgaggcagatactatattaaattattttctgggcggctgcggaaatgtctcagtgggtaaggcacttgcagagcaaatgtggggacctgagttctggtccccagcactgtgtgaagctggacgtggttatcgctgtgctcttacagtgagatgagagatggagactggggaattcccagacactggcatacctgcgtggaacggagcccagactcagaccaggtggaaggaggtaggatgagcacccaaggtcacatcataggcacagcaccgcctgcatgagcctacagctgcatgcacacccagtgtgagcctacagctgcatgcacacccagtgtgagcctacagctgcatgcacacccagattttcttgttcccacgaagatcaccatcgcctcccagaaactgagtgctgatttatttgtttgtttgcttgtttttgtttgtttgatgaggatgaggaagctttacggagctagattcttttatttttttaaagtaaaaaaaaaaaatctatgagtccaacaaactgtactttgagcttgagtttcctctcttggcttgctgtggcttcggccccttcagaccatgttttggccacaactatgcaacagtaacgatacgcaaacccaggaaaagaggaactgggttttgacttatccaagtagagggtggccttgtctatgaatcccgtccccagggatatgagcatccagtgtcagagccaatgcgattctcaggctaagcagccactcatgcttcatgtcctccacctcattgacggatgtcccctgtgctcggcatggaagccagccttgttcatgttccactaagctccagcccagacccagtagacatctgagacaccctaggtgctccctagacacccgagctttcccacaaagctcttcaaaaccatttcttccctcttattcttacaagatgaaagcttacagagttcactataagattttaaagtgtgaaacctacccaggtccacaagattgggctcccgcatttggatacaatccttggaccttgttttggggaaagaacagaaatgtaagcctccatgagggtcatgaagtgctagcttctgcagatgctctctctccacaaggctcctcagcccatgtgtgcagggttgggatgccttaaagcgggcaagcagacaattctaaagctagaatttaaattgatagcaaaatacaaaacaaagcagcacacgggaaggatttatagcggtgactgctggtgcttcttgggggtgttactaaacgcaaggaaaccagccaaacgccagcattgtcttcttctcctttgtatacccaacagataccactgaaagtgaccatgacgacagaaccctcttagctctactagctctgaacaggagcttatttggttgtatacagtgtcagcatcttaactgtatcacgctgtggatctcagcggtactagacatgttctctatacatacagctgcttgaaagatgtccagagtgcctaagaaattaaatgtatcgccttaaaatttttttaaatgtcatatgctttctacatattggttcatccaggtttgatgactgatgggcaaatgttggccctgcgctaaagtccttaatactctggaagttggtggctgggtggtaccaaccatggtgtgccctaagcatggtgatggcacagcacagcctgcagcttaggcttggtctaggaggaccgagtcctcttaggaatcagcataaggtgccaccacagctccaagacttggtgtccagcttgccaccaatgccaatggagtgtgacttttaagtgcccttgaataggctttcttggcagtgagggaggcctttgtgtttcccttgggtgtgggtgtgagtgtggtctcggtttttctctctctctccccccacccctatacatatagttaaggcccatggctcaaggtggcatggcgtttgcaatcctgatttctgagccctggactctacacggcctcaggcctgtaaccacaggttgtaatcacaggctgctgagatttaccttttccctctgttccaccgagactgagcgaggtgaggaagcctgtctctcattcattcatatatatacatagacatagacacaatatacactatatacactatataagggcagctataaggaacaaaggccagtccatttctccagttccctggctccagcaaagctcgcctggtggctttatctcagtctttcctggctgaacctggagaacccccatttcaagaattactggtgctttgagggtggcctcagatgtctgaaccatgatttcaaagtcatctgcctccatcccgggaaagtccttgggagtcatctctggacaggtcagtgtatggagatgcactcactggcctgcttttgagtgctctttattgaggagagtgggagctgggtgctgagggcttcatcctgccagctgggtaggagtcagtcctggaagaggaggcagaggaggtgagcacagcaggcggaggaggtgggcagtgttagaagccgagaggcacctgtcagtgcaagcctgagggacgtgaaaggcagctcaccaagtattcaggtgtgtcaagtgtagggtagagatggagggaggcagcgtagccaggagagccagctttgggtctccctcactctcataggcccttcagttctgtctttagggtatcacagcccacatgggcctccagctgccgcagcctctctggctggctggaccagaacagcttttcctgatgtgatcgctgctacgtgttgctgctgctgtgtccacagtaggtaccaggctgctgagggtcattgcaaggctgaggtgcaatcggcactgacagctgacagatttcctcacctcactcatcctcagtgggacggagggaagctgtaaatcccagcaggctgtgagcactaaattgagtaggacatttccacatgcttgttgctgagagggcattgtggggagtgcatggccagcctttctctctcgggttacctccctgctgccgcccttctagagtcaggggtactttggactggggcctgccaccttcctgtaacccttctaggccatgtcccttgttagccccactggcctgatgctgaagaggaggcagacagctccgggagacccccacgcatacgcctcctcaccagcaaggcctgggccttcagggaaaatgctcctctactctctgctgtcaggctcgggactgacaattaagccactgaaaaaagaacaattcacaacaggcctacacagagaagtcttttcatgccacaaatggccaaatcgtccccgttggcaccatttatgtcttgtgtataggagggactgtacttgaaaatggtcaaggagccttgctcagaaaaggatgtttagtggttctatggaaagcatcctgagagagcttattgtttccagctgtgaggtggccctggaccaagagctctgagtttgctcagtggggcatgggggttttctgacacagtgatggtccctctggctggcagggccttggtcattgagactataatgtgaggaggctgcttcgtggctacaatcaggtcacaggccctacccagctccaaaaccatccaagataggacacagtggcctgtatgtgtacaggaccatggaacccaaggcctagagcacactgagcctctggcttggactcagtggtggcttgatgtcacagtgccaagagcttgcatggaaaggcttgctggcctgagtgttctatccagtcacaaagatgctcacagatacccttgggaacttccaatccaggcatgttggtcggaaggtgtcttcagagggacctggtgtgattttaaggattcagagctgctgggaagccatctgctccccatttggctggatacaccaagtcaagtctcttttgcagttcctaccttgacctaatagactggtgcgtttggaatatggggccctatacaggtcagggtcacacctagctactgagccaaggtcagggacagcgtctgaattgggactgtctaggggtgtgttctgtgtccattggccatctggcctcctggtccttgagcagcagcatccaagatgtaagggaaccagtgcccccacgcccccattatgaccactgtgttaagtttggagcattgtctgggctgggtgtctatctggctgtttctgtgttatctctataaccatctatgcattccgcccagagtgggcaggccagtggcacaaggtggaatgactcttgtcatcctaccgaggcctgaattccacacagtctcagcccaggcttccagaccttccacaccacccactccaggtgcttctgagtcatgatctgtgaagaagaaaaggaaggatggagccagaggcttcatgtgttccaggccctcatttcccacagctgcctcctcccagctgggctagcaggcccctgcaaccatccacgcacttcccaggccccactcgattccgtctgacgtataagtgactcatttcctcaactttttctttttctttacttattaagacaatgaacagcctgcacagggatttatatctgcctcaattagatgttccagaagctatcagaagtggtttttgttgttgttattgttgtttttgtttttgtctgtttgttttgtttttatttttttatattagaccgtttgttagcaaaatctgtagccatgtgcctcatccttggacatggacttggatggggtcagctcccaggcactgtgtcataggacagccttagccagaagagggcagaaagaaaggttctctgttaattttcttgttactgtgaccaaatcttctaaagaagcaacctaagggtggaagggttaattttggctcatggtttggagtccatcacgatggggaaggctcagctgccgaagcatggggcagctgctcacagtgtatccgcaggcaaccagagatggatgctgggctcagctcactttctccttctcatgcggtctggggccacagcctgtggaatgaccctgtcaacgtttgtggtgggtcttcccacctcaattaacctagcctagataattactcacagacatgtccagaggcctttagtgattctaggtccagtcaagttgacaatcaatgttagccatcgagattgaagagcaggctaatgctttggggtacacagtgtgtatcatccccggtacctcatggccatgtcagcaaaatgagaacacaaggcaaacgggcacaagctttggggtggtggggggcactgactataagcctccatgcagggattagcgactgagtgtattcctgagtgcaacagaacacatgcctgaattcagacatccggggacacatcctggctacacctccttactgctgtgcatgtttgggcaaataattgaacctctcaaagaatcagatgttgactctgtaagagttttgttgccaccctgagaagcaggtctattttctaggaagggctgtgcagaacagacccaagtcacagtgacaatccatgcagacagaggcagttagctgttctagccttccaaaaccagaagcagtccctgccagccacatctcaggattctgggagaatatgtgtctcagggtttatttaatccacttaagccatgctgagttccacagagagtctgctctatcttctgcttgtttttttctcaattgcttcttaataaataaatgaggctaaggcaggcaggcgttagtccagctctggaaccaggcctggggctcccagaaccactgtcctgaagtgtttgcacactgtgttttctccttctgactacctgtaccgagtgtgggtagggtcagagctacacctgctgctataagtgctatatatcttctttttgatagatatctgtccctttccagaaagttcctcttagactcaggctctgccacacccagtggtccttcctgtgctgcagttgggatggctctggtctgtcacagcctccatcccatatctaaagtccagaaaaaagacatccggtggcaccagggctaccgtattaacaaggagtgtcgtttaggaactccctcagccctcttggcccagctgctccatggtggggcatcctcagccttgtgttggtaggcaggatgtgagtatggttcaggggactagaagtccctcctatggttgccaggcaccaagcacacagacagccaactgtgtaagccccggcctgctgtcatcctggcatcttcgtcgccttcacacccacacactccatccagagccgccattagccggagcccttcctctctctctctggagcccaagcttcccaggcccacacaggtcagggcctctcttacccctttccccagccacttatcatccaggggcatcttgtctgcaagaatgcatgttgtttcctccctctcctcctctacggggcaacttcaacacaccttagagttttagttttgtgctttggaacggtttgcttcttccagactccactagctgcaatgtttaccaaggctgggttgagactgttattctctgtaccttcttctccctaagcagtcctgaccgtccatagctctaaagtggagagatgaacccaagaaggcatacagattaagaaatatctggggaccatgtgctcaggtgagaggacctatcagaagtaactgaatgggtacaagtgactaaaggaagcccccaagcccacccagcagcttctgcctttgaaactaccaggacccactcaggccaggcagctcaagtgcttctgggaacatgaaggaacaaggcatttcctctcccctaaagggtattgaactcagactatgctagggatgtcacaacagcctaacatggctcctgacacagtctcagttcacttatatccaatctttgtggagttggttgtcttcattcacttctcacccaaggaggaagtgtgggctcagagaagctggtactgcctcctcctctccccttctctcctctcctcccctccccatgaacctgcactgagcagtcctccccagaagtgagtgctcaaatctctgcttcgccatgatctacatccgtttccaggttgtcagcaagacgggactctaacatagaccaggaaagtccagagatggaggtggtttgtaaggcagagtggagtttctacccacaaaatgtcggcactatctggatttgtccagcagagggttgccatgtataaatgagtatcaaccaagcaggctggaggtctcaccctgagactgaatgttgtcaatacctcggtggacttgggggaaatggatggcaaaatagatgggaagaaaagcaggctccagtcccccttctggttgtggtactgtttgcatccatatcagcatctaggggctgtgagaaggggggaggggggcttggtgacacacagcaaggagagtggcattcatgcaggcagagctatagcagccaggatcgtgaaatggtggtgggaagcaagacagttaaaggaaatagacccaagaacagaacttagactgtagccgctggaatgcaggtggcaccagccagggcccatggtcctaggtgtggcagaagagcttggatcaggagttcaaggataacctccgttatgtagagaatttgaagttagcctgagctccatgaagtcttgtctgaaaaataattggaaaaaaaaatcacagggctattgaaggtgagaatgtgtgccttgctatgtgttgttgggatttcagacatgccactgactggccctgtggcccgggagggttccttaacccctcagcggtggccagaacagactctctctccctaggctgctatacaaagtgctttcccccttcacagagggagtggccccctgggaggagcactgcccaagcatccttgccagtgtctccatcctgggcagctctcagaaattcccagactgtgctgacaatgctctgtgaggttcatgggagagtgcatggtcatggtcaatgtttccccagcctaccctgtctcttctctcttcttccattttgctgtctctcaccttaccttcctgcttgttctctgccaggctctcaaggccatggtgttcttcatttgcctcctgaggctgacctgaggacagatgattaggaaagcaaccccttattagtcctcattacagcttctccggatccttcagactagggcctcttgcagccagcagcagttgaatttctactctaggaggtatagtggctggagaaactgaggcagggagattgcctcaacccagcctaggcagcataataagaccacgtctcaaaaagaaaatggatagataggaaggaagagattgcatcgttggcctttcacctgaaaccccacaattctagaaacatgggacaggaagcctttcccttttcattgagtctggcgccccactgccaggtctccattcttgctcctgagaaggcttagctgtagagagtactgtgtggaccaggtgaatccaagctgcatgtcaaggaggggtctacaccaccaagctcattttaatctactcttggtttgacagggtaattctgcctcccatggatagcaccagaactgaaatggccaacatggcatggtctgggtcgaaagacctgccaaggttccaggtttcctgtggagtaacatcctggtgtgaactgggatgttccaagcctctagcaccctgaaatcagtggacacaatcctggggcatcacctttgtgtcatttcacctcttgcgaagcagctccgtgactcccaatgcttgctgtagtggtgcaaatgtcaatctgtataaatatggccacactggggcctgctttgttttcctttccagcactgatactttaatgtgggatggtgtccatttttgtaattatgttgctgcatccttaggagatactcagacagcaccctcaggctgaaggtgctactgccatgacagcgtggcagctcatgccaagcctaggcaatagcatctcaggaaaggaaggaccaggaggccaagggactgagcagacagacaagacccagggaaccatctctatcccaggacacccccagttagcagcctcaagccctgagctggttgggcttgctacctggagtttctccaccaagttagtccataagtagatccacaggctctttccacacgggccctttctctgtgtgctaggactgtggcacaggctccagggactgtgcaccctgcactattttgtgggaaataaaacttgcaagcctagcctagagcctatgagcaagccacatgacagaaaatggatcttggcttgcactaagggacacagaactggagtcgagtctgtgcaaaggcaggtataattgatacaaaaagaatgaaatgtttgagcagctgcaagttccccgagcaatgcaaacgtccccggtgccacaaggtttccactgtaattaccacaataaacagtttcctatagaggataaaaattctaagtctgagcaaggttacctgtctccagtactgtggaaatggtagggtttttgtcttaccttaaaaacaagtaatttttctacacttaaattacttaaatcaccaattaaaaagtttataattgatatttgttctcccaatgaatttaacctcatgcagagtgctccaatttcccttacaaaatggtttgttgcatgagatagcgtgagggcttatttttgttctccttctaagatgagcttttatctttaatggggtcacagacaactgggcggtggctttaatgattaaaatagagatgataccatagtcccacctagttaaatgtataccctttacaaaattctgttgattctttgtattaacactgtattttgtgaaaaacttgatacagcttctccggtgtcttacaagcagctgagtagggacgtcaaccctggtgccataatactgaggccagtgtttcatgaaagaagttaagtacatgtctcggcagtcccgaaagatgttcagttagatgttggacacaggagttccacggccaaccttgaattagaatgccaattgtcaaacaagtttttttttaagtgtgtgtgtgtgtgtgtgtgtgtgagagagagagagagagagagagagagagagagagagagagagatgtttaattagcagtctaattatctaccagagacttagaatcacagtccttcgtccttcctgggaagtgggaaatgcttagattttctataggaagtacctgtatatacagagactgctggttgattttaatgttaaaatacatataacctaatcagaaataccaagtgtggagtgtgtgtgtcccttgtcattgcacaatggtgacttttgtgcctcatggggtacattcctcacatccctgcaggctgccatgcctgccttgttccttatgaagaagacaggaacctaaggtctacctcagacctgagaaattaaaatctgcccatgcgggacaatcgtctttcagtcctagaaggaaagcagataccatctagaggaaatgctgcttctcctgaagcgctccaaagtagatggatataaatgatattgtttgatttccattgatttctttttcctagggttttttattctgtggagtcggaggagtatgtgagctgacagtgctggtgactttctatttttataagaactcaagcaaattctaacatgtttcctgaacattttggttttttttcaggaaacctgaatgagagagcagcacccatccatgggaacaatgaggcattctgctttgtctgcctataggagctgtgagctgtgctctagctaagaaatgccagccacctcagcaccatctttctgcatttcacaacagcaacttttgttctaggagcccaggctctatatgttctctgtacctcagttcttctcttcccagtttttctcaaatggatatatgcttgccagaggatgaatgagaaaaatggtgtggtcttgggtatttatttcatgacactgcccacaggggctcgctggcctgcaggccagatgccagctaccagcccgtggttcctctgtgaaaagagcctttcagctccttcacctcctggagagagctgattttccagcagtcgagcttgatcggggtaaataattagagagcttgagagggagagacatcaccctagtgctgtgtgtgacgtagccagcccctgtgactccaggctgacacagtctcacagctttctctacagctgggagggggagagatgggagggggaagacagagggagggggaagcaacaacgaagctttgcattgccttggaaaaccaaaagaaacagctcctgatctggtgtggggtgaacctcctcaacctgctcttttcttctggaatctgcgtgcacagggccgttacctgggcatactgacttatttcacaggtttactgggctgttggaatgtgccggactctgggtggtgtaggctgaccctgaaggggctaatagcttgttgccgagcttttacaggtattcactgaaagccactttttaagtacattcaccatttttatgtgtatctttacaaataactgctattctgaaacttgatgggttttatcctgtcctgcgtggtatttgtgaaaactttctaaggcagtgttcctcaaccttctttaacgctatgacattaggagcgaatatagttcctcatgttgtcgtgacccacaaccagacgattatttttattactacgtcataactgtaattttgctactattatgttctatctgtgttttctggtggtcttaggtgatccctgtgagagggtcatttgacccccatgggctccatggtgagaaactctgctctaaggcttagtgaaggtctcaggtttcctctgaacacttttactgaagcaggcaaaactgactgctgagaaataataattggacaagtggcgtcttgctacttataagaaagatacagttactcacaaataatatgaaaagaatatgacttaaataattaaaattcatagctaccacatggttgtataattacaaaggccccttaataaacaggatccgagctggaaaacatataaaagaaagatcatagctttgggggcttctcctaagctaaatgaaaccccctgatcagtatcaagacatgaacagccaactggctccctacccaggctagactctgatttactcactgtaagtcccagaattagtggacctcatcacaagagtcttccatgaaggtgatgaataaaggctgctttagtcaccagctcagcgagccctgctgcgtcctgggtttgtgacaagccaggatagttagtctaggtccatctagagagtaaatcacccactgtgatgagcttggctttgtcacactaaaatgtttttcttgttaaagtgtattcagatcacatctcctctatcaagattcttttcctcctttctgtctttctttctttctttctttctttctttctttctttctttctttctttcttcttcctttcttccttccttccttccttccctgtatgtgtgtgtccatccactaatttattaaaaagtcagtttgtcttggaactaaaaacagcaatagttgggtgatgttaaccacctacttaaccagcttagaaacgtcctccctctccccttcctccttttctctaccatccatcactccttcccttctttctcctcttcattctcttccctccctcctttcttcctctttcttcctccctccctccttcccttcctctttccctccctccttcttcccttcccaagccctaggtcttttgaaggctgccccgaggctgaggtgtcagagaactggtcaccagaaaaacaggtcctggcaggaaggtatgcacactgggcatgaaatgtgggagagaccaggatgtcttaggtagggcatagggcagcctctggagaacccgggaaagcctgtctcactgtagtggcacgtgtcaatactgtgtcctggtgtcatcagagaaacctctaagggaagcagtatgcgggaacccttgctccctgtgcactggctggtcgggccctagcgaacagcggacagcgtctttgtctgcctgcgccctgcgctgtgcttcccattgatttttagcaacgcagagttgcgccccccccccattccgccccctccccgcgtctgcgtgaggcgagcctgctgcagctgcggggttcctctaacttcgaatttccttattacacacacacaaaaagaggttcctccggcatccgatggagccattccatctgctactgacgctgaccgggtaagtaggatccgtgctccagtggcaagccttggggctgtacgtcaggtgtcaggcttgcaggggacccagcaggtgcaggtgctcctcctctttgcgaggtgagctcgcccctcccccgacctctgggggcctttcttcctggggtaagctatgagttcctgcgccccaggcatctcagatattttcccggagctactgtggtgcccagtcttaggctgtgttgggacgtggtaaccctgcccacccatctcaccgggagtcttgatgcccagcttgacactgcaggctgagttactgatttatgaacatagtatattttattttaggcattaggcataaatctcccctgggctttgcagtcatgttcatgactagaaaagagagacaaaggtgccacccagccttccatgactagcctggtggccagacttatgttgctctgtgaagagctaattaacaagtatgtgtgtatatacttatgtatgtatatatttgttgtatattttatgtagtgtaatatatataattaatagtgtaatatatgtctatatatagacacacacacacaaatctggggtttcttggattcctgtatatttaaaatgcatacagctcagctatcccctccccacaacatttgacaggtaacagctgctggtctgtaatgtaaagattggacatggtgctgtttggtttttctgtttggggatgactctaggattgtggtggacaatttaataaggtatgtgaaaataaacgttgggtttcgttgcaaacagtgctccctacagcgatggtgagatgggaagtgggttgtttgcttcctttattctagcttgaacttggttttcatcttgctacattcccagccttctgctcctctatccagaactagattattataagaaaagcaatctcaaccttgctcattatttccaagatctctgctactcctgtagacttggactggatggtgctactcatttggtggcatctctacaagaaatcacagcctgggtcaatatgcacatatgtcatgccctaccctagccaaatcatctaaattgttttaggagattttttttaggccagtgaacatttagcagaaatatctttacagattctgataaacctattcttagtttcagtgctataaaagcttgctcaaagcagtcagttctaatcaatctttctaactaaatatatttatgttgttaactgtcaaagcattgaacatgctctgtatggagtagcccatctaataaaatagacatttcactatgcaaaatatctctctaattttaagcactctgaatgcatttgtcagactcggagaggaggctccgtggaagactgagttaggtccagcagcattcgccctgggtttacattctctgcggactttctctgcgttctacacaacaagtgcctatcactttttaaagtgatctgctaacatgtgttcagtctattaagataaatgatggagtgtgcatatgtccatatgtgatttactctgtgggtagaaatgacagccattctggtggccataaggaagtggctacctttatgagaaggagtgagtggaaagacaccctggagcgatagtttgtaagctgcaggcatgatgagggaccaaagactccttcactgtagctgtcccacaggcttccctggtggctgcccttttactgtggatcactgaagcaaagacacaaaggtagaacgttattgagcaataatatggtcttttcattgtgcccatttaactacaaaactgtctaaatgcctgacggtcagcagaaaagccaccctacgagtaacgctgtgatgtggcgtgagaggggatagttttcaaggagcatattactgtagattcggattggggggcgggggcagctatgcttataggaaaatctgcacgacagactcggagcgagtgtggggtctttgtgactggtgtgtggagagcttgtcacctatgcttaaaccatgatgtgtggatgtgttgcccatggaaagaatgtgtaaagttcgcacagcaatgattcagttattgtagtgagccatgcaagcagctttctgagatctcgagaagaagctcagagcagactgcaggaaggggtgcagggaagggtaggagagagggagcttaagatgcgaccgagataataaaagatactgtggcttaaaatgtggatttttgcaagagaacagaccatagggcctcttagtggcacactctctctatgtggcctttgtttactgaggtacggttggcattcagtccctagggaaggttatggtctataaaatcttttactgatggcctgagttctattgtgttttacaaaatgcatacacccgaacacacatccattgaacaaaaaaactatatactatgccttcatatagttctctatagattaaaaaagaaaatcagtccaaaccatttaaaatgaagtattcttttttacagcctcagaaatatttgggggtaatatcctagccctgcctgatgttaaaccatcgtttcaaatattcacttaaagtaaaaagcactccctcattttgatgaataattaaaaggggtaggttgatatgaaaggctgtatgttgttccgtcgtggctgcgccagggatctggggcatcaattccactctgaagatcctgttaatctctcatttattaagggtggtgtagggagggacaggacctctggagaatgttagaaataatttcgtagatattttaccggcacatgagtctatttttgtgtgtgtttctaactttagctaaaagtaagataggacactttggggatgttagtgcttccctcttgtttagcagggactgtatgtatatcaggaatatcagagttcaagccctcaaacccaagaccgaaagcttgagcatggtaacacacacctataatcttagaactgggagtctagcctgcttgctggtcccaagccaaggagagacctcgcccccaaaaccaagctagatagtgtttctgagttgacacccaaggttggcttctggtctctccccacctctcacacacagtgagaaagggagggaggagagattgaataaggtttgtatatagttttacagaattcatctctcaaaaacaaagagatgccttagtgatctcttgctttatagtgtgtgggtcagtgacttatctatctacttgagatgactagtcttaacaatttgacctgtcttgggaaaatataaaccagcaatcacaaaatcccaaaggctctaagcaactggatcttagtggcctcgcagtggacatttgttagtttctttgactcttctccgtgtaaccaccgggtgatcagtgaccatggcttgtgtagactctaatatgggatgaagttccatgtcatatctcagatttctgcaccagtctctggatagcagatgggctaagcatactttccctttgtgcttcaaggatgaagagtgcacagtgaggtcaaagagcacagcctcatggagacatctttgcgtgtttagacagtggatgattttagaaattgaatgtggtgatgcttccttggtgtgtcttagaaagcttgccaaacgcagcatcctagacgaggttccacagcctaaggagaaacttgtgacatattcttacacttatttaaagcgtaaccttcacaccaatgcagagctaccagcgacagctaagtaatgtgcggcaaggaggaagagaaccgtgtgcagatctggtttgagtactgatttaaactttggaaatgaccagggtgaatctcaccgaacctccaggtccttaagacagggatcagccatgtccctgtaagtggatgctcaccccatcacagaggatctgtgtcaccgtggtatgggggggggggtggagtggggctgagtgttccaagagcaggggagtctgacaaacagtggaagggaagctgacagacaagcttccatgtgctggtggatggcagggtgtgacaagggcttcccacagcacctccatcacaagctctttcaagttcagcttctccctgaaaccactgcccctcttctcagtgatagttccagagcaggcttgtgctgagctgcatctacccatgtccaacctataacagcaacacatccggcttcttgtttctaatcttgccccatttcttcacaaagcagccagatcatagaatccctctccctcaagatgttctgctggcttctccattcacttagagagtaaaatccaggctctcgtctgatgccttctgagaactggccctgcctcccgtggttctcctggcatcttcttcttcctcttaagtggtctctagatctcaccaaccattttctgtctctgggcattagcccatgtattccatggctggctcttttgtataattcaggcctcaactcaaatgtcacctcctcagagaggcccatccttatatctcaagggacttttctgcttggcccatcaccccattttatcttcttcatgtactgaggtaaagtcccactttcatttgtctatttcccaattgtcactccttcacagcaatggagagagatgcccatgatccgtgctgctccccccccccccaatgcagaaccaggcaggtggttagtatttgctaacggaatgcacgggcacttggtgctcgatctgagtcctcgcagcctgcagccttggagagcctagcaatgacttctggcagcttcctgcaggtgcttgaatggatgctctgcctcccacttctagccctaagctacccatgcacttcagacagactgcttcaacagggagcagagggcactggagatgtcttctctctctctcctcagctctcttccgtctgcttagactccctaggtggtcctgtcattcacagcacatagatcctatgttttcttgacctattttcctgtccccactctagctgaattgttagcaggagagccctggttccagacagtgtttttgggcagaactctggctaatgaatgagacaaagtcacggaggcaaagaaggtatgccaggtgacccggtatttttccaaaaagaccctctattcaattaggttgctctgttccacggtcagtctgctaacgtgtgatggttcacatgtaagagaactgaagcacagggactaactaacctaacctagctgtggtaggttgcacagcagcccccagctagccacgtgaagtactggtgaaccacacccagggctggatcccttcagcctccctgtggtctcacactgcttcttcaccaatgtgtgtccttcctttcttgtcccactgactctgcacttcttctctgccaaaagcaaatctcttaaagtggcataggagaccaggacctgtcactagccattctcttttttcccccaatgaactccaaatgtgcagggatggattcagagcccatacccactggctccaacactctcaccagctggacagctctgtcaccgtgaacacccagcacacaagggtccctatcgcagtgagggcttggatttgggggtaatagggtattgctgacctgcactattgcctcccctgacatcttagattgtacaggccacactgggactgagtaagggtgaggcaggctggctgtcctctattctttctgcctttaagctggagaggataggaacacagaaaggatgggtgctgtcattgtctttcccttcctctatgcctgagccctcaccgccccatcaggctgcgtgtgattgaagctcactcatggaagtgttttgttccttttttggatgggtggacatgttgtctacacacattctcatcacggatgattcaaaattggggttttgagtgccgcccggtgagaatatttattgatttgtctgtttacttattgggttttttttaaaggcagggtccttgtagcccaggctagcctcaaagttactatgtagctgaggatgactttaaactcctgatccccctgcctccactcctaagtaatgggagtacaggcatggaccaccacttccggggatagctcttagttgctgaaggagccattcacatgggatataccaggagccagaggatgtgtctgagcttccagaaggaccaacatggccagtatgttcacacagtggcacgtggcagatttcttgttatagcattcatttctggggactgccagtttcctttactgcgtaggactcttgacatgacagataataatttatccgtccagacgcagggctttgctgcatcagacagccttaaattacatgccatcccctttacaaaaccaagaaataaccaaccggcaaagtgactgatgtggaaaataaagtatctttgcttcagagaagacagggctggggagaggctcaacagttaagagttctggttgctctgccagcagacctaggttcagttcccagcatccaaccattgcttgtagctccagctccagggtatctaaagccatttgctggtcttcttaggctcctacacacttatagcacatctctctctctctctctctctctctctctctctctctctctctctctcttctctctcgtacacacacacacacacacacacacacacacacacacacactttttaaaagaaagaagaaagaaaacttagagcctttgcataagcagtagataaattgtcttggtggctctttaaacctcttattagcatatattaattgtcaaataatgaatttcatgatggcactttcatacataaacataactacctttgatcacttcatttatatgcacctgcatctcctcccctgtcccctcccactttctttcctcttccctaatagtctctcttcaaatttagattccaagaataaaagaaaatgtaagataattcacctgtctgaatgtggctttctccttgtcctcctccatattctcctcctcctcttcctcctcctcctcctcctccatttcctccttttccttacactcaacaagattatcttcagtcctcatttcttgcacacaatgagacagcatgtcttaaacctactctctaaatgtgatcctccattcgaatggaaagatccctggtctttatggaacataagtggacatagcaggcatttctcttcttttaggtctttaccatccttcaaaaaaattactctaaagcacaactggagcctttgaattcccacatctccaaagagactacctagtgtgatgcttaatgtcacttgtcaacttgatgggatctataacctcatagatcagaagaccctggccttgataaggttaattgaattgggaagacccacccactatgggtggtaccactccctaggctggggtctaaaactctataaaaaggagaaagtgaactgagtctattcatcactctctgcttttgccagaggatgtgacatgatcagctgcttccattgaagcccttgctgtcttgacttctccccagtgaagaattatactcttgaactatgagccaaaaatacacactttctctcttaaatggtttgttagggtattttatcacagcaacagcaaaggtaaccaaggcacctagtgttgctttctaaggcttgcttttaaaatactgtctggaaatcttactcatgcctccatgctcctcttactcatcagcacactgagtcaagcgtttaaaagcaaagctgctctcttcctcttcctgctgcaggatgtgttgtcagtgtggtgctctgtgtttcttcccacagactgtgggcaaagccaccaacatcttttgagcaaaactgcatatactttcaactgttacagctcaggcctactccttatcttctctaagccgggtggttgctatttacctcaccctctgtcttatttgagtgaatgtatccatgttttcaagcaggggaactaggtcaagtgttttaggtttttgttgttattgttgctgtttcttttaatacaaccaactttcatgtttttaaaaacctcaagataaaaaaagaaagctgcattttggaaagtgaaaccattaactggtcaggttaggagcataaaatgaccaagagctgaatatgcccacgtgagcagaagagcagctgtcattcatgatttattcagactcttccgtcgctcttccctgctcacttacagtggacaaggtgctcctgtgaggttgagaggcatctgtcacacaaagtgattgaccttccaaccctttgtatttgatttgtttgtacaaaggaccatttaaaaaaacatgtattcctcttattattattatcttattatctgtcttattatcagtatagcatgaatgaaacgccctcaaagttgcattgtgaacagaagaaacaaggtagagtggctttggtgagccctcacacactccagagccagtcctccgacagccagtgcccaggatggtggttaaatctggctctgctggagttactaaatgatagaaatccataatcaatcaagaaacaagtctctaggagatggtagattgatggagagatgtggatggggtgacccccagcatggagatcacccagggactcaggggacccttggtggtgatgcattgagaccacccgtgggtgaagagtgtaaattggaactctagcctgctgttcctgattcgtctgaaggcagggttaggagtctgcattttaagccttctgatgcctgtgactgacagtctcatttggtttcttagcttcagttctcacatccctaaaaagagggtaatagcttctatttcacagggttgttggcaggaactgagagaacctgtgggcaagggccatgggaacagtgaagtgagacagtcgaaggcttgctggattcgtgagtttggctctcagcttccttctggagtttctgctctccaccctcggctgaggtcaacctgccttgggtagacagacgctgacaattattttattcctcatttccagataagattccgagggctcagatctctatctttgcctcctcttattagagtgctatccccagctccctcctcccttttgtctttcttttcttcctctctcccaccctccctccctcccatacatatgctgagctccatagttccaggtgtttgggaaaaaatggaaactttttcctaccatttgtttttgactcagatagggaaagcattgtggtttggttggtagaaaagttgccagtcagattccagccactctctgcatagctctcaagataactctagccatacacttcttcagtttgttctgattgcttcctaaagccagggagagaattgcctctccaaagctctcaactgtccagcctcccagaactctccaggaccatccagagcccttctaattcagcaagtcaccaaggcaggttttcccgagtcatactgcataattccttcctatgttggcttctatatagccccagcctgaagctagactcctgctatggaccatccataactgactgcagaattgagagacctcgtgagtcactccaccaggttccagagaacctggttaccctaaattattgtgacttgctagagacctggactattttaggacaacaggaccataaattaaaggtaggcttctgtgacagaagatgagtgtagtgctctgtctcaaatggcatggggcatgcttctgccaatactgacagattgatgggaatagactcagtccacagtcaagctgcatgacgcttagatgagaggccataagtgtagaaaaaagtactggaagcaagcctggagggaactgagacacagacatagaggtcaaatagcttgcctagggtcatccagtgggttagcagcactgcacattccgcgggggattccagctcaagcatttgtcagccctgggtccctctgcctccctcagcagactcagccaccgtcccctgaatgagggtgttactggaacagcagcctgattccgcctgcaatagttgcttctctgaaagaattaaactcctaggcaggcaccagatagaaaccatctctcatcagagagtgaggggaacagctctccaaggctctccattacctgtgaaaggacgatgcaactccttccactgccctgcatacttaatcccactgccagtcactcttgggccaccctgtctttcacttccttggacaaaccacatagtcccacaacataaggttcttgccttgaaatacagctcttttctctatttgtggtcttcagatctcggctcaaaagataattcttcaaaagtgcttcctttatactatttaaagtaagagacaaagtaccctgatggccagagatagtcctgctgcagctccaaaacctgaccatggctcttcacacacagtaccctgatggccagagatagtcctgctgcagctccaaaacctgaccatggcccttcacacacagtaccctaatggccagagatagtcctgctgcagctccaaaacctgaccatggctcttcacacacactgctgtgtgatccacagaggaaggaagggaggtaatcttcagactggagctctaaatggcagttgggttttgtgacttgtcggtcatcctaaggaatggactcaggggtctggctgggcttcccctgtgtgtgttccagcaaagcattcgctgttctagtctgagcttagtcttctccccagtcgctgtcattgtccttctccccttcttcctcctcctcctcttcctccacctcctcctccacctctaccccctcctcctcctcgttcttcttttcctcttcctgctcctcattttcctcctcttcctcttcctccccctttttcttctcctcctcatgacagcaccgtcaggcacccggctgcttaagtcatggatcttacatcgtccataacatcttccctcccacaccacttgccttttgttatttctccaatgtctcccctcagaggccactccgcagcttcatccatgttcctcccagctgctgtgtttcagatctcagcttctttctttcaacaggacagacaatccctacctcaagagtccttctaatacagttattgtgggtagaattagtaaaaggggacagattgttaagtagatttttatttatttattttgtgtacagacacgtgtgtgtgtgtgtgtgtgtgtgtgtgtgtgtgcgcgcgcgtgcgcgcgcgtctctctctctctctctctctctctctctgtgtgtgtgtgtgtgtgtgtgtgtgtggtgtgagcatgctatggcatgtgtgtggagatcagaggacatctttccaaaggcagtcctctccttccactgtgagggttctaggcattcaacccaggtcacttggctaagtggcaagcacctttcccacagagatatcttgctgacctagaaataaaattcctagcattggcatttttcactaaaaacaaacaaacaaacaaacaaacaaaaccgaggggggaggaggcattgtggctggaggcttgtgcagcacacacatcagaagacgccaccctgcttacctccgaacatctctagaagatgcctttgttactcagaggaggcatgaacaaaaagcaacgctgtggacagctatcagttgtcctaagtgttgcccctttaaggagaaggaaatggaacatagcagaacttccacatgagcccacattcttcatctgcacccttgggggcaagtgctgctgtcaggctcgatgctcagacctgaaacaaagtctcactgacaacaagacaaactctgtgcctcctaattgccccctgcacgaggcttgcctctgcagtgtgacacgcctttccaggtccagttggtacccttcataagccttttatgccaaaccactctctgatcactttactccccaggccttccaaagtgtttgcttttcttagagttttaaagaatttgggatacagccgagcctggtattaccatcctgtaatgacagctacctgggaggctgatgcagagagagtgcaaattcaaggtctaaagaattgagtaagaccagccagaataacttggtgagaccttgtatcaaaataaaaattgaaaaggctggaggtgcagctcagtgatagaagacttacggagcatgcataaaactccagttcatgccccaggactttgaagaatagtaacagtaaacaggatataaagcaggagtttgcaagtgttagcctctacccaagactgacaagtacctgccagtgttacaatctttctcttccatatcaccaacctgctattctttctcatggaaagttacagatatcttgttataggttgttgttgttgttgttgttgttgttgttgttgttgttgtcattttgtacattactcaactctgacctcaaggctaggaaatagtaaatcttgatgctcctaatatagagtgagtggtaactaaagactggatggatggatggatggatggatatatggatggatgggtggatggatggatagatgatgaatggatacatggatggatggatggatggatggatgaatagatggatggatggatgaatagatggatggatggatggatggatggatggatggatggatatatggatggatggatggatgggtggatgggtggatggatggatggtggggtggatgagtaggtgggtagagagatgaatggacagatggataggtgagcaaatggatgatgaatggttagatgaatgaatggatgaggttttcctggcttgctcagcataagatgacaaattaaaccatttgcagttttcatggaaggcaggtcaggaacagccaccctggagagttccttatgaatgatgttgtcacccctgtcttgataattgagacaggattgccagcctttggcaaagacccacattctgttacctgcacagttcttgtctgtgggaagccagctcctagatggccctgtgaactgcagctcctctccggtgctcaccccaagctttgggtgcccatttacctagttactcttttttttttccagattcttgagagtgccaccatttctgggagtgatttcatggtacctcttgggtccagctgggactcaatttgtgctgccatggaagcaagggctagccaacacggcatccacagtggtgccctctgaggacaacagataaacaagcagccataaactgaagttgcaggtagattaaggaggctgtggagcattgcagcccctccctggcagcagcccaagtactgtgtctcactaattaaacactccccacacagccatgatgaagttgctgggatgacagaattcacatttttttggccctctttaatgttgtccctgcagacattttatacaaaaacttaaaatcaaagatgatactctacttcagatctttttgaaaagaggaaagttataaatgaaaaaatccgcccagtataactacatatagctacagggattttgtatcctttccacttgggaataaattccattacccagcatttaaggtcaaacatctaaagccatcttatttcagaaaatgaaatttaaatttactgtttgtgtgtgtgcatgcgtatgtatatggtgtgtgtgtgtgttgtgtgtgtgtgtgtgtgtgtgtgtgtgtgtggtggctgggggagggggttgtgtatgtgcacttggaggccagaagagggtcttgcatcccctggagctggagttataggcaattaggtactaggaaccaaattcaggtcttctggaagagcagcaatcaccattaactactaccccatctctctccagccccacctgacttgttctaacaaagattctggggtccttacatttgcttacaaggtgagcacctaactgactgagctgtaaccctagcttatgggttttttaaaaaataaaattaataataataataataataataataataataataataataatgcagttcctgaatattctctttcatgtaaaacaattgtttgaaaacaattttgtattgagaaactactttgtaactgccccgccccaccccccacctccctggtttctcatttcccaattagaaagctccaataactccttgaggctctgtaccagagagctttatactgaagcctatctcccagctcttctgtgttcaggttggagccacagcctctgttttctgtggagaggagtagtgagcaggttttctatctcgcacccacccacacccacgcccttttaggagtacagtaccgcagagtgtacctcatttccataatagcaccgctgctccccagcgctgtatggcacacacatttattttttactatccattttttttctctgattctaaaagtaagatatgttcattttagacagtttggaaagtacagcaaagcaaagcacacaggaaaaataaataccacccacagccataccctaggacaacaagagaccacctccagtccaatccctttgccttggtctcagctaacagagtcgaagctggggttcacgtcctgctctgtcctctgttgagcatgttctcatgatattaagtggtctctgaagactggatataagctacacgtgttaaattgttcccctactaacaaatgtttcctttctgagttttgtaaacagccatcgttcgtggttaataaacccataggcatgcctccagccccgcactttaaagcatgaagtctatcgtgcatgtagcgtggcacacaagacctccacgtgcattctgcacatgaattcaccacatatatccaacacttacggatcctttttcatttctctcagaatcaaatttgtgcttggtcatttgctactgacctccttggatagccacctttgtttctgcacagaaaggtgccctgcagtggagatactggcaatacagttttgaagttgagaaaactgagggcctgaggtcatagggcaaaggtcattaagttagagccagatccctttctcttgcacccagagcttgatgatgctttctctgagaaggtgagaaatataagtaccagcatcctctgataggacagaaaagcactggtttcatcttgtttaggtccctaccaccaccactttaaatcgcagtttggaggacactgtctggggagatcattcaattggtaaagtactttctaggcaagcaagagaaattgtgttcagttccaggacccgcataaaaaggaaaaaaaaaaaagccacccagatgaggatgtgtaatgccagtgctgaccagccagcctagcctagctggcaagctccaggtcccagtgaggaaacctggctgaggaaaaacggaagtggatggctgtggaagtggatgagaagccacagcagaggttgtcctctgaatgtgtgtgcccttgtgtgtaggcatcggcgtgtgcagcacggacggagaccagtagttgaccatcctgatgtcacggaggattggccccaccacttcgggtctagatgacatcttgtggatttgggtggtgtttttgcacactgtgctcaaggctggaaggcactgtctgctgcaggcctgcccaacccacacgcagccctcccacactcaggctttcccagttctgttaccgagaagacaggcgcttctgagcacagaacctgatgacaaccagttaacaagttgtcttgggcttggttgccaaggcaccaagaaagagacggcctctgttcaggtgtggtatagattgtggatgtgtgcagaactctggggctgtctttatgaagcctgttcagttcgcatgacactgagtgtctgcctagggcaatggacttacactggacaggggggaatctgcctggggcctctcatccagccggtggatgctggtcacaagaaaattgtagtagggtaccaacctaccccactgcttcctaaggagacagctgataagggcagtcatattagtgtccctccctgatgcacccctgctgtttgggactcttcccaagatgggaaaaattgcctatcccagaacacctctgtatgtgccacattacatagaagaatattaaaataatcagtgacatcgggtaaagacagtcacacaactcctcaatgaagaggcaagatggtcctctgtgagctgctgtccacggaacatcagggtggttgctccagcttgtggtgcgagactgcccatacccagaatgttactcagataccagcctcaaattctgtccttgcctctatgtgagggtacctctcatgtaagttaccccacatgccaccccaaggctatttctgtagggtcctttttgcattttgtggggaaacacagccagtatttaaagggctggtcatggagctggagagatggctccgtggttaagagcactaactgctcttccagaggtcttgagttcaattcccagcaaccacatggtggctcacaaccatctgtaatgtacagcaaaaatatactcatgtagactaaataaatctaaaaaaaaaaaaaaaaaaaaaaaaaaaaagcctggtcacaggagccttgtgcctctgggcaggctaccctttctgaggtgttagtggggataatagcagtaccacggaggaagggagcaagaatcaaacaaattcatagatggctaggatggcatcacattccacaatgactaacgtctgggtttatttcccatagcagcagacccttcacatgaaacttaaaccacacagctctgtgaaattcatatggcgttactttatttcaggattggtctcctccctcgtgtgtgtgtgtgtgtgtgtgtgtgtgtgtgtgtgtgtgtgtgtgtgtgtttctctagcagtctacatctctcttctgaggctagatgccttgattgaaatggtgggatttcccagaaggaaagagctgctggatcctaggctcagccagagcatgtgtgatgttagcaaatgctggctgagccagtaaccgttgttgcacagagccctaagtgaggcggggtcacaggactatgaatgtccctggtgatataccaagatcctttctccatggtcagcatcatgttcctggccccagtactgctagcttctctgccagattctcttactctgatgtcctttctgtaggtcaagtgacttcattctgctgccccttctatgtcgcctgtgttcctttggtgtaagggcaaggagaagagaaaatgccagaagtaaaccatccatgctggctagggcttggaggaggcaagaaaccaagagggattttgtttccctgggatctgtgtggtatctctgaggagtgaatagaataccaaactgcttatctattgatataagggaaaaggaccaggatgctatgaggcccgggtagacctggccctcctgagctcccacaagctcaaaccagctcacctgcctttagaccctgcaggggcaagcaggcaactcggaaaatcactttattttcggcaacctatatttgatttcagtgtccattgatggcaggtcctaagatgtaaatgaaacttgcaaacaaaatcagatagctacacgatgccagggtatctttataaaactctcatgaaagtagttttttaacttgtaactaaaaacttctgaaaatgtctgactctatatgtatgtgtgtgtgtatggtatatatgtatgtatagtacacacacacatacatatatatatacacacacgtacatatatacacacacaaatacacacatacgaatgtgacggctctgagacagaagttggcaatggaattctaaatggcctaccagtcagctgaatgcagaaatctattagcaaagcccaggagaagcctaggaaacacatggcggctctacataaaaagctaatgtaaattgacctcagtcacgtgctaacatgtttcaatgaatgaatgaaatgatttcttacagaaatttacattcattctcaatttaaaaaaaattaccagcaagcacgaataaaggatatttatcaagaagttaaagtaaacatcttggtcagtaagtaatatgtaagaaatgcagccccgacaccgattcctgcatcctgaagggccaggatctgcgacttaacaaagaaattagaagggttgaaaaggagagaaatttcaactttctgaaacccatatggcagtctatctggaaaatcccagataatctacataattagaagcattccgtgcatctgggaattttgacagagactagtttggtaacattcttaagcacgagtgacttctaagtagaaaatgaagtttgaaggattccattagctggaaagtgagaaacagaaataaatctaatagcgaaggaaccagagcgcagagagctgtgaagtttcctctgaagaaagaatatttaaataaaaacaaactaatactgtaaatggggggggggtgcagcttcccccaaattagcatatcacttcgatacagtttcaataacggtattcacaaacttggtgtggaactggtataaagtgcttgcctagcctgcagagagtctagtttggcataaatggttctggtgggcacacctgtagtctcagcactgatgagacagaggcagggggatgaccaggagctcaaggccagcttgagctatcgaggaccctgagttacatagtgttagaagaaagcatttgcagagtcgcacctccgaagctttcgaggcgggggggggggggggggggcagggaagggggggtgcaggcactgtcaagcagttggcaaaggaagccagctcagaattccctgctggatgcctgggatttgctactgtttcggtttgggttttgtttgtttatttgtttgttttgctttaccttttcatacagggagctaactataaatttggatatggttctcaaatgtgacattaaaaaaaaaaaaatccagactacagcaggcagtggcggcacacccctttaatcccagcacttaggaggcagaggtaggcggatttttgagttcaaggccagcctggtctacagagtgagttccaggacagccagggctatacagaaaaaacctgtttcggaaaaaaaaaaaaaaaatttccagactacatcccagactaaatgtaaggcatgttttaaaacgtttagaaggaaaacacatgtgtctttatgactttggggtaggaaaggtgtcttaaaggagactccctcctcccccagagtaccaatgatttaagcagagttctggcatgtgcagtaggaaccctgttgaaggggtggtggaaggtatttcccaccgtgtaacaaagaactgattgaagctttcctatgggagcctagaagccaatccatactgagatgctgaaagggataaaggcctgagctgtttcacagagggaagggattagtagtgtataaacacaacaagaagaaagattcaactgggaataatgagttgcacactaaaaccttgaaaggcagcagttgcagcctacccctgacctctgaagtagagcctaccatacctaggaagcagggctgcatgagttgctggccaaggccattctgcaagcacagcccacattcctgcgggagatttagaatttccatcacacctgctgagttttggctccgccttgcatcagttgagagggaactaagctctgcctgtctctcttcctgtttcccatttgttccttggagagtttggctgggacagtgtggccctagggttagaccatcacttcccttcagaccatctgtataaagctgactcacaggctagtgtttgatgaccaggcaacaagttaacaaattctgatcaagttgtctacaaactcaggagaagcccatcgttgtgagaggactgtaatggtccatgcaccctccttagcacaactggagaggtgaaaagacagcaatgaaagtcaggctgggattgaagaggatctaaggcatatgccatacttcttagtgcccagaagggggcagcctagagcagagcaggggccccatggctgtgtgcccaatgtagcgaatagccagtggccctgctacaggtcactccttcctcccttctccctcctcctcgtggaactttctgcctggtggggttagggttcttccccagtcttccgcagcttgctcaggagagcaccctgaagtgacctcccagtcacctctctgctttgctggtgcagtgatgtcatttctagcagagaatatgctaaagggagcctctgcaaagccagatttatctataacatgaatcactgggcatacactcttacacctggacctctgacatctgtggcagccgctcacccgtgttgtcctgcagtctgctaacacttgggtgttacatttgagctggagatctctgacattttagagtccctacctgatgcatgtgaaaatggagttgagaaacatttttgtgagattttgtgttgtgattgaattaacttgaggttaattatatattaatttttacttgatttgaacttgaaggggttcttcaggccacttagaacctgtttgaatgaaaccaagacctgcacagagtctgcacacttcttattgactgtgagatattttgactttcctggtgtcctgattgatatcagattttcatgggaacattgaaatcctgtgctattattaatgacactcttcaatttacagttgtatatttctaacagaaaatgaacccttaaaacttgtctatttagccatcttgtagctaaacaccccccccccaaaaaaatagtgggaaatgcttcattctttgatctgccatgctgaggtcccatgtctcagctaccctgaggcctgtggagagtcctttagcccaaggtagaatttggtcttgttggtgatatctggctctgggtttcctaagtgatgactgataaattctttatgccagtggaaaaagtgtttggggctcttggaacccctgtcttagaaacttcccaggcagcaagttagcaccagccatattgtgttggacactttcctttcctagctgttcaaacagaagataactcactgtggggaggaaagatgcagactgacagacaattatccatgctttcacaactgatagtgatgaacttagtctgttagtatgttgctgtatgtgcccagtatagcattcacatatgcacatgtctggatatctggggaggaacaacagtgctctctctctctctctctctctctcctattgagataatgtccttaaaacaaagatccagacaagtacacaactacacaagcttccttagccagtcattatcaatctagagaaggcgaatggataagaacactgagagccctcagttgtatgcgtgagtgtgcggtgattttccgagtgtgcggtgattttccgagtgtgcggtgattttcctctaagcctgtgtgcttatgtgactcgaatcacttcctgcagaagtccgggatgtgagatgtcacattcgatgtctattgttagctctgtctgataaactgaagaaccttctaaagagacataatgtcatcaacattgttctgtctaaggaaaggactgagcacacagtcaatgcgaaggcccattattaaaatttgtctcctgttttaaatacctttttttatacatatacatatttttggcttctcatgttattgtgttaagaggtatgtgtgtatgcagcacacttcatgcatgtatgtattgggcacatgggagggggatatatacacatgtgtgtgcttttatatgaaggctattggtcaatgttgggtgtcttcttcagtcactctctgccttatttttttgagacaggattcctcaatgagcctggagttcatagtcatgggtccagtaagattttgtagccagcaggagccaaggagcctcccatttctgcctcttcagcacaaggattgtgagccatcatgtgcagctttttacatggactggagatccaaactcaggccctcgcgcatgcacggcaagcaccacaccacccgagttctctcctgagcagggttctatagctcctattttccagttttctcagtttgtgtgtgagaaaaagatagtatgaacaggttgtttgtaaaggtggtagcttctaagctcttaagtaagactcgagaaagccagcctttttcctctcactattttttttttttaatcgaatgccccagcagccttcagttagaatggcagtttccacacacacctcagttctgatagacgcagcaatattctctgttcccagtatcaggaaacacactgagataaggctttggatggccctagacttgatctgaacctgaagtcatcgcagccacacagggtcttgagctccctggctgagctataaccagctgctccaagtgctgacctacttctcccagctccaagttctccattaaaggaattctgattgcttcagaaaaacctgttcctccacccccgccccagacacaggcattaggtaacactgacatgtgaggtatggtgccttgagtatccgtagattccagtaaaaccagaaacaatggaggtctcctagtggggagcaaagctctaagtccctacaaattgcctccaccagggcaggacagggttaacagttactaaccaagggccagcaaagcagggtgccagctaccacaagggacagtcacccttctcccactgcagctggctcatcagaatacaaaggattatatggataggcctgacaattgctatttttaaaactcagtcttagtcttagatttttaacaccttgttcactcttaccggtttcaagttacagtgtgatagagcaacagcacacctctgagccagagtgtgacttactgctgtttgattatttgctgatctcttagcagcaaaactcccttcaggcgaggggagatggagcggtggttaaagcaccttagccactgaaacaggggtgaggatcagagttcagagcccccagaaacccaagtggtggctgtaaatgcatcctgagacgttggaggctggggtgtcttagttatgtttctattgctgtgctaaaaacatccaccaaatgcaacttggggaggaaagggttcttacctatgttctggcacaccccactgagggaagctaaggcaggaactgaagcaaaagccctggaggaactctgcacactgccttgctcagtttgttacttattcactctagaacttccggcccaggggtagcacctctcacaactgtctgatcctccccatcaatcattcatcaagacagtgccccacgggcttgcattcaggccagtcttctagagacactctctcagttgaggttcccccctctcacaaactctagtttgtgtcaagttgaaaaagttagccctatgagccagctcagtctgggctccgtagagaggcccaggttcaaaaccgaaggtggaagagtcatcaaggaaaataatccccaacatcaaccttggtcccccacgtgtagggatgcatgcacgtggaaccgtggtgaggagcgctttatccacacaggggaagacattaggagcgagaacaactttgtcgcgtccatccaaccttccaagagcatcaccagcacccatatttcttacagaccatccagtgagtcgcacccacgtctcagacgtggagagaccaaggtctcagtccatcctagctccaaggttctagggtagaagggaagagaccctcagcagcctccagagttggctaggtaagcagcaaggcttgggatagaggagagaccacgagccagccaacacagaagctattgtattcctgtatgactgcctcttatcctgggaatgcactgggacagcgctgttttggctcctgggccattccgaattctatcagtcttctctagtggctgaagcttccatcactaatcaattcacaacaacccaagaagtccttggtgaatggtcatttcatctctttgtcaatacttgtgaatgagactgttctctatgaagagcacagatagacaaagggtccagtgtgcaggctttgttggtatttcatctcagttctttgaaccagctttcttcagaccgtccattcttgcagttctgagcctgactgatggttgacatctgacaaccttaggtacaaagtttccacaagccatttctctagcagggacgctgggcttggggcccatactctgtagataaggacatttccctctggctttaaacgaggagacactcttgttctagttggggcaggggtggggcagtgatattgaggtatgcagaagtgagttgctgcttaagagttgggaaatataaggtttcatcccccttggttcgtgctgtctctgggtccaactagggagcaacagcctgctatctacctgccctctcagggccaaccttcctgtataaggtcctgctccactgccaggcaatgcgggagtttcactgtgccttggtgaagggttgtgttagtgaaggactaacaggggattactaagcatcagcctctgggtgctgagcagtgtttgactaaagcacctgttttcctgaggtaagggttgccctgccaccacagagccatgctctttttctcagtagcacaagaaccacgtgattctgtggagtctattccacatccgcatgtgttgattttgcttctgtgggcagaattgccacatgggatcagagcttcttccttaggaaatgagaacttttctatagattgaacccctcagcatcctccacaggagctctctgtggtcttgcttgtcttagaacagtacggactggggctcagagatgttagggggagaccttatggtgatttttataggacgatgatttggggataaaacttcatttatgatcttggcccacttatgccttgtataaaatcctttaaaaccagagtaaatgagtaggtgtatccttctttcttctctttgatgtgggtatttttacaaatctttatatgactgctcctttggctcaaggaagaaaagtttcccctacttttaaaggaattttatccaaattcatcagagaattttggggtaacttaattttctcaagatttgaaatgcttcatccattttgaagtcaacttcagttctggtcagaggttggtgtgttaagctactgagactcagagacacacatacagggagcaatggctaaggtgtgcctgtggcctgtgtcattttccttgttgttgggacaaattgataaagaaagcttaaggaaggaaatcactactttggctcagaattcgaaggcacagtccgttgtggtgagaagactggccaggtttcatccacggtcaagaagtaaggaaagagagacgctggggctcaccttgctttctactttttatttacagggaccctggaatgtggcatgtgtcccatggcactacccacatgaggaacgggtcttcctttctcagaggaaacaccctcacagacacaccaagaggtgtgtttccatggttatctaaagccaatgaaaaagtttaaccaccacacatagtgtggcgaggaacagagtgtaaagaagtgtaaagaagagcgcaattggcagagacagcagcacgcgcgcacgcgcgcgcacacacacacacacacccctggagcatctagatacttctgtggcatccacaccacggccagtcagggagcagtgggtcagtgctagctgctatgaagcagtgtcccagtcagaaagcaatgtgtgtccatttgtccaaaaggcacagtgctccctctctagagtgagtagcctgccctgtgaagacaatggtatgagaggaaccctctgtccagtctgtgcagagcaatgccagggtctctctcggctgacttagacacgcttgtactacagcccttacacaaccgtcctcttcccacattgagcactatgacagcacctggggtctcaataagtttttgttgaattgaaatgggtccttcttccctgtttctttatgtctttgccccacagcacaaggctgtcataaatggcttcccattaagcagtggtggtactgactcagacagcagggtccctcagatatctccaacattgatggggctgcttacccaccctcccagctgcacagctgtcctgttgctgacacaaagcacaaagtctggtataatgctctccaacacacccttactgtcatgcatagctgttggagcagcaagccccacacctgccacttgggagctgagtttggtctcaaactttttgtttccactaagtctctggagaaggaaggacgtgaaatcagcttcagagaactactgaaatggcttgtaccccgtcctcggccatcagcgcttcccacagccctgtttaccctgcattattttaccgacctcagtgcctaacatcagaggcatgagctgaaaagaaaatgtatacacatagccggtattttctcggccactaagaaaaattacgttattttgtttgagggaaattaatacatacagagaaaaatcgtagtgagtgaattaagttagtttcaggaagacaagtatcatgttttctttcttttgtggttcctaaatatatggttacattcagttgtgtatgttagaggaaagaggctaagctatctgggggaatgtgagggatgggcaggacagacaagctgtatgtatttgtgcgactgtccttatgtaacacagatgtgtacaatgagaagtggtcggtgtgtgtgtgtgtgtgtgtgtgtgtgtgtgtgtgtgtgtgtgttgtttttcagatccttccttccctgaaggattaaggggaaactggaggcttgaagaggacagcccacggcaagggcagaggagccagtgtcttggatctcagcccagatccaggatgaggcattggtggagacgtggggaggataaaggctgtgaagggcctacaggtaaatagcctggtctccctgtcctgggactcagctctgggagtcactagtgggagtccctggggtaatacatcaggacattctaatttctcccaccctcagaggctgctgaacacccaccaaggaagaactgagggcctttgttggtctaaatgtgacagagtgcttgcaaggcagctgtggccagtaaaagcagcctagtaagagtggacttcagcagctggcctcctcgtctgtcctttgggcttgcattcccatctccagaacaaagtctgtccccgattcttggagatgggcaattcctggtgctgagttctctgccccaagtcctgcttgactgggagtccctgccatcaccagctcagcaccgtgcaagcccagaactgctgcgcacagtcctcagatcccaggcctcagcacagtgagagcagcctggatggcatttctagatgcagacccactgtgagaacacagggaacaggaaccagaacagaaatatagagcacacaccctgaccattcacagacaacatccacagtgcatgtctgcccaggtcttgacctcttcagaggcaaaagatgcttacctgccctcctctctcatctagacagatgacccatcttgaaccatggcttcctacccaaaggctatctcccagtccttacactctgaacacagtatactttctccaataaacacccccacttctcacaagaagcgagctttatcatccttacctcactgggacagtgtccccagctttctgcagtttgacacataaaggacttttgacaccagtgtctcccatcagcctcatcacccctcactcacccatatttatcttttaaggataacttggtgatcgggtgtggccaaatacctggcagtggaagaaaggcttgttttaggaggcaacagtagattgtggcagggaaggtaaagacagaaatgaagctgggaccgttcctgtccgaggacaccaggaagcagcaggagatggtggctcctccttcttccttttcagatggtccattgaatggtgccacccccagtcaggacataaagtcaggtctgaatctccagcactaatgacctagatgaaacccttccaaggctagactgatagtttgggttttgttattgtttttaagagttatttatttatttatttattttacagtgatctggctgcatgtatgcctggaggccaaaagagggcaccagatcttattacagatggttatgagctatcatgtgcttgctgggaattgaactcaggacctctggaagagcagccagtgctcttaaccattgagtcatctctcgagtctgagaccggtattttttaagctaagaaaaattgtcctgattttccctctattggtcccaccttgaagccattaagaatcacaaagaagacatagggagatgtttattctaactgatacccaaaggccaagcgcagtgaccttgaagcctctctctcattccaggtctccctggttttgagtggacaagtggtcaagcttttgtaacctgtcttcctctccataaaagtggactcctaatgcctccccttggggactgtggcactcaaagaaggatcaggagttcaaagacaacctgggctgtaaatcctgagttgcaaaaaaaaaaaaaaaaaaaaaaacttttcgcttcctctggactggaaagctacagtccttctgtttcttggcctgtccctagggagagaggacaaggaaggctctatcctgtccttactgtcatagagcaggtaggctagttttggcttctgggtttccttctgtctctgtgatgtttgagggatgggaaccaggacttattttcttttctcctatcaattcatctcggagagacctgagagcattgctgacaggtctccacatctgcatccactgctgatagaatgtaagaacacagtagtagcccagtgaagcctcgcatccctgggagaatcaaatggctgatggctgaaggggagccattcctgatgtgaccagaccatgggtcacctgggagccattctgtgccctagagaggcaggtttgcctgagcgtctgtgggtgagagccatggagagaaccagtaagaaccatgtgcttctctagtgtccagctctgctgctgggggtctgccaggtgtaggagactctgtgtgaggaggcaccaggctgccaggaaggaagcaagagcatcctcaaggaacatcaactagatcagggtgtggttctgctcaaacagggtggtgtaggatatcaagagggccacggaaatcagtgccagaagggagatgggtttaaaattaaaacatgacagtaaaaccagaggagttaccctgtgtccttctctcagtgctgttgcttttgaaaatctagatctaacagaaaaagtggatccttgtatagagcttctgggactgattgagcttggcatctgagatgaaatctgagatctaatcaacactcagcaagggacctataattgattattaatgtctgccaagggcgtaagaaggagaaagcccagacaccatgcatctgccatttttatttcttttctaaaccctcctgtccgttcattccacccccaaaagatttccactaaactaaaagtggccagtgtagctggtcctactaaagttgaagtaaaatagcctggccactcactaactgctctttctaaaagctgtattgggatcagagagatggccaagggattaaaagattggaccagctcctttccagcaccaatgtggggcagctgggaccatcagtaacgccagctccagaggatctgactccctcttctggtctccacaggtactgcacccacatggttgtaaccccaccatacacacacacacacacacacacacacacacacacacacacctacacacacacacacacatacatacacacacacacacacacacactatttttttaacataaataaaagtcagtgtttgctgatttcacaaagcccccagactgagtattttggagaataaggaaaagattcatatgttattcaaatatgttatgttggccactgtaacccaatataagagtgtgaaatgtcctgggtcagcacagggtgctactgcatttgatgaaataggcagggggcgaatttcttggccgtgattcatttatggtgctcagtgaacagcactcggtgcttgctgactggttggttggtttgtaacgttttggaaagcagctagactcgccctcaaatgtgtgagtccagcattgccgcggcacttacctgtggtcacagcacttggcagatacaggcaggagttcaaggttatcctagacatggtgattgtgaggtcatcctgagctacacacgaccctgtcctggaaaagtaattttaaaaggataaaaaaagtttggagacctctaagagacaagaaaacgaaacgaaatggcgtagatctgagacagaggtggcaagttgcccctggaatagttgcttttctctctaaatcagcacttcagtctcgtttttgacccacgtttttattctgaaatgaatgggttgtttggggacatcagtgctctgtgaactggaacgctgaggacagggcccttcattctctaagttacttgttcatttcttcaaacacaatgtagagctgggtcagtggcttatgacagtaatcctagggcttgtaatctggaggcaagaggagttccaggccagtctggggtacaaagaaagactcagacatgcccccaacaaacacacacacacacatgcactcacatttgcctggtggcactaacctcacagctgtaggatggggccatagagctgaaccctccaccctgcactctccccttacttaagaaaaccaaattcctctgtgagctgaaactgtgtcttctgccacttttgtcagaaagaggagggaagtcagccaagaaccacacacacacacacacacacacacacacacacacacacacacagagcacgaacgcgcacacacacacccgcatcctccgcccacccccacccagctccaggaagagcatgcttggtaaacttctggcatttctctcttgtgtaagtgtggtctgtgctggagaggttgagaagtctgtgatgtctgctcactgtggtagctgagagctcctgacaagaagctgtgcagtcagcagcattaacgggacagggcacagggtagccataggatttggttgttgtttggttttctgagacaaagtcctgtgagggtgactcatagcccacagcgattttcctgcctcagcttccccagaggcaggacctctctcggtgtgagacgtgagagaaccaccgtgggaggtgagaagggagaggcatgccggaaatgaggacagagattgaacacacctgatttctgcagaccgtttcttgccagaaacccggtgttattaaaatccttatcacattaatctaaaaataaagtcttcaaagtgtttggtattccctaaagacagaccctatttccttaatccttccagggcctttctaggaattagagcagcccagtagttctttctcaccctgcctgaagactcctgggccagccttcctgccagtgtctgtgagagtccgtggcctcagagaaaagctgtcaacaagcctcagctcccttttgccttaaaaattgtgtcctattttgaaaattgccttcttggctcttccccgcttccacctgaccctacgtgtgtcctccgccaagcacttacggtctgtgttttttaagcccacagtgatactctgtaacagatcactggcctctggcaacaaagtagaccctcatctaaatgctgatatgtaatagctcagggaagaaaccggcttccatgctacccagggcccctgagatggtgacagtctgcaccaagttgcccgtttctgttctgtctccaccctgccccaccatgctgggtcagccgtattcacacacacacacacacacacacacacacacagcactggtcccagcttctcactgacagcttcgtttctcccactgccttcctggttgcccagatcatcctgtaacttctgctccctccccaaacctccctgtacaatttcagggacccatcttccctcagtccctccttcttcaccaacagcttcccaggcagacattgagactagtcccctacgccctatacacccacaaaaagcatccgatatgcctccagtctctttccacctgcctgccaccaccccaggcagaggctggcagtcctgactcaaggcccagcattagccttccagatccctggtaccccaacagctctctcctctctcgcagcttccacactgcactgtaaggaccaggtggctcctttttcctggggtctttttagtatcctctgtagagggctctccgctacccaatgtatttcctgaggccacccttgcatcagttactgtagcagatacttttcttgttgctgacaggaagctgctgagaaagggagggagggtttattttgcttacagtgtgtccagggctggggggacatgatggtgggaaaagggtaaggggcacgaggcagatggtcacatcctgtccttactcaagcagtagagacaggtgagctcagcggactcacccccttttattcaggtcagaaccctggcatgttggatggtgccccccacattgtggagggcttccctcttctgttaaacctttctggaaataccctcccaccatagaagcacccagaggtgcgtctccacaccgattccaagtccagtcaggcagacagttaagattaatcactgtgattacctgctgtttgtttgacctgcatggcctcctcaccgtggatgttctccacttcttaggagaaccgtgctgttctccagactcctctggagtagaactgggccttctccatccgatgggattcccgcctccatccagggatctttttatttatttatttatttatttatttacttacttacttattttatgtgactcaaaagatttgggaaataaacttgtctattcacacacacatacacacaccaaattgctgagtatcaaacccattgtcaattattgaataaggaataaaaagagaataatttattttgttgttgttgttgtttgagacagggattctctatgtaaccctggctgacctggaactcactttgtagaccaggctgacctccaaacgctgagatccgcctgcctcccaagtgctgggattaaaggtattcgccaccacacccagctgagaaagtaatttttttttaattatgttattctttctctaacactcttcagccctattaaccctactttggatccagctccactgcacaaagcctagggcagtaggtggatcaaaatcaggagtgtttatgctcaaactggctgactggacccatcttagttcttgtccattccttgcttccatcctgcccaccacacttctgaggtggcaccattctccttgttctacgtcgggaatgacacccagggcatctctggcttgtacccccccttccactgactatacacccagctgtctgctgtcctttgtgagaagaagtgggaactcaggtgtcaccagaaggctgttcattccgagtggtctgaggcaagcaggtgtgttgtttttattgtttttcaagcgagacaactgtgctttttaaaggatgctgtgtgtgcatgcttaccccccaccccctgagccttcttgaacatctaacacatcccagccgcctgacaagatcgtttgtggaagataaaaggcattaaaaagtcctgagagcaaagctggatgagtcacagacggaatgcgcctgcatgcctctttagcacgccaggcaggggctcgggtgggtgtgagcatccctctttctttggcttcctgcagctgtgcacctcttggcacaggcacgctgccttggcgctgcataatccgctgagatcaccaggctccgaggagtttgtgttctaaccccctaaagagtaaagtgctgtgaggtgctgtgtgtcacccacatactcatccagcacccccaaccgagatataagtgcctttgggggatttctgaaagcagctcccttcctcgttattatccccgtgcagtccctctggtccctggtacctcacctcatctaacctcaccccgtgtggatttcagcatggaatgtctcctcacccgtggtctgtgggcgggagggagaaggaacactgaggtgggagctctgccgagcctgcttgtgaggtcttttcatggtgctaagaaacctgagttccaccagggagattggaagaagaggagacgggcctttgctgggagatgcctttgggaagtcaggggagtgggtgacttggcagaggggaaacttggcttactacaagctaagaccctgtctgtgtagcctctctaccttgtggcggagggtaagtggggaaaggcagttctgtggtcaggcttgtcttcctctgtgtctgttgagaacctatgaatgagccacagcctcgaaaacatacaccaggacaggaacttcatagcctttggagtcacctgtgtgccgctcttcactatggcaggaaggtgacagggcgtgccaaggtcttgaccagacggcctttggggtggctcctgccagtctcatagcacccatgggtgggccagctacagtttctctctgcactttctatgttctcagatcaaagtcctttaggtgtctttttcccttctctttttaactttttttatcgattatatttggttttactacatttatttttttctcattccttcttcgctagattaatcaaatttataactgcattctttttctctctggtaattttttaaaattctatgcatatgtggtctgtagtcagcttactttttaaaattatcatttggtaatttcatgcatgatattgtgtatttttatcacactcaccctggtcaccctcttctccctttccagtcagtgcctgctgaacccctctcagaggttcctcttctattttcatgggtttttacattttaattagggttgctttcatagcacaggtgagagattatttactggaatatgagcaattatagcaggggctataccagtaaggaaaatgacttcccttcccttggtagccattaatagtcaataggtactcagggaggtgtgtggcctctcaggaccctcctgtattcacagttgagagccccagtcttggtcaagtagtcacagctgtgtgacttcacagctataccatgtgcaggatctgctgcttgttacagcactattccatctcatggaggccaggctggtctggaatttatgtgtagcagaggatggccttctgaacctcccaagtacgggaattatagcatggccaccacacctcaatcatctgtgccaataataaaacccagggcttcaaccatggagagcatgcagcctaccaaccgagctgcatctccagcccacgctaggaccttaggaaattcaggcacaagtcaggatcatgggaatattgaaattccaagatgctgcgcttagccttacacacatttcaaggtaggttttgttgtttgtgttttaagtcaaagtcctactctgtgtcccagactaacgctaggttcacaatcctcttgcctcagcctcccaagtactgggatgacagttgtccatcatcgtgcctggctcaagctgtgattttaaaatccattagctgcgatcagcaggtaactttagccctccgagccaccgtgttgacggttggaaagagacacgccgatcaaatgcattttcgcttttacgaagacactagaaggcaagtgttaaacctcgtattagtcaaggctaaagaaaacgggtgacgctctgaccgaccagttggaatcctgccttcgtccttttgtttctagaaaagtctgtttttcctaattaccaggcttagtgacagaaggcagtgtgcacagaccacagaggccccctggaaattcagaaatgaaacttctgttattaggagggatgaaagaaggtgtcaaaagggggaagagaaaagaaagaaaagccacagatgcgccccactaaacatccaggagtgtgccccacctgcagagtgagaacagccctccctgcagccatctggggatgcctctacctggctgctcacgtgaagggagcctaggaaaggaaccacagagaaggcggttttttttttcaagaacgggtttcctttttaaacacttttccgggtgtgttcatttaccacagtcttgtgatttatccggagagttaattgctttgattcttttcccttgaccttgagaatttttatttctgagagaagcgacgacgtttagttttctaatttagaaacacaaagggagtcgagagagccggtgaatgagcggggcttggactttgtgtaaaagtgctctggttacattacagactcttggacctgggaacaaagatagcatcgttgttagacctgtgcaatagatatgactgataaagcagaggtaatgccaatgccccattgtgagcacagcaatggcttgcatactctggaaagtggggccatgaaggatctggactcacaccaggggagtctctggcagtgtgacttgagccactttgtctccctgtcattgggatttcaggctcgtgacgccatgcccagactgtttcatgggagctggagacataaactcaggtccctggacctgtgtggcagttggccgtttgccaactgaaccatctttccagcccctccactgtcattttaaaagaagagctgatttggtcttaactatgaagggagcaggttgattctccctgtatccgtctcccaagctggcttcaagaagccagcatcagatacatttcagagatgcctgatctctcagtgggaataaccatagttctggttcaatggacaaagaaagacacatttaaaatgcaatcatttagggacaatggcctacccaggtaaaacatagctggcatattctccttcactgagaagtatgtaatgtcttagttccctcattgttgggacatttcctgagggttaggtagtccctttacaccccataaatgatttaggggcttaccaatctaaaagacagaacacacttgggaatcatttatcttcatctttatatcgatatcagagtaactctttgtcttgtgcttttgaaataaaaatgagaatagttaattaatcctgctggagctctttaatgtacctatttttaaaatgcttcttgtgaaaagctccataaattactataggttttaacttaccttgtagtcattaaaacaaaagtatatccaaaattcatttgactgctaggaattaaattcattgatttaatctttccccattattatgagtgctcttctgtgtttgccagtgcctggtgttcattcactgtgttgggaagagcaagattgacaggaattatgttttttccccatctgccaatcatatcagcagaagcacttttggtgcttcatgttggtatttgcttcaatcccttcaaacccatgctttctgcacagtagttccaagccagttcttgagggtgtgcccatcagaacatactagctggctccctggaagctgaaccaagtgtcagaaactggcagagagctcagcctacgctggcaccaggtcatcactgtccctgtccccacaggcaacctacagggacatcaacactgattattttaagaagaggatgaggctctgtggcaggacaattaaatgtacagctatgggggctggaaagatggctcagtggttaggaacaccagctgctcttgcaaatgacccaggtttggtttctggtacccacgctgagagcatctcgagtcttcctggaactttctgaggaatctgatgctgtgttctgacctcccaaggcacccagacacatgtggtgcccatctacacacatgcacacacacacacacacacacacacacacacacacacacacacacactttgtaacagtggagacagagttgaaacttatgggtaacaagaggcaacagccatattagtggctggcaggacagtgctgttttgcagagatgcccagactaaatgtggagtaaacagaaatggggtgctaaatgcatgctactgcagaggcctggcaaggctggcagatacacccactctggaaagggagggactgtgggctttagacagctcagtgaggaaaagatgatgggaatacaacggcagtcctgcccttaactggccatccatttggttaaacctgcttctttaattggccagagcagcacctcacatccagttccaagcagtggtctgcttctctgtagcccctttgtggccccaccaccaactttttctcatctaaactgaagtccagcaaactccagtgacccttctgtctttagcaccaccactcagagattaagggtctgtgtgaccatgtcctggtgtgtatgtgtgtatgtatttgtgtgtgtgtagcaagttctcttattcactgagccttttttaattcaatgaaatgtttttgaacatctgtcccatcccttctgtatattcttgtcttaagaagctacccacttcgatgggaagatgaataagtcacatggcgtcgtgtccccgtgaccctaggactcaggagatagaggcagcatccagagttcagggtcgttttctgctgcatggcgagtttgaggttagcttgggttccatgagatcttgtctcaaataggggtggggagggaagacaagcctataattcctacaatgactcagcaatgcaaaagaagaggcaagggctgggcacatggggaatggaccagaagtccagagaagtgagcagtggccacccctgagagcagctcttgaagaatggagaagtgtgttgtactctttggcaaagtctggcctcctttgttggggttaacaggtgggttattcagttgtgcttagggtctctgagaagtggaggaggaggggcagagataaagaaaacatggtaagggccttcctatagacatcaccaaataccacccaggagcatatacatcctcttcagctaagcacgccgtgccggtccacatattggaccacacttagtgatggtaatggcgcatatcaagttctgtgatctgctgttttaccaaaaaaaaaaaaaaaaaaaaaaaaaaagcaagttgctgcagaaaaattcatgtgaaaaagagactacataaagcaaccttctatttgtgttttctgaagctctggaaggacccacaccagcctgttcacagcagtttacctttggggcagaaaaagaactagggatcgagtggggggtgtcagtggaggctgtgtgcatttcggcaatcctctagttttatttgaacaaggaaaatgttatcttgacattaaaattgattttaaaattcaaagaaaaaactggagccactggcttagtttctggcttgcgccagcttttcggttggagcttgcatattctgagaactgggcagatattttctgaaaccaaacagaactcaaaaaaaaaaaaaattcaccatccttgcccacccggccctgccccaccccatgcctgcagggagaagggagttggaggctgcctttctcccatttgagcaaccctgtttatttgactcattggtgaccaactgatgaaggagactcctgctccccagtgactttgcagaatggctctgtgtcctgcctgtgcctgggtggcaccctgtggcggtggctggctctgggcagcggtggtaagcatgtttttctctttcctggcaccaagatcattttcttggagagtctctgtggacgttggcaaatagttttggcctccttccaacagattgggtttataccagcctaaatgaggcaggcatttaatcagtcacccagggaacaggctggaggccctctggtatcttctttataattaatttttaacatttgttttcagtataaaatttgggcctttatcctctttgaaataaaaacatagcatgcatattagacagtattggcagtgaacttcacacactattcttttattcctttccaactattaactcctattaaacaagacagagggataatcagatcccctgtgctcccccggctgcctggcgtgtgcgctgtctcatcctccctaattgccttcggtggccgacctctttcctatcattagtgtgccatcagaggccacttggcggggaccaggccacctcccaagctgttcccttggcccaacattcccttccaggctctgtctgcccttttccctggcccaaccactgggggtgggggtggttctgatttaccaaggcattgttaacaagacacaaaggaaatggctggagctttaaccctagactttaaacttaaactgctagggacgatgtttgtttgtttgtttgtttaggtctgtttggttgacctgctgttggcttctgagagcttgcacctaggtcaaagagagcagaaacataacagcatttctcaagccaggatgtatacacacagcttccagggtgctaatgaggacatcccaaggcctgtggagtatagtagtaaatgtccagaatcccagacctttaagaaacagaggaagctgggtcagggatcagtctagaatatatagcaagttcaaggccagcttgaatgagatcttgtctcaaaaagcaaagaaacaaaggaaaggaagctgagggagataaagtactttcacgaagatctgagcaccagccccagaacccacataaaagagttttaaaaattaaaaagccaggtgtgctactgcattcttgcaatcccagccctggggagatagaagaggcagattcctgggactcactggccagctagcctagcctacttggcaagttccacgccaagtgattcaaaagccaagctgaacagtttctgagaaataagatctaaggttggacctctgcacaagtatgcatgcacaggctctctctctctctctctctctctctctctctctctctctctctctctctctctctctctctcacacacacacacacacacacacacacacacacatacacacacacacatcctaccccctccatacaccctattagactcttaggggcaaaggtgaagtctttttctagtcccttttcatgtctttcttttcaagccactgagcaaagatacattcttcattttgcctgaaaaaaagtttcgactcaaacatatcttcaggctaactcccatgggtgctctgccacaaagcctttgtacaagttagaagcaggtgtccttctgggcagctccgggctttatgggaagtgaggtctagctcacatagcaatgggtctcagcgccatttacctctgtgacgaggaggaatctgtgcccctaatccaacgacttcccttgcatattgctagttcccaccacagtgccccccatatactccccaggtctatcccttgctatgaggtgagcagttaccagacacgctcaccttaatgtatcaccacaggctcaagacagccagacccaatcaaatatggacttaaaacctctaaaccatgagccaggataaaccttttctcttgtatacagtaacagaatgctaatataagtatctccatgtataagcatagggttgggtttttcttagtgctatgacaaccacaacggcaacctgcaacctttcagcctttatgttgaggatgggaggcacagaaaattagattttcctaagataagacagtcatagagaagacctcagccaaactttcggtgagcagctgagctggtagggagtcgtttaattagtgaggccatgggtaccaccttgtctttccctctcagaaaagtgttgacttaagagcctgggagagaccccacagggcaggagtgggctgtaggcccgcagatgatgaggaggaagtgcttaggagacaccaggagatcttacaaaaggcctgcggtatggcaaagtgttaatgattgcgaggccattattagcacaagtgtccctctctccagccaatgggtgggacacaaagtctcatttctctttgcatactgtggagaaatagcagcaaagtgctagaacagagacagccgacgggataacaaaattagagtcattaatgaccccttactcaagttgccttagcccctccattagcagctcagtagtctgccctctgggataaagagctgcctgaagcagaacccagacttggcagcctgagagaggctggtgtcagttgtgtctgttccaggcccttgtaccagatatcaatggctgagttaagaaccgtctcagaactcagcagctcccacaatccacaagtgttattccaggcccacaaggatgttacagctcagcttctctgggctgattctgctgggtccaagtacttcaggtatccctcactctgtgggactgtattccctactccccatgtctgggatggctgagtggctccactcatctggttcttcttccgtggaccatcaggtcgccaggtgaactctgctcacggcaacaacagaaaaactagctaacacatctgtttccttacgacatagatgggtgcagcccacctgcctcagtctactggccaaagtaagttgcctgggtaacctagtcaagggagggcaaggatgctccctaccatgtgagtgggtggagaggttctcaagacagaggcaggatataggataagaataggagctcccaatgcccctgcttcttcagttcctcatccctggagactcactcagtggagccttcttcctctgtcttcccctaagggcaggggaaggtacagggtccctcctctgtggactttcctaatagctgtgcctttgtacatggctcagaattcccccggcaagctgctcactcttgcagtagaaatctgatgatgttcacttaatccagacacacttgaagaagcatcgtctagaaacaacttcctctgctctttgagctgacaacacaggtttgatcccttctccatatttcgtacattctgaaatatctagattgccttccccacagcggaggtgactccttgtgctcagcgtcagtgctgttagcccttctcaaacagaaccagagggtagaggatctcagccaccctcatttcttcttgcatcaactcaggcaatgggcccctggattcaccttttgatgtgactatcagaggcacacagacaacaccccaagctaaatgcggtcaatcctctagcttggtgggtcctgaacctggttgggcattaaaatgagctttgagctgaatacagatccagggttctgggcttgggcctgcatcaggcagttctttatcccagagcacaggttactgagctgttaattaagggctaagacaatgtgatggtaagtatagggtttttgctcattgcagttctgtgatccaggctcatgggtggagctgaagggtgaactcctttggaaactgccaagtcactgagctgctggaccatcccctctgggaacactaagctgttccagaagctgatgcctgccctccttcccaacgtgacttggatgtgagctgtccccacaggctcatgtggttatacacttgttccccaaccagtgttgccatttgggaaagctgtgaagcctccaggatatggagcctggctggagggaggagaagtcagggaggcaggccatgagatttattgctgggtaccacctcctgatctgcctagatgtgagcaagcacccttcaattccacagccacagccataactgcatctgaagccttgccttccttgtcactgtgaactgtgccccttcagtttcgaaccaaatgaagtagctcttcgcttaagctgctccagtcaagtatcttaccacagaaacaagacgagcaacttgcattctgggttaggaaggctgtacagtgttgcagagtgttagttacgcaatgagtcattttctatggtcctgagagtcccttttgaagagtcctagattttttttttcaggttcatgcaggtgaatccattcctctggaggcattgagttctttgtatcacatattaggcctctaaactgagcaatgtctacaagtgacaccttacccaaagctggctgtgaagatagaggacacactgacctgtgtccattttaatgattctcttgaaaagttctgtgcacaggagttgcaggccctgctttagactacctcatttcttacactgacactcctgccccttcatttttggcttcagcttataaaaacagatggttcaggtatgtcatctggaatcctggggtcagagcgaggtccttggagcttgttagatcagagtttgggcctccctgacgtgtactgcactgggtgatgtgtgtccgtgtgtccacactagattgtaaaaagtattgttctgtcaggtgtcttccaggaatctctgctttttgtggctgctatggcccacttttcattccctatacttctgtcctgtcttcctgtgaaagtgtgtcttataatcaatctactagttcctggcttctctccccaggtggccttaggttgtgtcagatgggttcacaaggccactccatgagggactcaggaggaactgaggcagtggtttgcctctgggcaggagatcacagcagggcatccttaaaggaacagagatgttggggtggggattgacctaataaactctttgctcaacccctcctactgtggcagggatggtagacttgactggcaggcagaagggagaggtagcctgttaaaaatgactgtgacctccaaggtaggcaggctgtagcgaggcatcttgcaccttagggcagaggtagtgtgactatttcacagcaaaaatgtcacatgagggtcaccacacagaagctctttggtatctgtggaaaaagagatttgcacatcataacctatattcaagtagaagttgcaacatgtttgatcagctgtaatgaggccaggttcatagagcaagcaggagccaactaaaagttggggagttggggagaacgtagatgctggagtgccttctttggttcacaggggctgtgagactcaaaaagacctttatctctctgtagatgtcatcttataaagtgtggggggaggggctcatctttggtttctagtctaccctgttggatcctggatgccgagaagtttggagaagtgctcaggtagagtagctacccctccggagaagtcaggtctgcctgcggctattagggccaggctgctaaagtgttaagtgtgtgtcttccgaggttgttcaagccagtcagaaataggacgtgattaattgtttaatggtaagtagggcagaaagtaggaaataagagaaaagcagagccctttggggttttcctaagcagtctagatccagagggttgaggaggaggaggacagagccttcgctggacagcagcaggttagagaggactgccggcggtacactagctaggaagttggtggctcacctggactgtaggccaggagacagaattctggggacccgaggcagggtctaagctgggctgacgttttccaaagtgtctctgtcacagggatggattgattggggtgggtgggggggtggtaggctgtcacgaaggcactttaggggatcaggaacttgagatggaacacggagggtttgtgtgccactgtattctgcaccagtagggagtttgggagactactctctagacctgaagaagtgaggcctctcaccatctgattcctgagacactttcaagggtaggatgggtggtgacaggaggggaaaccctggacagagcagatggtgacaatgctgtggccagcgagcagtaataggctggcctaccaggcccatgctcaatatgccatgtgtgaggctatgagggaattgactatcgggtgtaacaagaagagaacaaaggggaaagaaatggccagtggggccttaaggaaagtgaagcagtgtatagagtagcctagtgtgtgcctggtcaagggcccaggaggcaacagatggggttgctttaagaagagtttgataaagggactatgaaccaaagaaaatgagcctgcacagacgaggccctgtctgggacccatagtggccggcaggcaccagaaggagctgcaaacagatctgagctgatgggtctgtataaaaagggagcctgaatcctggcttccctatgcttgctgctgccaggaggggaggaagctgttgatgaagtcccttcctgtcagcctcccaaagccacagcagggtgacagcagaaggtatgcagaggtgggagcaggaaacatcagagccaaactgcaaagtagggagacactgagcagagccccaggtgacacagtgcaggttaataagagagtggaggcaagtgagggctggacaagcccagcccatgatggatgaaagctgtgagccaactgtgtgtgactctgggagtaaaaacatggaggaagaaatcagagctcatgaccagaggacagccaagatggaaaggggtgggtctgagtccccaactcaggcagagcgtgatcagtcctccctctaaaaaaataaaagtagaagacatgtacctgcataacctgtgtagctgatgtaactggtcccagcagacctccaaagcctcctgaggaggctttctaccctatggtgtgatttttatgaaattaacaagaatttggggctagagatgtagctcaattgatagtgtgcttaactaacatataagaagccctagctagaatctcagcattcaggagatggaggcagaagggtgagaaggtgagatccatccctggctacataatgaattcaaagccagcctggactacctagaaccaaatgtatccaaaatgtatcctgaacaaaaaaaaaaaaaaaaaaaaaaaaaaaaaaaaaaagaaagaaagaaagaaagaaaaaaaggaggaggttagaaggaagaaagggagggtagaaaagagggggttaaaaagaacccacaatgcccaaactctactactctccttgttccctttctctgaagacctgacccagctagtacttactgaacacttgatgggaagcagccctgtgctccgtcctccccagcccatcagaactcatgtggggatagggttcatgccgctctgtgggtgcacatgtaggatcttgtgaaaaggcactgtcccccagcagggctaggataggtaccacagatttcacaggtagatattggtctctggaccaccatgcaaatgaagcaaggccctgggagacttttttttcccctgataattagaatttaagagagaaaaaaaaaatcaaacatgaggtgaggcgatcacagggtggaaactagatggttaacatctaccagaggaaactcggccttctgctgccttcagaacaaacagccccgcagctccaggagccagctccgctgagacactgagatttggcttcatgaatgttgaagcgatgcaggcagcaggctctcaagctcacaataaattacctgtgaatagcaggggcatcataaatagcttggcctgtgggttgctgattcccttcttgaaatggctctacttcacagccagccgcttccccagcaccaccctctcccgctgcctgctgcacactcagaaagtggtttcctccacctcctcggggtgatttgaacctgagaatggaggcagatacttcacagcctcccttaaccacctccttaacaccactgatcatgagtttaacagcccctcttgactgtcactagcaaatctgagcccattgcactccttacttagctaaagagactgttgcggcttctctggttttaaaaagccgagggtttagaggatggtgatttctcagaccctgcctgttagcctctttctaagaatgacctgtgtggattaaaagcggagatttgccatttagttgtttcctatgactgtttagcagtgagctgaaagctagggatgtggttgatgtcatgagaacaggtgtttttcaaaactcaagtccatgagaaagaaaactgtccaatctccacctaccttttcctcctgtgtgtagcgagttaaaacaacagacatcatcacattactcatgcctctctgaagtgagccacaaatatataacttttcctgttcttgtcacctcttaaattatctttgcgtttgcctttctttctttgttttgttttgttttggaaatcgggtctccctctgtagcctgtgacaatcttgaattcatggcaatcctactatctcagcctcctgaatgctaaactttataaagccagagtggtgccttttgtcagccttatgttcttgccacacctgaactccgttttatttccttccctttcccgtttatgttttatgcaccctgctaaactcaccaagcagaacaaggtcagctatatcatctctgacttatgctagattgcgggggcttaacttactcctccatatctcaaccaccctgcagggatggaggctgccgtagcatcggagatccctgctgagtccttacattggcaattgttgcacactgcacggccctcttgctgggtcagatgctcctggggttagggaacaatcagttcccgtgtcacagaaatgtttaggagttgtggctgaatcttcagcaaagaattagtatcagggccacagactccagcacccaagtccctagtcagtagctgcttacacttgaacaaagaatcagacccaaacccgtagccatttgagacattcaaattgaaatagcctcttagttaaagtgttgcaatccaacatgtcaaggtcttggtggagaagcagattctgtgtacctttcaagtgtgtctcagagcgtttgtctaggtgcaatgtttcagtgagtcccaccaggcacactgataacaccagggactgtttcagggcacacagatgcaatatggggttagcattttctcctgggtacttggtatcctcatccacaggtccttgtcttggttctatgaagcacgttatatgtctgatggaggtgggtgctacaaaagtgtccggcctctaagtcacagagctaggaaagcctgcttatttctttgactgggatgatacaagatggggtccatgcatgcatagtttaagtgcataccttcctgcatagcttaagccctacacaggagtagtcagtggagtggtcagaaggaatatcaaagacatgagccctgtatcttgggacatagacagtggtgacatggagcatgccacacggtggctttataacatactgtagaaagccaggggggagggacagctgcaagtagggacacatatgaaggaggtgacatctgggagggaactggaacaaggcaaggggtctctgtcaaagccccgaatgggtagtgcactgcagggagaggtctctgcaaggagtgggcaaatgggggttctcatgtgtcacggccagtgattcttcaagagaagcaggcatctaatctcttaagccagagccaacacctagagtcccacattcctctccgggtgctcaaaggtgttttactaatttctattaaattatacgaatgattgtcttctcgacatcatgtgtatacacactgaggctttctttttgccccctgccccactctcttctcttctacagagttctcactgaattctccccatccctatgtaccgtcagtagtaggtttaatctccatttcacagatggagagactgagaccaagaaaagccaaggcctgcctccaagccacacagatggagatagagaataaaaccacagtgtcttttcagggaccaagtccccattcctgtacccactccatacctggctctctgctgcagtgagattgtcccccacctccaaaagccacataccctgcagaattcttggggcatgaatagtggtagggtctgtccctcttccagacacactcttatatgtcttagagtttgggcacttatccttgggcactttctgggtgaggtgcaccttccaaaatgtgccgattccagcccatgagtactacccagaaccctgtagcagcacaccaggaaattccagtccttccaagtaccccagggcagctggagcctggatgtagcaaattaaaacaattgaagtcacatcacttgtgcctctctgaagtgagtcatgaatacataaatcctcaaacctgcctttcagatcccagctaataggtttgaacctcactgggtctgtaggctctggaaagcagctgtgaggaactgagcaataaattggattgtaaaagtacagggtaggaaaatgattgcagcgttttctacaatgacctggtttccctccatcgacagagggaaacgtgctctctctctctttctcactttgtgtatgaggtaaaactgtgaccgggttaagtccctgtggtcgttatgtcatcacagcctggcttgtactaatggctcgacaccccacggcatgcacctagtattttaccctctccagccacatgctctctcggccttcccgatttttaactcaatgaaggcaaggttcaaatcccaacccaagcaacagactccagaaccagttctcccaagaatacaaggggtactttctgtttcacttcaagagaaagaaattaggtcaattttcagcttccatatcatatttctgtaccatacccgagcaactccaccagtttctagacactcaaaattcaagcactggttctaaccagagcagccctctcattttcggggactttactggtccacctttttgtattccgacatgctgctgctgccaccgctgtccctgactgcctgccccctatctccccgtgatcttaagagttcatgagtgaactttgctccattgtacccaagacaagccactttctattttttgcttttctacttaaattttcaaataatctaaaatagcacttgccaatttttaaccacctcctcttctgaaatatttaattcttccttgggcggcttaacatttttgtcaatgcagaattaagtgccattttttaagacagtctattaacccagaaaggcaagcctttgaccaagtggtaaaggcaggcctccaaggcgagaaagaacagggaagcccctgcccatcaaccaagctgaggccatggctggctgcctttgttaaatgcatactttttttttttttaagcagaattccctagcaaagaccaattttaagggattattgctgggtggataagtagtaggaaggatgataacagcaacgtttaattggtggagggactgtcaactgtggcaggtgcacaagggctgtgtgggaccaaggatgacctcagcctccaagtccccagccctgaccgagaccggccgagagctgggctgttctggttgccgtttgtcttcattgtctgtttctaaagccccgtggaagaagacgggagggaaaagcatttgagacatgaaggctttgataatttctgcctttttatttgatggtcttaatcgaaagccttggttttccattttatgcaattaagtcagctctacatggaccccagggctttcacacacttcccactcctgaagggtcagccttccacatctgcctcttgtgcttaactaactggcctttagtgcagctgtacgaggaagagacgttttcttctattacaactcatgttttttcaagaggagatggctcagccactgaagtgtgaggtcctgagttccatctccagcacccacccgtgtgtgcactggtgcgctggtgcggcgaagcaagtttgtgatcccagcactggtgaggtggaggcaagcagagccttggagctgggtggccagaaaggcctggcaaaagtagggggggggggtgtaaggagagggaggggagaataggagaggcctggaggggaggggaggggaggggaggggaggggagagaaactgatttctgtgtcagaagaggaaaagtcctgccaggctggtgtgggaaaatgtgacttgtcaggtgaactctgaggttgattttaccagtacagattgggcaaagataaatggcttaccctttccaccggattaaaatgaaagagtgtctgaaatttttaagagaaaccattaaggctacttttagcacttttcccccatgagacagaacaccaaatcacattcctaccttgcctcaacattccttaggtgaaggtgagtgtgaaggtgtcccagggtgccaggaaagatggacatctctccttggatgactgtctgacctcatgctctgaccttgaatgactgtctgacctcatgctctgacctcatgctctccactcccaggtcacttccccagggttgcagtaaccacaggccaggaaaggatggaaaggggtgtgggcaaggctagttatctagggctcaggatgctccaacctcactacctcacaggacttaagaagtacctgggtgaagagtattcctctctttcagaagttttctctagccaggtgtggtggtaactgtggtcccagctactgtggaggctgaggcaggagaattgtttgaacccaagagttcagggccaacaggtgcagctcagttggcagtgtgcctgcctaccctttgtgaggtggattaaccctgagctaagagtcccagccccctttgaataaagtggcacacacctataatcccagtacctgggagatagagataggaagatcaggagttcaaggctagcctgaactacatagtgagttggaggctagcctagactacatgagaccctgtctgacaaaaagaatgaaaaagagaaagaaagaaagaaagaaagaggagaggagaggagaggagaggagaggagaggagaggagaggagaggagaggagaggagaggagaggagagaagagaagagaagagaagagaagagaagagaagagaagagaagagaagagaagagaagagaagagaagagaagagaagagaagagaagagaagagcagcctcctgctctcaaagcaaacacagtcttagacatgtggaacttccccagcccaggcttgaccttatagtgaatgttgacttcagaagcactaaggaatgtgtgttcttaaaacacaagttgaagggagctgtttgatccatcacaaaccatgctctctcagtggatccttaaaaagcctccctcacagcctctgaagtagtggctctcctaggtctctcagccactcagccttcctgctgtgtcccagcactttcttactgtgtgggctctcctgatggctgttgtccatattgttcccagtgtttttttttatttgattgtatttgtgttatgtggcagtcatcagctatgttctccctctgaggatggcccagcagcttctggtcatgtctctccccaagaaggagttgaaagcttagtggtaggtgagcatccactctttgtccagcttagtaagtctgcctctcttaaaaatgacaacaaagccttcaaaggcccgccgcagttgctttgttgtgcttaacagaattttctgaatgtattttcagggttggagagatggctgattagttaagagcacttactgcttttgtagagcataattcaattctcaagacccacattgggcagctcacaactcatcacctataactcctgctcccggggatctagtgcctttggcctccatgggtgtacacacacacaattttggaattttggtttcttttaaaaaacacagaaatattgtaaggatatgttttcattttaatcccaggtgtggagctgcaaggctgcctcaggctgtccacagaagctatgatttacctcatgctctggcaaggacatgattttgccagctgcagatagtttctgtgatagtgtgatgtttagaattctggggacttttcagaggggcccaggaggtggaaggttgttagtgggttgttggatggttgttgtttgctgttggttgaggtttgttaagtagtcatatgcaaagagaaaaacagcaagaagaaattagatatcctgatgtcaaagatcaaatttaccccaaggaactctgtcaggctgcctgtctgccttgctgctggaggtataatggctgctcaggagagacagaacaaagtccgagttaggagtctccgggtgtcattctccaaggaaccagaaaaggataaagtctggccggaataaaaggttccctagagtaccggtctgcctggaaaagccaaagtgttacagctctccgaagggaagctgggatctttcctgatactctaacagcgccaatgccagcagtagcagtggtggtggtccaaggcaagcagcagcaggcagcagagaaccacagctggagcccctagcaagcaggcagctggaagtagctatgaacagcaacaagctgtgtcaggggcatgagcccagcctgttggtcagacccaaagtccatcgaggaatgcttcgggagagaaaactttcccagtgtttcagctcaatggaacagccactctcaaacgattcttgatgaaataactcctgcactttattccatgtggatagagaccttataaacattttgggagtagggtgggatccaggggtaaatgtttcccattggctcagtctgagatgttagggatgctctatttgcatggggaagggcttcaggtgactgattgctgattgtcatggctctctcaatgggatgtcatggttatgtattccaggacaagtagagcagggagctggccccatgcctgccattcttaattctgaggtttcccaggatttgggcttgctcaaccttaccagttctgtctggtaacacggtccacttgccccacagaacttgacacccctaattagcaggaagcagtctaatggtaatgttgccgcctttctgactcctgaatttattcagtgatctctttcctttcatctctatctattcttctcttttatcgagtgttagggggttgaaagggtagaagaaaaggtgtgggtaagggtggaagaaagaagaacccacaaagtatcgaaagatgactacaaatggatggattaattagatagatagatagacagacagatagacagatagacagacaggtgataacagaaagatgttaggcagatagatagatagatagatagacagacatacaggtagacagacaggtagaaatagatataaatatacataattttgacctctttattctaggttgcttttcccactgtttctttagaaattaagttaagcccttccacagtgaaaatgttgaatctctaaaccattaattggagtggatccttaatatgtaccaaaaattttttttagcttttttatgtttgaacagaacaggtataaggttgaagccagtgtgtcagaaagcacaaagcgagacagctggggcctgccggtggccaatcctatctcatagacagtaacagaagaggtgtttatcttcccaccatgcttctgagaataaggagctagagagcctcatttggtttctgagtcacccactgactaggaaatgttaggttcagtaatttatgtcttgaaactgcttcagttctgcctcccagggttattacgtgcttccaaagggtttgtgggtaaatgttcccagaagagcaccatgacctatgctctaaggtacacttaaaatgtcctcaacaaagactttgctatcatgtctgctttccacagggatggacacaggctgccctaagatgtgcacctgtgagacatgatctagcaggagcacagaggttaagaaggaaattaatatgtaatagatgctttcccaggagcaaaaaggagttttcatcctggcccacagaaaacaacaactgactggctgaaaccatactgtcattcactgtggctttaagaatgtttgctgggctggagaaatggctcagaagttaagagcactgactgctcttccagaggtcctgtgttcaattctcagcaaccagtccgatgccctcttctggtgtgtctgaagagagtgacagtgtattcatatacataaaataaatatataaatcttttttaaaaagaaagaaaagaaaaagatagtgtttgtcatgtttcagaacactcaggcacatgggtgtgtgcaagaggctgttcacttttagttaggtagatcccactggcagcatggggaagctgctggaagttttagttacctgacagtccctggcatgtcacatgagttaaagggtgtcctcacccactcccaattttatacctcctacactgtgtagccactgttcagactgtgtgtgactatgggcatttgtgcttcccatgacatcataccaccttgtgatgtcacatccaggtcctttgtgcacacatactttataatgttcatctatggaccagcctcatgaggcacttcccagcatgccttcctagttaaatgacacacgatgactttgcaaacagctgtttcctcttccttcctaatacttacaccacggttcattctctgaccaggaccaggtgtgacatgggcccaagggatggacacatgtccagtgctgatcaccctgttccttctaggtctgactgtgttgttctggtaagacagtcttcatttgggttgaggaaactgtactggggttttttgcttatgtcccttgttgttgctaaactgctgactcttttcaaatgggccgtcttctacagcgcactatagaattaatagctttttttttttccttcctactaatgccttggtaggtattttgagttgtcatgtggtctatgctctgctgtttgctagatgcttggggaatacatgtctcttgagctttgtatagccaacagaaaaagcttttcgtaacctcaagtctcttcaagccagcacagaggcaaacgtgtgctttggatattgccaaaggaaaaagaaagtgctaagtcctaaaactttcacctgcatgtgggactttctgcctgcagctttgcttcctagctctctgggctagtccatttatatgttcatataatattgcttccactttcttacctaccctttcatatgcattaggacttgcacagacatgcgtgttgttattttgaaaatcaaatccatgcctgtattgttctgcttactcttgatttgcattgttcaacctttttaaggttttgtttgctgtctggttttccttttggaggagggttattttgatttggagttcttctttattaattgtgacatctttagggtctaacgatcaaaccaacttgtttctctttcatcatctttttctttattgaattccttcagcttttaagtttttttttttttcttgagacaacagtggttttcagtcttccctgcttgctgggtgcatttaaacttagagtctctttgatgccccaggcagtctttgagctgaaccctcccttgctgctcttctcagcactgtctctaatttcacctttcattttcttcataaattactcttgagtcagagcttcagggggcctggaagatttctcttttcaagtaagttttattgagatagtacttgtgacctaatactggtgagatatttgaagtggtctgtagaaatttaaccaccaatgttttgtgtggtttcagcacggagtttgaatatgagaaacatccaattccgtgcctgtatgctcagaccatctctcttttcctgtgcttggttaatcagtttctgagagagaagcctggacgttcccccattcttagcctgggtttcttaggtgcccccttgtgaattcaacccacacagtgtggttcttcaacccacaaaattatttttatccttggatattattttgtccttggattctgttttgatctaaggataccaatgctctcttgctcgatctttctttctttctttctttctttctttctttctttctttctttcttccttccttccttccttcctgataacattctttccaattattccatgctatggcatttaacatccttttcaagttaccatatagtgattatatacattcccatctcaaagtctgacttaatagaattttaagtccttcgtactatataccctttggcatacttggactcatcacttcatttattttcatttcctacttaacatgattctcaatgagcatctccttgcctatctcttctgtctccctgcattcagtagggtttgagtagtgtgtgtgtgtgtgtgtatgaatatgcatgatgtgtatggatgaatgtgtatagtatatgtaagtatgtgtgccagcatgtcagtgtgtgtgtgaatatattgtgtgagtgtgtgtttatgtgcatgtgtgtgagtatgagtgtgtgtatgtgagcgtgtgtgtatgtgtgagcatatatgtatgtatgtatgtgtgtgtgagtgtgtgtagtatatgtgtgtgagcatgtcagtgtgtgtatagtatccgtgtgtgagtgtgtgtgtgtgtgtgtgtgtatgagcatgtccgtgtgtgtgtgtgtgtgaatatgtgtgtgtgtgtgagtgtgtgtttggtgggaggaggtgatttagaatttttacatccttctgctttttttttttttttttttttactgaaaacagagtggttaatttttgccactaataagaagatacaattttatttagaattcgtaattttccctcccctcaaaacaaaaccctgaacacattttttacatgtctttaatttcccaggactctcttggtctctggttgctcttttcacaatggcctgtttgcttttccaacaaagtatattactaaaggttttatttcttttcttcaggaagggaagaaaacatatgtgctgcttggtctgccatcttaaaccagaagtctgaaatacgggtctgaatgctgctcgcaaggatatcttacattgaggatagcaggcaccagagactctgtaccataaacatttccacaagaaacgtgagtttccccgtaagcacgagtcagattcacagaccagaggatgggttgtgttggggctcagtgaggactgagcagaggctgcacaagggattgtgtttgtactggcgtccacagtcccacatgcttagctgccactgtggaactattagcaaatgaaattaaatacttcagttgcttagtaactaatccagtctaagaaagaagcaaaaatagaatacataaatttagaacttttaggccacttgccaagcaaaatattcttgcttttacatccttttgattatctgcaatttgaatggaagaaaatatattttagtgtccttgagtgagtgagtatgttggtattccttgctaaaggtgaattcttctcaatggtggacactcatgagacgtggtctggcttccagggtgatgccacactggccctcagaagcccaagcagaagatactgatgactctggaatttatttttctgacataatcagaaagccaaagaaagggcattatgtgattccagccctgttatactatgggaagataagcaaaaaatcatctgttttacataatttgtataaaataaaaatatcattttttcccaagacaccaaaatgaggacacagtttaaacttttatgtgacaccaaaagaaatcacaggtcacttgatgctggggttaatagaaataatgcaataaataaatagaagttatagtaatatcagttgcttaccatgtgacttttgcctcctgggagagcagtgtgtgtttatggctgacacatttcagaacagaaaggaaaacaagggtgttggagagatggctaagtggtcaggagcacactggctcctcttccagagcatccaggttggtttttagcatccacatggtgtcttcacaaccatctgtaactccagttccaggggatccaatgcctcacatacatgctggcaaaacagcaatacacataaaataaaaataaatacatctcaaaaaaaagaaaaaagcttaaaccctttgggagttcatatgtcttttaggatttcagcatctattccctgagaacacaacaaactgtacagttgggaaagtgtgacaatggggtggtgtcttggctcagccgcttgttgtatcgcgttggctgagttggtaaagtgtcagactctcccttctgattctcttccttaccccagttatggccaccagaggagtcttttctcttgacccgggcagtaagtagcacaggctgcattggctccacggggctcggcagggctcggcagggctcggcagggctcggcagggctcggcagggctcggcagggctcggcagggctcggcagggctcggcagggctcggcagggctccacggggctcggcagggctctgctgcagagcaccaagcccctctcttacattgactttttataatttttatttattttttttttttgtaagaactgataatgtgcctctattcagtttcttctgctattacctcatggttaaaggcacatttttccttttcaaaattattttttaaagatttatttatttatgttaattttatatgtttgagtacttgtatgtatgtttgtatgtatgtgcaccatttgtgtgctgagtaactaaggaggccagaagagagtttcagataccctggaactgaggaacttgtggctgtgagccccacgtggtgctggcgactgggcctgcaccctctggaggaatagaattctcttaacctctgagctattgttaatccatggctgtgaggagaaagattccccaaccccaaccatcgtggtcagatcaactaaagcgagtgtcttcatttgtggacactgctgcctctttctaaaggaggggttcaagaggtcagcacgggacatggggaaggtaggggttcttatcgttcagaagttgggagtttccaaacaggggatttggcaggcaaataggcagagttacagaagcagaacaagtatatcaagctggtcataagaagctcctgagacaaagacatgttgcaaggtcgcataacaaggtggtcatagcaacttttagaaacaatggcgtgcttcccatttcctgaagcaggcaatgtaaagtcatttgtaattaagattacaggtggggcatagcccaatcctcaagaaacagattgaatcataaataggaacggacctagtttgttttcactataagatgacttaagatggaggcaggctggtttatcaccacctctacagtcccagaaattttaaataatgttttacagtgttccttggagtaatctaagcccttgaagtgggtcatcaagttcaaaatggctggcaaagatgactcctgtcactccagagtgtaatcaagctaggcatggctcttggctttgagcgcccagccaccctgctagtctagggtcctgtgccccgtctcctgtctcagctctctcgtgtgctaacactcagcctgcaggagacactccatcacaagcagggacttgctccaacatagaaaaacagtcaattggctgagccagaagccagttcttttccactcccgtgtggagctatagaactccgggaggaagcagtcacttccgtttgcaatgaacacaaccatttaaacgttcttctgtccataagtttagtttttatgagaatcttaaccatttatagaaaggttggctggtaatctgaagggctaagaattaggagtaaaggtcactggtgaggtcagaaggctaggaacagttgaaggttaagtccatgcaggctgggatccagtcagtggtggaaagttaacatgaggaggggatggagatttacattcaagccagcaaaataaatatataattgcccagtcttcagttgaggtcccaccatacacctacctggacattcagtgatagcttaggttaggttaggaaagggttttgtggatgctgtgaatgcacgtgctagatgctctacttagcatcagatgctgaacaagtcatagaactcatccttaagaaccttctgttccaatggagaaacatatgatgtgcctagtgcaaaaatacaagagacgggcataaacactacaatcagaatcagctgcattatcgtggaacccggaagcagcaccaagactttctgtaggctctgggctctgcttcctgccgaatagcctacctgtgggatttgagctggtacatcactgctcaggcctcctgtctgctccctcttttccactgggctggatgtggagagtttgcagagagcagtcaacatggtcctgagctctttgcagatagtttgtggatggaggcaccaacctgtctgatagctagctctcagaggcaaggcaaagtggccattttggattgactctggatcaggggtctgaatgaatccatttagtatctgtttcagaagttaatagagtatatttacttaacctagttctcacatcagaactatgttcagcttgatacaaacctagacatatctgggaagagggaaccataactggcaaaacacttcccttctgtaagattggcacgtagctaagtgtgttgggtattgtcctgattgttgattgaagtggaggagtcaagctctttgagggcagtgccagttataggtgggtggtcctggggtcaataagaaagcagactgaataagcactggggaacaagactgtaagcagagtttctttgtggcttctgtttcagttcctgccgccagggccctcccttgagtagccccgacttccttggtgacagcttgagacctgagataaatttttttcctccccaagttacttttggccaatgtattttgtcacagcaatagaaaccctagctgagacggtggtacaagagatttagaatagatgtcacctcattcctgtttcccagacactgtgtggttggtcaatattagtttttatcactctgatcaaatctgccccaaatccaagccatgtaaggctctcttctgttatttatctttcaaattcagaaggtaaagaactaaagttattgcttcagctaatattttctcacacctcggcggttcatcttcactgtcagcttgactggatttagaatcacctgggacatctacttccgggtatgtctgtctattgggaagtttccagagagatttaactgagaagggaaggcccaccctgaaggtgactagtgctaccccacaggctgaggtccgaggctgaataagaagggaaaagagaaagctcactgagctataaccagacatggtaggcccctgctgccatgcctccctcagcatgatggactgaaccaaccgtcaaaccaccagccaaaataaacccttccttcctgaaattggttttatgggacattttgacacagcaataaaaaaaaaataaaaaaaaactaattatgacttcttaattcatctgtgtagcatggatttgtaccgaagaggggaaagctgtatccatcagggtttaattagaaataatcttctatgccattgaagctgattcttttagcatcaacctgggactcttgaattatgaatttagctgtgagccattttaaaagtagatatgcttttaccacaacttgatctgtggcacccacctggcagtagaaaagcaacacaggcctgtggccccagacagaaccactgtattcagcccagtttcctggcctcaccagggctcaccagggctagccttctctacagtctgaggtagccccaccagttccctccgtgcacaaagcttggtattgcctgtatcactttccatgtcgtaagaactagttcccataacacatggttggcccacccactcccagagagcactagctggaggacgagatgttcactcttcccaggaagcccctttgcctaccttttcctctgtgctcatctcctgaaacaaaatcctgggaaaccggtaaggctgcctgtcagaaccatactgagcaatttgtattctcagtaaggtagacttcctggagagacttctgctcacagaccctcaggaaggttaacaaagcaaggctatcaggtcagacttcaggacttcatggccttagggaaagttcgagaagtctggccccagaatggcatgtggatcacagtaaaacacaaggcatggccaagaattcctcagaggacacacagactgtgttggtttgtgacctcataaacttcctaagccacaggaagggggtagagcagggggaggagaaggaagaaaccagtaaagactgggtgtccctgtttcctgtgactttcatagcctcctctgccatctgccaccacatctgaatctctattctaagccagggcagaaaataagacccctttgcagaatgcctagctcctaaagggagtgccctcatccagagacagacagaccaaaggggagttgggggggggggtggtgctaaaatacaataaaagtaaaaagagatcttccatgtgagagaggagctcctttagtttttacaggcaaaagtaacctgaaacacagaagtaaaagtctcaggctgcaaagagcctatggagcacagacacaggagtcctggcacacggacataggaatcctgacggtgctccacagtgagcctgtgctgtggatacacagacacaggagtgagtcctcacagccctcctcagtgagcatcatccagcacgacttggatcctctgtgagatgcatccagcgctcccctccccagcacacagcctgtgtagctgcagttacggccacaacatggtcccctgggaaatgccactcatcacacgttatcaaaggcagtatgtcgaggctcattgtttcgtgtttttaatctcagacaccagtgcagaaacccaagatgtttattataattttgcagacaccgccaacaaaagctttactcatgaaggaaaaattaaatgttaaggctgtgcggatgataggggagggtgagccatggaaggctcagaaggatagaggggggaagcgtcatttcctttaggaaagaaaaatagggtgagccataaacatagcttcattttcaggctggcagttcttacagtaatgtgttttgtcaggcaagtcctcaatacagattaacatgaaatgccgacgagttccacctctcggcctgtgtagtggctattcctggttgtcaacttgacaatatttggaatgaactacaattcggaattggaaggctcaccagtgacccttatctggaggcttggagatccttatctggatcttggtttgaagatcttaagccatagtggctatggattccagaagattgaatctccgagtttaaggaacacacctttaatctgggctacgcctttcatctgggattaaaggtgtggtgggacacacctttaatctgggctacaccttctgctggagacaatataaggacattggaagaagggagtctagctcgagctcttgctccttcgcctgcttgctgcgtgagactgagtaactgctagatccttggacttccattcacagctgcgactgaacaattgttgggaattgggctgccgactgtaagtcatcaataaattcctttattatctagagactatccataagttctgtgactctagagaaccctgactaatacagaagttggtaccaggagtggggttctagagtaacagaagtacaaggatgaatcttttaaaattctggaattggcttgttgatccaccagcactttcaactattgaaacctctccagattctctccctcctgggagctcagagaattttgaagacccatggttgaaactatattccgaacttaaagaagctaatgcccttgattttcttaatgaattaggtgattcagtgcacaaagctttctacaagatggggaaaaaatcgaaaaatgattttactggctggctgctcttagtatctgtggaaaaaatgatgaatgaaaggaaggagttgtgtgataaaatcgaaaggctccagacacaagtaaacgatctaaaagttgctaagtgtgtccttgaggagaatcttctctcttgtagcaatagagctcaagttgcagaaaatcaaacagaaactctcattgtaaggttggctgaactacagcgaaaattcaagtctcagcctcagagtgtgtcgacagttaaagtaagggctctaattggcaaagaatgggatcctacaacatgggatggggatgtgtgggaagaccatgttgaagctgagaattttgaatcctcagattctcaagggtttgccccacctgaggaagtagtaccctcagccccacctcttgaaataatgccttccccacatgaggaaattaattttgcagagtctgctcacggcccaccaatagtttcttctagacctgtaaccagactcaaagcaaaacaggctcctagaggggaggtagaaagtgtagtccatgaggaaattcgctacactactaaggagcttaatgagtttgctaattcattcaagcagaaacctggtgaatatgtgtgggaatggattttaagggtgtgggataagggtggaaggaacataaaactagagcaggctgagtttattgacatgggtcctctgagtagagattctaggtttaatacggaagctcgcatagttaaaaaaggtgtcaaaagtttgtttgaatggttggctgaggtgtttatcaaaagatggcctactggaaatgacttggagatgcctgatattccatggcttagtgttgatgaagggattttaagacttagggaaattgcaatgctagagtggatatattgtgtaaagcataattgtccacaatgggaaggtccagaagatatgcctttcaccagctctataagacgcaaattggtgagaggggcaccagcacatttgaagggttttgttctttcccttttccttgtgccagatcttagcattggagatgcttctgctcaattagatgaattaaattcactgggtttagttggattccgaggtaacaagggccaggtggcagcattgaatcgccggagacaaggtgattctagttattataatggacagcgtagacaaaagaatgtttataataacatacccagtaatggtcagcacaggagaggtgaaatttataatggcatgactcggttggacctttggtactggctaaccaatcatggtgtttccaggaatgaaatacataggaagcctactgcatatttgtttgatctgtataagcagaaaaattctcaaacaaatgaaagaaaggctacattagatcgtggtaaacagccaaatgaaagaaaggctacattagatcgtggtaaacagcaatctcggccagtgaatcaatttccagacttgagacagtttgcagatccagaaccccttgaatgaaggggtggccagattcctctgaggaaggatcttgataagacactcaaaggttttgctgttaccctttctccagttcttccccagagggacctacggccttttacaagggtaactgtacactggggaaaaggaaataatcagacttttcggggtctgctggatactggttctgagttgacactgatcccaggggatcccaagaaacattgtggccctccagttaaagtaggggcttatggagggcaggtgattaatggagttttgactgatgtccgactcacagtaggtccagtaggtccccggacacatcctgtggtgatttccccagttccagaatgtataattgggatagatatactcagaaattggcagaattctcatattggttccctgaactgtagagtgagggctattatggttggaaaggccaaatggaagcctttagagttgcctctgccaaagaaaatagtgaatcaaaaacagtatcgtattcctggaggaattgcagaaattactgccactatcaaggacttgaaagatgcaggggtggtggttcccaccacatctccatttaactctcctatctggccagtgcagaaaacagatggatcatggagaatgacagttgattaccgaaaactaaatcaggtagtaactccaattgcagctgctgtaccagatgtagtttccttacttgagcaaattaacacatctcctggcacctggtatgcggctattgatctggcaaatgccttcttctcagtacctgtccataaggaccaccagaagcaatttgctttcagttggcaaggccaacagtataccttcacagttttgcctcaaggatatattaactctcctgccctgtgtcataatttagttagaagggatcttgatcgtttggatcttccacaaaatatcacattggtgcactatattgatgacattatgctgattggaccaagtgagcaggaagtagcaaccactttggactcattggtaacacatatgcgtatcagaggatgggaaataaatccaaccaaaattcaaggaccatctacctcagtgaaattcttaggagtccagtggtgtggggcatgcagagatattccttctaaggtgaaagataagttattgcacctggcccctcctacaaccaagaaagaagcacaacgtttagtgggtctatttggattctggagacaacacatccctcacttgggtgtgttacttaggcctatttaccaagtgactcggaaagctgctagctttgtgtggggcctggaacaggagaaggcccttcaacaggtccaggctgctgtgcaggctgctctaccacttggaccatatgacccagcagatccgatggtacttgaggtgtctgtggctgatagagatgctgtttggagcctctggcaggcccctgtaggtgaatcacagaaaaggcctttgggattttggagcaaagctctaccatcatctgcagacaactattctccctttgaaaaacagctcttggcctgctattgggccttagtggaaactgaacgtctgacaataggacaccaagtcactatgcgacctgaactacccatcatgagctgggtactatcagaccctgcaagtcataaagtgggacgtgcacagcagcagtctattatcaaatggaagtggtatatacgtgatcgggccagagcaggtcctgaaggcacaagcaagttacatgaagaagttgctcaaatgcctatggtttctactcctgttacaatgccatctgctgccaagcatgcacctatagcctcatggggtgttccctatgatcaactgaccgaagaggagaagactagagcctggtttactgatggctctgcacgttatgcaggcaccacccagaagtggacagctgcagcattacaacccctttctgggacaaccttgaaagacacaggtgaagggaaatcttcacagtgggcagaacttcgggcagtacacatggtattacagtttgtttgcaagaagaaatggccagatgtacgattatacactgactcatgggctgtagccaatggattggctggatggtcagggacttggaaagatcacaattggaaaattggtgagaaagacatctggggaagaagtatgtggatagatctctccaaatgggcaaaggatgtgaagatatttgtgtcccatgtaaacgctcaccaaaaggtgacttcagctgaggaggagttcaataatcaagtggataagatgacccgttctgtggacaatcagcctctctccccagccatccctgtcattgctcaatgggcacatgaacaaagtggccatggtggtcgagatggaggttatgcttgggctcagcaacatgggcttccactcaccaaggctgacctggctacagctgctgctgattgccagatctgccaacagcagaaaccaacactgagccccagatatggcaccattcctcgaggtgaccagccagcaacctggtggcaggttgactacattggaccacttccttcgtggaaaggacagcgttttgttcttactggagtagatacttattctggttatggatttgcctttcctgcacgtaatgcctctgctaaaaccaccattcacggactgacagaatgcctcatctatcgtcatggtattccacacagtattgcttctgaccaaggaactcatttcacagccagagaagtacgacagtgggctcacgatcatggaattcactggtcttaccacattccccatcatcctgaagcagctggtctgatagaaagatggaatggccttttgaagacgcagttacagcgccaattaggtggtaacagcttggaaggctggggtagagttcttcagaaggcagtatatgctttgaatcagcgctcgatatatggtacagtttcacccatagccaggattcatgggtccaggaatcaaggggtggaaaaaggaatagttccacttactatcactcctagtgaccctctaggaaaatttttgcttcctgtccccataactctaggttctgctggcctagaagttttggctccagagaggggagtcctcctaccaggagctacaacaaacattccattgaactggaagctcagacttccccctggtcattttgggcttctaatgcccttaaaccaacaggctaaaaaaggaataacagtgttaggaggggtgatagatccagattaccatggagaaattggattacctcttcacaatggtggtaagcaagattatgtctggagtgtaggagatcccttagggcgcctcttagtactaccatgtcctgtgattaaagtcaatgggaaactacaacagcctaatccaagcaggatgacaaagaacgcagatccatcaggaatgaaggtatgggtcaatcctccaggaaaagagccaagacctgctgaggtgctggctgaaggagaaggaaatacagaatgggtagtagaggaaggtagttataaataccaattaaggccacgtaaccagttacagaaacgaggattataaagtaatatgaatgcccattgtaaatttacaaatgcgtttgcgattgtacaagggatagttatatcatgttaggcgtattcacaaccttgttattgtttcgtgtgaacatgagatattatttgtgtcaagttgacaaggggtggattgtagtggctattcctggttgtcaacttgacaatatttggaatgaactacaattcggaattggaaggctcaccagtgacccttatctggaggcttggagatccttatctggatcttggtttgaagatcttaagccatagtggctatggattccagaagattgaatctccgagtttaaggaacacacctttaatctgggctacgcctttcatctgggattaaaggtgtggtgggacacacctttaatctgggctacaccttctgctggagacaatataaggacattggaagaagggagtctagctcgagctcttgctccttcgcctgcttgctgcgtgagactgagtaactgctagatccttggacttccattcacagctgcgactgaacaattgttgggaattgggctgccgactgtaagtcatcaataaattcctttattatctagagactatccataagttctgtgactctagagaaccctgactaatacagcctgggaacaaggaggagtgttttgatgaatgtcagttaatgacactcacactcttgaaatcagccctggcagccaggactgagggctgggggaggggagtgccttacagagagggggcagggaaggttgttccaggatttctaataacccacattgaagatggaccagaaacaaaaccaggatgtcaagatggtgaacctcccagggttatcaggcccaaagcacaaaacacaatttccaataacccaggctgggtcccctgcaggacgtatttatgcattaagagcacaagacagggctggtctcagtggatggggaagagcagcccccacctccctggtgcactgggaccttaaggctattcctctagacctggaagccttggcctgcccacccctttgtgattgttgcattcagacctttcagactccgataagcctgaggaattcaataaaggctgaagctgcagcagcgctctgtcactcacagatttaaatccctcctccccagtgactgggaggtgggatgcacttatttctcaggtcttgctcttgggcttgactgggaggacttagcggtggattattctcttactgtttggaagaagagctgtcactggaaattgctgactaattttctggctgtgtagctgacagttaatgcctaggtccattaatcctcatgaacaaaggctgacagactaccttggtgtccagcccactgtggcagtggccatctctctgacttaccttcgatgcttacatgctttttattggtttgtgtgttggataacttctttccagattctaccagtatcaagcccagcttcttagacattaaatcataaaggaattctcacaggaaatcaagatccgggtggaaaaattatctttttgtgcccagaacagaggtcccaaaggtaagaataaaactaaaacactctaggctccccagttctcatctgtgccctgtgatggttcctcctcctccacatcacctggagtgatctgtcctagggacactgtcccccattctacccaagaggagcctgagatacacacagcagggaaactacagagccaggaagcaagcttaagcatcaatcaatcttaagcaaagtcacaatgctctctgcaaggcttatttttcagaaggattataactatcagacaggcacatacctgtaatcccagatgggacatgggacacagaggcggcagaggtagcaaaggcaggaggatcatgagtgtgagaccagccgaagctatgtagcatgagtctgagaccagccgaggccatgtagcaagacactgtcaccaaaaggtgggaggttgggtgtagaagcaaaagagatagctcagctggtgaaatgtttctccttcagcctaaagacctaaattcagttcccagaagccacagggaaaagctgtgtgtggtggcaattgtttgcaaatccaacactggggaggcaaagacaggagagccctgaggctggcagacgagcctggctaacttaatgagtaatgccaagatactaatgaaactctgtctcaaaaaaataaggataattcccgaggaatggcatccaaaggtgacctctcacctccacgggtgtagaatgggaacaatgtgccttggggggcctgctggcagatcactccagatgatgtgaaggaggaggaggagaaaagaagaagaagaagaagaagaagaagaagaagaagaagaagaagaagaagaagaagaagaagaagaagaagaagaagaagaagaaaaggagacactatcacaagacacagatgagaacaggggagcccagcgtgttttatgttctggtcacaaaaagagaatttgtccacccggcccattgatttcctgtgagaatttctttatgatttagaaatttatttatcctcattgccataaaaagcaaagaaagaaagaaagaaagaaagaaagaaagaaagaaagaaagaaagaaagaaagagagagagaaagaaagagagagagaaagagagagagaaagagagagagaaagagagagagagaaagaaagagagaaaagaagagaaaagaaaaataagttagctaccaactgggaagagtacctcttgtacttgcacaccagtgatgagcttttaaagcttttaatcttgtacactctggtcagtaagtattctcaaagcctaagatgatttccaagagctgagtccacagcagaaggctgccttgtacatttagagctagtgttatggaggaggggcgcttctaggcaggaaaatggagaagaatatgcccaccaccttctgcagcagcctgctcacccagagcctgcccaccctccccctactgtgattaggagtaccctacactgctgctggctcatcatctggggattacaaagacactcaccctgtctggccctccgatcactggaagcacatgaactgttggcgatgtgtctattttctcactccaaaaccagggttgacgataccctctcattagatgacctcgttaggatttctattgttgcaatgaaaaaccacggccaaaaagcaagttgggaaggaaagcatttattgggcttacattttgatattgctgttcatcgtaaaggaagtcaggacaggaactcaaacagggcaggaacctggaggcaggagctgatatagaggacatggagtgctgcttactggcctgttccccatggcttgctcagcctgctttcttagagaacccaagactaccagcccagggatggcaccacccataatgagctgtccctccccccaccaatcactaattaagaaaatgcattacagccagatcttatggaggcattttctcaattgaggttccctcctttcagataatagctgtgtcaagttgactgaagactagatgactacagggtagaagcagaggtgtgtggaatgaagcagtaaggcttggcgttttccagcacctgcaagccctgccaagtgtctctgtccctcctcagcagtcctgaactaggctactgctgactgttagtttttaggctgagtctctggtgtctgaaacagcaaggtgctctgaaggtgaacattatttcttagtccccagcccatggagactaattcagaaaagcagctgcattgggccagagagtaccagggaatgacctcaaactcctagacctagtcagagctgatgggctgcctcaggatgctgggtctgctgaaagaactcctgagcctgcttcaggttccttcctccccagaccctccttcagtttcaagatcaagattatacctctggcaagacactaaaatcgaagcaattatctctgtcagagaatttcagttcccgagccactggcagaagaaatgtcagaggtccctggaaagtcaggaggatttgggtgtgaaagccaggcctcagacttggagagagaaagtgtctgccccacagcagtggttgggtggctaaagtggaaccccacattctactttcaaaagttcttggcataatgtatatgggatgttctggaaatccatatagtgtagtgtataccataaattatccatgtgtccacttcctcagcctatatctacagcagacctggaagatgacctcttaccaaggtctcaggtaatgtgtgcctaaggagcacaacaaacatgaagaacagtgtgtgatggcaaggtgcaggttcctccactgtggagctctctggcttcagaaggtctgataggtcacagtgggcaagctctgggtatgaggtggctgtggtgactaatgggttccaaaatgtgttcttaatgttggcagcctcggttatataatattacccgttgcttttactctgagagccttaatctatgcatccccaaacttgaggccatcttcctgttgctgctttctgagtgagcgctgagatttaaaggtgtccaccaccacacccagctgtcttcttaagccttgatattggaaaacaaaccaaaccaaaccagaatgtggcggatcctgtgaaacaacagtcctcatgtccgagggcattattatggtggctgatagagtgcacaccatggctgatagagtgcacactacccctctggccttgcctggcagagttgtctaaggaatacttcactgtgttgttggggctcatttcagtggagacacggaaacctgtgtgagctctcagccatggtgactgtggtaaatgaaactggctataaatctttacttacctcatttcttcagcagtggaagtgggagactcagttaattacaaagcctgtcttgacctttccctccaccccaggcactcaggtctctgtgggtgcttcctgagaacctctggagtacagcatgtacacccagagcccctgccaacctcgtctgcttcaacactctgtaaaggagttgctttcctttcctttcctttgctgttgtgggcccacggtagcagtgaagaattaatgccagccatgagccaaaggctgctttgaggaagggttaaagatgtttgccatagagggacaagccctttcaacctgtgatttttttttttttttttttttttttttacaaaaactgctaagctccctccaggaaagcttgcttcaggctcttctttctcactgtttactaaatggagacaaaacagagaccagtgtcactaggtctgaggtctcttcagctgagaagacaaggttgtaagggttttgtttttgtatttttttttttcctttctccctagctctccttggaagctctgtaactgtctgtggagcctctagcggggaggggacaaaggagtgtcactgactaagctgtgtatttggtgccttatctacagagcattacaccagttttcttttctttctagcaatgtgtgaagaggctgggggcagggtgggggtggggggggtctagaaaggtcagtgtcagagataatcagagggattcccagtcctaggcaggaaggctaatgctctctgcctgtgtttgaaaggcccatgacagccatgaatcaaacaggagctgagaggtacctccaggcgactgtgatagtgttagctgtgccccatctctttgtcaatgaacttggtcacacaggagaaagaaagccctgcatggaagccctggctggtagagcccccctcccacccccatacccaaccctcagtttcgtaacctagcttctggttaggccaacagtatcggaaacttccattgtccatgaagctcaagtcccaaagccgctttagctgaggatgacagtgtggatgtccttgcagaatgaagactgaggttgttttggggtgacagcaggtcagagggtttattctgggctagctggtgaggtctgaactggtgacagctatagcctcagaccaagcacagaaggtttaattttgagactcaaaggtgttgctaatcctattttagcaacggggaaactgaggcacgggcagagcactggtcagcataggatgtagcatttccagacatcatctctggagtatggagatgtatcctgatgtccttgcagccctctatggcaaaagggctctactttgagcaaagcctctggaatttttgtttaagcattccttatttagtaatgtcaacatttaattatgcagagagttatcagggaagccatgttgctcccttaactgtggtatcttaccttgtgtttctcacctttgtgtttgtcccatgactactcaggcctggagagcctgcatgtgtagtaagctgccttctattcctggaactcagcagtatatgtgtgtgtgtgtatgtatgtgtgtgtgtgtgtgtgtgtgtgtgtgtgtgtgtgtgtgtgtgtgtattcctgagtgcatgcccatgtatatgtgttcctgtgtgcatgcccatctgtacatgtgtgtgttagagaccaaagatcaatatcaggtgtcattcctcaggagtcatccatcttatttttgaaacagggcctctaactgaacctggaactcactgactgaactcgagttgctgttgagaaagccccagggactgtttggtcttctcccgctcaaaatttgcgatgcaggtgagtgtcactcctagagttctaactgaggatcaaggacttgaactcaagtccttatggcctttgcatgaaacacttgcctgactgagccatttttccagccctttaaacacactgttgacatgtactgggtagtccaggactccaggggacctcagaagtgccagctgcagcgtatcctcggctgctgctgcaataaaaccccataaagtccaatcacattctgcaaggccagtggtccctgtgccaaggtggcagttaagctgcctgggacagttcggacttgtggcttggcctttgcttttgctggtcattttgccatatagtggctggcagtgtgccgggtgccagcaggtctgaaagtgatgcaggtgaccttgcaggagtgatcctgtgtttccatcatcttcccagttcagggctgcgagtgtgagaggtagggactccctcattctttctcagaagccatccctgagcaccggttggcctatcagtaacctagtctaccctggagcaggatttccctcgctgatctgtgaatgctccttccattaaagatttattgtcctccatgactacaatgatggctgcacttttaaaaagagaatgtcttgggagaaatactggacagatggcaaatctatcatggcagaagtcatgggacctttcgagagaagcatcacagggcctcacagcaggattgtgggaaggaagcgggtctgctgagcacagacgcagtcagccaggcttttcaggtcctgatatgctgggccaggttcccagacccaaacttcttttcttccctgagaaacactgctcctctagctccacagttgtgtattttatctgacaagagagcatttggcactgtgaaaatggaattgccaagaacccccacaggaagagacaacagcttgcctgctctgggctgaagcctttcagaaagtctaggacttccctggaaattctgaggcagggaaggggtcctgtaggtgatgatcttgcagtcagcgttgtcccagctgtgaactgtgtttgtgatatgtgttcgttctcctcttgttgatttgtctccctgggctggtgaaaggttgtggatttctagagatatgtgcagacagcaactcttattacccagggccttgtccctaaaatagagtgtgtctcacaggaagtttcgggtggcagggaggtagctttcagcagagccctactagatctccagggaggaagtagctttgtgtgtgtgtgtgtgtgtgtgtgtgtgtgtgtgtgtgtgtgtgtgtgtgtgtgtgtgtatgtgtgcatccatggtttgaggaggcataagtagcatgagtgggggagactaggagccaacaaccctttagggagcccttcatcccacagttcctcagggttgatggattcccacggacttcacttcctgttgttatctgaccccttaactagcccaggacagagatgaggacagtgctggagagagagagagagggcaggggtaaggggggtgacacagattcagattcagaaaagcagaatttcaacggcaaagtaaaaggaagtcaggacatcttgaaatcaccagacttgaattatttgagtagagaccactaagcaccctgtccctcactcaagccctaggatctcaaagacatggagcacagccaacactgatctggataaaaagagaaagggacatatcacacacacacacacacacacacacacacacacacatacacgcgcgcacacacacggcaccaaatctttgaggtatggaaaaaaaaaaaaactccaatagcatgcataaagcaaatttgctgactgaattgatcacatgacacagacagcatcctcccaaagccctacttaccattctgctcccaaacctaattttcctctgccttgtccaccagagccactcccagatccctagacccatcacagaagagctatgcctctcaccaaccaagacgaattatgatccagggccatgtgtctggcttggagcatgattaatctttctggaggaaatgttcagggttgctaatgggaagctaatgtctcttatcgggttcaacaagttcagagatgtttgcagtcactaggtaggcaaggcttgatccagatcctgatggagaaactgtcttctcagcattagcaggcttcagtgggcctcccctgggccactggggccagacagtcagaactgctaattttgcaaatagcctgattccaccttgttttaattagcatggaattgcagactgattctactcaacagattggcaagtgaaaactgggttaaggtgtgtgtgtgtgtgtgtgtgtgtgtgttcgttcctgttctaatcattgtgatatgctaggtgctggggttgtctaactctgtaagactctgtttttacaaataccctcatcctattccccagaaaaactcaaatacagtattcatcaaaataataaaggaaaccagggatgtagctcagttggtagaatccttccttgcctagtaggttcagttcccagcactgcataaacataacattgtgatagatatttataatcccagcccttagaggttgaaggcagagggatcagaagttcaagaccattctcagctacataagaagttggagacaagcctggggtacatgaaaccctgtccttaaaatatacaaaaaaagaaagcaaacacgaggttggaatttttgcagaagacatagctgcaacttggaataagtaaatgctagatgaaactggtgacttgggaagcccacccgtgcccttgaagacatcatatcacattaaagatgtatgtctttatgccgtagcttagtggcctagagagccagcaactcaggttcaagcctgagctctacagcatctgctagttacagcaggctaagatgataaccatgtctccacctctttttccttgcatgggaaactggtgaaacagtagcctctcattctagtcaaaactaagaaaattagttgggctggggtcaagcatggcagctcagccattaaaggcactttctccagaacccatatggtgtgcatagaaaaccaagtcccacaaggttgtcctctagcctccatacaagctccctggtcagcacacctcccccctcagcccacatacatacatacatacatacatacatacatacatacatacatacataaaggtttagttgttgttttaaagaaaggtaacaaacatggtgtagagtctgatcacaagggcacagtatgggttctaaggagatatatcaggatccaggagaggaaaagaaaggagacaggtggctggatcgctgaaggcagcatactgcacctgcttctagcaaagtaagtctgtctccatgcaaggtggagtatgctgtaatgacatatctgacaccagataggcttaaagttctacaccaaggtcatcagaaagactcgtgaacattcacaccaggtacatggtcggctgtgcctcatttggggcagtttcaaatctgtacaaggataccataatttaaaagcacatcccgcaggctacctggggcttaggatgtccagacacaaaccaagtaacctgtcaacagtgagacaacagtgcagccacttcacttcgagtgaagtgagtcggaagcctggtgctatgttggtggattttctcctcgtcccatgtaatggcctttccatgaatgctgtggagagactagaaggcaggagggtaaggattagaaaacaaagccctggtcccttgcaggggactccatagccacaaagtcacaagaggtatttcctgtgttttcagaagtgtgccaggaacctcagctataccttttagtttgacgttattgttttgagtaattttattttattctttgttgtgtttgttgttgttgtttggtgttttgttgtcattttgtttgtttgttttgtttttttgttttgttttggggacagggtcttggtattagcccaacctagcctggaactccagatcctcctgcctcaggttgactatttagcccagagtcactgcagctagtgaaggacccaggggctgggatagaatcacaggtcctgtgcttactttctttacagtgcctcctcaggcccatcaaagtcttccaggatcacgcagaggaccatgccacagtcggaagtgaggtaaacaagtctcctcattgctatattttgtaattatcagacaagagagtggagttcccgcctgaagcccctcaggcctgtgtgaagcttaaccatgtatgtactcaatgtaggtgtgatcagttttcagatccatgcaaatgtgagctgactttcccctgatgtttgctgagtgcatgccaacagcattctgcatggctaacctgcctcagcaaccaaatccctggaactgtcatatgcagagggtctgtggtgtggccattttataaatgagccacgggaaggccagagaaagaaacagcatgctccaagtcagagcagaaggcagcttccctaggatctgtttaatgtttgcttctttacaacacaggatctcgtgaaacccaagctagcctcagactcaactgcatagctgaggatacccttgaacttgattctctaatatttctacctcatacccagttcatgaggtaatgcggatagaacccagggcttcctgaatactaggaaggcactctaccaactgagctacatccccagatcctcctctggggataagcccaggttcaaatccaaggccttaacaacatcgggacacggacataagacacagcactctactggacctgggcatgctcctaccctgtctagtgatcgcaaaagccatctttttaacagcccgcgttatgattctaccatcagaccagagaggccctagatagcccagcttcccattgtaagtcatcttcgacatgtttaaccgatggctgtgtgggactgctagaaagtttggaaatcaccaagcgctttgactttcctgcccacaaaaacagttggccttggcagatgtccaacgcgttgaccttagatccatttaatgaaaaccctattaattcaaaaagaaagaaagaaaataaggcaaaataggacaggcagtagaaagatctttacaaaaatcttgtgtgcccttcctccactgttgccttgaccagacagggccacaaagctgatacgacaggattaggacaattgctttgttaacacacaagcacagcgtgacatgaactccaggaaaggcatttggcaggattaacctgctgaggataaagatgtagcagacgggacctgaattaatggactggtatggccaaagtggagaaatctatttgcatgtaatattaactgtactaataaactccaggcggggatccaacagcccgggagcctctttgaaccaggacttgatccctgtacatcctatctctgctaagatgtgtgagtgtaagccggctgcctgcagattaccactctgtccttggtgcctgcaatagcacaagccctttactgactgcaactcaagcagatcccacttacaatattatttacaacctatggaaaagcaatgaagaaatgcaggttcaacacatgtagaaaatatccaccagggcctggagagatggctcagtaattaagagccctggctattcctccagaggacccgggttcaatttgtagcatccatggggcagctaagagtcatctaaagcccatctgaagccctcttctgacatctgcaggcatggtgcatacatggtacatacacacacatgcaaaacacataaaataaaaaaatataaaatttaagaagaaaatgcctacctgacccaggctgttggcctgacttgtatattctgattccttgaaagtctgtgtggggctagggtgagcaagcagacacctgggatgtgacatttcaaggaggtaccacagtctggctcagtctcagaacaaggtgagtgcctaaagattcatgcattgcccctcagactgccctactgcaggttaccataggaacagtataatctatacccattcaaaatcaatacacttacaacagatagctggatgttgggcggtgtggtggaggagaagaatgtaggtgggtggggacctctgaggggtcctataaaatacatctcagatcattgcaatcaaagagcaagagagcctggtatttatctaccagctctttactgtatctggctcagagagtaattccccaccatgcagactagacattctcccccaaagaagctagggaacctagagcaacagcctatgtacaagaatgcctaggccatatggagtgtaaaaaggtgtgagtcagggtatgagtgacacccacttaaagttcttgtgtacttcaacaaagaactggactaggaacactgaataaagattg

SEQ ID NO: 156 - DNA, 3750 bp, Mus musculus
aaatcgggaaatctggagcttgcttgaactacctttgctttattcattaggcacttccctttcttcctccggaaatgaaggtggatatgtaatggaaatcaagcttgcgtatgtaattgccaaaattagcctgtaagcgttaccggcccaggagccaggtaacttctagcgattctgggaattgtagtttttttttctaagtaaccctcgtgagaaagtgcggtggccaaattgattatctgtataaacccctacaatatgtgaccgggggctattccggctgggaaattctgcggatatttctgacccaggtccatctcttggtcagtacctaatatttaataaactgttgcttttaatttggaccgaaatggtggtgggggggggggaggaggaggaggggggggggaggaggaggaggaggatgaggaggaggggaggaggaggaggaggaggaggaggaggaggaggaggaggaggaggaggaggaggaggaggaggaggaggaggaggaggaggaggaggaagagaaaaagccccaaattctcttttcatcccggataatggaggggtgggctgacccagctgtgtctagggtctccaggaaatgcattccctctgcagaatcccaaggtgaatggcagactctaaacagtaagcttcctgttggttcctggattatggttaagagataccctgtctgataaacagggtgaaattgatggggtttgtacaccccattcgggcaattgggagacgcctatttttttattttacttttttattctttatttttatgtatttatttattgagtaatttctgcgtagttggaagttcatccaaggccatcagttattttctgatccgttatttgccttggagccttggaaatgccatctactgacgctgggtgacagaaactgcagtggcccagtatgtggcaacttcacctgggttccaacgcctaggctgttcaacaaagcaatttccagaggataccaggcagtccagggattatacaagaaatcagttgaaacacaatcctattggtaaaattgtcataatcagtctggtgaaacctctgtgcgacaccaattcagtctttactgttgtctgttttgtgacttgtccacatccggtctgtcctcgtgggttactatttagggggcgtctaaattaaacaaacacacaatataaggactgatggacctagaagtagcaaagaccaattttaaatattgttgtcttatatatcagatctgtctttgtatgatctgtctagtgaagctgagcctctgaatttgtgatgctctgacttgggatggtatccaggagccaaagactctacctttcagtctacctacagtcgcaggcccttcttttgcctgctcctacctctgtctagctggcaggaaagctgggtcgataaaaatgtaacatcttagaacaccaagcatgggtaagggggacttgcggttaaagaattcacaagtaacacttggggcccaatggatatctttgtaatgtccagagcctcacatagaagccaagtgctgctgggctgccctacccccaactgcattgagccagacccagctcctctccaaaatatggatgaatctttgatttctctgcttgtaaattttgttgtttttgtgtaaggatgcacgtggccattgcatgctggtttctcattggtcttcaaagcatgaaaaatgttgtttctcattcttgtagctagtttactgggctctagtttactctgggttttctggacacaggacttcatataataggaattcaaatacttccagtatatagtcaacttccttccctaaccacccacccaaactcctcccaatgttccttttgcatttccctctctcagcctgccttgttggtagctgttgccattaacatctcacttctcaaaacccttgggtccttacttatgaggaaattacaaaacactcctttctacagcctaccactctccctatgtcttggaggcttatggacaagtgctgtaacaccacgcacatggtataagttactggattctttgtaaatgtcaccaaatatggtaatactgccctggcttctagatacactttactgacttttatttactcaggtgcttgggtgcaacaaattcaattactcataattaactttgcttaaaaaggttaacacagcttctaaacttttgttctgatacataatacacagtgctagcaggggagaatctagaatcaatatagatttcatcatcagaaacctcaattcacaatttacaaaattgattcaacagaaattgcagacacagaaaaatatactttattttggtcatataaggttacattctaatattccaggcattttgtctaagggaaatacaagggaagtttgcccttaccactgccattttcttaggaattaataaactacaggaagcataagaatctcataagtgcttatatcaaaatgcttcagtatttcaatgatattttttactaactaaatagcagaatcaccttacagctaaaaatatccttcatgtgtactcgttaatatcaagtctttactcacttatgtgtaactcctggagggctactgtaaatcatatttgcatgtggatgttactcacatttcctgtttggggaagttaaaatacgttcaggacatcatacctacttaatgtttgctcatttttgctgttctcatatcaggagaagcaggtaaggatgtgatcgcccttttactcagaaattttgctattttagttctcagtaaaatattaaaactggcaattcttctctatatactgccaagctttttaaagaatgttaccaataatctgttctaattgagccacatcacaggcattttatataactcttagcatcaattgtttggggaaagatctaatggatgacttaaaaatgcaggagagagaatagagtagtatgacttctcataatattcaatcctctagagcaagggcaaggatagcctactgctacaaaaaaaaaaaaaaaaactttttttgtccttctcgaacaaattaaaaatcacagtatgttggagagatgttatggcaggtcatgagaactgcccagatccaggaattcactggatttaagattaggtttgtgctttttctcagggtactgaaatcccgttgtgaaaacctgaatgagtgacttgatctgtgaaagatggaccaagaaaatccactatggatacaactgctaaacctaagaatagaaattgaatgggggtgattgagtcatgaagccatgaacaagagactctctaccaagagtgaatcagctgtagaaaccagtgactgagagaaaagcattgataaaatctcagagagagggtttgacttcgaggttgctggtccttgctatgttttctcttttgaatgcatatgttactactactactcatattgtttcctaggcaaagatggtttcacaaacacttgatgaatatatattcatgccttccatgatgaaaaattaactattaactaaatttgcatgaattatcctttattgctgcacaaaagctaatgaaggtttttcttaattgtttttgtctctaattggattcataaatgtggtccttataaatgtctctagaatgttttgttggttatactggagagcattatagccctgattgctttgattctccatgtatgctttaaagtttgaattgcaatgaaataaaaatatttc

SEQ ID NO: 157 - DNA, 2685 bp, Mus musculus
tttctcattgcacaaagctttattgggcccctcccagaagtctctccaagggatcccgcctgggccagcctgggaggtctgctgggcaaacacagaaatgcatctgctgaacaggctgctggccactgaggaagaagggccaggaagagggagtgtgctccttcaagaagagtccaggcagaaagtgggctcccctgtatgaggaagggtggggccaggtcagaccagggctttagaagaacaggaggactataggggtggagggaggaaagagaagggcaacaggaacaccatgggtggaagttcagaggaaggaaaacctcaagtgtccagagaccagggtgggggaagcagaccaagagcgacaggagtgacggtcaaggaagactgagcccatgtaaccagggcatgatgagatggggtcagacccagggcacaggactgttattctctgatgctcttctctaaatctaggggctgggccatcttttctgagtgcgtaggaaataccccggctgggagacatagaagccagtggcaagacccaccaacctgcatgggtgtctcctgacagccttgggaatgggaggcagagactatgcctgccacacactgcacaccaaccccacccggaggctaggagatgaaggggttagtgtcaggccctctaagcactccttccctggcagaccactactacccaaatcttgggagtggaagactggccaaaggccagtcctcctcagtcatgccaggaccttggccctcctcctccaccaagttggtccaagataccaaatggacccagcccagtgcatccctcctttctctccctgtctgccctctgctggagctgggagaaagcaggcaggagagcccagagcataccatcccaccccggctcttgaaacaggacaagtaccccaacttgtgtcccttcccaaatctgccaggtccactgaggcctacacccctcatggatttcagaagagtcttggccttgggccagtattcatgttctagaccactgggacaagacaagatagtttaagtaactggtagaaaggctgagaactacagctagttaggggtgctcccctgaagggcatgggaaaagaggactggggaggaaaatagagatgaggaggaaccgcagaaaggtagggagcactggtgtggttgtcaagccaggtatgtgtccccaaagccagaatcactggcaccccttgggtctttcctcacctgtacaggatgccagggaagtcgaaggcctgggttcttcatccaaggctctggaatcctgaggtgtggggtgtagcctatttcccacacaacacccgcccctgtccagaaatgtggatggcagggtttcccaagtgtcccatatcagaaaggggtgatgttcaggggtgactggtcccatagagcaggaccagaaggacttctatctgtcccagactatggctgccacatggcatatgcacctacacacataatgcgagaaggggaggatcggcctcatatccctgtcccaggtccttataggaagaagcaggacacaagccctagactggtatctcccagagatgaggggatcttgggctgaagagaactatctcttgctctacccaagacagcgcccagaagctcccaatctgtctctcagactctccagccagagtctcttctcactttaccacctaagtctgaaagagagtggggggggggttgatctgtaagctcagaggagccctgcttagggatagaaccatgagtggaacccccagccaggcacgttcagggagatttctgaagtcctcctgaaagaccttacaaagagtgctagaaacagcaaaggagtctgatggcttccttcaggtgggaagtgctgatgtttactcccttgcccccagagcagagacatcctctgacccagagggagaagagccactttcacaggctgttcacaggcagcacactccagatccagctgctctggcggccacaggtcccgcgaccgagggactccctgggcagagcatcctgccaggacagcagaaaccaggtggtgagggcgggcgcctacctgggcgccctctgggctacttgaggtcgacttttccggacaagttccatggctaatggaaagtggtctgactgtgctcaccctcccgagacgccagcgcggtctctggtagagaaagttaggtagctggtctctcccgagagggcgatgcatgggacgcaagcagctggagctgtagtatccggctggggtcccgttaccccagagaaggcccctgtgagtgctggagcattctagggagtgcgattcttaggcgctgccttcgggttgaggccttgacctgaggggtcattgtgaggtgtatctaaagtggaacttgcttagggtctcgaggaccccaggtcaagcagccccgccgcccctgaacccaagtctccagcagtgcgccacgcgcagagacagattaggaggtctgcgccgctgtggcagagccgaccagagccccacgctgttggggagttgccccgcacccctaaaaagcctcagcacacgttccctgttgaaagtacgcactttacgcgtccgggcgcctccgcggttgagtcgggccgccgcgctccgagttcgcgaaggtggctcagttcgggcgctccagtctc

SEQ ID NO: 158 - DNA, 4094 bp, Mus musculus
agatttctagaatgctttaatttctggaaatgcaggttaagtaaaatatgacatcccgatggaagcttgaagagtcactgaccatgtcaaggaagaagaaaactttagaaagtgaaccccaccctgttacagagcacaggctcatcttctagagtgtgtgtctgggtacatcctgcagatatttactgctgaggcctggacacttaactgagctccttctttggatgtggccttgaagtgaaagaatgccattcttagtgtgggttgaatttcaaaggtcacagaaaagcagaactcacttggggtgggtgaaggtagatcagtctatgtcaaccatcaggaataaccagggacagagtccattgtcacatttctctgatcagccctgggaagccaagccagaccctaaataagacattagtctgtagagagggccatgcttgaggctctttcacacatcctagcagcctagaaatttaccttaaggatggagaacctgcactttgtatcatatccaattgtgctccttcttgtgggtgtgagatgtgagagtctaagctcctacagtgttcttttaaaacacatctagtctccttaacaccactcaggaagagggcatttaagaccagagagctttgttggggggcgggggggggcaaaggaacaaccttaaaggggctttggtgaatcctgagagaccacaggaggcactgaaagtctgtgcaatctgcatcccctctagtttaaaagccgtcctctgtgacaacatccatgatagacatcatggtgtaacctgtaactgaaactgtgggtcttctgagtactacagagtacataaaaccgaagcagcaccgagcaatgctacagagacatcaaacttcctttctctgtgccagtgtaaaggcgtggtaaaatgggcagggtcagacaatcgtgggaaccagaggggaaaataaactatggaatggttactgtaacatatgccaggctcatctacaggaaaacacaatgtaaagaggccagcactggttttttttttcttctttgtaataattgagtaatagtcttgttacatcttatagaccacagttagggagtgttcccaggaaagccaactgtggtccacagctctgtcttcatgtctcccagccacgctctcttcagctcctccctgctccattctctggactttagtcaggtactgggagggaatataaagaaaagacaaaattgttgtgttagttgaaagtcctgcactgcttcatatttctgaaccgaatctgcggtgagtcaggaaatggatggcgttttttcaagtcacatgaatcagcgccccagaattcatcattttcaccaatgggtttctttcacagcttttctcacttttggccctgtacacaggcccacctgaagcagttgatggtgttggggggatggtgaagcggaggggtagggaaagaagaagggagggggagaacactttatcttgatatcaacaaaacattcttggcaaaataacaagcccatttagttaaaaatctgaggattcaaggtgcctttatcaaggattgccttccaaaaggggaaagcagattctactaggaaaaggaaatatttctaaatacttaaaaacaattgcatttcagagtgcctgctctgtgctaagcctcagctgtgctttattgagcagcttctttctcctttggtgcttgtgggtcaagctgcatgagaagacgtgagtgagctcagaaaagttcacgaactttctgcaagtcagtagcaaaatcagtgtcagcttaggaccatttcacctccaggggttctcagccttcctaaggctgcgaccctttaatacagttcctcatgctgtgggggccacaatcataaaattatatcactgctacttcataactgtaattttgccgttatgaatcatgatgtaaacatttcacatgcaggatatccgctatgcgacccctgtgaaagggtcgttcaccagccaagaggttgtgacccgcaggtcaagaatcactgttttagaccaagaaagcactccaaatgaggatttggtttctggtcttgtttcttagagatttgtaattcattatcactgatacatttaacaatggtatagtgtagtctgtaaatggcaaaaatcaaacctacatcctgccccagtaacacaaattcacttcatttagagggtgaaattctatgggataatcctcacggtaaacagcgcttatgcctccaagctaagagtgagtttctttgtctgcttgtaagtttataagttatccctaggtggtcccaggctggccttgaattctcaatccttctgcctcagccacctgagtgcacaggtttgatctccctcattcctttcttccttaaaaaaaaaaatatttttttttttaaaaagatgtgctaattgtttttatcagttgacattgagggataagcataagaaagagtgaagtacatttgagttttaatttgtctttctccaccctgttctgctccaccctgccttcctgaaggctatagggttcaagtgtgaggctgaggtcttccactgtcggcccctagaaggcctccttctcccaaaagtctcccagactgttgtgccacgtaggcaagagaaggggagtgctcagaatggcgctagttcccacccacttctgaaacagcagggagaagcaaaggaagcctattaacttttccgggcaagatctagaagccaggagctgccaccccagagctggaagccagccaagcatctgtagtagatgtttcccaaacaagccctagaagacatctgcgttggggccatacttttcaggctccacaattgtagacacagcacactctggggttgacatagcctccaatggactctttcaaaaatggtttcgcctaattctttcatttgaaggtgacagacacaacaaattggtggcaacttgtgcttctattcacctcctcttgaatctctgtggtcctggatgagcggtgacacattccagctattacccggtccctgtttagcatcatggaaccctcacagaggccccgaactgtcaccggcgcccctatcccctaccagggcacatttgcaacctgccaataccaggatgtgattgtggcaaatgggaacatccttaggtcttgcagctaagaaactcattgatgaggttccttatgcaaaagcacccgaggccaccaacaaggcccgatatgggaggaaaacctgaagacatcgttcctttaccctatcctgagggaaaaggatcgccaagcatggctgtaggggcagggatccacggtttctgactttatcctgtaatttcccctcttcacaaccttgtatgttgtttagaacttggtgagttgatcacttccttagaaggagaactgaacaacgcgtcaataaagctgccttcccaaggcatttactttgcgttccaagataaactttttgcccccatgctcactcagtaaactcccaagatacttgcggagtaccaattagcccagctgtttctgtccatgaggtaaccctctcctaattcccattagggctacttgggaacctcttgctctatttccttggatggcagatttattcatttctctgatctatccttttcaagaactgagagccttgctgggcccagctcgcctgtaagaatccgcggcgggcccctcaccacccccaaagcacaccccagtcttcttatgatgacacagaagaactgaatcttaaacttccactttcttcccacccgcgatccgccgggggcacgcacttacctggagcttaggcaggcctagcagacgccacgtctctggtttgggttgaactgcctccagccctttatacagcccatcctgcaaagtagccacgtaggagccaccgggcaaggggcgggtagccaaagaaggtctcttccaggcgaggaagggagttcgaaaaaagtcaccagttgggtgagcttgcactctggtggcacaaatagaactcctggggtgtgtagagagccccctggggagtgtttgggggtcccatctcgggaagaggcggggctagagga

SEQ ID NO: 159 - DNA, 8448 bp, Mus musculus
gcactcgaaagcgagctgtccgggtgccgccccgagtggagtgagccgagccttgcttaccagcatctgcgcctccgcacaccgcgaaggcgcccaattggaggtgcggccacggccggggcaggcggcacaacgccggtgagagcgctcgcggaggctagggaagcaccaggatcggggccggaagactgcgacgccggggtgggggagtagaggtggggggtatggggaagaaatgtggggcctgaatttcgagactggggactggtgtcacaatcacctcagctgagatagaaatgaccacggaaatacccatcttaaagtgggaggttcgcaagcgctcgccatagccccagtaagcctttgagacctaggtcttttgtcgtccccaccggtacagttcaacccagcgtatagtaggagggctcattctgagacggacttaagatggacttaagatgacctgcatctgatggacagcagcagcagattcaggctgtaccctttctgtgaaactggttttagtcccttggttctgtggggtaacttttttcactcctagaagatgctttggcgtttgggaaatagaggaagatcagcaacgaggtttggatccccccaaactaagtacacgccaataagggactgttcaggctgccctgagatgtatggtggaattctttacatgtaataaagtaaggttggccttgggaggagggagaggtgtccacactgcatctaaccccaccctaccctaaccctcctcctgccggtgccgtccttcccagcctcatttttctttctagagtggctgtggttttgttgcccctgtccgcagccctcagggacacgctgttctcttcactgttgaacttgctgctaagcatgcactgggtaaaggggcctcaacttcttgcacaattatggtattaccatctctgcttaaggaaaagtcttccccgaactagacggatgttgctctccttgcacctgccctatggctgctactagtctttttatctcctagagtagaaatacctcctggtccctcctgtcctgtaagtacccacagccctttgcaccacgcttgaggtgtcctgcctgtcttgctttcctttagcctgcagtttgggatgtgtttagtaagcctgcggttctaatgttttcttctggaactaagtatagtattaagtaaaggtgccatctcctgacttgtttctcggcttctactctactgctcttctttttccggatccaggaaaatgaagaataacttacaaagccctcgaaactaacggcttcttccggctctttgtataaatgtccagcttgttagtttacagaggctgaaggccaaagctgctcttcacttgctttccagacctgatcgcccctccccctttccatcccaccctgccctactccccatttgcttgtggacagccactctgatcttggttggtccctttatctttgcatagcctctccaaccgcaaagtgtctgtatttatttcttcaggtggctatgaccaaacacctgaaacaacagttcaagagaaggagggcttattcggggtcacactcaggtttccgtctcacgtagtggagaaggcagagcttagggcagcggagagtccaacagggaaggtcagaaagcaaagagggtagggccaggtgagacccacccctaaagacctacttctgctacctagttctacccccctaaagtctcctcaaggccctcttgggaataaacaatcaacatgtgaacctgttagagacatttcatatttgaaccaacacacccatctgattgtaattcattattcatttagcaaatggttcatccattcggtgtgccaaataatagtttaggctaaggaattcagtggtaaactcacaaaccaaccctctgggttcctctcagttactattaattattaatcactattaagtagttggaatggttttaatgagactatcctccatagacacagatatttgaacccttggtccccagttggagcactatttagggaggtggttgcagctctggaggaagtctgtcgctgatggggtgtggggagtgccctgagatctcccagactcccctcccacttcactctctgcttcctgccccggccacgcctcctcagtaggaagtctgtctctgtagggcaaaagtgagctcctccataaattggttttggtcatagtgttttatcacagccaaagaaaagtaaccatatatagtagttaaaaacaacaaacaacaaaccctagggtgaggggccagagaatgatatttcaaggcaaaggccttgtgggtagtgtcttagtcagggtttctattgctgcacaaacatcatgaccaagaagcaagttggggaggaaagggtttattcagcttacacttccatactgctgttcatcaccaaaagaagtcaggactggaactcaagcaggtcaggaagcaggagctgatgcagaggccatggagggatgttctttactggcttgcttcccctggcttgctcagcctgctctcttatagaacccaagactgccagcccagagatggtcccatccacaaaggacttttcccacttgatcactaattgagaaaatgccttacagttggatctcatagaggcatttcctcaaatgaagctcctttctctgtgataactccagctgtgtttttcgtttgctcgccgttacctgatacgctcggccatctagcgagctctcagactcgatgtgtgttgtgtatcttgtaggttttgtatatgcctgatgtctaacaatgctgagagtccgttcgtgtgctcatttcccctgtctccttttcaggaaagtatttatgtaaatagtttgctgattgttattgggtggttctcttaactgttgtgtgtcaggcactctttactggggatgtagacctttatcgtttgctttagaagtattttttcccagtctctggcttagcatttgtactggctagttttgtgtcaacttgacacagctggagttatcacagagaaaggagcttcagttgaagaaatgcctccatgagatccaactgtaaggcattttctcaattagtgatcaagggggaaaggccccttgtgggtgggaccatctctgggctggtagtcttgggttctataagagaacagtctgagcaagccagataaggcaagccagtaaagaacatccttccatgacctctgcatcagctcctgctccctgacctgcttgagttccagtcctgacttcctttggtgatgaacagcagcatggaagtgtaagccgaataaatcctttcctccccaacttgcttcttggtcatgatgtttgtgcaggaatagaaaccctgactaagacagcattcatctcttaatacctattggtaagcagacattttacattttgactgcgagctcagcaacttgttcttcaggacatgttacacgttacatatttttctgctgctatgattgaataccgtggcaaaccttagaggagcagggagtgaactcagccaggagtcaggaagagaacaagtgggtccctgctgtaaaacctcaaagtctaccactctgcccaccctgcccgccccgtagtgatatgcttgctccagcaaggctcctccccactttccacctacaggaggaggggtcagcatctgtcccaaacagccccaccagtggctgggaaccaagtgttgaaacacacagacctatagggatatttcgtagtcatgagctgtggttctgatattatcctcaagaggaaatgtttgccaaactgaaggccataggtctctaaaggtttgtaatttggggttttatacttaggcctatgatcaatttttaagggttttgtttgtttgtttgtttggttggttggttggttggtgtagttcaaatattaattggaattccttgcttttgtattttgttaatagaccgtcattattccagcaccatatactgtagtggttcgcagccttaggaacactttaatacaattccttgtgttgtggtgacccccccccccaccataaaattatttctgttgctacttcataactgtaactttgttgctgctatgaattgtaacgtaaatatatctgttttccaatggtcttaggagaccccaaaggggtcacaacccacaggttgagggctgctgtagagaactgacaatcctgatttggacgtttttcctgaaaaacaattccctcgtacatatatgcagctactttcaggctctccttttttaaattattattttatgtaaatgaggctctatctacatgtacacttgtatgccaggagagagcattggatcccattacaggtggttgtgagctgaactcaggacttctggaagggcagacattgctcttaaccgctaagctgtctctccagccccggctctttattctgttccattgatctgtttattcgtcttgaccccactagcacctggtgtgattttgtaactttagaagaacctttgaagttagctgatgttagcctccaactgtgccctttttcaaagtcctttgcatttctagatggattttgggagtgtctacaagaagataagaactttgaataaattcttaaaagcctttatcttacgtcctttgtaattccatctgatctttggaatcagtttgccaatatctaagaatgtcaaatttagctgaacattgttggtacacttttaatcccagaactcaggaggcagaggtaggtagatctgtgtaaatttgaagccagcctggtttatatagtgagacaacatctttaaaagaaaaaagaaaaaaaactaaaaatgtttacttgagggctggagagatagctcagtggttaagagcactgactgctcttccagaggtcccgagttcaattcccaacaaccacgtgatggctcacaaccatctgtaatgggatctgatgcccttttctggtgtgtctaaagacagctacagtgtactcctatacataaaaatagaataaatatttctaaaagaaatattaaagaaaaagtttaactgaaaaaaaaagttactcttctcaacccattttaaagatgtagccccacgtgcatgcaccatgcacacacgcaatctgttctagtcttttcaggtgagccattgaccattgacagtcaagaaactataagattgctggacagtggtggcgcacgcctttgatcccagcacttgggaggcagaggcagacagatttctgagttcaaggccagcctggtctacagagtgagttccaggacagcccgggctacacagagaaaccctgtcttggaaaaacaaaacaaaacaaaaaaaacaaaaagaaaaagaaagtataaaattatgaaaaagagaaaacattcaaaatcttaaagaacttactcaaaagtgtgcatcctgtaccctgtggagaggttttcccagcagaaggcagtcttctggacttcataatatttttttgtattctcttcttttacaagattaagtgtgtgtgtgtgcccccacatgcatgcatgcatatgtttgcagatgtactcagactccagaaggcttgtaagatccttgaagttataagcagttgtgaacttcaaacccatgtggagactgggagctgaacttggtcctcaggataagcagcatctgctcttagccactgagctgtctcaccagccccatctccacagtcccatctctccacagccccatctctccacagccccatctctccacagccccatctctccacagccccatctctccacagccccatctctccacagccccatctctccacagccccatctctccacagccccatctctccacagccccatctctccacagccccatctctccacagccccatctctccacagccccatctctccacagccccatctctccacagccccatctctccacagccccatctcttcacagccccatctctccacagccccatctctccacagccctatctctccacagccccatctctgcagctcccatctccgcagcccccacttctccacagccccatctctccagccccaccacctgtattgactcactgcattatttctcatattcatccctggatatagtgtctaggaatatactacatttctcctgagggaaaaatatttttctattctagatgcattaactgttttgtttgtttaacttgggacatcatgagtgaaaagttaagaacaagacgtgtgttttctgtaaatgcttagccttggctgagctttgatgatgtgcacactctccttccctagctagaggagacagggtagagatgctcttccatcaatcgttttctgtatggcgagatggtctcaggacctagaggagtgcagcttggttgtgcacacttgttaaaacaaccacaacagtatttgcaacagtttattgctgaaggaggaaagtccccactcacatttcctagaggattctgacctcttcagctagtcacaaaaatagcgtgggctctgagcctgctggatgtcactgagcgcctaccgagtgacctcgctgagcccctgctagatcattttgcggataggactggcgcctgtctactttgaagcacagctttgtgacgatgaagatgatggcaagcctcacttgctctcagaccttgagtctcatcttgcatctacttctacacttaaatctcgaaactgcttttgtagaaagtgcttgcataacaaagaccaaagatatgcatttgtctcctggctgtataatttgttttaaatttaacttttagtatgcagccctccagagaaataatcaagaataatttggtaaaatagcttcccataggcgcactcctccagttcagaaagcagcaaaagcgtacgaggcctgtgctccctgctcttctgcagggtgtggcgagggcagccatacagggaagcaccgctctagtctttgatttttgtctctacagtgttagtgtgcatctctgagacattgcatgcccaatgccttgtcttcttgcagcttatgcaaatcagaatacaacaaagtgccacataagaaggggccataggtctctttatcaagggctgcttaacaagcacttgtcacagtcgatggcatctgatgcttcctgatccaggcaagcatttttttaaatgatatgtaatctttatatgtatttgtgagatgtgtgtagacatcaaatgggaccagcctcttctttcctccaacactaaccaactctgtgttgggaaacttcagactcgtagttatattgaacatgtaaatgtatttgttgggacagtttgtgtccgtctccgtcccccagttaggcttttatttccctttaaagtcactaagaaaatgtggaaagctgcttccagcaggccttgatggtgcatgcctttgatccctgtatcaaaaataaataaataaataaataaataaatagataaatagataaataaataaaacaaaagaaagaaagaaagaaagaaagaaagggagagagaaagaaagggagaaagaaggaaggaaggaaggaaggaaggaaggaaggaaggaagaaaggaaggaaggaaggaaggagtcacacaggcgatagtaatcttctccccatgtttttgcttgtctttgaaagtcaggtaaagggaagaaagggaaaggccggcccaagacctccgggaagaagcagaagctgaagaagcaggaagtggacatcatgagccccgcagccatgctgaacctgtattacattgctcacaatgttgcggactgcctgtacctgcgaggcttcccctggccaggggctcccaaagggaaaagggggaaaaaataagatttaggtgatagaattcaaagcacgccttggtctcaaagaacagaaagtaggagaatgcatttaggataactcaaggacttcggccaaacgggctctaaaagacaagcggaaacacagagccactgtgcttttctgtgctaagcaatagcaaacgccgtttttttatttccgaagctaagccaggcactaggtaagccactttggtttttcagaagtaatcaggaaaagtagttcataaaggttaccctggcactggtagtaattttttttaaatattataatcataattctagactgaattaaaccttgatctcagaaggcagctccagtttgtgtgagtcattttctttggtgaggggtcggctcagaaaggaccaggcagaaagctcaggcctaacttgtaaacacattttctgctgtggtttggtgttgggttttctttgttttctttttcgatgctggggatgaacctggggcctctgttcaggaagagccattaaattacccctagctgcccctccccccccccgttttttaacaaaatggaaaataaataacttgtttttat

SEQ ID NO: 160 - DNA, 5033 bp, Mus musculus
gggattttaaagtggaaatcaccttttcaagattattaccatttctgttgtggtactggaggctctaaaatctctgcatgatgtagttcagttgaagtgttttgggtattcttagtgattttagaaaagcctcattttgtaaaagtaaaatatcagtaaatatcccaagataattttcagatattttactgtattatgtgtaaacgattgaacgtaaagggaaatataaacagacttaaaagtccaggcttaggagggcacataattattttaatcccaacactcagaaaccagagaggcaggcttctgtgaggtccaggctagtctgctctacatagcagagaaggagcagctggaactacagggtttatcaaaaagaaagcagtagctcctcccgccattgtgagtgccaagtgtgacactgctgcaggtcacagtggtgttttggagatgtgtttagttaagaagtaatcttaaagctttctaatgtcctagcaagtcctgcttagctgagggaattttatttgcatataataaattttattcctgaccggtggtctcagggggctaatattaaagtatttatccttcttgtctttttaatcctaggtagagaggtagcaagagtgctaagcacgatattacaagtaatgaaaattctttcatttggcaattatatattcttgtcagatctcaaaaattcgtggctgtttagaagagagtggctggaggatgaagagattcttctaaaattaaagggaaatggtttcctaaactacacagcagagaaggcggtggccaagcatatagcaacatgtgggatacattttcacagtgtccttaagaaagggcaggacactcggggctagtgcaggggcatttgaagcacacttccatttctgggatctcgtatttcattgtgtgtaataaggacctgagaacacaggcagatgcagctcttcagtttcatcttgagtttattttccaaataaaaagggcctgctcttacggcttcaatcatttatattttcagaattgcttagggcacatctcctacccagctttagtgacattgcactaacccagctagggagaatgggtgtgagccactccagccatttcggtggttggattgcattcgggactttcctgtaaaggagacgtggtttttcctttgaacttacctctgggataatcagaaataaccagaaagcagtcaaagatgattttcttttggattccacaaaactgtatactttttttcctgaataagcgcctacagcagagaatagttttaacatttttttcaacattttatctctagcagattagcagaagacactgtcattgtgctatggctggaaaagacagaatacacaaaagtagtccttcagcagtgttcaggtctcatcaccccactgagagatgtgccgccagggtagcttgcttctcagaggcttcctaggcctcgacgtagggcccagcactctgccgtcattcctttatacggagtgaaggaacccagagggaacaacatggcgttacaatccagggtggagaaaggttggttttagggacgcttccaagagctgcctaacttccttgtggcaatgaaaccggcagacattgtgttcgccaatggctgaggaacacaggaagttgagaattattgcagaagagatttggagagatgagaatcatatgaccaggttggttctgactggaacttccaatcttttcctctcactggttcccattttttgtaatctcctcttccgtgcttctgagtaaacactacaggcttgggacatgggtccatggcaccagcacttaccactgaggaggggcagtgctaggactcagcgttttggtcttttgttgttgtttttttttttttctcctgtccttaaaacacatgcatgtagcagtcattgacatacctctgtagacctagcacccttggttacataggaagtatggggtagcctgggctatatgagaccttgtcctaaggaagagggtgatattttaaatatatttctccaagtaagttttataagttgtaggggaaacttggacagttgaaataagacagtaaagctggcaacatcaggtaaagaaaggtgcttgctctcaggcggggacccaaatggtggaaggagagaaccaactcctacaagcagtttatgcttcagagctgaattgcaacaaattatcttctgtggcagcaaatttccagggcttcacaaattttaaaaactcctgggaagcagataacttttgcttttttcccccatatattgcattagctgtagtgaagcagggtgtcagccaggatggggatagtagagcctactctgctgtaggtgttgcccatatgatggaacttgttctgtggcattgaatatgttagcccattgcattttaaactttggctcttaattatttcttaccagttaaaaatacaagtgtaactgaagaagtgggcaagtgagtaccagttgcctttggtgatatgatatcagtttatgaggaaagatcttgagaaagtatctcaggtcaacctatggaataccttaaaggagcaactagagaaaattacacctaatttcctgtcttagtcagagttcagttgctgtgaagagactctgtgactgtggcaactctccgaaaacatttaattggggtagcttacagttcagagattcagtccattatcatggtgggaagcatggcagcctgcaggccgacttggtgctggaagagctaggcttgattcaaaggccgaagaaggagaattgggtggcctgcacccacagtgaacacatttcctccactaagacctcacctactccaacaaggttacgcttcctaatagtcccgctccggctgaccaggcatttaaatgagccttagggggccattcttattcaaaccagcacattcccctgtaggattctgcttacattaagtgtgcctttatcctcaggccccactgttctagtggcgcaagggtagaaacacttggggatggagtgtagtcatgtagttgcttggctaacagcctaacagcctgctttggagaaagctccctgtgttaaaacatggaactagaacctctttattctagacatcgaaagttattgtctagcacctaatcttttagaagcgtgtaggaacttctttttttcctagctaaaaaagaaaactaacaatagatatgttgcctccatgcatgtctgtgtgccacatgtgtcccaggtccctctaaattccttggacctggatcgacagagagttgtgggctcccaggtgggtgctgggaactgaagtccagttcttaatcgctgagccatctctccaggccctgagacagctcaccttttcatcagaaaagcaggtgcagtgaaggtctgttaaaggctatattcacaggctcctgtgttcctcacagagctgttagccaccgaggaccctgccagttcaaggaacgattactagtaaggttgcctgggaatgtgaagaattttctatttctcatagaatcattttatctagcaatagaaattaaggcagtggacaaattaacaggagtcaagatcttccttttcatacacttaactgagcacacgaaactgatttagtgttgcttcatgttgaagactgggctcttgatcttcccacttatccctcccatagtcttcattgactcaataaacgaaccctttatttgaaaagaagctgaagtagggtttgaaacatacctgtggttggtctgttactcactaggtagcccaggctggccttccagctcaaggtaaccttcctgccttccctgagtgctggcatttcaggtgtgtgccactactcctggtaaatggcaccattgttaacccagttgctcaaccaaactctaggaggtatccgtgatgtctctttgctctccacatccagctctaacccttctttacctccagaaacactgggtaggtcttttccttatctgacttgtgggcggtaacttctgaattcctgactctgctttgagcatccagtaatccatgtttctctttctgtctgcaggactgattgttttatgctggtgtgtgtgtgtgtgtgtgtgtgtgtgtgtgtgtgtgtgtgtgtgtgtgtgagagagagagagagagacagacagacagacagacagacagactttcagctgtgccatctatcttcccccaaccccagactgggaaattgtgaggagggctaggagttgtagctcagtgttagagcatgttcttaccatatgtaagagcctagattcaattttcagcattaaaaaaaattcgaatcaggttacagttaccctggcttaagacatagaggcttccattgcagttaatacacaatgggagctccttctcaacccctgtgcctgtgcctgcgtctgatctcttacctacagttccaaggaccagcaacacaggccgttgttctgtactgtcccttaggccgaagagtttcctgtcttgtcattgtcttgtcatttgagtcttgttcacatgtcatcaccttggagaaatttccctaggtcccttctgttctctcctcaacttttcatagcatccgtcttaatctgtagttgcttggtctgagtattgtttttctctgattagcactgtgagaaccaggactatgtcagcctgttttcctcccttggtgtctgaaaccgtaaggcctggcacgtagaacaaacaggttgtgagcttgtgaatgaactgactagttaaggatgaagctcactcaccactttagctggaagtaacgagggcagcaaactagtaagctagacctgttgactgtactcttggagtaatcactcggaaactgcgtagtacccgttagccattgtgtattcccatataactagatctaatcatccctgtattatcctaataacagcatgttgtgttcataggttaacagttctctttcatggttaattacctgtcaatttgcagacattttaaattcttaacctgttttct

SEQ ID NO: 161 - DNA, 3250 bp, Mus musculus
gagcacttgcctagcacatgtactgtgccctgggttccatctctaaaagttgtatataatgacacatgtgtcacccagcattgtggaggcagatagtggatctcggtgcctaagagtgagtattcaacagggaagtgtactttggatatggtaaggtgactcagctggtaaaggcatagtcacttagcagccaccctgaagactcaagctcagtccatgggatctacgtggtggaaggagaaaaccaactcctgcaagttgtcctctggcctccatgcacaaatggtgatgtatgcacacacacagatgtttcaaaaaagataatttaggggctggcgagtggagccagagttaagaacacacactgctcttcaagaggacccacatccacctctggtctccttggacatcagtattcatgtgcacataaattattatttttttattaaaaggttgctttgaaacaatttataaagcttactgttgggtttgagtacttgaagaagatatgtataatggttttagtaaaacaaaaacaatgtactatctaaggtttccaggtgatgttttgagatttgtacattgtgtcaagtcgggctatgtatgcctcaagcatttatcataatggtccttgtagctatttgaaatgaaacaaaagtgtggtggtgtggttgccacctgcctgtgtaatggcacatctgagcctcttgaaatgttcagtgaccattgggagacggtttgcctttcttcattacaaatgcacagtgtctccctttcttgacttactgttttgtttatgtgtgtggtgctaacagaggcctctaggtcctctggagcttcagagttgtgagctgctggtgtgagtgcttaaagaccaaatccaacctctggaagagccgcagttaattctgtggtattcaatcttgatgcccacatattttactttgaattattaggagcatagtatgtctagggttaagaacactgctgggtggggcatggtgactcacatctatgatatcagcacttgggaggcagaggcaggtaaatggatctctgagttccaggccaatccaggatacatggtgaagcagtcttttatctttttgagacggagtctcacaatgtagctctggctgtcctgaaacaatatagaccaggctggccttgaacttccttctgcctcccagttgctggaattaaaggtatatattaccgtgcccagcataatcctgtcttaaaagtaaataaccattgtaactacagctggattttgtggtactggtggtatcttctggggtaactggcttttactgtgttcctggaaacagccaattttttgtttgtttgttttttgagacagggtttctctgtatagccctggctgtcctggagctcactttgtagaccaggctggcctcaaactcagaaatccgcctgtctctgcctcccgagtgctgggattgaaggcgtgcaccaccacacccagcgtaacagccaataatttataggcttaattttgaagtggattttattctcctgacctaaacctttttttttttccctataatctcataattctttgactgcttttacattttatagacttaaatcttttgggttaatttttccacaattgtgtctatgttaaaaataacctctgcaaggttgtaaatgtgtttgaccatgccccttgccagtctctatatggtagaactgtaaagataccgtgtcattgtgacattttcatacgtgtgtgtggtatactgtgatgcatcaccatttttctcatttccattctgtaccttgattgtatggattgcttttgttttgagacaggatcatcttttgtagcttggctgatctctgttcaaatcagccaagctacataatgagagaaaacaaaacttgagaaagagaaaacttgcctctgtccaagtgctgggattaaaggtgtgggccaccaccgtccagcaatcttacttgacagagtagaacttttaaagggttcgttttgctttctttcttatttctgtcttctggttgagctttacacgcctttggggtatataggtcagtcacatgttggagactgttcaaggtgcaacctttttaggacgtacctcgaagttgtcatgaagtgttgggttacgttgagggatcttgtacctagatccctctttgctgcttcaatgatgagtgtaccttgatatattgtgtactgtggggcagtgggccgtgaaaggtagcctggtggtcccctttgagctaaggctacctttgatagtccactgccccacggtgcatgcattggtgtttttcggtaggtctccctgtcctggagtttctgttgtggctataggatggatgccaagcagtgggtcttgagccccatgcccctttctactttctagccattcccacttggatcccagtcattgggttgggatgtttatgtcttttagtctttaaaaatgcttgtcattgtggtgtagtagtgtatatgttttatgtaactgtcaatagatgcctgacaggagcatcttaggggaggagaggttcattttggcccagtttcagggttatggtctgccagagtgagaaaggaacagaggtgagggctgttttggcagcaggaggagttaattaccaagtaatggcttgggaggaaggaggagcagagagagataggaagcaaagaagatataagcatcaaaggcctgaccctgtgattcaactgccagctgccatgtctcactgcctctcaaaacaccagttaggaccacctattgagccatggacgtggggataacgtccatatgggtggtggtaagtaccataaggcgaggactgggaacatggctaagtggcagagctgctcctagcataccaaaaggtgtcacaggaagatggaaaccaccaagataacctcaaaaacaagcagaggaagtgaaaagcatccaccatgagaccaccagagacaacaggaatggtgggagcagaaggaagatggccagagagctacaagtgaagatgagagatggaaagcaaaaataaatagaatattcagagtgaaaagagaaatgaatttaagacagccagtcggaaagggggtggggggcatatcctagtgggttgtactccggtatgaaattcttagaacaatgtgctgcaggcagtactccagttactgaccagcgtgctacattcctatactgtactcaataaactgtaaacaaatataccacct

SEQ ID NO: 162 - DNA, 178130 bp, Mus musculus
attattatatataagtacaatgtagctgacttctgagcaccagcagagggcatcagatctcattatgggtggttgtgagccaccatgtggttgctgagatttgaactcatgaccttcagaagatcaagtcagtgctcttacccactgagccacctcgccagccccctcctctttcttttaaataaaatttttaatgatttatttatttatttgctttatgttgtgagtccactgtagctgccttcagacacaccagaagaggacttctaatcccattacaggcagttgtgagccaccatgtggttgttggaaattgaactcaggacctctggaagagtagtcagtgttcttaaccgctaagccatctctccagcccataagacattttcttaattaaggattgactgggaagggcctggcctagggtgggttgtgccatccctaggcttgttgtcctggctgagcaaaccatgaggagcaagccagtaagcaggaccgtccatggtctctgcatcagctcctgcctccaggttcctgccctgtttgaattcctatcctgacttcctttgatgatgaactgtgatgtggaagtgtgagctgaagaaactcttctttgttcctcaaattgctgtggtcatggtgttaaatcacagtaatggtaactccaagacacatagtaccaaacaaacgcctggaaaacaagcctgtttcctcttacctcctttacaatgctgctcacttcatcaacaacaaatgcagtctgttaaggaagaaaatgtaggtaagtttggtttaaaagagctttctgcagagcatcaatgagcacacagtgagatactgaacgtgacttagaaatcaggctgtcgactgtgcagatgaacctcagagcccagaggtgtgaagcagctgagtgtcacactgcaagccaggtgtcacttcaaactagaatcctgtctctccttcccctgcagctggctgtcagcaccattagccagtgcaggtgccatattccgagccactccactgccatacaaagcagctgaagaaacataagtcatcattgtagagatactgactaggatgtttaacacgtaaaaggctcatgtgtgcccatcattttcttaaccccaatgaactacttcaggatgaagcatcagctgacttgagggctgccagcagcaaggtgatgcccgaagtagttttcttagtctcctcttaacataatactggatttgagtgggtgtgagggtttcctgaaaacattggccaggtactagcctgcagtatgcttcttacctgagaacaaatgaactattccaagttctgggatagccttagcactggacaggccctggatcggatagcacagcctccctcggcagtcactcagtcctgttttgctacagacttcccttactgctgaccacagtggaccctgccctgttccagtattgagtatcaccccttcctcttcaggagaatgagaattgaccacccaaagccatttcccttgctagaccctctaagaagtcagttggaaacaaagccgaaatcactgaaatagtgaaaatgtggtgactctccagggtaagtcgactgaaaggctcttcctaagtgactacagtgatcctaagccacaaagcaaagccctagtgtcacttcccatacagtcagagtaagaacataacagaagagaaattatattgaaatcagggagcactgccagctgctaccagagagggaaatgagctgagggaaacctggggagctagaggcaggtagaaaaggctcagctgagagggctgctgggtaaacaatgcagagtggccgtcctcctgctgctgacactccgtgtaaaacacagatcactgtctggacacttcacttcagtcagcctacatgtacaagctggaattagaacgcggttgtcagggctaccttttcacatggccatttccttcctataaagtctagctggctgtgactaccataaaagccaatcttcagccatacatgagatcgctgtctggccaaacatcccctgtgctgctgcttcggaatcgtggcttcagagtctttacttgcgttccaccaacgttcaaacaaaatgatcctgactgccgaaaagtgtgttgggaaaatagaccaaaactgaaagattctgataaatgcaaatgtcttactctttcctcagaatatccttagttgacactttagaaatgtcaaaagaggaagttagggttttattattattgtttttgacaaattgtgtgggattttattgagtttcaacaaagattattcagggaaaaaatgagcaactattctttaactggcgtccattcagctgtttctcaaatgcgtgttagcacgaagggaaaaacattttgacaacatatcatcaaggcgagtggctagggtactaagaggcattacattcttcccccacaagaatgagagattccgttactatcttaaactgaaatgaaatgtacccagtcgctgtggcctgggtgggagggagcgccgcactgaaggacaaggtgcggcaccgagacaaaggcaggttctgttcgcacgtctgtccttggcagacggacagtctgggcagcagacccccactgcggtcacccggagctggccctgcgcgcctgtgtcactatacatgccacagcaggatgcctcctttcccaacctcggtcccggctggggtctgcagcagtgcggaaggggtggagtgatgtcatcctcccgacgccgtgaaccccaccgagacacgagcccagcgccgtctccccggaccgcgggcaccgcccacgcgggaaagacgcagagtggccgcagggaaccgccaacgttcaaacaaaatgatcctgactgccgaaaagtgtgttgggaaaatagaccaaaactgaaagattctgataaatgcaaatgtcttactcttccctcagaatatccttagttgacactttagaaatgtcaaaagaggaagtgttagggttttattattattgtttttgacaaattgtgtgggatttttgacaaattgtgtgtaggctcatcagcctcgggccaggtggccgtgagcagaagctgtgtcttcccagaccgggccccgccacacccggatctccgccgccaccctccctctcacggcccaaccccaggttacctcctcggaggcctggaagtcttccatctttaatgcctgtccttcgcccgccgagtagagtggactgcgcaggcgcggccaggccacgcccactccgccccggcgccagggaccctgaccactaccaataaccacccacgctctagggccccgcccctccaccaaaggctcctcctaccaccggcccctccactagtggctccgcccacccttcggccccgcctgctgctcctcttcagtctccaagtaacagggcgtgtctctgagccctctgggatgtgctttccaaagcaaactgtcagaaccacctaacctctctgggtgtcatctctgcagacaattggcagcctctgcaaaggctgcgtataagcttagctggggtttcctcctgagtgtggtgtctcctctagagacacagacaggagtccaccaagacacaggaagccgttcgtatcagagcaggcctgtactgatatcagtactgtataatgttcccaagatggaacagccaaacattcatctacagtggagcagaggagtgctctgcatgaactacgaagtgagagattctgtggtgatgagcactttacagctgcacatgacaagaaccttccagggtcagcctgaacaagctagacagaccacacctgttacctgcaccatggtctagcaaactgggctaatcacttgcaccccatctgaagtatacgacgttacaagtccttgtgagcatgtctgtcttcgctgttgccatcggtgggaagcacactggatttaaagctattttttttttttgaagagattcatggaaagccagccactcctctccatgaataagaatgagaagcaattcaaatggctactatccacccccaccccccggatagcagttaattataaaaagaagtggtctggcctcaccttcaggctgacctatagtggtggttgtcatctctggctgggtacatctctgggggtaatcgtcacaggaaacatctttgtgacaatgacagctagtagtttcacttttctggtgtgatcccatggtggaattcagtgcttcctctaaacccagggagttcgcaaaggcttgaactttagccaaggatttcagctcccctgcttacaacctttccactttccctttcttggcaggcaataaattgtcatctctcatcggtgagatggttgtcagtcctctgaacacacggctgcagcttccacgaagggcagattttgtaactgacaggcacacagccaccgttgggagacaagtcattaacagttgtggtccttccttaccttgttagagaaaactgtcaacgtatgagattagtctctggtcctccaggggataaaaaaggaccagtgagctttagttattaatcacgcgtgaggaaacaaagatggtgagaggagaagctgctaacagtgtagtagcaagtccgcctgccagtgaggcagacccagcagctgtaactgtaaccagaacattccagctggggcgcacagggatagcccactgattcacaggctcagaggagcacctgaggatagctcagtgacctaataaaatacttccctgctacgcaagtctctgtggttctctgcaaagtgctttgccacatgagacagtttaaagtaccctgccgtccactttctctcatggcgggggacagctttaatcactgaccctttctgactgtggcgaatttgtcttcagaatctaactcaactgacaaagagtcacttgcttgccataggacaggcagccaaactgcttatccatttcccccagtagccctaatcccttcacattgctgttctaatgcaatctgtattcgctggtgtgatgggtaatgttagctgtcagcttgacagaatatagaatcacctggaagacaggcccctggacaagcctgtgggggcgggggcggtgtgttttggttgtgttgatggaggtcgggacctctgtccactgtgggcagcaccattccctagtctgtatgttcatactgtatgtctgctttaagttcttggcacttggatttcccagcaatcatgaactatacccctaaactgtgcactagagcaaacccttctcccttcagctgcctttcacagggtgtctttattatcatggctggtcttggttttatagatcaaggttcaaatcaacctgaccctgcctaagatcatgatcttatggctccaggcatgttgtcctcttcctccctcttctgtaactttcctccatgctgccccattcagtgagcatcttattcttcttaaagtgtctcctgatgagtcttgcttgctttcatgacaacatgaaattcctggcttctgtaagctccttaatttagccatgagtctttcttgctcactgacaaatcccccacatgtaaaacaggcacaggagatcctgggtagcagctgaatgtgaagataggacgacccaattgcagattaaccacctgagtgacttattctcttttctgctacctgcctggggatcttggtcttatttgctggatccttcaccaaagcaatattctcagcagacatggaacagagtggcgaggagcatgtaggaaaagagatgggagattatcttatttcaacaatgcaatttgaaatatccgtgagcttctttaccttccagatctcccaggaggcttcattggtgggattatggggctcacagggtctcggcaccacatcactacatttcaagatgcttttaaaatttattattatatgtgtgtgcatgtgtgtgtatgatgtctgaatccctgggacatgtatgccacagcatgtttgtagaggtcagaggataacttttggagttggttctctcaagacagggtttctctgcgtagccctgactgtcctggaactcactctgtagaccaggctggcctcgaactcagaaatcctcctgcctctgcctccccagtgctgggattaaaggcgagcaccaccactgccctggagttggttctctccttctaccttacataggtccaaggccaactcaggccaccatgctcacagagcaagggattttactggctcagtcccctcgcttgcctacactacatctctttgtaaattggcctttccattcagtaacaactttcatggtcctgatactgcccgaggaagctgctgagcctttgagaagatttacttgtgacccaacttttggagaactgtgtaactatgagctcagcacatagcttgccactctttaccaccaactgtgtaaactgctcaacgccaggctccgaacctacagaaatctggtccaagctgtccatttcacggatgaggaagcttgagatacagctcaggtaactttcccagctcacacagctggtcagtaacataatcacccaaggtctgcacttctggacccagcagagtcctttccctacagcttaaggcactaggtattcaaggcctttgactgcaggacacatttccttaccagaaagcacagcacagggaggaagggaaaggtgcccttcagcaagcatcccaagcatccccgggctccacctccgctcctccaatgcaggtgaagggacaagagagctcaaataaacccacacccacaggttctctggactctcatatgtggccgctacatgcatcttcactgaaagagtacgagctggggcttgagaccatgtacccaggtcagagtagcccagcagaaaggcgaaggaccgcccccgttctgattagctttggtttgtgtcggggaggcagagagggggaagagaaatcagggtttggccaggcccggtggcaacagctaggcagcaggagtgggagaaaggggagcatgagggaggagccaagcaggaacgaaagcctggtgctcataaggctagcctatctgctcagggttctaagatggagaagaacccaggacccagatgcatggggccgccttgcaccctgaatcgcgcgcgcctcagtcagcattcctcgcccttcccgaggctcagcgttccggggctagggcgcggcggtgtggacagagagctgcggccccttgcgcctacctgtagtagcgatcatccttgaatggcgcgaggtcctccttgagctcgcggtacgcctcctgcagccgccggcacagctgcttgaggccactgcagagcggcggctcgaacgcagggtactccgcgtccatgcccgcgccgcgctgcgctccgccctcgcaatcgccgtcctcgccccctctccgccgccagctcccggcaccggagccttcggcacgattgggcgggaccggtcagggggaggagcagaggctgggagctggggagggggcgcgcatagaggcgccggctccacctcgccaccccaggcccgggctaccgcccgcccgtctgccagggaacccacccaggagtgggagatcaagcactagatcgccagcctcccagtgccgtcctcgctgggcctggtaccgaggagagaaattggaagagaaatgagggaaaccggcttgaggtccggcccaggggcctgttttgtaggcaatgttcaaggctgggagcgggcaaccacgttcagcaccgcggacagatcccaaggcccatttccctttttgagtacaaaacacaaaaagcctttaaaactaaatccctggggctgagagatggctcagcagttcagagcacttgttgctcttgcaaaggacctgctctcggttcctagcacccacatggtgggtcacaggtcctagtgattcaactcccttttgacagccccagtcactcatatgatgtacatacagggaaaaagttacatctatgtatgtgtatccatgtatgtatgtacatatgaatgtatgtacatatgaatgcatgtatgtgtatatatatgtgtgtatatatatatgtgtatatatacatatatgtgtgtgtgtgtgtatatatatatatatatatatatatatatatgtcataatattatttttaagtataatgaatgggttgtgtccaagaaaggtgccacttcctactctccttccccaaaaatactgcctgtggaaagaagtctctcatcccacaagcctagtagtgtgcacaataaaaactcacatgtgagattgcatcccaagagagtggtgtgatctcttgtaaatcaaatattaagtgcagaaacacttattccggagagtattgcattttcactgggatccgggacaggttcccatgaaagatcaatcttgggtaacctgttaaaaatagccactcatgtgtgtgtgtgtccacaattgagtttaagttttagaatatgagtctgtcttggttttgtttcttttttttttcttttttagatttatttatttattacatgtaagtacactgtagctgtcttcagacactccagaagagggagtcagatcttattaagggtggttgtgagccaccatgtggttgctgggatttgaacttcagaccttcggaaaagcagtcggatgctcttacccactgagccatctcaccagcccttggttttgtttctattgctgtacaaaatgccttcacaaaagcaacgtggggaaggaaatggttttttagctcgaatttccagggtgcagtccatcatttcgggtgagaaaagtggcaggagcttgagaaagatggtcacatgacatccactggcaagaaacagatgaatgaaaggacacaggcgtgttgtaatcagcagtttctccatgcacacagctcaggaacctgggcccagggaatggcacaatccttatcagaagcgtctttgcccttagttaacagagtcaaggccctcacaggccaacttagatgagtctgttctcaggtggttgtagattgtgccaagttgacaaagtcatcactgtggccctggaacctggttactgagatctcaggtgactacaaccaccactcatgttacatagtttcaggattcccatagatgcacccattcttcttcatttttatcattggtttttatttcttccctcctaaatcttttttttttttttttttttttttggataaaaagattttattcctttcaagcacaaagaaaatcaacaggaattttaaaggtcattgatcagaaaatgaacaaaacttcttagaaaccttttcaattagccaaaacaaggtaaagataaaagttaaattctttcagcctaaatatttatccatctatatatcccactttgtgaataggcttttgattaaaagaagaaatgacatcaaactacccccaaacattttataagaggtaccaccatctagaagtgacaaaaataaattagtttcccccatgatatttaatctctaaagcataaaaagctatataatatcttatacaaattaaccagtgcttttacaaaagtaaagcagttttggactactaacagtacactgtacttgtggtgaaatatgaggcacaagaatatatgtattaattaggcattttccatctactcggtctctatggtcttaattcttggcaatatataactggtgtgtactctggtacataagtcatgaattgtagagaacaagaagcagtgtagtatagtaacaaggtttgtatttgacaacgaccgcattgctgaacatgtttcttttatgaactttgtgatttgtgttgcagatggtcacttgtagtagatccttgacttgactcttcaacattcatgctctctccatctgcagtctctgccatttcttcatcttcatcatcatcatgtaggtcttttgaaattaactgtctggctaacttaatattgagtccttcattgtaatgaagcttccttttcatttcgaactgccgcttcttttctcgctcctcaggggagaggtcattatcttcctctccaccactttcttgctcccgagtccgatactttggctctgagccttcagcagcagctaatttcttagctaagatatctggagtcatgacttcattgccttcagaatcactataggcgtcttcatcgtcacctatcatattgtgatatggggtgtttggctcgtctattttcatcaagccatagtctttgtcagcgggatgatatgttgtcaggatgttcatttcatcccacttctgagacttcttactcagttcctcttccacgatcgggcgggactgttcggccgagggcaccaccggaggggaagccgcagaggtcttgttcttcaggattcccttgatgggctggtgtgaggccttcgaggcctccatggccggtcgctctggctgccggctcatggtcgctgctggcctggggtcccggaggagaagggatgggcgctgcagagaccctccaggcagccctggagcccaggccaggctaaagcagccgcacccgctgccgcggaaaccacgaccagcgtctctgtcacgacacaatgaccgcaacgcaacagccgacgctgcgcggcaggcggcccttcgccactggcaaagtagcccacggcccgcagaggaggccggcctagtctcttccctcctaaatcttacctctttgatggctagcaagcctcttaggccttgtacatcttcctgcatcttaggaatgactgttaagaaggttccactgatatggctactcgagctgtaagagaggaatctagacggggcgaaagaagaaacggagctaagacaaattgattctgatcaaagctcaaattttattgttgcgacactagttatgaaggaagggggaggggacccgattcccgcagaataatctctggtccagtagaaaggtgagcacgtgtgtggctccgcaggttccagcagtgggcgtggcagaacgaatgagcagaaagctccacccctgagcaagcaggtttcaggctgggggaggggagactacatttcctcccttttattaacaaaatttaaaaaaagaaaaagctggcctgaggggaaaaaaattatctatgttcaaaagttctgcctggaatctagggctaaatcaaaaacctgcttccctgggattctttaacttttcttatgctaaactgtatctgacttaagactgtcctttcttatcctagtaaacaacttaactgaaaagccttgagctgcaggctctgactttatgatgctaattagtacttggtaggtaactttctagttgaattttaagtagggcgttggaactctggctaagtttgactgaacaaatttgaaatacactatattaaggataacactaagttggtattcctctgcatttttggatgataggtgggaaacagggagaaggggtacgaccggctctgtagtacaaggccaaatggcctttttatttgggtgggaggcagtgaagggcttgccctttcaacagtacggtctccaatctcttctggctggcctgtgtgaacataactctaaggcatgaactcctgcttggagttgactttttagtgcttccgatgctcttgggcatgatttgatgtttactgagactgaagtaacattaaagttccccagtgctgccccaagtttcaataacaaatagaaccaggcacggtgtcatttacctacagttccatccatctatctgcttagggaggagaatcatttgaggctgagagttctacactaacctcagcaacatagccagaccatcttaaaactaaacaaactggctggagagaaggttcagtgggtgaagtaagtgcctgccatgcaagcatgaggacctgagttcaagtctccagcactcatgtagcctgcctgtaatgtcagctcagaggaggcagaggcacagggaattcctggaggaagctggctagccatattagccaaaatgaagagttctggagacagtaagagacctgcctcaatatttaatgtgggtagtactcgagaaagaaacccgacatcaacttccggtcttaacatgtatgcatacctatgcacattcactcctacagaagagtgcattcacatgcatgcaaacactcatatacatcactcatacatatgtacagaaatgaaatgaaacacaatgctaatgggcagaggagtggaagtttaaggtatctgcagctggagtgaactcaagctagcctgggacacaggagaacttgtctcagaaaacaggcagcagcagtattgcccttgaaatgaatcctttgtctctttgtctcagggggagaggagaatggtccatctacacagccaccctctgctgcctggcttgtttgttgagcacattccaaaggccaggagagtataatattctttcttgagaacacatgggactttataaagaatcatcaaatggaaatgtcaactcagataattttttctctgagatgaatcaaataaaggccattaagaaaagctgcctggaatctgagctgggaaggacaacggatcacagacagccacgtgtgggctgtgctttgctcttctgaagaggccacgtaaggctcctgtttttatggctcttggctgagacaggccctgaatgcatttttcgccaacagctatactcagggagctgtttttctgagcatgtactgtgcaccggatgcttgtctaagcacttgccagcactgtcttactcggcactctctgccacttctgagacaggcaggactacaatgcatattttgagacagatgaggctttcagaaaacttgcataccagtttctcagattttttttttaaagatttatttatgtataggagtactctatctgcatgccagaagagggcattagagcccattatagctggttgtgagctatatgtgtagttgctgggaattgaacctaggacttctggaagagcagctagtgctcttaactgagccatctctccagcccatttttttaaaagattttttaaatcagtttctcagagtctatctacaagagaggctttccttctgaacaaggtgactggccaacacttccaatgtggcgaagttacctctaagtattactgctgatttcatccttgggtagattgtaccatttttaatgagtatctacgaagcaaggaataggtgtgatatatgaatccagatgtgtttgatttcaaagaacttgactttgtattcacgagtatttaggatgggtgtatggcatgaacacaggtgcattcgcccaagtgtgcccttgtagaagtcagaggttgattttgggtgtcttcttctactattctccatcgttttagttgtttttacgtaaaacatcatatgtgctcccgtctgtccgtccgtccacccatccacacacacacagatgtttgcctaaatgtatgtctgtgtaccacttgcatgcccgatgtccagaggccagaagagtatgctgaatctcctgggactagagttaaagttgtgagctgtcatgtgagtgctgggaattgaacccaggtcctctggaagagcacgcagtactgttaaatgcccagccacctcttcagcccctccatcttattttgggggacagattatctcattgtagttggagctttctagtttggctagcctactcagccagcaatggatccacctatctttggcacagagtattggggtttacagacacatctgatgcacttggattttacatgggcattgggcatccaaacttagactgtcctgcttgccagcaagctttacccattgcaccatctcaccagcctcaaatccacttttatccactctatagtacaatgactactcagctaccaaggactgtttcaaaattgaggacttgaagcttcattgagtaataagtggctggtaggcagtggtgatgccttcttaatcccagtgctcagaaggcagaagcaggcaagttccagtacaaccagggtccagagttacacgggggtgggggtggggggtgaggggcacacaacaactttgggctggggatatagctaagtagagcgctagttgagtgtgcataaaattcaaggttatcatttgaccatggtggtccatgcttgcaatcccagcactcaggaggcagaggcagaggcaggaggatcagttccatgctccttgggcatacatactgagtctgaggccagccaaggcttcatgagacactcttctccccagcgctcgaacagctctgagtctctaatctcatggaacttcactcaactcgttaacccgacattctaaggacaggggagtctgtgttgttaacatcagccttcctgctgtttcatatagaactagagagaggaagggactgggatccaggagggtaggcaagagaatgcccggcactctcactcacagtttctgttacttgtgagcttttctgtttgatggtaggaagtcaaactgacttaaagagaagcaaatgctgctgtctcttctacagcctcctggggctgatttaagaagaaagcacaggacgcaggtagctatgcatgcccctggtggcccctggctttagtccaaagagaagggcactagaaagtcaaagcagtgccagccacagggagggagggagggagggagggagggagggagggagggagggagggagggagggagggagggagggcacttttcctgatctgcaagggagcatttgaagagcttatgaagcacagccaggatgcaggatgcttctcatggtcaagggaaaatggaagcccacttacagcaagtgcctagtacaaggcaacatcgtaggcaccagagcaggggctggccccacccttcagacttggtgaaggtccatttctggaaaggatcaagcagtgtggctaagtccacagtagccgttaaagctgaggtctggatctgggaggcttcagagaggcagggctgagacacaaagcagagtgtgctcagagtggggcaggtcagagaagtagcaggaggggagactgcatgtacgacccatgagaatggctctcagacacccgagtgcaaccttggctctgtagtaaactgggcagacatcaggacctagggcatagccctgctccacctttgtcctcaatgaagtgatacccttgtgagtactctgaaccgtgtctagactagtgggagcagcaaagaagagaggcagggggaactaggaggctgctgttgccatccagggagaattaggaagttgctgctgcggtccggggaggcagcgttggcggctatagctagcacagagcagaggggtctgtagggatggtggtaatggacatgacttgatagagcagaggctatcctgggaatggtggcattagacagtgcaaggataccagatacgagatttcgccaggtagtatgtcacctgatatcctctctgttggatacatgatatgactgagccagagcactgtgattcagtttactctcattctttaccacgtctgcttctctgttagggttggcggtacactcggttcctgaagaaggtgtgggatctgggtctcgccagcccaagagagccccgttcccatccctatggctcccatgcctatggctcccatgcctatggagcatggctttggctgcctgttatcatgtggaacacaaatgtgttcctagaagcgactcaagaggcaagctgaggctgtagagcctgtccattaaccagatagccagatccagatgagggaaccaccagtggcaccaggactcgaatggcacttgctttaattcctgaagtggttgaagttggccttctggctctgcttcaggtatttaacaacgtcaacatttgctgtcctggtccctgctgcctatctaagtctgccctgccttttctggtccctgcccctgaggatggaagccagggccccatgcatgctatggatgttctaccactgacttagatcctcagcttgggtttgttctttttctatcttcctgtggtgtggacaaaaccgagggcctcatatcagccaagggagcactctgccactaaactatgcccctagactgactgctcgtttttcttctagttgatgccattttgttttatattaaaacagggtctcacatggtactagagctggtctataattcactaagtagcccaggctggccccacgtgctgagatagatacgctactacacctgagtaaccttggctcttgtcagttagcagcaggtgcgggagctaaatgctgcttttcaatcagttgctcaatgaagatcccatcagtatgccacagaatcattctgcttcatcatctggaattggcaacagccatttcagccttcaaatgcgatggtttttgtgcagtgttacataggcacgtctatatagaattggtttgtttagaattagttatacagaattggttctgatgaactttgttccccatggtcccccattcatctgtgagatgtcaatgatttcaacacaggaaacagaattcataaaagattcttttcttgatcatccacatcctaggtcagaggttgtatcttaatatgcaaggacaaaaagaccttctctcattcatacatatcagcccatcactagagtggtggtggataggggccaggagtataactcagtgcctggcaggcatgaggtcttgagctccagtcccagtccccaccctgtgcttttcctgttgtattttaattacagactcagtggcctcctccatactttataaagtctcatccataacgttccacttggtttcctgaacaatggtcactggtatagagcatataattagacattattggacacgcaacactactgatatttgtggtatcctcaggaaaaaaaatgtttattgtcctgtgtattttttgtttgtttgtttctgatacaacaaaggatttatttctaggttatttttataaagcaacaacaagcactgcccttaataacctccccttttaggttttattcatttatcatggtaccctattatatgatatagctatttacctctctctagaaattgtatctaagtatttcacaaaaatacaaactttatctgagtaaaattctcgaagaaagaataaataagaaataaatttcttggtttttgttgtttgaaacagggtctctctacatagctcttgctgtcctggaattcattatgtagaccaggctggccttgaactcaacagagatccacctgcatctggaactaaagacatgtaccactaaggctagcagaaataaatttctttggccgggcagtggtggcgcaagcctttaatcccagcatttgggaggcagaggcaagcagatttctgagtttgagaccagtctggtctacagagtgagttccaggacagccagggctataccaagaaaccctgtttgaaaaaaaaaaaaaaaactaacaaagaaagaaagaaagaaagaaagaaagaaagaagaaagaatttctttccattacatttacacggcaagttcttgacacattatagcagacattcatggacctggtacttcctagtagctggaatggcttgtgaggtggtctttgacttgcactgcccttttggcttcattaagaggcctctggctttggtgagctaaggctcctctagccaggactcctgggaggctccattctcagaagccccaggcacaactggagaaggaaactgacaaccaacttcaaccccaaatcaatgcagaaaattacttttgtttactttagtttgagacaacggacagtgccaagagccatgcccttaagcgtgttagaacaggcccagtgcggtcttcaggtagctctgtcaacccaaaaggaaactcaactgtacatcagtcttgaccctggctgatgagtttgctgttgtaatgccggtttcttgtgtgcttctggaagcagactctggtaggaacatttccatctcagtgctttacacttatggtttgggggtaggcaccagacttaaggatgagtctagagttaccatgagtttaatgagctaaatcccaacccgtatttgagacaatgtttcactaaattgcccaggcaggtcttgaactagcaatcctcctgcctaagccttgatggtagctgggtcgatgggtcaagtgctcatgggaaatgaacaagtgccaggaagttcaatgaaaactatgctgcatctgcagatatcccaacaaggagatcacaaaacatggagaaaagcttgtatcaaaacatacactgtctcctgtgtaccatgtgtgcctggtggccacagaggccagaagaatgtatgagatcccctggcttgctgtgagctgccatgtgggcattgtgaaccaaacccaagtcctctgcaagagtatttttttttaattactaaactatctttccagcacttaaagacatcctatcactacgttatcaggctggcttaaattcttaagactcaagtaatccccctgcctcagccttccatggaactgggtctgtggtttcactcactttgcctgtctttttcagtttcatattgagtggctccagtgctcattaggaactctacgcctttcctcctgtttaccttacattagcatgcctcatcaccttactgaattagaaggcaatctgaatttctctgcaatgtcatgaacaatgcattaataaatgagggggtctgggcacgtactgctgagactggcattgttggccctgcctaggtgcctatgctagtcagctgtgatggacaaagctgctgcagagatctatcccatcatggaggagctgggccgtcactgctgtagctgactagccggcagaattccttactgggaattgaataggtctgtgtgacttaaattcctaaaagctctttggtttagtctgacccatcaggtcttcccgggagttgtatgtggagaactgcagctcagttccccaacaaagactgttgtacccacctttctgccagcttccttagagctgaagttagctttgcagcttagcaactgctaggaggtgtgggtaagaccaagataaatgttcaccagctcactcctgagatgaaagctctgtaagcaagtgggggagacctgccttctggatgcagcgtttgggaactgacggcaggaagacactggggttaagtcctaggggcttgggatgcgccagactgtctaggagctcaaaaagctgtagctttatcctgtagcttttagaccaatgtacccttcccagcctccaaggctggatctgcagtcatcaaagaccacacttgggtttgcagagactttcctgtaactgctagagatgaggcccacgcagggactggcagttctaatggatgagcgaggaccagaggaatagttttacacagctttaaaaagggagctgaggggctggtgagatggctcagtgggtaagagcacccgactgctcttccgaaggtccagagttcaaatcccagcaaccacatggtggctcacaaccatctgtaacgaaatctgacgccctcttctggtgtgtctgaagacagctacagtgtacttacatgtaataaataaataaatctttaaaaaaaaaaaaaaagggagctgaaacctctaccacaggttaggaaaccacactcttagcctcctacagtcagctaggaacttgaggaaggcaggaaacaaaaggcaggaagaaacacatcacttgaggacaatccttcctttggcagccaagagctatgcctgcggggtatgtactccggtgtttgggctgtttgctgttcacttggagagtgggaaaacaaaacaaaacaagacagacaagacaaagcaaaaccaaaagccaagcaaagcactggtcaggcttatgaagtttccatggcatgtgaaagtgaactgcacccactaccagaccaaagtgcaaggcctccatagcgaggcccatgggagatccttgaagcagtatcttcagatgcctcatgtcaaagcgggaatcatcaggactttcgtcaactcgagaaggaaccgagagagccatgttagtctcagttcccactgaagaatgggaacagagccaggatgacccaagagcaaaagcacaaggtgcactccaccctgagggttcagaggggtagggctggctagccttaccaggagagagcaagtggggtaatagttgagggctgctgtgcatctacccttacctacctagcttcctccatcttttagggctgtggcagagtggagcctgggagccatagctgtatgtgtgagagatgactgcaccaggtgcaggaggagcctgcggaggagacctaaggagtaaatggcgctctccaggtgaaaactgcttatgatgaagaggaagacaagctgcagccgaatgaatgccttcccttacttcttgttactacaaacagtcatttcacttttatggttctgtaatttcccaagagtgcctaccttgtctccaggttcaaagttttgacactccactggaggctccatcctggacctgtgtcctggcttttcacatcctctgtagtgtaggaacacacctccctgtggagaaaagcagagcacaggaaaaccagaaaagggaacggaaggggctgtgcaccacgcccacacatggcactgaggcaccaacatatttattagcacctttcatcttttaggtactataacggagcattcattttctccccccatgatataattaacatttattagaaaaaaataagagcataaaatcaggtcacgcaatttggaaaagtcggtgtcatccatcccaggggacatgcactactaattggattcttttttaaaaaagatgaaaacccaaaaaaagtcaaaacaattcactaagtgggcaatgagatgacagggacatttcgagtgttcccagtcatgatggcatttctcaggcgacccttgaagtaactggagggtcagaagttcatgtcactagagggaggtgatttcttctcaaaggacccaagacccataattcaaacttggcacacatgtaattgatattttttgatctgcaaaattttattaagcaatagctggacaaatcttacaatttcaaatcatcaagaaaaaaatgagattaacccatttcaattttaaaggcaaaataatttggaaaattacatcattttgaatgcaaaccattactcccttctagaatacttcctggacaatctagtatacaaaatacatacaaagataggcaaataagggagagctcattgagatgcaatggtgactctcaacagatcttgtctggaaggttaaagcaaaatgctgacttttcaaaggaaatgaagaaaccaacactgcagggaccgatgtgtatgaaacagtgcatgctgttcccaaagtgtggacaagaacatgctggtggtcttgtttggtctgtgacatatgcaccccacattgcacatttatggggataaaaaagatgacagagaaggagaaagacagatgccagcagtagcaatagtagtaaactcggaaattatgcccaaatttacagtactaaaataatgcatttataaacaaatgcaaacaatacacctttggtaaataatacagtgccgtttccactcaaatgtataacccatgcttttctacaacacgagaaagaatatctacaataaactagatcttagcatcctacccttcccctgaaaattgacttgtaaacagaaaatacggatacaaagtcacaggagaactgcacaaagctgaagaaaatggaaacaaagtcagtcacaatcctccagagttcatctgccagagatgaggcgatacacagccgtgtagtcttctgaactgtatgttaccaaaaactcccaggagcaaatgccagctcaaacctagctactgttgccaacctgtccccagctcacaggacagcacaccaaaggcggcaacccacacccagttttacagccacacagtgccttgttttacttgaggaccccccactccttggggactccttggggacttccactacacttggatttgatgcttccatcattttattagaataagcattctaaacacatttaggggaaaacttctggtttcttttcaggagacaatagacagcttacagactcatgaaaacttttgtctacacaggtgccacgttttgacacatactcccaccctcgtgaaggggaagacgagctgctgaattctgagctctcaggctaccagagccagaatgcagtgtttaagcttctccaggtatgacttttcatttaagagatggacaaaaggaggccaggcaccctaggggcctggccaaagtcacccctatccccgtggcacgacaagtggacctggagtccctggcctttgactacagagtgagtattacacagaaggccagtctctggatggacaaaaccaacatgcaaaagctttcgctttgtatgctcattagagccgagtatttctagctgtggtggtcccagtttttctcaggctatacattcaaataagtatattcacccataacttttgttttgatgatactagagccaaataaatctaacactagttttcatgttggttaatatactcttttcctatgggtctctatatagttgactgtttttaatttcagtatccaatgagacattgggacattcacaaattgctattaataaccatgaagtacccaaaattctgttacttaaaagtcttcatttgaggagaatttaatcaagtgatattgactggaagaagccattatcttaaatgatatgatgccacaactgctgccagccagcagctttctgcccatgtggaacctgagactcactctccgcctgggggaggaggctagtgagtggctgctgttcctgcagctcacaggtcaagcaactcaaggccagaagcctgcatctccacagacaaagagtatcttttagggatgttcttatttagcaaagttgtaagtataacttttgcagtctggaaaaggtaaattttaactaaaaaaacccaaaaaacaaacaacaaccaaaaaaaaaaaaaaccctaaaacttgaagatcatttactaagggactcttttgagactcttatctcagatgtcttgcccttcctgtgtcttatcacattttattttaaattaacattttcaaaataagaaatactgtcttagggtatgctatctcaaagatattgcctattttgcatataatcaatactgagataaagagtgaatttatttttttaggggatcaataagattttctccaactctcaagaaagttgcaaagcacctagcctcccgtcccccccaaaaaccttctgtcatattctctttattttttgcagcaaaatatattgccaccaaacaagtcattacaaaggtactatttttctaaataaataataaaatgggcataaatcaccaatacataataacaaaatagttcccaagaatactataaagagcaagataaataactatctcttagacaacaaaacaaagaaaactgcatttaaattattccatacacagagaggcgacaacagtattgcacagctaatgctaagcactggatgccttatcaagctacagggacttacgtaaacacactaactctgaacatactgctcaacttgttccgggacaactggcccacctaagaatcagctctcatattttaaattataaaatggaaaaccccactatcagctgggagatgttcttgtccatatttccttggaatctaggaaaaaatgatgagtaatttaatttttctcagctaaaggaatcagacagtttctttcattatttttaaaccaaacacaaggaggaggaggaagaggaaaaagaggaggaaactaagtcaacatttaaggtgaaaagaatttccttagcatcttccacttgtcagctttcaaataagacccaagtcaaaagttaaagctcttgtgctctgggaacaagcagcacaggttgcagcgacagcgagaactgggccttactcccaaggtctgggtgttttcctgggtgtgtgtgttcccacgagaaaaaattttgcaaacatgctacaggcagaatgaataaagcacagacagtcttaacaaggctctcccatagttgtggtcaatcttttagtacagtctatgcacccaaaaacagttttttttcccccttacagcatattgtggtgttttccccaaagatgtgactatggctctatcttttaatatgctaggaaatgcacacatatttttgattacacttataactgctggaaagcattcaaaacaactgaattttaatgtggacaagggaaggaaaggtgtagttgcaaatcaagtctcattcacggtttagaaaagacagagcaataggatctaaagagaaagacgtctacagtagaatgctccagagtcaaacaaagggggaaggagagccaaggcaggttcttgacaagtggagggaggtatgtggtgagtgagcagtctaatgactatgatgtaaacccagctccaccccagcctggatcggcccactgactgaagtctcttaccttctttcaaagtcagataggattacttctgacacaagaaaccagtggggtttccaactaccgaccttggaaaatcacccttgcatgagccacactatcagctcatccagttgtctgtctgcatgtgagcctgtgtccatgggcagtctctcttccctcacacactgcctatcaaatcacgttgacaatggtggcagtacccatctatggtggtttacctaagcagagcacaaggcatttgcatatgtatccctcattcatccaggtaccttttagtgagcagcacacatctgtgaatgaaatgctgtcctccacaacccagtacaagctgactcttccagagttttggttgtgtttaaaaaatttttttttcatgagtgaatgttggaataaagggcagatgacatgaagaacgaacactaacactccatatgtttaaaagaagagcaaggccgagcaacctatcttctctgcaaaggcccttggtcctggccatgagaagtaaatgcagtacactctatagccaagctacaccgccttcaagaacacaaggtacctcaaattcttcacttccaaacaccactctagcaaaagaaaagagacaataaaggctaagtgaacgaccgggccatgcctacagaccagcaccctcctggcctgctggcttcccctgttcttctcaggtagtagcagtatgagctccgcctccaaaggctcctgccatgtatactcctgcatctgtctcttcattttaggcactgagtaacattggccagggcaacagcaaaagcctgaacagctgagaaggggtactggaagtctaggatgtatgcgttgccatcaatccgtccaaactgcatcacctgggagaggatgtaggaggcaaacacaagaaaggaaaagaaagtgagacaacagccagttgtgtccactccgctccgagggagccagagagtgcagtctaggacagagttctagaaactcaagtaactgaatctgatgggcttctagatctaactacaggtttagggaaacaagacagaggctcatggctaataacgtaagggggaacaaggagctcacatggagtgctacagataagataaagtgggtcttccggggaaaagaaagacaagactccatacgacgctgagagactttcagagatgtgccaacgttgtcaaaggtctctgccttggagcaggcttccctggtgactttctagagtatcacaacccccttcctctatgctcctccttgtcctgctgaacctgtggctttgccacttcatgtggcctcaaaacatgagattaccgcaccacagcataggatacaagatatacgcccatttccgtgtggtctttctctcttcttttgaaagacacacagtaacagttgcttccatgtctctcacttgtcttgatctcacttaggataagggtgggcaggcgtaatgtaagtgccgttaaacatttttaggccctgcaattcccatgctctgcagaatcaaccactccattccgctcaggtcagatgaacttatagacttacagaattgatttacaacaggaaaagggatatatggatgtatcgaccagtttgccaattcttggcttagaaactgccaggcacacagcaggcagcaaaagtatttgctgagttaattaagtaaaaatgaaatttaaaatggatgggcctcctgtgatgctcaggaggtaaagtgaggtggcagggctacagaggccaccacgctgtgacaagcactgtcttgtcatcgtggtcttcacctgtaccaaggagacttgccttcttttagagaactggaggaggacttagcaataaacacagagataagcaaacaataactaggaaatggaaatattgaggaaaactcatcgaaggcacagctgtgagtcacttggcgtggaggtctgaaaggtctgccctccccttccccacagactcatgtgtctgaatgcctggctgagggaatggtcactattaggaggtgtggccttactggaggaagtgtgtgtcactgtgggggcaggttttatggtctcctatgctcaagccaagcccagtgtggcacgcagtttctttctgcctgcagaacaagacatggaactctccttcttcagtaccatgtctgcctgtgtgatgccaggctttctgctatggtaatggtctaaacctcagaaactctaagccagcttcagtgaaatgttttcattttgtaagagttgctacagtcatggtgtctcttcacagcagtaacaccctaactaagagactcagtgacagaaggccgtcaccagtacctagtgcttaaactgggaaagtacggctagctctcgtgtgtgctaatgaggtaggggaggcagggctgacaaacataaccttcttccatagctggtaatgaaacgctaggaaggagtactgtacatatgacagtcagtctgtccaaactgcattgtcttgaggtcaaggtggtgggaaacaaagtcatgaaatggaaaaggaggaaagaggcagttaagtaagtttgccaactcctcagggaaacagacagcacaatccactagagttactcaggaggaaggcaacacatgatggctaaattagaagtatcaataaataaaaaacatgtttttgcaaatttaaagagatagcagagaccagcaactgaaaagcaggtggtgagggaatgcgtgggggctgtgctttcccttcctaaccggctgcctaacagggtacgcgtcattggatttaaagcacgtgtggaggccttttaaatgcttgttcccagagttcaaggcactggccctacttgctcagtggccacagtaccacagtctccttacctgtcgtccttccaactcaatctggaaattcttggcagactcctgggtcacccttcctccgaagtccagctggtacacctgtgtggcttcgttccacagtggctgcttgttggccatcacgtacacgaagccctggctgcccagccgcccatcttccttctcactggctttgcggcacttgaattcctccagctcactggcggtccgcaggctcctcttgcttttccaccccttcttgctgccctggctttggttcatcagctcatccccgctgatgaacagctcgggctcactctctgagctgtcctggaactcgtttgtcttgttcaacttctttgacttcagttggtctttctgacttttcactttcttcttctctctccctaggcgggggctggagatgagagaattaaagtcactcaaagtcctagcatcctttttcactttgccctcagtgatggcctgaacacttccttcctctgctcggctatccaggcgcttccggttcttctttccgaatttttccgttctctgcggtacagggctttctgtcagagagaggacttcttggaaattgtctgcagtctctaccatcacctctgtgcccatgtggctttggagcttggcaggtggaggggacacaagaggcttctccaccactaagtggggcttggggggaagagtgccctgggtgttctgcatgggcgggcaggtgctgtaggagttccaagggtgcaaggcgatgggcggcagctgtacactggagcaggtgctgcttcctgggtatgtggggggcaaggtgcagtaggaaaggctgggtgggtatgctggctgaagtaccacagcagactcctgttgtgcaaactgtgcctgggacagggcatccttaggggagcatggagcttgtactccaggcaaagaggggttgttatagctgcctggatatggcattcccatcccatagcctgtcgggaaggtggcagtagggctggacggagacttgggagacacaaagggcactcgagccacatccaggtgctggccttgccctagcatgaggggggacagttttaaggggttgggcactgtaggttgtgctgtcctttcctggggaacccaaacgtcctcacccagcatggggtcccactggtaagggggaggtcgcttcatggtgacagcagcttcaggaagtggggggtgcctcagaggcttctcgagctgacagtgctgagacagggcctcatcctcggtgaaggctgagttgacatagtcagtacgatcacgggaggtgtcaggagggcttagaagattataggaggactgggaggccagtggggaggtgctgatagcatgggccagggctgcacctgactgggagctgggccctgctccactgcactggctgcaggtgtatagggcaggtggaggtcttgctgggagctgtgccactgccccagcagcaccccccttaggcttggctaggggctgcagtggggcacgggagctgtctgccagctgggccatcttaagtgccacctctcggttgttccttcgtagggtggcatggatgagactgttgtccagcctttgagcggcactccgcccctgggccagctggctagcaatttcagggtaaggaggtgggtcccctgtagggatggagtatcgagggacagttagtcggttcagagtggcactggtgcagggttgggggaccttcttctcagtggctgtgagtctcaaggtggcagaactgcctgggccagggagagtgtaggtgttctgggaacagagcatccgagtccgaggccggcacacctcttccacattgccactgctgtcaaaggtggtaatcctctcatagcctagtggaggctggtaatgtgctgctgtagggtacagtgagaagtcacccttcttcaaacacacatccactgggggctgtggtggtggcagagggggtgggggtgcagccgtggtgggggcagcagggatagttcctggatacgggggtgggggattcatcttcgccacctggacctcctgcggggcactgaaaactaccgcatccccctcggcagccagctgaggcactgggcgcagggccttggctgacttctgcaggtgctcatggtcccgatctccatggtccaccgcagacagctgcataggcgcctgtggtggtggtggtggcggtggtggcaaaggcaattgaggaggattctgaatgatgcggcccatttctacacctccaaaaatcacctgtccaggattggagtaccgactggagactgggtactgggtagcagcatcacctgcatgctctgctgaccctacagctgttgtctgattggttaagacatccaactgcacattttgattggccagcagggactgcaccagccctatgctctgggtgggagacagagcttgagcagagctgtggattggtgcaatagggatgttcactgtacaaggcgggttgttttcagggacacctgatgctcctgtaactgtaaaacaaacaaagaaacaaaaaaaaaaaatcggttgcaaaacagtgcaatagaactacgccagaataagacgcatactgaaatatatctgatcttttccaagcaaaatgtacccactaagacatccaactgcacattttgattggtcagcagggactgcaccagccctatgctgttcacgaagcttctcaaacccttctggaagaacatagccatctaaggagtgtgcagcatggcctgcctgttgagcatattctaaggtactgtcaaaacatctcaatgaacgtgttctaactttctgaatttggtaccatgtgcttgcatgataccattacacataaatgtctacagaactctttagtggttttgctcataaaatgcctatgtaaaataaagtggaaacaccaaaaataaaaaataaaatagaatccctagaaatgggcatattggctgaatgccctttgcctatttactgctttttaatatttcaaacagcatttaaggtacaaccaaccaataaaagcatgtggatattccatttactatccagaggtcacgtcatgaaccataaacgtcagccatgacttgcaggcaggtgctcagagccacagttggcagtgcccctgtttgttattagacgcgttctcacgaccggccaggaagaacaccacagaccagaatcttctgcggcaaagctttattcttacatcttcaggaaaagagagcaagaagcaagagagagaagcaagagagagagaaaacgaaaaacccgtccctcttaaggagcattctccttcgcctcggacgtgtcactccttgattggctgcagcccatcggccgagttgacgtcacggggaaggcagagcacaagtagtcataagatacccttggcacatgcgcagattatttgtttaccacttagaacacaggatgtcagcgccatcttgtaacggcgaatgtgggggcggctcccaacatctccccctttttcttttaataagagcaaataggccacccatattaatgagagtggagatagaggtcaaatccccagtgtgtaggtaaaggagccatgtacaggattagctcttaggcttacaggcttttacccagagcaaccctgacctgctcccgtgtcgttttgcctgggggaagggaactaggacactgaaccttcatgaaagatgacatgtctccctagaataggctcatatatgccgcagagcctttccattgcagtgcttagccttgcaactctctcgggctgctgaagcacactcactctatcccgtgcaatgagtctagcctcatgggatataagagctgagtggccagcgacctattgcctaagcatagataaccatatatcagggggagctccatgttctagtcctgcaagcgcctgggcaataaccaccttgtctctcctagtttaggccttaagcttacagaccaatcaaagaagcaacactaatccacagcaaagtgtatctccaaataatattaatcccacccatattttaaagaaagaaaatgctgaggagatccaattgggtaatcctttggtcagggacaggtccaagcgcgtggagttgacctgaatgatggcaagcctcgaagggtctgttcaaattcagccatccaattctgtaacatatactgaaaaagactttttgacaaattagctgccctagtaaatttaacatactgaatggaaataacacacaatcccggaaacttttgttcacatccctgctgagttatttgtcataatacatctagttgtatctggacaagatctatgagttgattaaccagcatgagacctctctgtatcttgacattaactgaggcctgttcatctatgactgtagtcactgaggctgacaaagtgttaatggtgtcagttgtctggacctgtccagacagagccaaggctgtctgaattaaggccaaacccagttcctagttagtggtaaaaaagcaggagaatacttgagcattatacatcaccgtcattgggagtgggaatgtcgacattatcccccaacgctgctctctctttattattgacgccctggacatcaccaagacgagggacattagtattcccttggtcagtctggatttttcgggtgagtctttctggtatccaaaatgggttgttttcattctgtgggaaaacacagatagctcccctggatcttatcaagataggatccgggccataccatttattatcaaggacatttttccatttaaccatctcattgggcctatctggctctgaacaatgacgttcagccgcagtatggccatgaacatcaatatttaaaaaattgagtgtaaagagtgccaaagacaccgacactcttggtgctcggggtacagtctcctcaaaagttcccctcttctgttttataagataggctttgagggtgcgatgcgcacgctcaacaataccctgtcattgagggttgtatggaagtccagtcaggtgggttacgtccatctgacggcagaactgctggaatttttgagacgtataagctggtccattatcagtcttaaggagtctgggtttcccccaagcactccatgcctcaagacaatgttgaatcacatgtgaggctttttctccggttaacggagaagcaaacatgatgccagaacatgtgtcaatggacacatggagatattgaagttttccaaaggaagaaacatgtgtaacatccatttgccagacctgtagaggtcgaataccgcgtgggttaattcccacatgaggaactggcaagaactcacagcagctttgacattgagtaacaatgtcacgggcttcttttcttgtcaaggagaaacgactgcgtaatgtttcagccgtcacatgaaaattattatgaaaatttcttgcagcctctaccggggatgatagggcagcagccaccactttagtggccttatctgccaaatcatttcccagagccatggggccaggtaggcctgaatgggctctaacatgagtaatataaacaggagatcttctagataacaaaactaattgtatctgctgaaaaatattggcaactctactggaaggcttaatcactccagccacttctaaaagatttactgcattaaccacataataggaatctgacacaatattaaggggttttaaaaaggtttttaaaacttctaagaccactaaacattctaccacttgaggtgaattttcattatattgtttggataccactttaccattagccacataggcacctatgccagtttttgatccatcagtatataccacaatcccatttttaagtgggtttcttactgttatttgtggaaacacaacagattgattttgggcaaactgtaagattggatgttttggataatggttatctatttttcctgaaaaggaggtaactaaaactgcccaatcattagatgcggctgccaaggtttgaacctgtgcagcggtataaggtacaattaaaagatatggactttgcccaaagtgggtgattgctgcttttaggcctttaagggcaagctgtgcaattgcatcaggataccaatctattattttagctggggatacgtttggatggatccacaacaatggcccattttgccacaaaactgcagttggcaattgtgctgtcttaaagacacacaaactgaaaggctgcgaatcctcaatacgttgtaattgtgcattctgtaaggccttttccactttttgtaaggcctggttagcagctagagtaagagtcctaggggaggagatatgaggatctccttctaaaatactaaacaaaggccttaattcagcagaaggaatctttaaaaagggtctgagccaattaatatctcccaacagcttttgaaaatcatttaaggtatggaggtgatctcttcttatctctaccttttggggcacaatcttatctggggacaccacagagcccaagaattgtcctgtatcagaaatttggaccttttctgtggctatctgtaaaccccactgacttaaagttttaagtagaaaaggatatgccttttgtagcatggtaaggtctttatggcacaggaggatgtcatccatgtaaaggagcaaaattaaagaggggaactgtttcctcactggcaaaagagcttcttgcacataaagttggcacattgtaggactattggacatcccctgtggtaagaccttccattgatacctcttatcaggttcagcagaataagctccctgacccgttaacaagttaaaagtccaatctctctgctctggagttaaagcagcagcgtttgctcgggcctgcgcctgtgccgcctcctgccacagagctcgccattccacatatttggccatactagggagagcggcttttgcaatcatttgccagtcggcaggagttagtgccatgctggcaagcctgtctaactgcaccaaggtaaaattagcattgattccatatttaatctgcacatattctaccggagcgtggacacgcccaccctcggctccttcaaagactggaaatgcctgttgtattttcctttgttcctctcggggaatgaatgagtctgcgcactgcctttctgcgcactgcctctctgcgcattgctgacgcactacgggctgacgcactacgcagggcggggactccgcatagggcgggagtgcacctggtagccgattgccctgaggccaattagcaaactggccttcgccagccgcttttggcttttttcttgaccgattagctggctggtaatgggctgcttcttcctcccagtctgtttcctcagaggaggattcttcatctgcttcagaactactaagagctggcttcctgagctcatctagtgacgagtatctcctagagacctccgctaatcgatcttttttcttctccctttttcctctttttcttctaatctctctccaggtattcctacctaaccttaacttttcctcgggttcaagacccttggaaaggcctgtatacttaccgtttctccttgttcctactctctctctccgctttacttctgatagactgtcctgaatttcctctagaatttttagccctgccttaagcactatataacatgtgaaaaggaacaaaagggctcctaacactagaaaaagttcaaggccaaacctaacttgtaaagccattttccactttacttctgatagactgtcttgaatttccttagaaagttcaagatcagacttacctcgttccccagctgaaaagttctgaattcggcagttgaatccttctcaacagtctgtgttacgggaaccttataaccttgattcgcagttctggttctggaatgaagtatccctcctgcgccagtccggagttttttctcgtcccggattttctcgtcccggaattcggcaccaattgttattagacgcgttctcacgaccggccaggaagaacaccacagaccagaatcttctgcggcaaagctttattcttacatcttcaggaaaagagagcaagaagcaagagagagaagcaagagagagagaaaacgaaaaacccgtccctcttaaggagcattctccttcgcctcggacgtgtcactccttgattggctgcagcccatcggccgagttgacgtcacggggaaggcagagcacaagtagtcataagatacccttggcacatgcgcagattatttgtttaccacttagaacacaggatgtcagcgccatcttgtaacggcgaatgtgggggcggctcccaacacctgttggcagtggcgctgactctagctttgctcccttagcctactaagtggctgtgtctcttcctcagagcacattgtcagaggcccagaggcttaaaacttggtgtttaatgctgtatagcaacaaataattgagcaatcaacaggatctaacaggcttattttataggttggctgacttcacccaaacagcaggatgtggccaacacaagtcaagcctggccttgggcctgttaaccatgtgtttgctgggatctccctgagagagacagttcatcctctggcttaggagtctggccccacctcaggcttcctgtctttggcatgctaatctctcaaagagatactctttggtgtctagggagcaacgacttcaggtatctccctcaccaacggattcacaatccctgactgtgagccccaagacagtgtacttcagcctctcaacagagaactacacacacacacacacacacagacagacagatacacatacacacacacacacacacacacacacacacagccagttgctgcagcaattcaactgtggagaaggaaaaaactctaatcactgcatttggggacagcaaagagattgtcaagggaaagtatgagccatgtccaaaccagagtctgaaacagcagagcgtgtgtcaagctacgcacccaagttcattcactaaatggcaggtgctggtgcagaagtagagtctgggtctacaaaacttgtagttaaaaagcaagaatgtttctcaagcgcccttgagtaactgagaatagtaagatacaacttattggaagccactggaaaacactctggtttgggaataaaacaagactatttaagaatcccctactatagcaaagaaatctcaaggccaacagatgtctgacagtttgtaaagttaaatttaaaagccgtgtgctaaataaatagtaaagccaggtcgcagtacagacttggtgaaagggtgttcaaatgcaaaggctctgagtcctgggagcacgatagacccctagagaggtggtccaaagcagaggtacaaaggacagatgctatgagacaggacttagctctgattttacacagccctcctacattaggttcctgatttgagctcctgccctgacttcccttcctgacagactataagctgtgaggtgaaataccctttcctccccaagctgcttttggtcacgatgtttaaataagcaatggaaagcaaagaaaggcaacacccgatgtgagaaatgctctgcaaactgtcactcgtcactagcatcgaaaccacccatggaagctcctctgggagctcccttcctgccaaaaagcacccatggcggttttcctcctaggatacactatgcctcttaagcttagcgagcgaggtgggcctttttcaaacctcattagcaactgtactcaatgactgagcactctgtcccctggcatggtccactgagagaggagctgtgacagactcacctggtaagtcatcctcatcttcactgaaaacgtttgggttgaagacaggcaggttaatatagtccatggaaatcttcctaacttccgggagataaatggtcatctgccgaggctggagatgcagcaggctggttttatagattactggtgagaggaaggaggacacagttagttgaggcacacctttagtgtctgctgatgaacacaatctgggataggaaaattcttagtctgtctacagaaccacaaattttaaatgccaaaaatatgccttggactcatccttccttacaacgagcagacgcaggagaaaagtctttaaaagcttcattggactggaggcctggggagctgccactgctgctcagagtgaaggcttatcttcctgcgtctcactgcagtgctctgtggagggacttacagcactcctacagtctgttcaaagcttaaggttaacttagtaacacaggtatgaggaaatctaagaatttggaattaaaacagttagaaaagataggattaattataaaattatgaatataagtttcacaagtaggttaaaagcaagattaggtttctgtcaactctcttttgtgtttaaatgtttattaaataattaacttaatcgtgtgtgtgtgtgtgtgtgtgtgtgtgtgccatgacacacgtgtggaggctagttctatcctacaagattaaacttcggttgtctggcctttgtgaacatgcctttacccactgggcaagctcagtggcccatcttctatgtttaatactctcccctgggaaacgatatacacaggcacactaacggcattctcagtaagaaaagccacatcctatgtctaccactggctctgggcctgacaaaccagtcaatctagaggggcctcagtctgaagctggtgctcgaggtggctttcctccacagtctcagcatactaacctacaaaacacaatctgaatgttggtggaaaagttctgtgctgttctgagttagtacaaaagtattgtccagagcaataaagaacatttgatttttgcattgaggaatgattacaagcatcatttgcctctagggaacaaaagcaggttgacagtagaaagataaatcagagctcgttccctctctcccatcctctctccatgttgttcttcctctgccccatctctccatttctttcttccctcttctcactgtctctctcttcccttctctgtctttctctccctctcgctctctcctttctttccatttcttctctctctccgtccctcttccccactctatgaaccatcctttaaaacttctgaatttcgagtctatgacataatacataggttatataaaaaactaaaaagaagtaactttcttggatcagtcacagccaccacggctctgtgtaccccccttcccccaaggactacaggtgaccaaaatacgtgagcaggctctgacacagccagtgagtttctgggatcattagcaaatagatggagttcatgtggatgtcacatgtcacatgccttggatgtcacatgtcacatgccttggaggtgtgtggcttcctgccctctatcagcagagtgtggagataagttaaactgagggtgggatggctacattgtgagaccttgtctgaggaggagtgggaggagagtggagggggcggtgccaagaggaggaggagaggtgagtaacacactagctgtcaggaggagagaggctgccaatgatgaagccagtcccacttgctgtctgccctctccctcagtaagtctgtatactgagcttacccccccacctctcgcccatgtgctagtgtgttctaattgaaggaaacaaattattaaatgtaaggaataatagggaatactcactttccaagtccattagagcatcctacattgtatttgagaagattaataaggtaacatgaatagtcacttcctaatccaaaacttgctttgtctattataatcaagtggggagttctttaggcttggtcacaacagtttatggaccaattgctccttggtcaggagaacagtgaccccatgctgtgtctcaggaagcctttgtcctcacaggctaactcacactacaacagcagaggctcccagtttagtttccctaactggcttaactatggatctactcacaagaagagaaggacagaagctgacaaggatacattaaataaactttcacctcagtcttttttcccaatctttatcttagaaaggctaacttcccagaggcttactaaggtggaggtaatggtgacatttaacaagttagtagggcacacgtgagcgactcaacatttgtggtcatcagagcttccagagcactgaagtatcctaagaaattccctttggagaaaagagctgtgtgctacggtaggaagtgaggagtgaaaaggaaggacccattgttcatgcagtaaagccacactgaccacataaaaactcacactggccctgtcacgtcatttctttatcacattatacacagcaagccttatttttttgtgaggccaaggactaaatccaattcaatttcatgttctactttggcttcactgtttttctttctttctttctttttttcttctttttttttttttttttttttttttttttggtttttcgagacagggtttctctgtgtagccctggctatcctggaactcactttgtagaccaggctggcctcgaactcagaaatccgcctgtctctgcctcccaagtgctggggattaaaggcgtgcgccaccacgcccagcttggcttcacttttatttgaagtgaaaacttcatactgaaagctttaaacttggtgctgttttaagtgcaccctacaagtgcacacagagcagactgcgtttgagctgggctgaggtaactagctgaggtaactagctgaggtaacggtgctagaggtcgaacctcaagcctcagccctgctgcactccatcctcaatgcatttgtagaatttggtttgcaagaataattcattttttaatttttattttttgacagatgagtcttttaataggaaaataaaaaaaaaaaaaaaacaactccctcatccccaaaaaatcaaaagccacacatgcaacagcagcaacacacatctcttcaatccagacagctgagtttcagttcttcgccttgggaggtggccttacacacccataagcacagcgcggtctggctcagaaggctccagcgttagctgctcctggggcttcatgttcttgctgcactttcctcacttcagatgcaaacacagcttctgctgaggctgtggagtcaatgccgttggccttaatggaaatcacaaagtgtcctccattctgcaggaagatgtgggcattcagggccacactctgggtttggtctggctgggccacatcagcaaagatgacatccaccgttgagataagcattcggtatttgtgtaggtgccgagcatcttcacgttgatgaggccacggccagagtggtggagaactcagctgcatcgaccagaccagaccatcccggccgacaatatcagagatgtgggagacggcggtgcctgaagctgctccaaggtagagcaccttccctcccacccccagccccgcttgatgtggatctggtctacatcgcccaggatttgtcatctccttctgaaatagacttttctcttcatacacagattctccagggatgagattctttgtgacaagggcatcttcctttccgagacagataaagacaccttcatgccgatgcggctccaccatcacattcttccctgactggtttcctctcttgtctccccggccaccaccttgacccctgttgcccccagattggaagcctccaccttggccacgtccacctcctcatcccctgaagccacgaccccttctgcctccttggcctcctcctctatcaccaaagccacctctgccaccgaagccgccaccaccggggctgaaacttggtttcattactgtgttctggtctcgaaactcaggcattcctgactccatgagtctcaggctttaagaataatttattttataagtctgcataggatacaacttctataaatataattcttgaaaaacaatttaaatttagctgtagagagcacacattagatcaagggccaaggcctgcctggcctcacagagagaaacaagtgagattagcaaggaggcaaaccaagaagatggggggtgggggtggggggtggcaactacctagcaacagcttgcatctctgtcagtccagtgccagccaacctggtgtacagcagcagcactgcagccaaggtgttcccctgaagaatccccaccatgcgacaggcctagtacaaaggaattttattgagggaagggaagggggcctggaaaatgagctctctagcattctagcgctctcctacactagacctcctgcactctgtctcctgcacttcagttcctgctctctctctttctcccctcttcctccccttctcctattctctctctgcctctactcattttccaggcccccttcccttccctcaataaaattcctttgtactaggcctgtcgcatggtggggattcttcaggggaacaccttggctgggccactgaggtgccccctcctaccacattatactgctgttttataaactacaatgggggtgggcagggagtgcagcacagctatgcatggaagacccagcaagcaggaggaggctgctatgggaaggtctgtgactaagtccacttcttccctgcccctgaggtaaggtagcaagtacgcctcacagggatagggaagcaaataaaaaccaaagcctggcatggcctcagcttccattcccctcacataagtgccctctgtgtcttaaatctgtcacaggcagatgcttactagataaggaaaagcaagaactaaattcttaagaaaaggagacagctaccttcttggtctttaacttctctttagaagtttcttgtaacgtaaggacccaggcactgaaacctagatctgctcagcacagccaaatgtctacaagtccttcaaagtcttctactagagattttggctactaacagagcttatcaaagaaaaacacatgaaagctccaggaacaaagccagtgagcgacagagctgcttctctaacagcgagtggctggagtcaaggagacagacaggagtccggtgctgtcttaagaactcattttctaacttaaactgccacaggttgagatgggaacttttattgatttccaatgggacggtgagaaaatagagcgagtctttacctgcaccgaggttggttggtaggaatgcagccaagcccacaatcttaaacttggttccccagatattggatgtgacctgagcaagatagttgtgctgtgggggagggggaaagaaaaagacaaagaacctcagtccatttcatacaattgtctacttagaatgaactaatatgtaaaatgcttaagtagacactgccagcaacatttactctccacctgatgccattttacagatcaagggttagttaaccagactgtgatggctgccatttcccagtggtggacactgagctgggagtgctggctctttcccgagtgtccacatgtgttcagttttaaaagggcattagcagtttgagagatggctcagcagctaagagcacgtgctgttctcatggaggccaggagttccattcccagcacccacatcaggtggctcacaaccatctgtaactttaattccaggggatctggcctcagtgggtacatctatgcacctggtgtacataaacacacacaagcacacatacatgcataaattaaaacatctcttaaagggttattaaagggctgtggaatgtggctcagtgtgcagaatgcccacccagcatgcatgaagcccttgggttgacctctgccattgcacaactcaacctggcgaggtaagcctgaaaccccagacttgggaggttacgctgggagggtcagaagatcaaggtcatccttggctacacagcaaacttgaggccacccagggtagaggagaccctgtctgtataataaaattaaaaagactatcaaagctcagagtagtggtgtatgtctgtagcttcaaccagttgaggacaatgaagaagtacttgagcctaggagaagggggcgtggcctcattgttacaatcaggaaaacaggaagcaggtgtggcaggatgtgctctcagcaactgggaagctgaggcaggggtatactcaggtccagaccagtctgggctaccagaaatatctgaaactaattaactaatcaataaaataacaaagaaatgacattatgtgaaataaagacagaacttagactaaactaactaaacaaacaaaatggccaccaaaatgattgggacacaatttttgttcatttctcctttttctcatggataaattctgcagatttcaactgaactgaatccattatgtccctgaacctcccaattaccctactgtttcatgtgtcgatgaaaagcatcttacaaagtcagtgctatgctcagggtgggcgtgagtacaatatagctcctggaggaactcaggacctaatgatgcacaataaggcttttgttggtttgtatacaatgtggtgtttgataaacaccagcagggcattagacttgtgttagctgtccagggcaggaagccttcacagagaaggcccacactggaacagttagggctgagagtgagggcaaaaccagggaggtgctggagaggtgactgtggcagaacacaggcatagagaaggcaggcaaggccagactgtggggctatggccagtgtccccttcctggaactgaggagtcactgcaggaccaggaggcagacacgaagaagggaatacacctcactcagagctgtcctggaggaagactccagcaacagagaggtatgtgggacacagccacgcggtgtgcatgcatgcaggtgtggcaatcagcaagacggggcaagttgggaaggatggcggtatttccaggtagcctgctggctggactgtgtgcaggctctgttgtcagttatatgagcctacctgagtgatgtcttcaaaaggaacctctctccgtgtcaggctgggcgagcccatggagggcttgcgcatgggcaatcggggagaccgagaaatctcttgagcagcccgtggaagcttgggtgactttcgggcctcaatgctgatcctgtgggaacaaggtatgaggggtcagacatccacagaaggatgcatctggatctagaaccccactccctctgacactcagctgtagaatgttggctctcaatagtcagggcactaatttcacaaagctctctcttgcttttgatttagaaacaaggggaaagaatgtcaactaaatactaagtaatatatgcagaattaaaaaatggagatgacacctggtgattcacctgtaagagcctagagaatgtacaatcaccacctactgacttacagtatatttagaaaagcgcatatgccttctgccacaagtttgcggaatcggccctagggaggtggcaggagagaagactttctcatcctaacgacaccgccatttacaaaacttcttctatgtcagtttggatttcagcagactatttagcaccaccaccgataatatttaggtcaaatcactgaatctaaagcttttctgctgcttctgattccatgttctattttagctctgctcctttacaggtgtttaacactagtctactcaaaagacggtgctatgcaaacagctacggcagggttcatagcgtcctatgaaaagtgcatacagcagcagatatagactgtttacggaattggtaagaaacttcaggctccaggaaaatggaaaaacggaggactgagtgttccaggcagagagaacgaggaagggggcaccattcacaagaatggcaggaccttcagagggtatttatagataaaatgtgtggcaaatgatctgcttaggtagtgaaaaacactagagaatgacacaagttctcaattttatgaacagtttaaacaaactttagaggaaaacaaagcaaacccaatgtattacattcctggaacagttggatagtaaaaataattgtttatccttcatgtcatatacaaacactggtttggctataaagcagatctgagattgaatgtaaaaaataaaattttaaagatgcaagaaggactctcatggtcttagaacagacagagatttcctaagtgcagtacaagagggactgattataaacggacctctcatattggactatctagcaaaatgtctgtgtgatatggagtcctctctgttacaagtcattaaacaatctagttaaaaaaaatgaaggaaaaattcaaacagacacttgaccaaaagcaataaccagatgctgatataaacaggacaagtgctcagctcgacatcaccagtccctggagattccagaatcaaactccagtgccactgtcactacacagccacacatttatctagaatgggtaaaactcttaaagtcaccacaaagctggaaatgaaaatggaaaccttctatactgttgtagaaatttaatttagtatagtcacctggtaatgctctttggtagtttccactaaagtttaaaatgtaattaatctatgaccatgtaactccttttataagactatatgcaagagaaatgagtgcaatatttcccaaaagatttgcacaaaaaaatttatactggatttatccatcacagttctaactagagactgcccaatatccattgactgggaaagcacataacacatagtgatatgcttgttataatgaaataataccataaagtgttttaaaataaaaaggcaaactactgatatctatgatattgtgctgagagaaaaagctaaatgaagaatacccatattcattcaacagtaaaaaaaaaaacaaaaaaaaaaaacaaaaaacaacaacaacaaaaaaaccaaaccatacctataggaacaaagccatactggatgcaagaagcacacgaaaacttctagaatgatgggcatgtccattatcttgaaatggcgactcatcagtcaacctactgcccaatgaaccagatatttgaaagatggccatctgggcacgtctagggtggtatgtaagtcgcaccttgattttgcatactatcacagaactgtcaacaagcaagggctttgatgaggttctgtctgtccattactgcccacagaaaagtcctgtggagagacagtgctctcctaggtggtgacaccagacctctgtcttcttcagatggtatctatcacaggcacggagctaggcactttcgtcaaaacaatgacacatctgctgtgacaccttctttcctgttcttaaactggaagggacaacaagaaaactgggaagcagtggtggctccaggtcacgtgccttcactgctgaccctagtgacaccttgaggccttcatttaccatctaccctggaggagaaaggcaggcaggcaggcaggcaggcaggcaggctgtaattattccagaaagaatcttccagaatgagaagtgagaaaacaaaaggggagttgattttgctgctgtgtaattgtgaccttcctccaggtttatttgggtagaaatggttccagaactaagcagcaatctggacccaagaggttcagcatcctcattacagtcagcttgaactgaattctggatctagaacaatgccatgccatgtagagaggttctagagctagaggttcagaatcctcattacagtcagcttgaagtctggatctagaacaatgttatgtcatgtagagaggttctagagctagaggctcagaacgctcatcacagtcagcttgaactgaagtctggatctagaacaatgctatggcatgtagagaggttctagagctagaggctcagaacgctcgttacagtcagcttgaactgaagtctggatctagaacaatgttatgtcatgcagagaggttctagagctagaggctcagaacgctcattacagtcagcttgaactgaattctggacctagaacaatgcatgccatgtagagaggcacaatgacaggaagcttactgttaccttgggagtttgggcgatttgctagatctggagattttgggagacttcttggcagcccaatcatcactcagttcgatatcactggagtctgagcagttgcagctgtcaatcacagtagaaattaagctgttcccatagatctcatctgtaagaaaccaatcgcaaggtgtaagcaactgttactgctatacagcctgactttatgggcttccttgttaagttaggggttagaatattaagaagtagtccttttccttttacattttttatgctcttttctaaaaagaagtaggcaatttctactattattaaaatggctgatattttagtgctctagaaatatacaaaattcctaggacagaaatagatgacatctctgccttaattgctgctgctcctgcttttaaaacaagatcagtcaatcctgaaaggaaaatgtcaaccaataggggattcttaggggccatgaaagaagccaggcgaaagggagatttggacttctgcttcccagtaacaaattttgaaggggagacaccccaatgggaacctctttaaaaactcttaaagaactaaagtattctgttaagaacatgggtccaagtgctccatacatttgacagattgtggaaatgttgggtagcatgtggctaactccttatgattggcatcagactgcaaagtccactcttagcccaggacagtttatagtatggaggacagaatatgaggatagagcaagggaagtggttcagaatttagctgttaggaaaaaggcagataaacctactatgtcatccttctcaaggccaatgcattctgatgatgtaaagcatgactttccaatgcttgttcaaccacactagcaatcagtgttcctttgttaataaatctgccatagcatttcctgaagccaatagacctggcaggccagtatgtcctctgatatgtcctataaaaaatttttccttttcttgattgaattatattttgtaaatgaagcaagagtgatataattctggaattcccagatataagagctctctctatatcaggaaataaatgaactacatattttgaatctgtataaaggttaaactcttcaggtatgtgttcaagggcagtaataattgcaataatttccacctgctgtgcagaagtttcttttgctaattgtaggtctatcttttatataaacaactgaggttccattaaatgacccaactgtaaataccaagatggcatcagaaataggttccaatagggcattgaggtccatgatacttaatttgttccatatcatgagcaaatgctattccccagtcatccacagtttgaagtaaatactccaattgttccttattgtagggaataacaatttcatgcatttctttgccaaataattccctggatcttatcctccctttaataattaatttgttacacataaaaggataagaagataccatttttacttgaatatgagggagataaatccattctagcacaccttcttgccatagccatgcaataggggtgtaagctgttttaagtataataagagaccatggttttaaataatttatttgttttacctttgcatcttgcatcttttgttctatcaattctagttgttttaaggcttcttttttaatatttcccaataatttttaaaaaccattaagtactgccgggcgtggtggcgcacgcctttaattccagcacttgggaggcagaggcaggtggatttctgagttcgaggccagcctggtctacaaagtgagttccaggacagccagggctatacagagaaaccctgtctcgaaaaacaaaaaaaaaacaaacaaaaaaaaaacaaaaaaaaaacaaaaaaaaaaccattaagtatttttaatttatcaatcctaagttgctatttttgaaatatgatatattcattatgaattgtttttatcaggggtaataattattattagtccatgctgggttaatacctcaatcatatttttcaaaattaattcagttaaatcatttgagctgtctcttagacttggaatcaggatctcctttaagaatttcaaataaatgatgcaactgtcctgtggtaatttttaaataaggtctaatccaattaaaatcatttgtttttttctgctataagactatcatccatataatgtaaaataaaagcctttttatacttagccctaatggatcttaaagcttgatctaccaatttttgacaaagggtaggactggtcttcataccttgggggaggaccttccattgatacctttgaaatggcctatgaaaattaacagagggaatgctgaaagcaaatctttgtatgtcttctggttgtaattttatagtaaaaagcaatcctttaaatctataactataatataataaccctctggaacaactactggggatgggagtcctggctgtaaagctcccatatcatgcactgtcttattaacagccctaagatcttgtaagagtctccatttacctgattttttcttaatgacaaacacaggaatattccatggactgctagattcttcaatatgtcctaattgcagttgttcttctactttttctactaattgttctaaagcctgtatctttccctgagttaggggccactgattcagccacacaggctcatcactgatccatgaaattttatctgcatataatttatcagcaacccctataaaaaatgctgctcattccatttttcatctgtggttagttttattttcatgtcccctaagatatctcttccccatagggagaatggcagagaggaagtagtgtgaggttgagaagtacccactttgtcttcacattcccatgtcagggtttttgaactctgagctacattgggagccagcctcaatcccaccagaatagaggttatatgaactacaggccatgttccaggccagtcttttcctgcaatgcaagacctatctgctcctgcatcaatgatgttcaacttgacacaagaacaggctaggcaaattgtgaaggatggtaaacattctcctgatcattcattaaaaatggaagttaatccaaggggccttaaacctcaagttttgtggcaaatggacataactcatatcccagaatttggaaaatttgcctatgtacatgttattgtagatacttattctcatgtggttatggctactgctagaactgggggggctgtgaaagctgccatacaacatcttattatgtgcttctcctcctcaggtgtgccaaaaagaattaaaactgataatggtccagtttatacttctcaagcaaagttttgcattcaatggggcatagaacatacaacaggaactccatacaatccccaaggtcaggctatcatagaagactcatcaaaatcttaaggtacaacttcagagattaagatctagtgctcattactactcgcctcatcaattactaagccaggcttcatttaccattaatcaccttaatacaggtgataaaggctttacccctatgcaaaggcattgggctcccctactgcagactgttactcgtttagtgatgtggaaggatcttttaacaggcgcatgggagggccagatgtgttcatcacctggggaagaggatacgcatgtgttttccacagactgcagagaccccaatctgcatcccaggcagacttattgaccttccaccagaaaacctctacaagaacccagaagcaaaagaaggcaaaagaagtcatgaagaaaatgaagaagcttgatctcttcttcacaggcggcttcggctcctcctgaacggtcatcgaccacgggatagatccacccacttggggacaactggagaaactcacccagagagcacaacaaataatctctgataccgggaaaccaccatcagcagaaaatatgctatgcttgctgaggttgctatgcaggtatgctgtgcctccgcaacctcgtcttgggcctatgtccccaccctccccttcttcaccccgtgggttggggagataatcagagtcatgactctgagctgctgggggacacgctgatacccccccccatttgacttcctctgtaatttaaatgagggaatgtcagattctgccccaatctgtgttactttaaagggaataacctccatgggttgccttcccactagttatagaacttttctttcagatagatcctgttgccccccccaaatcataaaagattaatgtgagagctttcaataatgatttttggatattctaattatagtgaaacttttataaggccaaagaacctatgcctctgaaacaatgtccacaagaatatagggacaatgataaattgtggttatccttgctttcaggtgatagtccaaatggcttaaatgagggtttagtttttgggcttcagtacatgatccttggaaaactcaagaaaaagtttatgattattccatagtctctccattttatgattataggaaacaattaactaatgagttatagctctttcaaggatataggcctgatacatttataaataagtctgttaatagatggttcactgcaggacgggtggaacctatttatgtcagtcattctctttcacataatacttctaatgtttttttcagggttatttagactttttgctgcaactaacatggttcttttttaaaaagcctaaggaatgtaagaggattcctttggcaattagatcttgcctaaactatccttatggtatactcgctggccagtcctcagattttaaaattattaaagtaaaacgatcttatcaggtcagctgttccgaatgtattctaactaactgtgttgatcctatttcaatgaagaattattcagtattttgatattacaaagacctccttatgttatgtttcctgtagatttaaaaaaggacatttggtttgatgatgtagccttacaaacacttaagagagttagtgagctaataagtccaaagcgttttgttgcaactttaattgtaggcattaatacttcaattaatattactctagtagccattcttactccacttacagtctcaacagtcaccttagtctctgatacaaagactgcacattttgttgatgacttaaacaaaaatgtctctttaacacttgcaaggcaacgaattatagatcaaaaattagaagtaaaatttgatgttttagagaatgtagttttggtattaggacatgaagtggaaaatattaaaattcagctttctgccaagtgccatgccagctttcagtatatatgtataatgccattaccttataataaaagtcataattggaattttactaaaaatcatttgtttggaatttggaaagaccatgatatcactcatgatatggctcaattacaagcccaaatctctgctatgagcaaagcacatgttgaatcgactgatatagaagatttggctcagtctattagctctgaaccctgttagttggctacattggatcattgttgtcgccgtggctacaggaataataattcttctcctccttacttttccaatcatcttccgactagtcttttccttcctctctacagccaacagagatatttatgagcttcgattaaaaaataaaaaagggagagatgcacaccacctccaggaggatctgtgtgcatacacacacacacaagcaaacaacaaaaccaaagtcaacccaaaccatagcccaaccatatgaacaagaagaacctttgctcatctcttctaattctcacctttccataaatagtgatatttcttttcatgtcagtagggaaattaaaaaaaaatgttttatgaggggctgaagcgacagctcaggggttaagaacacttgctgcttcacagaggatctgggcccagttccctcccagagcccacacagtaactccagttctatagggtccaacaccctctctcctgggattttgaatgagaacggctcccataggctcatatatttgaatgtttggtccccagttggtggccctgtttgagaaggattaggaggtgtggctctgctgaaggaggtgtgtcactgggggcagactttgagttttccatcttgatcactcaatctctctccctccccctctccctcccgctctgccctgtggttgtgggtcaatatgcgagctctcagccgttcctttactagtccatcatggagtctaaccctctgaaactgcaaggcttggtcatagtgctttatcatagcaatagaaaagccgttaagacacatgggcatggcacacatgtgacacacatacatacatgcaggcaaaatatccatacacataaaaatagatcttcaaaaattatttaagaattgtgtgaaggaagatggtaatttttttcctgtatgaaatcaaacttccaacgcccttttctgaaggtcacccttccccacttattggctgtagcgccattggatattgaatgctcctgagtttcagcgcctctgctggaactgaactgccgcgtgagtatacttggaggtggagcctttgggatgtggttatgtttgagagtggccctcgtggagtgggatttgtgttcttataaaggagtcctcaaagagcagctcttccccctttctcccatggattgctggcacagatgtccatctatgaaccagggaggtggtccttaccagataccagctttgtcagcacctggacttcccagcatccaaaatggtgaagataaatgtctgcggcttcagtctccagccttctgttacagcaactcaaatgctctaaaacactccttgagcatcagtggcggtttgaatatgcttggcccaaggagtggcactattaagaggtatagtcttgttggagtagctgtgtcactgtgggcatgggctttaagaccctcatcctagctgcctggaagccagtatcctcctatcagccttcagatgaagatgtagaactctcagctcctcctgcaccatgcctgcctggacactgctatgctccaactttgatgataatggactgaacctctgaacctgtaagccagccccaattaaatgttgtccttataagagttgccttggtcatggtatttcttcaaagcagtaaaatcttaagacagcatccaaattctcatgtatgctaaggtccataaagccagactctgattctatattgaccaatctttacccttgcatgaacaaaaaagtactagcaaagtaccacagctgtctgatgccaaaatttcaattaaaaacaaacaaacaaaaatccaactgtaacaacaaaagaaaaatgcaacaacttacggattgcactttcttttcttttcttctccataggcaaggttcttacaggtcttgatgcatatctctaaagagcagcttttaacgcagtaatgaatggcaaattctatttctccagtgacattagcattgtcaaaattacccatctctgtgcaggtgctgttgatgctccctgaaatcaatggcagacataataaattacttcacagttaaatattttgcaattctgcttccatgataaatcccaattaatgtgaatgtacatctgactcatgttcaactgataaatgcaccctcttacattttgctaacctaagttgccacctgctgaatcctaaggcaatggggcatcctccccaggccttgtctcgttatgtctcagcctggtgataaaggttaccccatcaaagcctttatcatgagtcactgggatgaagcaagctagctcatatgccattctgttagcgtaactctcctgctaggcggtatccatggctggaaagtgtgtgtaaagcagcagacagtgaggctgaggggctaaggctgggaatcagagagaactgggctcccgggcttggctgattctgcctctcgctggatatgtcaaaatctaacagagaaagataatgctagtctcaaaattatgaagaagactatgtgaaatgtcttatgtggatggactgtgcagagatagtgataaattatatttaaatcttatgggcaccaaaaaaaggaaattactgccaaatattagagtagattaaacttaaatgacacatgaaggtgtgtacgtaccatagggtgcctgtgcctcaaagattaagtcatcttatcactattaaatttacttaactgccccatttgtgagcagtccatctcagcatgttgactttatagaaacagtgaagcctaaataatttctccttctaatacccaactggctcctctgtactctgagaagaaactaagaaagcctatggtggatggccagaactggcagagagataaaaaacaaatcaaattatctcaaaggtcctggaacctgaattaaccaatgccaagaatatagccagaatgcagaaaaatgttgtcttatcaaaccatgtgagtgccagaatggaaaacaactttaaaacagtatacattcaaggacccacaggacggtgcagcaacgagaatgatcgagagttaaaaaaacgtagactggggagatgtggagagaggttataaactaagagacagaagaaatggaggaacggcagagctaatgaacgctagtactgagcctacagctcagcaataaagagcttgcctgcaatgcagaaggccctgggttctgtgctcaggaactctttgccgaggaaatcagcccaggaggagcagtactttgccctctgcacaaaggtgcacacttctctagaggtggctgctggtcctcataccctggactcagttctggttttcccagaaccgaagctgcaagtcttgagcagcaaatcgagtcaacatgaaggttctggcccaaaagagcaatgacgtttggcggcctgattcctgttagtgtccctgactctgtccgtcttaaaaacaaaagccaacgctcgtcaaagtaaaaaacacccacacccaagtgtcatggatctcacttgccagggaccacccccccacccccacccccgaaggccacaagatcatcaactatcaccacaagcagagtccagagcctggccacctcacaaaggtagaaaatctatgagaattacagcttttggatttgtttccttttaattgataaattccagtaacccagaacacacggaaaagtactacaaagtaggttatcgggtgacaggcagacttttacccggctggctatgctgtctccagcaatttccctccttgtattagcccatccttttcctgtcaaatacaggctgcttcaaaaccacctgtgagtcaacttcatttttccctatggttttgttagatagtgactaccagcccctacaaaatattctaccttattttactgttcacacagttcagagcattttatgtgcatagcaaccacagtctgttttctgtttggctgctgccaaatttccaaaactaaaacaattataagcaacactgccctggacatccagaggtgcacatttggggcaacatccagggcactctttaaaaatattttctgtcaggcctggagagatggctcagcagttaagaacactgactgcccttccaaaggtcctgagttcaattcccagcaaccacatggtggctcacaaccatctgtaatgggatctgacgccctcttctggtgtgtgtgaagacagcgacagtgtactcctataaataaaataaataaatcttttttttaaattcctgtctattaaattattcaagagatcccacagagctagaagtgaaacacagaggtgagaggtgtgttgagcaagctgtggcagaagcagggagaagacacctcaagacttttggagatgtgtgtgtattgtatgcgtttatttccaactgccctccagggaagctgtcgccatttccattcaccacgttttcagatgcctgctgccctgggccccggctttttaaatgttatgaacatcatcccaaaataatattttgctttaattttgccctgatttcactacttgggaggttgggtaattggttctatttgttgtccatttcataagccttttctagcccaacttcttatttctcagagttgtgaattcttccagaaagggcaggaaacatctttggacaagaaataacaaagcagttacttgccttatggaaaagtttgagtcccttaggcaaacactgctttgatttaaaagatgttttgttgagacaacaatttagtctcacatcataaatttgaagggtatacacaagaaaaagatgagaagggctgagaatggagttccttattgagtttaagccaagaaaaacgatcctaaaaaaaaaaaggcccatcacactgtctctctgctcagtgtaggggccctaactcttcctaaaacaccttctgaaatccattttcttgtataatgtttacgaatatgtatagatatgtgttcatgtgaaggcacgtatgccgcagcacacacatgaaagtcaagagaataaccgtgggtgttgttcctcaccttctgcattatttataccaggctagctggccttgagctttggggtagtctcctgtctccacctcccatctcactgtaggggtgttgggattatagacacatgccacagcccctggcttttatagggctctggggatttgaactctggccatcagtgatataagttttacccactgaaccatttcctctgcccaaccttaattctcaaaggttttccaggcaggggtcagctataaggagaggagaaacaaggacagcacaagtaagacaaaccagttcttacaagagctcaacaaacctgtgggtcatatctgatatcctacgatccctggcttggttgacctcaagccccgaagccccagtaggactctggcaaaccatctgacctccggactctcaggttgctgagttgtaaggtggactggcagtacctgccacagggtcacatgacaatgtatgggatgagacgctatcggggcaggctttcagagagcgtgatagctgtgatggatgattaacatatagtctgctaagtgtttagcaagggtcacttgagtgtcagacactgctcaggggacttgggaattacactctagtgagcagctgatgaaaggtaggggggtaaagtacatattacatagaagatgctaagcataggagagacttttttgttttttggtgtttttttgtttgtttggttggttggttttggtttttcgagacagggtttctctgtgtagccctggctgtcctggaactcactttgtagaccatgctgaccttgaactcagaaatctgcctttcctctgcctcccaagtgctgggattaaaggcgtgtgccgccaccgcctggctcacatatgataaacttggagcttccactgggtgagaagacagcttgaaaggcccgtgatgaagccaggctgagtctgccactgctttgctcttggcaccccaccttccggaatcataaatttctatcattttcaaattactaagtcagtgatattttaagatagcaacacaaaacagatcaaagttactgttaactgaggccttagggtccctcatcaaatttctaggcatttggttttgtttagtaaatgagtgagtaggtggtccctatccagaaaacaggatctggaatagttgatcccagtccagaatctagaatagttgatctctgtctagaaactgaacagattttaaacattatgaagccaccgtgaaaagaagaataaaactggaagacttatacctccaaacttacaaagtaagacaaggggctctaggcatgaggacggacctgatgcaggggaaaggggccagaacagggagcattctcctaagacttgatgggacaaaatgaccgactctgtagaggaaggacaggctttttaaaggggacgccatgttgactaaatagccacataaaattagcctcaaccaaacggcatcatgccaaatggccagtcaggggacaggtgaaaacatcaatggaaacttcttttttggtttggtttggtttggtttggttttttgagacagtgtttctctgtttagtagaactcattttgtagaccaggctggcttcgaactcagaaatctgcctgcctctgcctctgcctccagagtgctgagattaaaggcgtgtgccaccaccacccagggaataaactcttctctgtaagttttttttttttcattctgctatttttttttttttttttttttttttggtttttttcaagacagagtttctctgtgtagccctggctgtcctggaactcattctgtagaccaggctggtctcgaactcagaaatccgcctgcctctgcctcccaagtgctgggattaaaggcatgtgccaccatcacctggcgaatggaaacttcttactgagtcttctagacaaaacagaacactgtcttcactgtgtggtccacatagtaagttccagtccagccagggctacatagagagactctatctcaaaacaaaacaaactctaaaactattcctaagacacgccactgctttgttactgctctggtttgctttctgctgctatgataaaatccattacctaaggcggctttaggaggagagggctatttcagcttataggccacagcccatcaggaagagcggagggaaggagcttaaggcaggaaccaggagacaggaactgaacagaggtcacagaggcacactgccttatggcttgctcagcttgctttctgatacaacccagggccacccacccacaggtaacaccacccacaaaggactgggcccttctttggtcatctatcaagaaaatgcccaacagacttgtccacgggccgatctgatggaggcagttcctcaacctaggtgctcattttcagatgactccgttttgtatcaagttgacaaaaacaaacctgtacagttatcaattactttttgaaggtataaaaatgttctcaacaagttaatagtttttaaaaggtaaaaagcaagccttaacatatttccaggttttccctatccccaaacctaactgaagatctcctggaagctctactcttaccctctgaccacaagacaacagtctaggcctttctttgtgtcttatatctattgataccaccatgaccaagacaacgtatggaagaaagtatataggggcctcacagtttcagaggataagctcacgaccatcattattggagagtatggcaggaggcaggcaggcaggcaggcagagagctggagcagtcgctgagagcttacatgtcatccaaaagcaggaggcagagggaactaactgggaatagcacgggtttttgaaacctcaaagtacaagcccactcctcctctgaccaggccacacctcccaattcttcccaaacagttctaccaacagaggaccaagcattcaaatatatgagtctatgggggccatttgcagtcaatgtaccacaccttgtccactaggccagccggatcctgtctggttggttctcttccctggtactagggactcagcacagacttatgctgtgtgcatgcctgtgctctgctcctgagctatttgtgtgggccccaatatcttgataaccacacatcttatagaaacagtattagaagaagactcacgtgtctcaagcctccagagaagacagcgctgtgtgtcggactggacgggggagtgtcttgcttcaaaacagggtcgggagggtgtttaggatcttcttgatggaacgctttcagaatatcgggtgtgctggccttctggacagagtaaacacaaacatcccgatcagactgagggttcagtaacaaccgagctagcaggcaacccagcctgcatatgtgaactgctctcttaacacacaaccttctagtgactgagtcgggagacgcgtgtttgggtgaatttacacaccccatacaccagcagggccccgaggcagagtctctggggatggtcatgaacattcaacaggtgggctgttttggaatacaaaaagtgttaaagaagtttaaattctgcttttaataatgatcatgacaggtaatcatggtggagtatagtattcacactgactaacatttttacttctaacatgcacataaggaggaaaaatgcatctttaaattgtatttattccttgtttcttttgctagtaactgatatttcttctgtaatgatacagctgtacttcttagtgttaaccactaacctcaggggattgcttcagtggaagccagctgaagtaaaatgaaatggcttagctggtccccagttgttccatgctgagcgtagtcacagaggacatctgtgcagtggtgtctacatggcagggctgtctgtccacagcccctcctgtgctttcttgctggggtctctcaaatgctcacaacccagcaggcagcctctgggctgtgactgcctggaaggcttctattctactggctcacgcagcaggggagggacatgccaaggctgccacatgatacctgcactcagaatgtcaaaagtgaggcctgagagaacttgggattccccacatggggcacatctcaccgcaagtgaaaaaatacagtgtctctcatggctgggtgaggggctggaacattggcctacctctcctctgccgtctcgctatccaatgcccttatctttaatggagaaagattctacagagctgctttaaagataatattaaatagcaacatggcctctctacaggggacaatgcctggcttgtggttagccttttgtcagtactaccattagatcagcttaatctgactgctaagtgccgtccttctgggcttcccttccttgaacactacttcttcaggccttcacctgtgtcctcacaggggaaactgcagcagcctaagacattagcaacatttaaacccaggttctactcctggcactgcctttccctagctatgagctgcaggacgtgttggttggccaaggaggaaagctcagggtttttttcatggtcatgggagcaagtcacccttccatgatacactaggctatgaaggcaccatctgcctaggacaaagtgctttggaaatggaccttatgctagccctgaagaaaagcggttggctccagggatgccactgtgagcagatactcgtatgcacctgggaatttcaaaagccctgctgagtccatcccacatgttaaagacacaagccattgggaaagtaccagcatctgcaggcccttatcaccagaagctcagcacagatgccccagagcctctgaatctcattcccggggaaaactccatcgtatgggagtctgtattccaagagccccatgactctcctccagccacagcttatacctggagtagttactccagagcttagtcgccaaaccaagatgagaccaactgaagcacagcatcctcatctccaggagaggcctggacctgactaagcctctcggctctcagtgtaaaaccgggttgtatttattacccattttggaagggttgacagtcatataaagctctgtgtgcaggaatctacctgcaagactgggatagcaagttaaaggcaagtttctcactggctgcataaaggactgactccatgctggacagacagagacccctactgtttttatttttatccttcttgggagcaggtggaaggccgcagacagaggcaggttgtgagatatctagagtagggggttctcatcctttcccgatgctgctacactttaacacagttcctcatgctgtggagaccccccccccccacacacccataaaattattcttgttgctattccataactgtaattttgctgctgttataaatcataatatatgtttggagatagagctttgccaaaggggacgaggctcacagtttgggagccactgctgtagagtatgttcccaaagggagaaggttaagcttaccacagtctcaaaaaaaagggacagtctgggggacatcgtggatggagcctacagccacagaggaggggacatgggtcctgtagagctcagcagatcaaacatattggcctgccaacaggtcacctgggctggattagaacccaggcactgtctggagttgggtgcacccgcttttggcatagcccacatggcagaaagcagagacgtggcttccctggtggctctccttccccagcgagccctcttgctttcgatcacagggtgggagcaatcctcccacttacctgtgcatgtgcagggtttgtttgtctttccaccagaggcccaggcagagcctaaccagaggtctcctaatcatgagaggagacttgcagaccccaagaaatggcaggtcatcctgcaggtaaggcttgcttttggtgtggcactgaaaccagagagaggcagccttgggagcttgggtcaggttaaagcctacccctgatatgaacaatcctctatggtgatcttgaattgttcatggtgaccttgaataattctttcttttcatttgttccaggaagaagagtctcacattgttccttaggttgacttccagttccttgattcagcctccggcattaacctgcccaataactgggaagacaggcataaactactgcatctgactggggtcttaaattctgtgcctcctttgacctggtgtgcctgaatacagactgtatataattagcttttcctggctgattaaggctttctatcaaaagaaaagtaaatgcaggaaaaaaaaaaaagaaataggccagaacactcaggaaagatggcatgaacgtggtcagtggcctcagtggtctcagcctaccctggaagtcacgttgactgcagtgtctgactggctccgcctctccgtgtggcccacacactgcctggggtccatggccagaagatgcttctcagaggtcatgtcattctgggacttggagagctctaggagacaaggggggaaagtcgagagcaacaagctttgccaagaccagagggagccttctttggggttctctaccacccacagatcctagggccccaaaaggccacaaaaaagatgactaggcaagggtggcagatatggcagatccgcagagaagaaagggctccaggggtggcagtgccagaggaggagggaaggctggactcttccaaggtccacactgctcatgtgtttgtgggtagccatcgtcagggtggggttgaaaggaaacctttcacccagctccctgcatcccaacccacctgtatgatcaacagcctgtccagacacaagcagctggctttttaggggttcctgacagagactgttgacaaactactttctcttgtgactattggaaggcagtcagatttgagatggcccaaaggttgcttcagtaactatgccctggaaaggtcacttcagctttggatttctcagtatgacagtatccagccatttggcttctgtgggctatgctggatggggaattgtcttgggacacacattaaaatgacaaagaacaaggcgggggggggaggtggaccccaagcaagtgaaaaccccagctttcagccagactctcccttaaattccaccacccttctcaagaggccccctcaactatctccatagctgcactctctagagagaagatttgaattacctatactattctaaagtttttccttatccatactacataagaaacaggtgacattattttttaactctgcattttattcaacattcagtttattaagatagatcatgaatattaaaattactggtgagatcactcaccaactacaccaaatctctgaaacccatacctagggtacagctccctccagctacacagctcgtagtggtcccttgggaactcatgagcatcacttgctcctgccctgtttgctgtccacacacagatacatggctgggaagagcccagacttctgctgcctgctgctgtccacatcatccacactgtccaggagagccttggaggtcttccttcccagacctgcttcccaagcccagagcatccagtttgccaacctcacttcctagcttcccttctgagaaccacaccaccctagcagtctcaaatctactacccagaaacatcctgctggcatcggttgatgctagcaatcggaaaagactagcatacggtagagaggccagcagcctggatgtgaagggcacagaaggcccttatgtctagctgttggtaggaactctctgtcatcggtctgttcccactagcctatcctgagatggtacctatttggtccattacaaggtcatgacttaacgtagaggaaaaaactgagaagtttggagttctaacaagtaggattctacatcagtctaatgggcagaggggagggaaggagcagaaagaaacagaatgctctcaaggaggaatcaaggccatcttcctctgctaaaggggcctagcgggtggccattgtgagacgtttatgggttttacaaaggactggaattcctcacttttttcagctactctgggcaacactggcagccagagggtgccactccgggtccttattctcaaaccctgtggttccaaaccaactttagcatccttggccgctggttctcagatcgctctggtctcttcacaagcccatcactaagggcccctggcactgatccacatttctctccagtaaggttgggctatcttctgtacccacttctgcaggctcaggcaggtggctttggatgtctctgtcttcggctgatgacaagagaccagaggttcaaaaaacaagaacctctctcttgtttcctctgaagtgagagctgtgcttttacactgatggagaatttataaaagccatatgggctggggcaggggactgatttagaggctgccatgggaccagcaccagctgtcacagaggggtaaatagacccatgaaattcagcaatttcctcctcctgaaagagacccaggacagctcactgcttagctcaagagtagggctttcattttggccatctgcgtgacagagctctcgtggaatacagacaactcatttaaatcaaattgcacagttggctctaagccagcagcaacgcacccatccgtaggcagccacagaaagggcatggcaaatggaggacaaagaaataacagagaaagagaaatgtgtgcccagggtccatttggacctgctctaaaccccgccccaagtgtgagaagcagaaacaggtaaaagcatatctaaaaagaagaaacacggaaagagatcaagtgcccaggcagggcaagcctgggctaactgcacctgcagatgcgggaagatggggattactaactaccacctgcaggaaagctttccagggagaagaacagacaagtagaaggtactgagttctggcagctagaaagacgctggttttggattcctagcaaggtagttttgtttccgtccctctggaatcctttgtgctgctgagctgggcaggttcgggcaaaacaagcaggagtcagagcgaggctgacagactgaaatggcacctgccctccacagggagctagaggctgctccattgacccccggttgaggctgcctgagctgacctgcacagggcacggtagaagaacaaatacatcctgagggttacttacttctcatctgggtggtgacagacagaaacaagttttccacagacttattaaatcctctgaagtggccaagttcctgtaactaaaatagaaacaggaggctgtgtgattatgtcaccagcggtctttgccctactgtctccaggctgccagcctccaaacactgtaggagtgggaaggcctgtgtctggaggggacaagcccccaggaaataggcatccctggcacgctgccacctttctctgggttttgcagccccattaaaggatggagcattatcaacaggcagttcacaagataactacctcttagatgtaatgactgacatttcattggctcaaagatggtacttggctaattactccttcatcttcaagccctacccaacttccatatagaaggcacagaatgcaggcgacatgggggctgacagtactataggaacaaggtgaccaagctgaacacaaagagttctctccccaaaagggaacataataagaggggtaacagtgactttgtcaaggtctcatccatccatctacccggtactcatgggccatccatctctcggctcacctactgtctattcatgtgtccactatttattcatctgcatctatctactccaactcatctacccatctgtctacctatccatgcattcatccaatgtccagccatctatccatctgtccagccaaccagccagccagccaggcagtttctacttgtctatccactgcctcctcaacactccatatactcatctatttacccacaaatccatctatccatctgtccgtccatccatttatccacctgtctgtctgtccatctgtccaccatccatccagagatcatttattcatacccacccactgactatccatttgtccaccttctcaccatccattcattcaactatctacccacacaacaatcagttatccacccatccaccaaaagatatatctttaaaacatgattgtaggagaaaacagaataggaccgtgagacaccccagggtgtctgtgaacttgggaaagagtgaacacgtttttgtctctcaaacaaacatatatattatcccgtgtaagacataattgatccctttgatgcacagattgatgaagataaccaaagccatacaattccatagcattcagtttccaagtacacagagacaccattctgcacaggggacaaggacagagaaagatttatttctgcttctcaggtggaaagccaagataactccctgagatctcacagctaagttctttgggtggaaatggttctggtccccctggagcctacaaatactaagatatattctcattccagcaagcacagcccccatccccacccccaacacacaacacatgccagatgcacacacacttaaaggcacaggacagaagtggcaacgaacactgaagacaaggatcaagacaagatgtctcggggtacaagcagaaggagccagctgagactgcagacagtccctggccacagaaagaaatggagatcacttctccacctccagctccagcaaagtcagagctgcacactacaaggctgttgagccaactctccaggatcctagcccggccttccttccccgcatcccacccagggactcagacagacaagttaccctgctggagctgctgcactggctctcactgaaaggtggtggtgtcggagggaccacagagattttgctgccaaggagaaacacaagaataatgggttataactacttaagtcactggcttacagatttacaaatatttgagtttatcattcaagctcttagctttgtttgcatctaatattcttttcttttaaagaaaataacgtggcagcttggcacttctctgttcagtgtgtctgggtttgggcacgaggatgtcaccaccttcagcccaggcatcgactgtcccagcacactctgaagccactaggggaccttggctcccctgcccccaccccccagctgctcttggacccagacttcgtatatggaatcctagttggactactgcattcttagtgctaaccacaccagtataagaggcacaatgtgaaaagaaaaacaaaaactcaacactttgagaaaaactggaggaatgagctgaaagaagtaggaacacatgtgggaagggaaaataagagtggaaagtggtgtgctcgcacgcctgtaacatctgtgaaaagtggtatgctcgcatgcctgtagtggtgtgctcgaacgcctgtaacatccatgggggttgcggcaagaagattgccagcatccgtggccagcctggactacacattaatgaccagaccatggagctacatggcaagacaaagaggaggagaaagggagagaaaggaggttgaagggggaggaggaggaagaaggaaaggaggagaaagaggaggtggtggaagagaaagaagaaaaggaggaggaagaggaggaagaggaggaggaagaggaggaggcagaaagaaagaggagggagaagaaggaaaggaggaagaagaggaagttctatgttctaagactggataaatttcatgagcaccaaaaaatgtagcacccacgggaactctcggtgacagtgactaaactcagcaggacagggtgtgtgacctgccgcttcaaggctgccagggactcagaattctgtgcaaagatgtgaacctctctcaaaacactgtttgacagccagtaggtatttttaacttcaaaaatgtattaggtccacgccttaaccaaggaagacgccagagaaaggaaagaagagtggaagcgacttcttggccagatgcactgtcaaagacagtattttgctctttacagcatctcgggagaatttgaaggggaagaatattacatgaaacgcaggatagctagaagactcctcaggagaatctagaagctcctctcaaccttttccaggaactttatcatttaaaaagtcatgttcctgagccaggcgtggtggcgcacgcctttaatcccagcactcaggaggcagaggcaggcagatgtctgagtttgaggccagcatggtctacaaagtgagttccaggacagccagggctatacagagaaaccctgtctcaaaaagaaagaaaaaaaaaaaaaagtaatgttcctgagcagtgacctctgaaggtccaggacttgtgagttctttcagggcgtcctctgtgctcctgctgctaatacgggtgggacgctccgtcctgcactcacctcagcctctgataagattgcaggagcgggggctggtgagatggctcagtgggtaagagcacccgactgctcttccgaaggtccaaagttcaaatcccagcaaccacatggtggctcacaaccacccgtaatgagatctgatgccctcttctggagtgtctgaagacagctacagtgtacttacatataataaataaataaatctttaaaaaaaaaaaaatgaaaaatcaaaaaaaaagattgcaggaactttgccccagcggtctcgcgtcggcctgggggagacaagccaagggcagtcagtaccgagaacaaactgtagataacatacacccaggaatccatacattcaaattgttttaatatcactttggggatgacgaaaatgctcaaaaatcagatggtggaggctgggtgacatggctcagcaggtaaaggccattgccaccaaacctgccaacctgagcttcatccccccccccccaaatccacatgacacagggagacaaagattcctgcaaactgtttctgatctctacacatgcacctggcacacactctcgcgtgcacacacactattaatacatttaaggctggagaaatggctcagtagttcagagcactgattcatcttccagaggacctgagttagattcccagcacccacatggcagctcacaaccatctgtaactccaattccaggctattcgacacctgcttctggcctccgtgggcactcgtgtgcagcatggacttccctacagacaaatcactcaaacacataaaaaataaacagaaaaataaagatggtgggattattgtgtaacttcccatgcattggacaacggttggctttaacagccctggcagccccctgcccctcaatctgtcgtgtctgggaatgtctgcttcagttagaagttgatgctgaatgagattttctaaatctgggtaattcgaaaagttcctcagtgccttcccctaggaaataccgcgtaattgaatgcatccctcaaaatgccccttgtgacgaagacttaacctaatctctttaaaaaaatgtaatctccttaagtctagtcagagtgaccaatgctttgctaaatcagactgcaccagcgacaggagccctgcttgtttcctgatgtattaaatcctcccaaataaaattctgcctgaccacggtttgtgactcagggattcttggctaccagcatgggggtgggggttagggaggcctgcagcacagcggtaggcttgtagctcaaggagatgtctagagcctttacacagcccaatccaccaggccacggctctgggaggtcagggtagctcttgtgttgtttggaagatcttaattcacttcatagatgtgtcaatgctacttacggacacacagacagagcttaaggacacagggacagagagagatgttgagaataccgagggggagggggactctgggaggggcagacaacatctagagttaagccctggtgtcaagctccaaccctcaaagcaggatacagccccagctccaggtctttagctgggctggccccagaaggggcaggaatccttaaaaatcacaaaggatttttgtcttgttttgttttgagacagtggctcgtgtagcccaggctacccttgaatgcactacatagtcggaagaggtcttcaacttcaaatcctggtgttcccacctcctagggcatgtaccgctgaccctggttctatgtagtgagtagtcaaagcccagcttcctacatgtgaggcaaacattctattcaactgagtcttatcccaacccaaatgttttggggcttcataaaagaactcaggaccctacatgcaatacttctccagtgcaaacaataggcctctcccaaaggctggaagttaaactagaaagcccagctagcagtgcctggagtccccagctgcctggatggcaatgagacagacaacttcacagcaggatgggagtgggcacggaggcaggggagagctaggaaaggggaagaaagagagagaaggaaaatggcaacattgtataccagcctggctgctggggcacataacgctctgagcacctactccatggtccgtttaccttcccttagactctcttacccgtgtgtccttggatatctgtaatacctggcccagaggcaggacccccaaggcactgttgtcccccaaccccaaatctgatgcaatcattctgccacctgaaccacaagccccatatggtgtccccatggtgttcttgtcttgcctgggttcctccacatctgcatcccttgctttccctctctgctttcttattccccggtttccctgggccatacctgacctctgtctccgcaactactgtcacctccacctcgtttctttgggctacttccccaggcagtcccacctcaggctctttttctcaaaccctctaactaacccccagcctggcttccatagttcatgttcctcctgcggccaatgacagtggtcttctgctgtgtggctagctctctgctgccccctgctggctgtggcaagctgaggcccaagacagaacaagaagaacttctgctctccagtgcaggaaagatgactcagtggttaagaacagttgttgctcttgcagaggacccaggttcagttctcagcacttacatggtggctcacaaccttctgtaacatcagaggatcttattctatctcctgacttctgtgggtcccaaacacgtgtgtgatacacattcatacatgcaggcaaaacactcatacacataaaataaaatacttaaaaataaaaaagcctcttagcttactgttgtgttttataaaaagataaagatgaagggggagaatatgtttggtagatgtgtggtcaggaatggggggagggggctcctctgcaggcccatgctgagagaccagccacaggacagaggacatatagaatagagtttattcagagcatggcgagggaagctgagagggtagtagaggcagagaaaggtgggggtggggtgggggtggagtagaggagtagaggccggccatgagcacgtggagagagagggggaaggggatgagaggacagagtgagagcaagaaggccttaagctcgagacagcagagggggcgagcagccccttctatagagagtcaggcacgcctgccattgccaggtaaccgtggtgcagagttcagacaaaatgctaacacttacaacataaataaatctgcctccgatccacgtgtagggaaatgggaggctatgcagagccccagatgccccttcccttgtaggtcagaacctccagggtgtgagaccctctggtgagggtgactgggtgcacccagggatctgaagtgtgctgcctggcaaggctttgcttctctcccgttcactaccatttccctgagctttgcttttaggttttcaaaaacactaaatatgttgtcgttgttgttgttgaagtttctaattcctgtagtcccctgaaggaatgtgcacagataacattcccaggagttcagagagaagtaggactggagagacccgtctcctgcccagctgcaggcaggaccagctcccagacagccagggctccttgtgagaccatgtgactgatcgtgagggcagttggagaatgtgcaggcacacaggcacacacacgcgtgcacacacacacaatttttaaaagatttgtttatttaatatatatgactgctctttctgcatgtacacctgcgtgccagaagaaggcatcagatcccatacacacacacagttttcaaacgtgacagtaataatttcactttggtgatattattcttcccattttcccaagtcaacgcccggaaccacccagaatgaaactccggggccacagcttcctctgaggggcagggagtaccctgcattcctagacacttcccacaaagcccactctgttcccaccttaaagaatagaccctgggggaaacagaacttctgcaggcagatacagagaggaagccaccacagtccttatcttataaagggaacttgaacccaggctggacctccacacagtgaagacaaaatggaggtagctgtgtagcagtggaggcagggctggggtaaagcttctaaaagccaaggacaagcaggggctgcagagacgagggaatgtacgccttcacggacaccggctaaaacatcaaacaacaactctcccttgcttggagctgtgaaaatgacaaaggccacagtgcttttttgtggcgccttcctttccaggttcacctgctgccactactgtcccctatacttggtctggccaggtgagtgtcccagacacacagtgcctaacccatgtttcatactccccctaagcatctctcactggagctggaccttgtctgtatctctcgtttctgtcttgctagaggtttgtttacagagacatgatgactgttgtatgctgttttaactgtcagctcgtcacccggaagagaatttcaatggcagaattgtctagatcaccaggctggcctccgggcatgtctctgagagattgtctggactatgaattgatgtaggaagagccagcccattatgagcagtgacattccctagtttggggcccaggattgtatctgacggaagaaaggtataaaaaggtataggtataaaaagcaagcgaacaaggacgcattcaattctcttgactatggattcgctgtggccatctgtttgagtctctgccctgacttcccttcagtgacagactgtggcctcaaattgtgagccagatgaattctttcctcccctaaactgcttttggctgttgttatcacagcaacagaaatgaacgtggacaatgagcgactgtcgttatgaggctggtcactctcatacaatggctactgtacagacttggacttaagtccctgtgccttccccacaggaagctgtgtgtctgctcatacacccattcgattgagaaatctgaggatatgaccctctcttattcatctgagctacacagaaggcagctttccatgcaagaatggtgctgtgaacatagcgttgatagcagccgacaccatctgaatagtaacacgaaggcttgttaagtctgcctgacaactcataggaggtagcccaagacaaatccagaagccatgaatctgggggaaaatggaagaggatgggggatgggaagggtgggtgaggatggggaggggtagggtgggtgaggatggggaggggaagggtgggtgaggatggggagaagggtgggtgagcatgggggaggggaggagaagtgtgggtgaggatgggggaggggaagggtgggtgaggattgggaggggaagggtaggtgaggatgggggaggggaagggtgggtgagaatgggggaggggaagggtaggtgaggatgggggaggggaagggtggtgaggatggggagaagggtgggtgaggatgggggagaagaagggtaggcgaggatggggaggggaagggtgggtgagaatgggggaggggaagggtaagtgagggtgggggaggactttacagagttgggaaggagaaggaaagggccagggggagagaaaccaggatgcattatgtacgtctgtaaaattgccaagggggggagggtgagactctgctttgcgatacaaacattgtctttgatacaaacattggataaaagcagaaaatgtaaaggctggggtctttatctgctgatcatgaaatctgacttgatcatttctgctctacccagcttcactggaacagtctaaagttcctaagttcaggagcctgacaggcaggcgcccagcatgcatgcctgcctgcctgctgggaacagtgcttctaagactcacagttcactctgaggggctgagtctgcagtccttccttttagaaagaaaaggcgcaatcaaaaccaggatcgtatcttttctttaaaataagaaatagagcgttttacttcttgaaaataaatgtaatttcattaaagatactaataggagagtggactcgcacaaactattggccataggctcaaaactgcctttgccgactctgatgactgaggtaggtggcattcactgagtgaatagtgtggagagacacaggcacagccttgaattcaatttcacacatacttctatctctttaaagatggtatcacacttaaatgttttgtgctttgtatttgtgtgcatgtgtgcggcacattttgggagtcaattctctctgcagagactggagaccaagcataggtcaccaggcttggtggctgggccatcacaccagcccaagcatcctgccgctgagctacagccccagcctccacctctctcttcactaatgcatctgtgtgcttcaaacccacactggtctgcttctgtcttcaaacccttgtgaccaggtggacactgactaagttgccggtgtagaataagaccctcaaaagctatagcccggcatggtggcacacaccatctaatcccagcactcaggaggcagaggcaggcggatttctgagttcgaggccagcctggtctacagagtgagttccaggacagccagggctacacagagaaatcctgtctcaaaaacaaaacaaaacaaaacaaaacaaaacaaaaacaaaaacaaaaacaacctcaaaagctgaatatttgaaagattaaaccctgcttgctaccagaagggggtaagcatttctgtccctccataatggccagaagcaaagccatactggctagtgacacagtgagccacagagacacagctgagggtgtgtggaggaccaaccttcctaagtcgttctgtttccagttattaacaatagagattgtttacaagtaacatttaccctcttttaacttgagaaggagtagtattaaatattagtgttacatattaagtcctgatgttgctttctgatacttttgtctttgagacaggatctcactgaaaccacagatacacaacagatacacttaatgcttgactttcatctaatacatacatacatacatacatacatacacacacacaaatgtgtacatatacatacatgatatatacacagacatacatatgtatacatatatacacatgtgtgtatatacattaacatccatgtatatatacacacctacacacatatatacacacatgtaaacatatatacacaatacatgcacacatatatacctacatgagtatacacacatacttttttttaagtcaatgggtcaggtagtccaggctggcttcaaattcgccctgtatctgaagatacccttgaacttctgatcctcctgccatgtacctaagtgctgggattacaagcgtgcacaactgtgcctccttttatatggtgcagaggatagaacccagggctttgtgcacattaagcagacactctacaaactgtgtgtcctgtttgtagaacaaatcaaaagcaccaaaggaaaatgtgcacttacagcaatcagccacaagatggtgccaagagtaaaggtggatttccagtttcagctttgcaattactagtgacctaagaaaaggcccaccacaattaacattgccactttactagtggcacttgaacccacagtgttcataaagaacgtcctggggacctgcccaacacaaccctgtccaggagccactgacccctgtgtttcactgaagtggaactttagcgtgtgaagccagcagctacaaacttggaacattttcaattgatggtgaagccagggtcccagaaatcacattaagaaacttctgcacacactaccaagtcctgcagacagcagatctactgggaacactgccaggacagccagggaagttccccaaagacactttaaagttgtgaggctctggacacaagcttctagtggcacagataaatctccaaagcacaggtacggaacccgggctggcgagatgggtcagcagagaagagcacttgctgctcttgctgaggctccgagttcagatcccagcacccacatcaggtctctccagtcccagggtaccaatactcttcttccagcctccacaaacaccacatatacaaggtgcatgcacatacactcgggcacacacatgaaataaattatttctttcataaaaaccatgaaactaatttaaaagttgcagtgtatcatcagaaaaaaaataattcagccaaaggaaccagatgttttctgtgccgagtgggaaactggagctcatttttgctaattcttagacctttatttatcatgtgtgtggtacaatgtatatacatactatagacctaagagggggtacatgccttgcacactcatggtgtgcacactcatggtgttggctctgccactcccaaccatgttctcttgtgacaggttttctcactgaacctggagtagactgggggccaggaagtcccagcaacccccaccacggtcccgtggttactggcatatacacaatcaacactaactagctttttatcagatctgcagatttgaacccagaacctcataattgagcagcaaatgttcttccctaccaagctgtcttgctgccccccttgagtctttttgaaggttgggagcctggtacaggaagtgtcaccacgatccagctctagtactctctattattacttgcatctagtctactttagtggaaacattggtagcatttatcgtaaatggctctacctgataaccattaagggagaaagaggtaaagcagatacaaaggaaacctgtgttgcgagcgcatggatccatggaattgcagctaaacagtgctaaaaagaaagagcatccaaacgtagcctgaggtaggaactcccgcctataacacctgcctttatcatcagatagtcctgtcttgtcctgccctgtccgccactcacgaccacagcttggctaaacaaaggatgggacatggccattggaaaccatgtggtccacgatgtttaagtatctggaaaacattctttatgaagtactatacagagaaatgccaggataaaattaaagataagcttctcccagttacaggaattaccctatgaaattgtctccaatcatttctaaacctgtctcatgtgattcagctaaataagattttaatacattaagttaatgtattaaaataactaaacccattaagatttctagtacactctagtttagtgggggtgggtgtcacaggacaaggtgtgggagtcagccccccccatcatgtgggtttctgggattgaattcaggttgtccaggctgttaggcttggcagtgagcatccttcccccaaaagtcatctcactggtctctggttgttaaaatgtgaatatatgtacaggggagggcacaagcccacatgcacacattgggggtaaggaatgcgagggggggggagcacaagcccatgtgcacacatggggggaggggatggggggagagagcacaagcccacgtgcacacatgggggggatggggggagagcacaagcccatgtgcacacatgggggggaggggatgcgggggggggagcacaagcccatgtgcatacatgggggggagggggggagcacaagcccatgtgcatacatggcggggaggggatgcggggggagagcataagcccacgtgcacacatgtgggggggaggggatgtgggaggggagagtacaagcccacatgcacacatgggggggaggggatgcggggggggagcacaagcccatgtgcatacatgggggggagggggggagcacaagcccatgtgcatacatggcggggaggggatgcggggggagagcataagcccacgtgcacacatgtgggggggaggggatgtgggaggggagagtacaagcccacatgcacacatgggggggaggggatatgggggggggaagcacaagcccacatgcacacatgtgtgttcagggttggggggggaagaatactgaagtaacagaatatttgcaactgttttctaggtgaatttgctatgctttcaacatttcccctctgccttttcctcctccttctcctctccttctcccctcccctcccccttacccctcttctttttttgagggggaagacagaacccagggccccacaattgccagtcaagtattctaccaagccttgtccccaggctgcctctcactttcgaatttttaagtgaacacagagtatcgtcaaaacaaaaagcacaaatggaattagacatcatgcttcggagagggctgccctctctgggaaaaagcagccggcccaccctgccaggcataccaaaagaactgaccttcctagacggtgctcgggcaaaacatcagaaccctttcaggtgtccctgcctccagccagccattctgcccctacgaaatccgcccaagggaatgacatagaactgccaagatccctgtacaggatgttcaaacatcctgccccatgaggaccaaatgagccagaatagtcgctggcagtggggagaagggtaaatgaattggcactatatctgatgtataaagtcgtagatacacttcagagatgtctgcggtggtttgaaggggaaatacctcttgtaggctcatgtgtttgaatacttgggcccacttgatgatgtgctgggggacaggaagctatggaaccttaaggaagcagagccttgctggaggtaagaatatgggctttgagggttaatagcctggtcccaattcctgtttgcactctctgcttcctgtacatggatacaacatgattagccagcttactgcttctgccactatgccatgccatgcttgctacctggaaccataagccaaaataaacttcttctcctccctagagacaggatttctctaattgtgccagctagcctggagaggctctaagacagagagccatccgtctctgcctcctgagagccaggattaaaggcatgggccaccaccaccacctggccaaaccccttcatcttaagttgtctttggtgtgagtgagcaagagaaaagtaatgaatccaatgccatcctgcccagctttcatgagttgattcttggcttccaccatcagggtcacaagggttgaactccggtcatcgggtttagcggcgagtacctttcccatgagccatctcacagggtaggttaagacacttcatcaaggtttatagagcactttatagagcgctgaagggaaataggaaggaagccactgcattctttttctagttaaatgtgcagactagagtcactaacgggagtttctgcttttaactcttaacactactatgtttagtgccagagaattgatgaacgtgagtattctagcagtataaagaagaaaaccaaagatcaactgttgagcttactaaagactattgataaagattcaaaactctgccaaagagaagaagaaactgctaggccaattccataagcgtcattcggacatcttcattgagaattctggagactgagtttctaatgcctatgtgtatgtgcacttgtttgtaaaggcaaattatgcaacctaaagaaaatttaagcttggatgcctaaatatgaagttgtacttaataaaattttatacccatatgtgtcaaaaatgtcatcctgcccctggtactcaggtctccttcatgtgaccccagcacattacctctagtataaccccagccactgaccttttaaatggaaattctacttgatctgagttgcatatgaagtccttacagccctggttaacagactgaggcagtaagccttggggacaacagttacatcaggcaaataagcccttaccaaataagtaagctgaagacacatggtggcattggctgcttgtcgtcgtcccccccccccactcccctgtgaaccctgctgtctatcactgcttacgggtgactgcttaaagttctctcatttgatgttatacatcggaggccacctccgttcatgatgcagaagtaaaagccagcatgattgtctcaaaagctctgtaatttcttgtcttgacaattccaagaccatgaacctttttttttcctttcaactaaaaaacgtaacaccaaatattttaaaactaggaaggatcattttacacgggttacagttttaacagcatttacctgcagttggaaatttcctggctcgttcttcaaagaaccattctccggttttgattttcacgtttctgaaaagcaaacagaatcatctgtttcagagaggtgctccactctctgcctccaggtgacttagcactcactatgcagcccagcctcaaactcacccctgcttcagcttctcaagtgttgggataatactttttaaacaatagcactattttaagtgtgctttgcctgcttgcatgtcatgcatcatctgcatacctggtatcttcaggcactagagtgccagatcccttgaaactgaagttaaagataatggtcagctacctggcttgcccctggcctctctctatgtagtccatggacatccaaccttttggcttgaggaagaattgtcttgggccacacatacagaagtatccaacccaaggtcagctttgagtgtgacccaacacaaaattctaaacttattaaagacattttgagatttttttgggggggatgattttcttttataattttcagaatgctcaaacacactgtcctagtttgctttcagttgctgtgacaaacacctaccaaaagcaagaaaggatttgtttggcttagaggttatagtctaccatcaaaggaagccagggcaagaagtcaaagcaggaagaagtagagaccacaagaaagaatgtgctaactggcttgttccagatggcttgctcagcctactttcttagacaacgcaggagcacctgcctaggggatggcactgcccaccgtgggcttggcctttccacttctatcatcaatcaagaaaatgccgggcagagcagcccacaggcaaagccaatggatacaattctcccgttcatgttccttcttccaaggtgatttagtttgtgtcaagatgacaaaaactaaccagcatggggtctttgtagatgacaggtgttgtgtctagatatcacataaatgtacatacatccacttgccacacaagagccacaggttgaacaatcctagaaggtcctgccctgcctgatggaggctggaattaaaaacatcaagcacctggcactccatctgcttccagaagcaccagcatccatctttacagccttcaaccctgctaatgcccaattagcaaatgagagataactgttgaccgtgctttgcaaattccagcacacagatacttcctgagggggaggccggaggagccgagcagataagctattttgacctcactgctttgatcaagcagcgaattaaataggcacttagggggtcgcgtctttgcatctgcaggtggggaagcagttatgtttatgttttatgtgctgagaaaggtcacacgaggcagctccagagacgctgaggataactttttcatcattccacaggaggtagaagatgggtctgtgtcttcagaattctttgagtgcctaaagcagcatgctctgcaggtctgctctctggccaaggccctgatggcaaagaagcctcaagaacactcccaaagagaccctggaggcttggcaggtgctcaggcagcaaaaactccaactgtgaaacagagtaacaggtgtcctgtgtgggcagacccgtccagcctctaactcctgctaagagcaagtctgtccattcccccagctgaaaactttccttcaaacaaacttgggtgctgactcaaattagcgtgggtttgttttgtctgtccacaagcccagctgagctgctcttgaccgtggcacaggaaaacagaccggatgttagcgattaaatcctaggcgactatgagaaactggacactcgtgacgaagatggagcaatgattttatcaattcctcttgcaaaacattccccagtgtccccctccctaacctcagggcctcagagacacactcacgggaccaagtgcagtgagaataaatgagtattcctgtctccagggagtgccctgagcaaagagggataaggtaggctccaaagctgtgctttggtgccttcaaaggggtttgtgctaccaaaagaacagtgctaagggcaccagacaagcacttgtgtgcttaatttatatgtaagtgtgttttatccccatgtaagtatctgcagtatgcacaccatgaggtttgagtagacagcaaagagcagctggcaaaccgccacagacaatatctgcagggcgtggaagacctgggagccgccatgctaagccagcctcaccatggcaactagaaaggactagcagggagcagctgctgtggctgctgcctccaggcaaaagagccccaccacagcaggttatccaggcgggagtgaggggcagggggcggagtgcaggggttttaggacactgaccaggcccaaacacagggatcactgtaagtaaaagaagatagaagacagaactaaaagaattgaatcagccaagttcacactgagttgcttcagttcagttgctttccctgaacacaaacgacaacaaagacataaaatgcagaggggagataacacacatgaatgaagtgtgaggccaagctgcccactgaaactaactttctctgtctctgtctctgtctctgtctctgtctctgtctctctctggcctggatttggagcctagtggtagaacatttgcctagcctgagcagggttctaagttcagctctcagtacaaggaagggggtggggtaggggagaaggaggggagagagagagaagggggagggaaggggagggagaggggagagaaaggaaagaggagggcaggaatggcacaaatgagaaattgaaataatcaaattgaaaagaagtaaagggtgggtggctggcgagatggctcagcggttaagagcaccggactgatcttccgaaggtcctgagttcaaatcccaacaaccacatggtggttcacaaccatccgtaatgagatctgatgccctcttctggtgtgtctgaggactgctacagtgtacttacacgtaataaataaatcttttaaaaaaaaagaagaagtaaagggtgctgatatagaaatgggcaaactcaagaagctgaaacaccaaaagttcagagggtgcctccttggtccataaagatcagctggaaagaccaccttccccggacaagcttaactgtaaggaccggaaactgtgcattttcagggcataaagaatagtggtaaaccagggcccattgcctctgtaatattacattccaaaagacaagaagatatttgttacatttcttgattaaaagggcaagacccaggattaaacacccagcgaggtcactgaagtccactgacttggaaaatgcagccttcagcagtgactgtgtggcgagtgggcagttatgggaaccggacagacccgactgctctcttatgagaggggcactttgttggtttccaaagaccattaagtatgcatttgaatcaaaaagaaattccagaacctaacccaccattggccaaacagcacaatgtaggagggatttcagagcatatctgcccaacatcagctttacgatccagcagaaagaccagggcagcataaaagagactcattcatgacaatactgaaatggctgcatgagtgaccagggcagaggctgaggcatctggagccagtacttcatttatgacgactgctggtttgggaatacaccctggtctgtcttgtgaacacgaatatgttattatggaaatccatatgaaaacattgtctacagaaatacccaccccacctgcccagactctcaactccacccctctgtgaccttgagtgcttactaggtagcacttggcctgattatcatgcaagtgctagcctgggcaaacagtctctttgcatggtgaccggcttcagctgaatgaagtagatgacaaccgggagagcaaaccaaagatgtaattaaataaaaagctcatgaattctctaaagggtttcaagcacactgaccacaaactgagcctggccttgaatagaaatggtcactgcgatcatgttctccctgtgcatgctggtgtgagcctactaatcctaaccactcaagaggtggaggcaggagacttgtgagtttgaggccaccctggacctgaactacctagcaaggccctgtctcaaaaatgcattctctttattaagcaccaaaaaggtattctagggttgggctcagtgggtacattggtgccgagtttggatctctagaagccacataaagttagacgtgataccttgagcctataatcccagcactcccgaggaagggtcaaattctcaggagctcagaggctggctaccctggcatacgcggtagtgaacgttaaagaggtcctgtttcagacaaggtggaagaatggaagacagggctctaaagacccctcagcggtgcatactgctctccagtttccggtacccatatagggcagctcgcaactatctgtgactccagctctggatctgatgcccctggcctctgagggcaccagcatttgcatgcacacactccaccccagacacacacaacaaaacataaatctttacaagacaaagggagaaggcgaagaccaatacctaagggtgtctccactgatctccatgtgtgaacacatttacacacgtgtacacatacatcaacacgcacactcccacacacaaagatattctatcattttggatttttgtttgcttcgtttgttttggcggtgttgttgtttgagacatgatttctctgtgtagtcttgactgtcctggaacttactctgtagaccgggctggcctcgacctcatagagatctgcttacctctgcctctgagagctgagaatgaaggtatgcggctccactgtccaacaatttctacctttttactgtctgctttgtcttcaagactttaaagaatattaaaaatctttactttctttttatacatgaataaaatatcatgaccctgtaaatagtgtccctgctctcaatccaagcatacacatgaagtgaactgtgtcacaccgtgagaactggacatataacactgccagttaggaactcttcctggctatgtctgactatgtgaagtactttatagacgatccctgacttgtctatacctcatgggaaacacgagggtctggagacagagctcatggaaagtcccggggtccagccccagcccgctgcccccaagcaatgaggctctggaaaggaggtctctgcccacagtgctaccagtgggctttgggaaagcctatggcgtttaaaacaaacagtgggcagtgaagacactgacctctatcctcagcaccaattaaaagcctgcttggacgtgcccggctgtcactttgctgtcttttcagatggctggtccttcctcacagagtaactgcatgcacagacaaagagagaatatgacatctctcacattcacaatgggtcacatgcctttgcgggctgaaagtataaacaatggaattatggaaatactgagggttggtctgaaatctatagggttccccccatcccctaaactttaggaagtttaactttaatacaaaacataattgttgcaggacctttgttaaaatgtcacttgattttcaataaaacttccccatgccatgcagaaaacacaacatgccatcccgtaagagcacacttatgtctgatccaaatcccaactcagcaggatctagtgatacgggcctggagtcccagctatggcagaggctgatgcaggagaatcacaagcttgagtctagactgccaggacaaaggacaaagccagggaggcttttaactagaccgtggctcaaaatgtaaatataatcacgtaaactcatgggtaaatataagcacgtaaactcagcctggtgatgggcacttgcctggcacatgcaaggctccactccccaagtcctaatctaaaaagtgatttaatctagggctcagagggcagtatactggccacgaaacaaaccaaaccaaactaaccaaacaaaaacccttaagtaccggaattcagctccctaccacccatatacatgttgggtgggcgtggccactccatctataattccagcatacagaaggtggagacaggggatccctggaggaagccggctagaagagcgcagctgatgagctctagtgtcaagtgagagaccccccaactcaacatataaggtggaggaagacacctgacatcaatctctgcccgccacgcacacatacacgtacacgtacacacacgtgctacaaaagaaaaggctttctgaaccaaaccgagtcccttctaacacatcccagaatcgtatggcaatggtttctgcttatagcaataattcaggactgggcggatgccaggtcagctttctactggactctctcaatcccctctcctctgccatcatgatggtgcgtccaggacactgcagccatccagaacagagctccagaacatcagtaccgactgctgcagtctggaactctccatctcaaactctgtgtgctgtgctctatgtgaacttgacacaggctgaagtcatctgaggcagggagcctcgattgagaaaatgcctccataacattgggctgtaggcaagaccataagacattttttaactactgactgatgtggtggggtctagcacattgtaggtggggccgtccctgaggtgggggtggggagtggtggggggggggtccttggttctataacagtggttctcaacctgtgggtcaggaccccttaaggggttgcctaaggccatcagaaaatacagatatttacattatgactagcaaaattacagttatgaagtagtaaccaaaataattttatggttgggggtcagtacaacacgaaggactgtaaagggtcaaagcattaggaaggttgcattaggaagggtccccaacccctcagcttctggagaaagcagaattacaaggccacacttgcagagcattcctcttgctctatcagcacagtcttccacctcagaccaccagatgacagccatagtattgttgtggcttctgtgggttagagttcactttaacagcagtccccaggacccaggacagaagcagaagctttccattgcctctcaagactaggcttctccagggctgcctaatcccagcaggcagaccaggatcaataaagaggagccgaggctccaggctctacactgcttcacagcctcaggcaccctgccctctgcttctgcatcccctccaaaatgtgggcagcagtaagtaaccgcccttaaggtaggttggagctctaagcaaggcttaaaaggactttcccaccactgtggtctgggagcaactggcagctctgagtctggctccccatctctcccagttctgagctcttggtctcagcagatctccaagagaaaacttgccctgaaggaagaagtcggctgccaaatatctggggcctccagcagcttacagtcagcacacttcaccggccatttgctctgtagaaatttaaattgtataccattctttaaaaagagagtagttagagacctgggacaggggagactcccaggagtctatgggggtgaccctagctgagaatcctagtagctagggatactagggatacggagactgaagtggcctccccctgtagccaggcaggacttccagtagagggaggggacatcaacccacccacaaaaccttcaacccaaaatttgtcctgcctacaagatgcacagggataaagatggagcagagattgagggaacagccaaccagtgtctagcccaacttgagacccatcccatgggagagagccaatccctgacactattagtgacactctgccctgacactattagtgacactctgctatgcttgcagacaggagcctagcataactgtcctctgagaggcttcacccagcagctgatagaaacagatgcagagacccatagccacacattaggtggagttctgggagacttgtggaagagtaggggataggattgagtgaggcagaggggccaaggacaccatgagaagatctacagagtcaactaacttgggcccgtggaagctcacagagactgaatcaccaaccaaagaacatgcaggggtgggcctaggccccctgcacacttgtagcagatatacagttgggtctttatatgggtcctctagcaattggagcatgggctattgaaaggaaataaaactgtaatccatgtaatgtatgttaaatagcccaaagagttgtttctgagctttgaaacctggggctgaaaacatagcagaacagaccaggacatgcccgggcaagcccatcgcctccctagctcccacccctctgacctaagttaaatgttacaggctgctgatgtttaaatggaccaatgatgtgaaaccgcgccaattcctcccccagccccactccttttctataaaaacccctagcttccaagcctcgtggtcgaatccactgtctcctgttgtgtgagatacgtttcgacccggagctccgccattaaaaaacctcttgttgttacatcaaggtgttgtgttctattcgtgattcttgggtgcacgccgaatcgggagctgagtgggggtttccccactgagttctttcactatcagaccattggctccctttcccccatctggagtgcctggctaggcctcagtgtgagaggatgtgcctagtcctgctgggacttcacttcccaagggagggggcagaaggggaggggcttgtaaggttaagactgagaggagaggggggaggggggctgagattgtgatgtaaagtgaacaaataaattaataatgataaaaaaaaagagtctagctgggcgtggttgtgcacgcctttaatcccagcacttgggaggcagaggcaggcgaatctctgatttcgaggccagcctggtctacaaagtgagttccaggatagccagggctatacagagaaaccctgtcttgaaaaaacaaaaaacaaaacaaaacaaacaaaaaaagtctcactcctgcatagcctggaacttactgaaacccaccatgcctgccccttctttgtatacttttaattggcacccccaagtctccctctttcttgatttaaaaagtctagttccctcattcagttcttttttttttcttttttttttttctgagggaaaaagcaaggggaagaaacgtggttggaatcaagaccctttcctaggtcccatgtgatacagggagatggcggacagctaagctatgcagggtggtggccccaagaggacagagttggagacaggcgtgaggggtgcaaagaggagagagaaagccccacttgctgcaaattagcttctaacatggcttccttcatgaacccacctggagtgacgcaatgattgcaggttattttgaaaaacatccttattgcaaaataaggaagctgggggttatagacttgactatagctctgtgtgtttagcgggtcaggttacagtgctgggcaggatgccctagggcagagatttcaacacagagctccctcctaggagagcaccccagcccagcccttctttcttgatctttagtttgcagttaactattagaagggcttgtttagagcctgtattagggttgactgtagtcatccaagccaggtggctgactgagcagggaagggagtccttggaactttctgaagatgcactcccctctctaggcccacacccacaccatgtggtcagggtagctatggtcctgctgaggggtttttctcttgaactaagaaaacctgaaggatgccttactccagccatcccaggaaagggggcaggcgatccaggacagggccataggtgccgtgacagaagggacagggcagagcgccttgcacctttgctggatgcctgacatgcattaagccttgcaaagggacagaaaaccaagcatcaatgttagggtatccaggcagacagccctcctggtccaggaaggaaagccaggcttatggtgctctgtgagtgtatgcatcttccacgatctggtctagagacctctgacaggagcagtaatgctttacaagctgctctcagaccagagtgcctgctcactctctcttccagtttcatgttctcaagacacctacaatctgctcttacatggaatggtgggacggcaggtccaatgtgctcttagttttcgaaatggcttgttgaaagacaccatgtctatgtttaaaaacctcagtagcaaccaggtgctacaacacacgcttttagtcccagtacttgtaggcagagacaggtggatctctgagtttcagtccagcctggtctataaactgagttccaggccagccagggttacatagagaaacccatctcaaaacaaaacaaaatctcataagagatgtctcactgtttaagtgcactggctgctcttccagaggccctgggttcaattcccagaatccacagtggctcacaaccatctataattttagttccagggaacacaatgccctcttctggccttcatgggcatcaggaatacacactatgcacagacacacatacatgtaaaatatatagcagtagactcagtaaatgatcaataggtaccattgatttctgtatttgaaaccacttccctcattcaaaacacaatcccagaaagcaactcaggaccttacttgcatccctgcagttattccctgatacttttcctgatggggatgagggctgagaaaatcaagacattgggttgggtgtacagtggccccgaaatctcagctcttgaaagaggctggaggatcgggagctcgggaccagcctcggctacacatcttgagtttgaggccagcctgggtttgatgagaccctcttttaaaataaacaacaacaacaataaaaactaagtcaatagtcgagaaatcccaaaaaatgacaagttatggaacagtctatcatcagtcaccaaacattcataaataaagatgtcttatgttttatggctgggtatgatggcacatggctttaatcccaacacgcaggagtcggatctctgtaaatttgagggcagcctgatctatatatcaatttgcagattggccagggatatacagtgagaccctctctccaataaagtttacatgataaagccatttttaaatttaaatatctcctttccatctgtagcttatgcagcctgggaatctatgaatcagacttggtatgatggctttcaggaaacacttactgatgactgaggtgtgctgggccatccctgagtcctgggtcagaggagaaacagagcactattacacatacgaacacacgcacaccctacccgcgatgcttacctgtcctcaaagcaaaccgtgcacttccatgcacgagtcctccgcaggaacacacggcactcggaacacacgcggtggctgcagccctgacacacggccccacggttcagcagaaggcccagagcccgctggcaacgtgcacagcacttttccttgtattcctggctagagctcttcgcccccttccaccgaagatgctgcaggtgtgatttcagtttcctgtgacccaacaagttgaataatgattggttggtgtaatgatttgttgtcattgccagcttggcataacctgaaatcatttgggaagagcctcaacaaggatcgtctaccttgggttggactgtggacgtatctgtgggagattgtcataagttaattaatgtagaaagacccagccactgtgggtggcaccatcccctagacagggcatgaattgtatgagaaggagaaatggagtggggcaagcaagtaagcaaatatgcattggttcctgtctgctcttggccatgggtgtgatgtgtctggctatttgaagtttctacctggacttccctacaatattgggtggtaacctggaattataagatgaaatcagcctctttttccctcaaagtgctttttttccccccagggtgatttttcatagcaacagagataaaactcagatttatgaagctaaactacaggagcctccacagcgccttaccctggtctctcacctcagccgtcgaagcctgggctcaagcgaaacagtgtagatcccagaggcagctcaggctctgcctgccctttcagaataaaaccttccacaccagtggccaagacactgttactattccaaacagctattctattctaaaatccaataaagttccatttttctcggtctgttattatcccagtaaatcagagtttacaagtacgtttaaagggttttgaagtaaaggcgggaccaggcgtggtggctcctccctttaatcgtggtgcttgggacaaagaagcaggtggatctctatgagttcaaagtcagccaggtctacatacactgggagttctgggaactcttagtggaaagagagcttgtcttaaataaataaataaataataagcaagcaagggaaaaaattgtatttttggctaagcagaccatttccttccttaagaatgttattttacgtgtgtggtattttttttcctcgtagatgtttaacatgcatgtatgttagttcgtcatgggcatgctgtgcatgtggaggcccgagagggtatcgggcccctgggcctggagttacagatgattaactaccatgtgggtgctgggaatcaaacccagaccctctggaaaagcagccagtgctcttaactgctgagccatctcccctgtaactctggaaaagttctcctattaaaaacattcgtttgtaccccctgcttggtgctgagactgaatggtttctgatgtgctaagcatatctatgctcaataacctgcttgctttcaaatatgcctaaaagctgggagctgaccttaaactctttttttttaatttaaaatatttagatttctttcaatcttgtgaatatgagtgttttgcttgtatgtatacatgtgcaccacatgagtacctggtacctacagaggccagaaagggcattggttcccctggacctgggagttacagatggttgtggcccatcctgagggtcctgggaattgaacccaagatcctctgcaagaccaaaacgtggccttaactgctgagtcatctctctagccctgactgacctgcgtctaccccccaggtagtgagatttctggtgtgcctcgaataaggaaaaacaagctctatgtatttacagagggaacctcccagctaacagggaggttctgaccatgtccagagctgccagtgagcacaaacagctgcaacccagccaggccagaaaagaaggtcctgttgatacagggacagggaacaggcttagcaggttcaccttcctttctctaagccagccttaaggcaaaagcgaacaaagagaaaagacagaaatggattctcccggttttctgtttctgacccccaacccccccgatttgtgcctccaggtaccatagaaatcaaggtggggaaccttaactggatgttttcccttggggggctgacagaagcttggcagtgtttctttagtagctcccacaaacatcacaaaggctcctttttccaaagaattgtgagattaatttagttctattgcaaagacaatccccatgccttacaccttcaatgggcttcgcgtgggtgagaagcttagccctgagctggcagtcacaagaaagccaaggagcagagccaagcctctaagcagaaaactccaagccctgttggaccgccccgggtcgaagcgcagccccaggtggaagcgcagcttaccggaccctttcctcctcggtgctttgaacagtttgatcacgatataggacacggagaatgatgtcccgttccaactccttgaaggactccaggtccacttcgtgggccatttccgatagaaggggtccactgtcctgtggagaagccggagtccagcccctctctggtttcactggtgactgtgtttgacgtgtggctcttccttccttcctaactgggtcatactccttcagagaagcaaaccccacgaggctgccccacggctggagtcgcttccacccgaagagtgttttcactgggctctgccagatgagacaagcgcgtatctttttctgaggttttgccagagattgttataaatgatgcatggctgctgagcagataatttctgtgaagcgctagtaatctccagcctgaggaagttgaccagcagtcatgagagagccctaagacttagggtagcaaaatttccccagaaaaaatatgtccaggtcagcagaagtgacagagtccagcctgattaatgccttaaaacctgtttaaaaaaaaaaaaaaaaaaaaagacaaagaactaacaaaagccatcatcggtttgcccggctgcacacctgtgcaacgtcactccagaggtgagaccactcaggacagacacagcttggcgttttcagctatgatttttacgtgccgttgaagaagacatctttcaataccttgtataatttctaaacttagacattcctatcaaaaatttggatcttcagttgtgagaggacagagacccgagtttaatgttaacatctattgtttaatgttaaccattccatcagtgcaaatattagagagttcactaatttagttacatagacccagatggtctagcctgctgcataccaggctatatgtatgtatgtaagtatgtatgtatgtatgaatgtatgtatgtatgaatgatatagcccactgcccctggtgtgaacagaaccatacaggattaaatcaagcatgagagaaggggggtaccactcaaggtgtgcaggggtcggtgctagcccagtagttgtcaaccttcctaacgctgccaccctttaatatagttcctcatgttatggtgatctccaaccataaaaatcattcaattggggctggtgagatggctcagtgggtaggagcacccgactgctcttccgaaggtcaggagttcaaatcccagcaaccacatggtggctcacaaccatccgtaacgagatctgactccctcttctggagtgtctgaggacagctacagtgtacttacaataaataaataaataaataaatcttaaaaaaaagaaaaaaaaaaacaggggaaaagatttaaaaaaaaaaaaaaaaaaaaaaaaaatcattcaattgctacttcataactaaaatgttgctactgttatgaatcacaatataaatatctgatacatagagtatctggtatgttttcagatcccaatggggttgctacccacaggttgagaaccctgcgctagagcaacaaaacacagcaggtttccttggtggtcagtttcttttatttgtcttttaaaagaagaagaagggggctggtgagatggctcagtgggtaagagcacccgactgttcttccaaaggtcaggagttcaaatcccagcaaccacatggtggctcacaaccatccgtaacaagatctgactccctcttctggagtgtctgaagacagctacagtgtacttacatataatcaataaataaaatctttaaaaaaaaaaaaaaagaaatgctaaaaaaaaaaaaaaaaaaaaaaagaagaagaagaagaggaagaagaagaagaagaggaagaggaagaggaagaggaagaggaagaggaagaggaagaggaagaggaagaggaagaggaagaggaagaggaagaggaagaaaacaagaacaagaagaagaagaacaagaagaagaagaagaagaacaagaagaagaagaacaagaggaagaagaacaagaagaggaggaggaggaggaagaggagaaaggaaaaagaaaagaagaagaaaagaagaagacaaacatgataaaaacaacatttaaaatacggaggctatggagctggctctgctgtgaatgtttgtctttggagaaggctggaccttactcctcagtacccaagtgaaaaaagccatgtgtgccggtgcacacttagaatctggatggtggaaacccgcagatctctagggcttattgatcagcaggccaaatggctagttctgggccagcaaaggaccctgtcttaaaaaaaaaaaaaaaaaaaatcaaggtgggtgatgtgcaaggagcaacagctggggctggcacctggcttccatatgctcgagtatacacatgtacctgcacacatgttcctgcacacatgtgaacaaacatgcaccacacacacacactcatacacactcacacacacacaccagaaaaaagtatggtgtggtggggcagcagaggtgcagtggtgaagagcattcattacttttccagaggtctcagcactcatgctaggcagctcacaactgcctgtaactccagctctggaggttcaaagccaccttctggcttctatgggtactatattcatatgcacaaacacacacgtaattaaaataaaagtaaaaatataatgtattaaatgcataaacatgtatcatggtcatttagcattatcaaatgtccttcatacataagaaagttattatgccccaccccagccatgcagtaggtatggttgtagcaaaaccagcacaaacatgcagagtaagataagaacctcccatctctgtgatagtcttatgggaccattatgctacatatgtgttatgcagttgttcaccgaagcatcattacaaagcacacaactaacttcacaccactttgattgaaaacacattagtgcaaggacgtcctcagctctcggctattattttttacaagtatcgtcagaactcagaaagagtgccatcaattaggggaatgtgcataaccacggcagcctcaacctatcaattatttatgtcctgtaatagtgctatgagcatcgttaggcaccgggccctgcttctgcttagttcaagccaagagattctgcaggcctccatccaccaagaaaatgtagacaattcaagcagtatgctttctgtaacgccatcttgataatccagcctagttcgtcccgtagtcatgagggtcctttctatactttgatgacttttgaattcatggatgatcaacagactcctatgacatcactctctttcgacaaatactcttaaccctttatgtaatctgtggtagtctggggaggcccacacaataaagtacattggtttataaaagaaattgaccacactaaagtattaaaaattgttacatagtagcttgtgtattcattgatatgtgagataattaaggtccagcactgatgtaatgattaacaatgtcaaagtgaggagttacagagacaaagtttggagctgtgacgaaaggatggaccatctagagactgccatatccggggatccatcccataatcagcctccaaacgctgacaccattgcacacactagcaagattttgctgaaaggacccagatagagctctctcttgtgagactatgccggggcctagcaaacacagaagtggatgctcacagtcagctattggatggatcacagggcccccaatggaggagctagagaaagtacccaaggagctaaagggagctgcaaccctataggtggaacaacaatatgaactaaccagtacccctgagctcttgactctagctgcatatgtatcaaaagatgtcctagtcagccatcactggaaagagagacccattggacttgcaaactttatatgccccagtacaggggaatgccagggagtgggtgggtaggggagtggggggggggtatggggaacttttgggatagcattggaaatgtaaatgaggaaaatacctgataaaaatatttaaaaagggctggtgagatggctcagtgggtaagagcacccgactgctcttctgaaggtctggagttcaaatcccagcaaccacatggtggctcacaaccatctgtaacgagatctgactccctcttctggagtgtctgaagacagctacagtgtacttacatataaccaataaataaatctttaaaaaaaaatatttaaaaaaaaaacaatgtcaaagtggcagggatagagacaaaactttgctgtttctaaggcaaatgatgtcacaggagaacacttgggatttctgtcgggaacaaagttacaggtctggctgatttcaccttggcctttgctttcattcacaatggaaggaaatgctaagttttagttaaagaataatggaaacagggcccagagaggtctctcagtgtttaggagcactggctgctcttccagatgacctgagttcaattcttagaacccacataatggttttcaactatctgtaactctagtcctatgcggtccaatgtcctttcctgcctctgagggcaccagacacacaagtggtatgcagatatgcccatgtaataaaatatattcttaaaaagattaatgaaaagaaggatgctgtttcccacagaccaagacaggctaaggactgtggcctaagaaattacacgtttattgatttcattgtaagatgaaattaaggtaacagttgtgggggttgcatgaacgggaaaagctagagacctgaaaaggggctgcttggcctctgcttcccaccagtaaagaacccttaggtgcctgctctgttcctagccaggcatcaggaatcacatggcaagagggacttcaggagcagccacacagcatgtctgtgtgccacagcctcgggttcccctgttccaacttcccaggtgcagaagtgaactagcagatctcagtttcagagctccaagtctccatggaaagggagaacaacagggagatgtggtagctgtgagatggctcagtccatgaactgtttgcctggcaggtaaggaccggtcttcaatccagtgtcacaccttgtaatcccaaccctaggagctaggcaggaagttccagcttagcctagtcagcgagacccaatgagagaccctgactcaaaagacaaagagatggcaccagaggaggaagagtggaagatggggctggagagatggctcagcagttaagagcactgactgatattccagaggtcctgagttcaattcccagcaaccatatggtggcttacaaccatctgtaaagggatctgatgcccccttctgatgtgcatgaagacagcgacagtgtacttacatatataaataaatctttaaaagagagagagagagcgagcagaggatgatctctggttttcacgcacacgaacacgcaaatgcacctgtgcacacacccacacacaccttagaacacagtgtgaccaatgctacaagaagcaagttagtgttcgcgcttcccaagtgtagcctctgagctcacttctggctgtcttctatttgtgaacagcctgcagagtcacttgctggtttgcttgattctcagttattttaaataaacaaagcagtggatgtgaacagttcctgtggctggatgtgttcttctccggcttgggtctccagcttctcattaaggtagggccccagtgaatgccatcctggagggataacgacagcatttccacaggaggaacctgggctcctcgatgcttacccagcaaatatgcatttcagtcgtgtgcatttcaggaatacaactatctacgaaacactattccctccccatcctgggccggccaggatcaaggagtgggaactaccctgttcaagaaagagaacactggctcccccttgtgtgcgatctagccatctttgttgggcatttgtagagcaccagacactattctgggcacctccatttgctgtgtctgatgaggggattatagcaaaagcatgtaaagaggagaataaagtcagagagacgtcaccagcaaggaaaagaggctgaaatttctaccaggaagctggagtgaagcaactgcccatcagcattagccagacctctgatcttccttgtcaccaaggcaaaacacaacacagcagaaaccttcagggtacatacagttcgaacaaaccaaaagaaacgcttagggccttggtcctcaagctgagggtcgctgagttggccgaccacgtcatcagcagtttgaaagcagaagaagaacgatgacccatatcatctttacacaaactcaaagccgaggacacaacacagatttaaattcaccaaaagggcttcagctatagcccgcatggatttctggtattccaaaagacagagagacagtggtctggacagtcccagtggtctggacagtggtttgtgagcattccaaatccatttcgccgtggttactctcaactcttggggacttggatcccagcttctctgtacattcagccaaatgggagactttatcctcatttctatagatttttagtatctcagatacttggtgagcatggaagatcagtaaagccttctgattgaaacgtgtcttgtttttgttttgttttgtttgtttgttttgccttagaaggctgtcctagctagttttatgttaacttgacacaagttagagttatctgaaaggaggaagcctcagttgagaagatgcctctataagatccaactgtaggacattttctccattagtgagcaaaagtgggggggggaccctagcccactgtgggtggggttatccatgggttggtggtcctaggttctacaagaaagcaggctgaggaaaccacgaggaacaagccagtaagcagcatccctccatggcctctgcatcagctcctgcctccaggctcctgccctgcttaagttcctatcctgacttctttcagtgatagactaggatgctgtgatgtggaagtagaagccaagtaaatgctttttcctcctcaacttgctttttcatcatggtctttcatagaagcaatagcaaccctaagagggttgaaaagaccctttcaaaatagcgacacaaaacattatcccaaggtcatttatgacaagagtcagtggaaggcagggtctgtagtgtgcacctgacatttcacactcaggagtcaaggtcagaaggctctcaagttcaggaaaaactgcacagaaagtctcagaaaaccaaaaagatggactagcaagccagtaggtgattgctctgtggttgtcggtgtcttctcatcgtcatgccgctcagaggcttaggacattctgtttactatgattgaacactggaacttgctacaggctttccttggggtctgtaccacccctggtttagagatatatgtatgcttctgttattgaactgtgctgaaatcccaaatatgggttgactttcttaccagcttatggggaaagcgcacaacctggcgacagaagttaactcacagaaacacgagggatgtcgtgcatgatcaggattttcagggaaagtggctactgtgtacactgaaggaaaacaaaacgttggccatcatttaccatccgagaaagacatcaccacttacaggatttgggtcaataaatcacaggccagcaacagtgtgtgcgtgcggataccatcagccacagatgtctggttacctcctctgtcagctgatattcttttttatagagaagttcatgtcacatcattacaacacatacctatttctttttattactgttacaatcattacataagttacgctgtgcatacactaactccaggagagaacgggaggcacaaggcagttcctataaaaactggttcctgaacttatgaactagtagaccccctcactgcccaggtggcttctaaattaatgccatcactcttgttcactttccaatttgccattggtttggaggagatcggggcagagacgaatagagaatcggttcatttggagcttataaacagttttctgagttagtttgattatgaactaaattctgcctgatttctgggttgtaacgaagcttgtagttgctctttcaatagcagtcacttaaatgacctccggtgtgtatctacatcctctgaagcttcctcttggctaggttggcgctggacttttgggagtcatttgccaatgtggagattctacagtggaattctttttccaactcactcagaatcagctcctgctgggcccagcagcacctcatgcaatctcagctgcttgggaggctgaggcctgcccaggatagttggtgaggctttgtctgaagacataaaacagtgggctgtgagcacagtcctgggtaacatgctcgcctaggatgcatagagcctggctgatgaaaaaaaatattgaaactactcttggttcatagtatcctttccccagagacttcaaaaagatgaacaggcccgtcaaagaagccaacacttacagttttagcaagaataagaacgtggtcacaaacttgatttctggtgacatgcactaccaagaaattttaaaaggactttggggtttttcaggtatttaaaaaaaatatggatgaaacaaacatagttctctcttggatgcttttcagttttgtaacatttttgaatgagcaagagaagaaagtgatgtctcatgtaccacacgagggtgggtttgtgcttctccatcctcaatgcttcctgaatgttgcctgctcctgccctctccccatgaagtcatttaagacccattcatatggggccagggagatggttgggtgggtagtgctttgtgtgaggacatgagttcagatcctcagagcccacgtaaaagctgaacagcattctacagtgaggtgaggggtcagaagactcccccagaaacttaccgacattgacaccctcctcaaacaagatggaacataagactggcacttgaggctgcattgacacctgcatttgcacgtgcctagcagaaccgactcttcttccaaaatcaacccccgccccgccccctgcaaccacagactattaaacacatcacattagatactcttccatactttctctactcttccttctggccaactaaatttcatttactctaaacaactgagggcaataagaggctactgtcctgtaagtagccctgttctgtcccttgcttcaccgctgaggtcttgagcaacttacagaactccacccacccaggacttaatgttgttactcacaaatcagagtgacacccaggatgttcctaggcctttgacagtgaagtgtgaatacagacagagaacagcatggtgtatggcaggcaggaagtgccggttgatattagcaacatgcttgaaggaggactcacagaactgctgtgtgttggtgtgatggtttgtatatccttggaccagggagtggcaccatttgaaggtgtgtggccttgttggaataggtgtgacctggttggaatgggtgtgtcactgtgggtgtgggtataagatccccaccctaattgcctggaagtcagtcttccactagcagcctttggatgaagacatagaactctcagctcctcctgcgccatgcctgcctggatactgccatgctcccaccttgatgataatggactgaacctctgaacctgtaagccagccccaattaaatgttgttttttataagacttgcctttgccttggtcatggtgtctgttcacagcagtaaaaccctagctaagacagttggctagaattatatcaacttgacatgaattatagtcatttgagaagagggaacctcaactgagaaaataactccacaagattgggctgtggggaaggctgtagggcattttcttaattaatgattgataggggaggacccagaccattgtgggtagaccatccctgggctggtggtcctgtattctacaagaaagcaggttgagcaagccatgcaagccataagcagcacccctccatggcctctgcatcagctcctgcctccatgttcctgtcctgacttgcttcggtgatgaacagcatcgtggacatgtaagccaaataaccctttccgtcctcaacttgcctttgggtcatggtgtttcaccacagcaagagaacactgactaagacatgttagtcttggaagggccatgcggggtgccaaacccttcagtcagtttttccttatttccagtcaaaaccaatcaccccttcacctttagccttcattctttccactctgcgtttctccatagggggttcagtttcatttgtgctggcgtgtttctctctaatgggagtctcgggttacggtaggaggtacccagtgcctggcttgaactgagaaaccttgtgcacaacaagactggaaggtttactaaagccggaagcaggaggcagcagggcaggagggagacagtcagggatgggaatatgcagaaagctgcagtgtcagaactctgaagcacatacgcaaatttgagtcactcctaaactcgaaacgaactctagaaatgatcacaagccagtgatctcatacagactgtcacaatggcacagcgagaaccccgagacctcccagacccagttttcttcgatgtctataatcctgtttgttcaggaaggagaggagcaacaagggaagccgtttctctggggctgtgtggcgcagggcactgtgtctgaggggtccctagacagccacagccctcccactcaggacctggaagcaccagaccacacccacctggcatacagtgtctttcctatcatgcctctaatgaagtttcagatataagtaagcattaggcatcaaagattagtaatacagaggttaccatagaaagtcattccatttctgttcccacaagcacccagacaaaaagcagcgtgggatgggaaggggggacccacattatttggcttacacagtccataacagaggggaggtcaaagcagaaactcacagcctcaaagagaaatgaatgtagatctgctaccagctcctactcagttttctttaacacagttcagggtccagccaatgaaacagtccgcccatatcagggtgggaagtcccacatcaattaacaatcaagggctgagccctgtggcacacgcctttaatcccagcaccaaggaggccaaagcaagaggatttctgtgagttcagctaacctggtctactaagcaaagccaagccagtcaaggctaccaataaaataggctccacccagcagttgactcagacagatgcagacaaccacagccaaacagtggatggagcttggggactcttagggaagaataagaggaagggttgcagcccctaaggggataggaactccacagcaagaccaacagagtcaactaacctggacccttggggctttcagagtctgaaccaccaaccaaagaacatacacgggctggacctaggtctctccactcctatgtagcagatgtgcagcgtggtcttcatgtgggtcctgaacagctggagtaggggctgtcccaaaagctgctgcctgcactcgtgcagtgttctactagctgggctgccttgtctggccacagtgggagaggaagtgcctagcctcacagagacttgaagtgcagggagaggggggggtgtacccagggggagggcccacctactcagagtagaaggggaggggggatggaggaaggattgtgggagggggtgaccaggatgggggcagtgagcaggatgtaaagtgaaaaagtaaaaaaaaaaaaaatatatataatttgaaaaaaatccaacaaaataaatagttgagacaatcactctcaggcagacacagaggataatctgttggggttaattctttagaatcactcttttcaagttgtggcaaattgacagaaaccaaccaccacacaggccacagtaaattatttaaaacacgtgaaatgcgtccttctagaattagccatttcaagtttttgaattatggttgccctgagtaactaaaaatgtgaaagatgtaaccatggttcaggagtggactgactgtgtttctattttgtctgtgtagccatattggatcccaggggaagggtgggctacagcatccagaccgtctgtgcacgggacgtggtgcagcatctagcatcatttactgacctgctgctgccaggtgtgaggaactgcaaaggcaaagccaagtcggacccaatctatattccagaggccagaaaaatagcgggcaaacaaaccactcacactccaggaggatggttgggaaaagaaagcatgctttaatgcacactgggagggaagaaagggctggaagaaccagggagggctgactagggcacaggggtggcgtctacgatgggaaaagtcacacagctatagagacctcatatagaacagcggcctgtcccggcttcatttctgtggctgtgataaaatatcccaaccaaagcagcagagagaaaagggattggttttagcttacaattccaagttcactgtggggaagtgaaggcgggatcttcagatagctcgtcgcactacatccatagacaagacagagtatgagcacaggcaagtttgcttgcttgcttagttaattaattaattttgtgatcagttcaatcctcctacttttatacacttcagaaccccaacccccacccccacccctgtctaggatggtggcactcacaccaactagctcagttaagggaatctctcacatacatgcctccagactgtcgcaatgcaaacagtccctcactgagactctcctgctagggaattctaggttggggcgagttgacaattaaagctaaccaccatgcagtcccagaacactgtgtcctctggggatgtcgaagccatctatgctctgtggcctttgcacagtgacaatatcagcaaacctcacactctgggacaaaacctgtccctgtagttgacacatgcctgcattcattcttgctacaacgctggttgctgccctgggcccggcaggcagcgaccttgattcaggcatctggagctgctggcaagggagccagaacaggaaatggagagtagaaagacaaagggggtgagaaggggaggccgacactgtttgtagccaggcccttgcttctttacctactgatgggtgttttgagctggcagccactgaaccaaaggaaatagatgtcggtcctgtattgtgtgggccagcacgccagcagaatggaagtgagcaggtagcagtgtgctagtgcaagcctgcctgagaacacactgtcccaccccgccccgctctgttcccacagcctgcaggccacagccactcactgaggagcctcgagcttttggaggctgcagctaggcccagctgttccaccacagcttttttttttgagaatcttctcagcttcagggtgggaccacaacacttctgcctccaacgcaaaggacaagccggggtgaccaaatagaccttcacactgtccctgagaaatcacaccctttatgttccttgtgtagcttctttctctatgaaggtttttgatagccgcaaagaacacgcgcccacccaaggcagaagaggaataagagcggttatctctagttccagccagaactgggctcccatttacaggcttccaagattttgcgtaaatgaacattatcagaaagccttgcacaggaagggaattgtgtgctcaaaaagtttatctttgccgattatcattaatcattggtgtgttttctggggaattcaagccccggccaaggtcccgtttctttaatgtttattttgacagtttttacaaggcgggtcagcctcagatcccttagaacatactcccggaaggctatcccagtggggcagaaccatggctctctgtgagagtgctatgtatgctcctcattttggtggatccgtgctacccagctttcccctgcacctcccatggtcttgtagaatcagagtaaaagagaggggaaaaaaaaatcaggattttcatggtttaaacttgacctcttcacacagaagttcaaagaagtaaaaattaacacaacgttgccatggcaaccacagactcttgtcactatgttttttgttgttgggatagccactgttagtttagtactccctctaggccccgcagattagcaagtatgttatacactaaaggtctctgtggcaggctgaagtcagtgtacccactctacagatttgaaaatggaggcagggtatttggtaatttacctgaagtcacactgggactctgaaacctgattctttgtctggatacagaagttaagaagttatagtctccaattaattatcttgtctgaatgatttttttttctctatcaactctactatcaataaagatctaatatacactttcctttgacaacttatgtcatactgaggtatctatttgggactgaataaagctcaattaagagaaatttaagggtctggtgggtcatgcctttaatttcggtactcaggaatcagaggtaggtggatctcggtgagttcaaggccagcctggactacctatagtaagtttgaggccagcttgtctatatatagtgagcttaggtcaaaaatctctacaaagtgagaacctgtcaagatagagagagaaaatagggtttaaagtaggtcctgggcaattttacttctttattgtaaaattatatttatctttcatcttcaaactagaggtcaaggttgacgaaaacagcctaaaccagtgaagctgattcagaacaaaacaagtggtgtacataagaccttgaaagccaaggtagccagatgctatgctattgcctaagaaggcatgccatgcggctttggtatgctgtctcgtgttttgttctttaaatcttaagttactttcctgattagaacatcattactttctctctctctctctctttctctctctcttttctttctttctttctttctttctctttctttctttctttctttctttctttctttctttctttctttctttctttctttctttctttcttgagacagggtttctctgagtagctcaacctgccccagaacttgatttgtagcccaggctggcctcaaactcacagagatccacctgcctgtgcctcctgagtaccaccactgccaggctcatcattacattatcaatgtctcctattcaacacaatcacaaggcttgctgttcctgccatcaatctagggacagctctaacagctgaaagaccacgagctcccatgtagactccgggcttcctcctaccttaatctggagtgtgtcctgatgaggaagtcagttccttcaccattgacctgtgtgtcttcttcctgcctgccaggcactggctgaggctgatggtttacatggctgtcccaagtgtggctgtagctaatcccacgtcaccaaggacccagacagcggagacgtcctaatgctacgccaaggagctcacatgaggattttacactgcaagctagaagataagagacttcggtgaaatgcctcatccttccccccaaacgtccagcagagcacagtgtgtttcctgtgtgtgacctcaggtgcatgactactgacaccacaaagaacagcttctcatggaccgtcatgggcatttctagggtaaatttttttgaaggctgacatgcatgcaggatagtatgtaaatcataagcatatttgtcatgttctgaatggctgtcccttctcaaacttattcaaatgtaactgccatggcattgggtatcagtggtgtgacgagaaggccacagggtctctactctcaggctagattaacagtagcatcctgggagtgggccccttgattcaagagtgggtttcttatatttttggttgtgagcctagcctttaacggatgagacatctttccagccccaagagtgggtttcttataagaaaatgagtttgggtgctttactgctcctcctccccctcctcctcctcttcctcctctgcttcctcctcctcttcttctccctcccttctttccatctccacttctgctatgggatgccttccctctgtatatgacctagatgccagtatcaggaccctgaacttgcccaccttcagcatagatgctgagggttgggatgtagtagggagactaaagtaagagggtgagctttgggggctgtggagatggtttggcagatagaagactagctgtctgtcttagttagagttttgctgctgtgaacagacaccatgaccaagacaactcttataaggacaacatttaattggggctggcttacaggttcagaggttcagtccattatcatcaaggcaggagcatggcagcatccaagtaggcatggtgcaagcagagctgagagttctacatcttcatctgaaggctgctatgaggagtctggcttccaggcagctaggatgaggtgttaaagcccacacccacagtgacacgcctactccaacaaggccacatcttctactagtgccaccccattaggagagcatatacaaaccatcacactgtccaagcatgatgacctgagtctggactcccagtacccacagaacagccaggtgcagaggtgtcatccagtgctggggaggagtagagagaggcaaaagagtttgggtactcttttcctcctcctccccttcctcctccctaggaagaatggcaagctccaggttcagtgggagacctgattcaataagaaagagtaatagcaggttatgcttatgcctacttctgccttctacaaatgcacacgcgtgcacacacataccacatgaccacaaataaatacattaaaaactggagtaaagggtaacaccaatcttgagcaatctcaagcaaatcactctgtgaatccccacttcctggtgagactcactaggcttgcctcctggcttgatagcctgctcccgttcaatcgctgtgtttgtggtgtgtctgttatgggctgggtaccaccacaggggctgcgatggagaagctctggccctaaggtaaaatcctcaataaataggaacttgtatttattggttagtagaactataggcatgaagtgctgagtcaacccatttaggaatatttgagagaaaatgctttgaaaatgagaatcgttacctaaaatgtagacacttcagtctgcttggctgcataacaaatatgacggaaggggcagcttgcatagcaacttcttttctcacaatttgggagcccaaggttaagatacgggcaaggctgagtgaggcccattttcatttttgtttttattgtttttacattctctttgcttcatagcccaggctagccgcctgcctcaccctcccaagtgctgggattacgtgagtgtgccacccatgcctgggttatttctagtcatttaaaatttttatttattcataaaacagagatgtgaagattgggtttattttttttcaattttttattagatattttcttcatttacatttcaaatgctatcctgaaagtcccctatcccctccccccgccctgctctcctgggtttattatttattttgaaagatcttattttttatttatgtgtctgctgaggccagaaaaagacatcagctcccttagagaaagggctacaggatgagaaatgactcatatgtgtgctgggagccaagcttttctggaagagaggatgggttcttaactgctgattcatctcactaggccctctcttcattattaaaaagcaaaaaatttaaacttcattgctattcagcaaaagagtctatgtccgagtatatcatttaaaaatatatctttgggttacaaaggaaacaataaagggagcttggagactctcatctgaagctcccaactacaatgagcagcaggtcacggtgttggcagagacagatgtgtagaagctgagcaggtaggtacaaacagagtagattaaaagagtggtgatgttgacttggccacaggatcatcaggtggatgactgacaacaacattagccaggcactagcctgccaatgtgcttcttaccatgacagctcccaactttttttttttgttttttttttttttgttttttttcgagacagggtttctctgtatagctctggctgtcctggaactcactttgtagaccaggctggcctcgaactcgggaatctgcctgcctctgcatcccaagtgctgggattaaaggcgtgtgccaccacgcccggtgagagctcccaacttttgtgcagatagctgatccgcaaggagaagcaaccaatgctccatactgttggaaatcattctacaatttgttcctagtcaagatttgtttgaaagtttcattttctatagtgtgagcgggagggagggccaggacctctttcttcccctcagagaccagcttttgttcctttgtttggtttgggttgtcggtttttagagagaggttaggtggctctgacagtttgctttggaaaccacatcccagagggctcagagacacacaagccctgttacttggagactgaagaggagcagcaggcggggccgaagggtgggcggagccactagtggaggggccggtggtaggaggagcctttggtggaggggcggggccctagagcgtaggtggttattggtagtggtcagggtcccccgcgcgggggcggagtgggcgtggcctgaccgcgcctgcgcagtccactctactcggcgggcgaaggagatgcgttaaagatggaagacttccaggcctcagaggaggtaacctcgggttgggtcgtgagagggagggtggcggcggagatccgggtgtggcggggcccggtctgggaatacacagcttctgctcacggccacctggcccgaggctgatgagcctacacacaatttgtcaaaaatcccacacaatttgtcaaaaacaataataataaaaccctaacacttcctcttttgacatttctaaagtgtcaactaaggatattctgagggaagagtaagacatttgcatttatcagaatctttcagttttggtctattttcggcagtcaggatcattttgtttgaacgttggtggaacgcaagtaaagactctgaagccacgattccgaagcagcagcacaggggatgtttggccagacagcgatctcatgtatggctgaagattggcttttatggtagtcacagccagctagactttataggaaggaaatggccatgtgaaaaggtagccctgacaaccgcgttctaattccagcttgtacatgtaggctgactgaagtgaagtgtccagacagtgatctgtgttttacacagagtgtcagcagcaggaggacggccactctccattgtttacccagcagccctctcagctgagccttttctacctgcctctagctccccaggtttccctcagctcatttccctctctggtagcagctggcagtgctccctgatttcaatataatttctcttctgttattttcttactctgactgtatgggaagtgacactagggctttgctttgtggcttaggatcactgtagtcacttaggaagagcctttcagtcgacttaccctggagagtcaccacattttcactatttcagtgatttcggctttgtttccaactgacttcttagagggtctagcaagggaaatggctttgggtggtcaatgctcattctcctgaagaggaaggggtgatactcaatactggaacagggcagggtccactgtggtcagcagtaagggaagtctgtagcaaaacaggactgagtgactgccgagggaggctgtgctatccgatccagggcctgtccagtgctaaggctatcccagaacttggaatagttcatttgttctcaggtaagaagcatactgcaggctagtgcctggccaatgttttcaggaaacccttacacccactcaaatccagtattatgttaagaggagactaagaaaactacttcgggcatcaccttgctgctggcagccctcaagtcagctgatgcttcgtcctgaagtagttcattggggttaagaaaatgatgggcacacatgagccttttacgtgttaaacatcctagtcagtatctctacaatgatgacttatgtttcttcagctgctttgtatggcagtggagtggctcggaatatggcacctgcactggctaatggtgctgacagccagctgcaggggaaggagagacaggattctagtttgaagtgacacctggcttgcagtgtgacactcagctgcttcacacctctgggctctgaggttcatctgcacagtcgacagcctgatttctaagtcacgttcagtatctcattgtgtgctcattgatgctctgcagaaagctcttttaaaccaaacttacctacattttcttccttaacagactgcatttgttgttgatgaagtgagcagcattgtaaaggaggtaagaggaaacagtcttgttttccaggcgtttggttgatactatgtgtcttggagttaccattactgtgatttaacaccatgaccacagcaatttgaggaacaaagaagggtttcttcagctcacacttccacatcacagttcatcatcaaaggaagtcaggataggaattcaaacagggcaggaacctggaggcaggagctgatgcagagaccatggagggtcgtgcttactggcttgctccttatggtttgctcagccaggacaacaagcctagggatggcacaacccaccctaggccaggcccttcccagtcaatccttaattaagaaaatgtcttatgggctggagagatggtttagcggttaagaacactgactactcttccagaggtcctgagttcaatttccaacaaccacatggtggctcacaactgcctgtaatgggattagaagtcctcttctggtgtgtctgaaggcagctacagtggactcacaacataaagcaaataaataaataaatcattaaaaattttatttaaaagaaagaggagggggctggcgaggtggctcagtgggtaagagcactgacttgatcttctgaaggtcatgagttcaaatctcagcaaccacatggtggctcacaaccacccataatgagatctgatgccctctgctggtgctcggaagtcagctacattgtacttatatataataataaacaaatctttaaaaaaaaaaaagaaagaagaaatgtcttacaactccagtttcataattgcggttgcctcctgccagtgacttgagcttgtgtcaggctgacagaaaaggagccagcatagcatgtatgaaggagaacgctatgtgaattaaaatggaaaaatctcaagagctgttaagctttctgtgttttgacatttcaaacatttttactttatatctaagtaaaatgactcctatattacataaattatataacctgaatcaagaagtcttaagtggcgttagaaagtgtcgaggcagattccgtaaccttgcagcatgaagactcatgatgcacgcataaatgtctccagtgctcgtgaggaagagcaactgcagagaaaatctaacaacgtctataactcaggacctggagatacagctcggggttattcataggtttttcttacattttaaaatacattattgatagcaatcatagtacttctcttaaacaaggtggacgacaggcccagggaattggacaccgtgggagtgaccgcagcagagcttagggaggaagtttattttggctcaccgttggaagggagacagtccaccacggtggcaggactgtgaggtggctggtcaccacgcatctttatgttcagcaagaattttctagattaggctagctgaggtaaagacccacccagaatgtggacgaactgttccacaggcagggagggccccaatctgaagccaaaggagaaagcgtgcttagcccagcagtcctgactgcagctgtgatcagctgcctcaaaccccgactgccaggactctcccaccatcatggcctgggagctagaataaacccttcttcctatttgatgttccctgaagtaattttggatctactacaatataagatttttgatgcccaatattgaagtcaataatgctagagtgttaaagaaccacacactgttttgtgagaagtactcaataatcaaaatgattttctcacttttatgtacattgttcagcatccagtgtgacttttctggtgctttgcagggagtgtaagtttgccttttattgtttcttccgtgcagtgtttccagtggaacaggtgggaagcagaaaggtggtggattaaaccagaactggcaggaatagagtgggtttgttagggctgagttttgcctcctgtctccgcatccacttttcctgtgttgctaggcagcaggtggttggaagtgccatcagcagtccatagggaagcatgaggtgactcagcatttttgccctggctgtaggttcgttctgtcctcaagctgtttttaaaaaagtattaagtagttggaatgagtaggtccaaaattagagttttcctttctccctaaacactggacttcatagtgcacagagggggttgctcttcctcctttgacagtctctgtgtctagccttacctttactaaagccagtcttgagcccacagtgtgctctcagcctcgagtgggcaggcgggacagaggagctggatccgagccccaagtctggaggtggaaaccacggtgcatccctcatacgctgtcgctgccctcagcgtggagtgtgtggcccactcctccaccgtgtgcagtgagggcccctggacctgtgtctgccttgtctgtagggaatcatgaaaccttttctaggcttccagcaggttagcaggggtggggagggagctgttgagagccacactggcatctgggagagaggatgctggagaaagacacagggtgtcactgatattacagggacagggcagtgagctgtgctatccaggagccctgggactcagggggaacgctgctgctgtaagctccagcttccagtgttaaaggttcagttatctagaaagtgtgatacgacaaaacccacacaacgaggccacaagtactacaagactggtcaggttgtgccaacacccaataaaatgtcatctaacacacacatgtatgttttatggcttggctaaaaatgactagtatatgtgtaagaaactggcaaaatattttttctgcctcaataagaaaatgtgttgactgttagaaatgaagagcagcatgactattcagtccattgttcagtggaactgtggagcccagctgacaggctctgtagaacacacatcttcaggccgtgtaaagctcctcgacatgggatgcagtcagtgctgcttagcagaagccacacacgtagaggagcccttgactgagcagaagctcgcatctcctgagagttctgtcttcagttcctgggagggccatgggccatgtcggaccggtgagtgggttctctccatgacctcttgtgcttttttccccctaggctatagaaagcgccatcggtggtaatgcctaccagcacagcaaagtcaaccagtggaccactaatgtcctagaacagactttgagccaactcaccaaactggggagaccatttaaatacattggtaatggattttcatcttgtgtattttgatagaggttctctaaatgctgatctgaggtgtgtctggtgctggaagaaaggtcacttagcaattggttgtcgaacttccaagaaagtttctccaggaccaggtcccttgtgtagtgaatgtaccatgtgctttgcatgtcaggctaatgccagtgtcttagggattatgtcaaagaagagttcataggatgtctgatcagacatgttgagaacatgttaaaagaaaggaaatcggtagtttgtcaaagtgagacagcacagtctgccccttatattgtgactttttctaacacgtttgtttaatttaagtgacctgtgtgatcatgcagaagaacggtgctgggttacactccgcaagttcctgcttctgggacagctccacagacggtaggactctcaccttcctaggcaatgttattttgcccatagctccaattttggtgatctgcagcgctaagcagtattttgaagcgcacacttagatgtttcaacgtcgatgcaattctgtaagtcaccattgcctgtagattggtgcacatgccatctctgtgagtttgaggccctatctaaaaacaaacaaaatctcaaaacattctgggggcacttgcccatttataagtaaagttaggcagtaaagtccctctctgtatgtcaggcatgcagtgcagtgctggcatggtgggacccgaatctcctgggctgcctcatttcctgtgcctgtctgtgtcccccacaggaagctgcacagtccgatgggagaacaagaccatgtactgcatcgtcagtaccttcggactgtccatctgaccaccttgccagcctcagcctcgtggtcccagcatttccagtccatcttaaccaccagctatgttgggcaaaccccttcctcctaagttgttctgtggcactctcaaaaaaccaaatgactccccagtcacaggaaccacatgacttcagccagattagcagccacctgtcatctgagccaggcagtaccacttgtcttaactgtcttctccaaggtgctaaaaactcaagtctgctggtggaaacagctctactttctgaaatgattcagatacactaactttccatactttattctttcttagaataataaattattcaaaattaaagtttttgtgttccttgtagcccggagcatcacccgagaatgagtttgagaagggagaaggttgcttttagccttctgcatgctgacatcgagtatacctgagctgctggtctcaggacagtgcacagccagctttgcaggtcatgcttgaagccgcgggcctgtttcttactgtgatggcgaaacctgctgacattggcagagctggagagaggccacagacctcaggggcgggctaggcacttgtgacatgtggcctcacgcagagatctagaaaagtggccgatgtctggggaaatgggctacatcagtttagctctgtttaattttttaattacattcgtgtgtgagagcgagtaagcatgcgtcccatggcacacctgtggagttcagaggtcaaaggcagtttgtgggacttggctctttctccaccactgggtcccaggaatgaacttaggtagtcagggttggtggcaaacccctctacctgctgtaccagctcactggcccaccagtttactttcgttgcactcactgccagcctcaggtggcacaaaccaggaagcaaaaagaacaggaggaaagcttaccctagcaatctggcaaacatgtctgccctctcagtagagggcgagatgaacgaacgccttggtcctccaggatgggaataggccacttcacctgtaggacaggaacctagccatgctgcaatcctacattcctagtccctgcttcctggacgtgacggttgttcaagccatgagctccgacctatgtctggttggcccagcgcagttcgcctgctgctttcggacctaggctttggcattttagtagcagcagcagctacatatttagaattttacagcttacagaatggtttcaggattgctgtgtccttaacaatgcttagcttgggtatcacaaagggcccacagtttatccagttaatttcaagtcataaatcctagtgagaagggaccccaacagactaggttgtctgttgaccgctctggggtgctccttgtgggccacctaaggcactatgattggcattgccacttggtgtgtgtatgtctgaaggagtgcacgctcatgcatggtcttgtgtgtgcccagttccagcatatttcctgagatggggtctctcactgaacctggagcacactgtttgagctaaatttgctggccaccaaaacagtgggacacacctgtctctgctccgttttcccagccctggggttacagacacacaccactgtgcccgcttttacatggatgctgcagctctaaacttgggccctcattctcacaaagcaagcatttaacccactgacctgtctccccgatatccctggctgaagagccttgctgtggtcttctttctaaagcattcatataaaaagctagtaatacataaagaattaaaaattagaaatatattaacatcggtgaacaagagacagtgtcagaatgaagctgataaggtttgttatggatgagaaatgtcccccatcggtgtgtgatggtttgaatatgcctggcccagggagtggcactgttagaaggtgtgtcactgtgggtgtgggctttaagaccctcattctagctgcctagaagccagtattctgctagcagccttcagatgaagatgtagaactctcagctctgcttgcaccatgcctgcttggatgctgccatgctcctgccttgatgataatggactgaacctctgaacctgtaagccagccccaattaaatgttgtccttataagagttgccttggtcatggtgtctgttcacagcagtaaaaccctgttgcggccggcctgcagcttgcaacgaatggttcagctgagatggcaactcgggctgagagagaaaagactacaaaaccctaagacaaggtgtgtgtcaaacacttgctcttcatctggcagtgacatttggggaggatctgggaacttggaggtggagcttgctgaaggaagcaggatactgctagcatccctagtgggtgagggtctctgccttgttctggccccttcccgtcattctgctttgagtcctggctaccaggaggtgagtgacttggccacactctgtaggcactgtgttcctcatcccgggctcatggtggaaggagccagccatggactggtgagctaaagtgactctctcctgtgaggtttttcatcagatttcggtcacagcaacaaaaagtctcatacaaaatctcaaaatgtgacttttattgagtttttcataaataagcatttattccttgactgactgctcagacaacactggtgcactgatggtcaaacggtgttccttctggacttagaggctagtgtttttatttaacagatatttacagacatttgtaaaaaggtagttttcaggagcagacaatccctctgtcatacaatggaattaacctgttctgtgtcacaggacagatcacagaatggtagcacctagcagcacccgagccaccaagagaaacattcagcaaggcttctgacgacatccattttcctttggcctgaaaaaaaaaaaaaaaaaaaaaaagagccacatctcccccaacccccaaaaatctaatcactaaggcaaacgctcaaatatacaatacatatcaagcctcatatctgttcctcatggagggacttagttctctcttttgtgggtgcttgtgtttttcctataaagattagtaaccatatttgaacctgttcatcctaactgtgccttcaatggttcagcacttgaggctggcgagatttgctttataaactgcccatctgcaggatggctttacatacctaagcttacttcagtctaactgtacagagagcaagcgcctcatgagcctcgggtgtaagtttacataccctcttctctagcctttcgatggggcttgaaggcaccaaatcactgctgcaatgaatgacaataaatcaagcagatttactacccacagggaaaatgaagctctcaccgggaatcagggagccgtcaccttccaggttcccctggattggaccaatataaaaaataccccaaagacagtaggattcaaaccgttaccctgaaagaactaagtcagccctttgaacttataatttaagtttacaaaattttaatcccctcagaacaaaacagtcttccggtgactatcaaaagtcccggcggtgtttagtgttttaacctcacccctgagctgctgcctacacactgaagtcttagctctgtaagcagagctttgcacagcatctaatacatgatgcacacgaccctaggagtgctgctttataattcatatttcaacagcaaaaaaaatattcccttagttttacggacactaggatcagtttataattattctatagggcagtttttaaaagttctgaagtctgtacctaaatgcttaaaatatcttacactgaccgatacatagtgttataaaccatggagacttatttataatgatgaagacatgtaaactctcacatattagaacatcttgggatcagtacgagtcagcgtccataagatggcagctgcagggctccactggaagggaagggctggtaacataagatattctggtatcttccccaacagactcagtgatcacagcaagtgcaaactcatgtaaacccgttaccctcgcagtgagtttccattccaatgttcatagttacaagttgttttgttttaaaaaaaaaatgcacatggaatccatattaaagtatgaagtttaagaagataggcagactgaagaacgtcttccaccctggagtcgggcccacacggatagtaacctgcagctcagagcggaaatctgagtcgatgcacagacgaagggaacagaagagggatctaccggaactgggcctctggatttgccaagacagaggcaggcaggatgctacctttaccaggtgttcgcagagacgctgtgtggggaaactgaggagcgggaaggaaggcggtggccctgaggacttccaatgctgaacttcagtgtgggtgacatccgttttccacagagccacactccaaacccagaacaaccttggggcgagtcccttcatctgcagctgtctctatagccattcaaaatgtcttactttctctttactttagttcctaattaaaacagaaagtctttctggcaataaagtatttctaatacagttgtatttcatgtagctttgatttaaaaaaataataataataatagagctctccgggggttcacactcagtgaagatgcagaaattttggtcggaagggcctcctcgttttccacctccagcacagggagacccaatcctaactgtacacagacccttgaaaagcaccatgacacaggaccttgcccacagcgctactggcctgtagctgcctgggcgtcctccaggctatcagcccactctggactcaacttcgatggcaattctgctgggggtggggggtggcaatgatggacgggaacctggccacttgccattcctgaagatgctattgaatgtggctcatcaaacacaatcaaagtctcacagcagatgcctgagtgagcatactgaccccaccatgtgctggagaagatggaggcagaccgcccacctgaggcgggcacagcttagacttcccttgagggtagggcactcaagaacggtgccacagagaggagagagtcatcactgcgacgctgggaccttgatcgtcaggcctcccacagactcaattgcttttttaaaaggaaagaaaaagtacataattctttttattaaaaatgggtaacttctcctcatgactgcatacgggctccatcgcacctgatgtcggtgtacaggatatgcctttgaattctctaccaggcagcccctcttcttaaatagtggggctgtccccaaacaaactccaccccacatttcaatccatttgggttttcctttaaaaatatgtaaacaaataaggaacaggaaacctttgcttacagaggagtccagacacaaacagatagaaggggccagaatgtgtcactcaggcaggcctctggccccctgctgtcccatctgctgcccggggctcagtcactgtccgactcttccctgcacttggcacggatggcctggctgttctgcaggggcatttcttcatagtcactcctgtggcaaaagagacctgtgaccctcggccactctggcagctcttctctgtacatgcacatgcgtgtggaagtcagaggtcaacatcagtgtcttcctcaatggctcacctcctcagggtttgagacagggtttttcacaggacctggagctcactgattctgctggggtggctgcctgggaggcctagaagccttctgttcccacctccccagtgctggggttacaggcatgcaccacggggtctggcttgtgctgttttatgagtcagggtcttactatgtagccttggctggccttgaactcatgaagatccacctgcttctgtttcctaagtgctgggattaaaggcatatacgaccacacccggctcagaacctggcattttatgtgggtgctcatgcgtaagtcactacagccaccatcttgtagcccttggctgcctctctgccgtcataccgacagctatcctggaactcacctcatggtctctctcttagggtcaactaaaagcccactctctccaacttgactctcagcaccccagaatagttctgtagttaccacaccctgcatgcattctgcaaaacggaatgctactaaatccacacaagggacacaaaactaagccattaacagtctactgccatggagacagctttcaaatactgcgagtgaggacgcatgcagagccaggcgggctgcgcgaggtggcggcgacttacccgtaaatcacgtcatcgtcagagtcgttcaacatggaaaacgcagggttatccttcagctgggactctgaaagacaacaaaagcctttttaatgacagcattttgtgttattagtctaggtgggagtctgatggatcccaagccccgtctggacttggccgaggcattctgtgagattgcgatactatggttccaaacaccatttagctgccttttgcctctgtcctaacaaaaggcacagtgagtcacagtgccctacacctggggaacacctgagccaatgcgacccagagccatggtgacttaccgtacagggcattcttcgacggagagtacacaaaggccagcgtgtacaagtaaaagttcaacaggccatagaaagacaggaattcagctggtgttgacggtcaagggagaagcatgggtttggacacacaagccctttgcctcccattccctgcagccctttccaggataaaccagatgggggtccagcccagataccaggacgccgcagctccagctcatggccaggtgccataaggggcctcaggggcttagtgccatataggtttatgactcctgaaggacaggagggattgaggtctgctgacataagaaatgcaaacctgaagtgtcctcacctcttccacacacagacccccgagcacctgacagctggagctcagtcacaagggacacaacagaagccccgttcatcccaacacagctgctgtccctcagcctgacctcagacagggacagcaagagcaacaagctatggaccggatgtgggcacagcggaactagagcttcagcgctgtgtgagctttcccacagactcaagctgacaccatggcgatgctggcacctggctacacctgaatgaagcttagaaggtgctctcagcacccaggactccaatccctggctggtcctcggtgtgcgctccggatgtctgtctgtctgtctgtctgtctaagggagtcaacagctctggactgactggggatttgaatctgcaactgttcagtttctcaggactgcccacaagaagcaagcagcagagcaccgagaatggtctagtgtggtcatccttttggattcaggctgtgcagtgactcagccctgctgtgtgtcagtctcctacctcaggaggaggacggatgaaactcacccttcccagggccaacaggaagccaagaaggagggcaagccatgcttgaggcctgctgagcacaggtcaaaagggactgactgatcccctcataaatgtctaaggctaaggtgctagccatgaacacagtgtggctccaaggcccagctctccgagacaaggatatagttctggtagtgagccgacagttctgctacgaagttgtcctgcaacacttgtgctccaaaccgtaggtagaggatgacgatgctgaaagagaagagggagccaccatgtagaaacacagaagggcttacctcagcaagacttaacaggaaacttctatgcttctatagacacactatttgacaccccacccccagtcatttttgctccagggaaaagcaaaacaaaaaaaccaatgcaactaaagaggagcgtaggcctctgctgggccgctttagcttttagggagtagagatcaagactaaccaagttgtgtcttagaacatagtccagcaaacactgcctgggggagggctttgtggatggctgccacctgtcccaacagtggcttccccttgatgcctgctgactgctcacacagggccctgtcctcagcaccaaaaaggtctctaggcacatgcacccttcaggaaactttgcaggctatgcttccgtgatgcagttgactgtaaatgtgcagggtttgggtaaatgtgggttaacatgcctcacatgcctgggcacttatgatggaacgtttgtaaccgaggccattatagcttcctccccacaccccctgagacagtgtttctctgtgtagccctggctgtcttggagcttgctctgtataccaggctggcctcgaactcagatcaacctgcctctgcctccggagtgcggggattaaaggcgtgcaccagcaccatccggctgttgtataactgatcaggagctgtggccccattgactcacatgttttgatgactggcccatagggagtggcattattaggtgtgaccttgttagaggaagcccaggctcagtggtacacggttcttttcctgatgcctgtggccccagatgtacaactctcagctccttctcctgtatcacgtctgccgcatgctgccatgctgctagacctcagaactgtaagccagccccagctaaaggttttcctttgtaagagttgtagtggtcatggtgtctaatcacagcaacaaaaccctaagaaaccatccctctgactttgtggatatgtgtggccacaaacaccctgaatcaactccatgcaaggagataacagggagaaaggaaatgaagtgttaaatcatcatgaagtcccggggctgtggagaggcttgaggcccatcatgtcgcctcgaggacgtgagttcaggtgcctggcacgtaggtaaaagctgggagcgtgggagtggcagagggcatctgtaagcattgggaagtgagctggggcatgcagacacagagactgtcggatagccagcctaacctattagtgagctcccggtccagagaaagacagagagctgagctaacaaaatagctcagcaggttacaatgcctgtggccaagcctgactacctgagagctgtccctggatcacacatggaggagcgagcagagaacttactcctgcaccttctcctctgacctccacatacatttgtaccatcccaacacacacattagttaacattaaacatggaaaatggaaaaggaagatactcatgttaaccctctggctccagacacacacatgcaggcacacccaagcacacccacacacatgaatacacacccagacacataatgcatgcacatccagatacgcacacatgcacgcacacccaagcacacgcaggcgcacacatacatgagccccccctccccacacacacaccctcccacagtgaagtcttacctaataactagcactacaaaggtcaacgcagtcaaaaactttaacctgagatctgaaaaaagaagaagatgcaaattccacttcacctcagagtttgacacacaaaaacaaaatcaaaaccaaaaaccaatccacccctgggcaggccctcacccttgcatgctctaagtctgttctactgtggctgggaaaggctacgtacagcagggccaacacagtggtttctggcgaaggcctctcaatcatgtggctcgccccagtgaaggacattgttattaatgatccttacaggtcccgggcagctcacgtagctctgtggcaccaggggccactgaattctactctaaagggttctttcaacactgctaatccttcttgaggaatctcttggcttcctagggccaagggcttctgggggtgtggcccctggtgccctatgcttcccagcatggcactcacccacgtaaggcatatgacggagctcggagcatgctcgcactatcaagaatagaaggtataaaatgtacacagcggccaccaccatgaagaagaccttcatgccctggaaaaaaggaggtgggtgaggttgagactaggctttcatgtgtcctctagcacccccacagcaatcgacccagagccttgggtcacccacactgccacagcatcaggaagggcccctcaagcagggcacctcgtgtcacgatcacatagacacaagcacaggtgcctggcctaatagaacccaaggccagagtgtgctgagcaattgctagcggctgatgactttgcctggggtggggcctgacccttgtgctactgaggacaaaggtcacgccaacgagggctggacccagctggtcctcatacaagtctttgactgttctgggcctcagagttcctgagaaaggaggggctggaatgagcattcccttccagtcggaggatgggaaatcccttgctgagggtcagaggtcagtggctctggtgagagcaggttccagatgatgtatgtcctcctcactgagcccccctgcctatgaggctcccgtgggtaggagtgtctacacctttcctgatctctctgaagcagagccgctctctcatggtcacagcatcgagattgcgactgcaggtcaaagagcagggttcagctcctgctgtggaagaaccctcagtctggttgtttcctcatcgcggggaggggcaggacagctgttcccagcaccctggcagtctttgatccctgcagtatccttcagtaaagggtgtgggctaccccctgttctgaggcccttgaagctatatcgcagatggcctggctgggaagggaagggcttgctgacaattcaggatgaagtcctgtctgcgacatttggccaagagctctacatcccttgtgtgatgaaagagattccattactgcccccatttcacagatgaagaaacgtaaggggcttagtctccagttggacctgtagtggcctgcgctgcctacccttgcagtctagctcctaactctgtagccttccttcctgcctcagtttcccacagaaatgatgaaccaggccagacaaacacaaaggcaagagcagaccagtctgtaaccaccaattcctctaaacgttggactttcactgactcttcctcaacccagcctccacccagaaaaccccgttgaagctctgccctgcctacagctggctccaagctccccaccccgcagtactgacgcccctttctgagctaagctcctcctaggacatcccgctctggcccctcaccccggagtcttcctcctctggtcccccagtacctagcgagaccagtgttcgccctcagtctatcaccctcactggtgaggtcctcatgcctgtgtggcaaggacttgagcaagtgagctgtctccccagcctatatcccactcctgaactttctatattcctatctcaacagccatttagaagctaaaccaggcacttcatcaaagaagatcagcatgtctgtctggagtcttcacggatactgcttacctgaaagtttccggtgtcaacccgatactggtacatgggatcatttaattcattaaatctaaaaggatgatgttgaaaatacagattaataagagcacttactctacacttcacacttcccccaacttgggtttttcatttgtttttttgcttgtatagcacttggtacaaccactggaggattttaaaatagcaatcctgtattatacactgagaaagcatccagcactaagccggcaagggaacatgcctactgtgtccatgctcatcagtgtggcgaaggggcagggttatttatgccttatgtagctaaggcttatcttttgctcattgtgtttctgtgagtgctgtgtgcacatgagtgcaggtgacgctggagcccagagctgtaggctcccctagaggagtcataggtggttctaagccacctgacatgggagctgggagtacacttgagtcctctggaagagtacgcttaacggagccatctctccagccccaggggctatttcaatggcatacccagacatgtgagatagacgaaggcaaagcaagccaaatagataataagtaactataaagtgcatgagcttaaatgtcagaattagcattggcatgggacctgagcttcagggaagtaagtggcatgtggcagggatgctgcagaacgcatcaggccacggtggcacgaaagacgcatgaaaagccacagaccaaccacgctgatcaggggctgagcagggtctctgaggagctgggcagtgctacacaggcctggaagcagttagtcacagaaagggatgtgggtctaactaggatcacggcagtctaagcagggtcacgtgactctaagcagggtcaagcctgaagctctgcaaggatcagagtgtctgaggtgcatgaggggatcgcagcatgtctgctgtcccagcaaaccgagtcatttcttgctgaagaaggttacgatgacacaggcgttctcaccttctacttaggctagaagacccctttactgcaagccacacaagccaagcccaattccttggatccagttatgtgactatgctgggcagaagctgtcttctgggtgagatggcagggcaggcagattcagcctgccctctgttgtcagcactttccagggctgacgtttcacacccagaagcgttgcgttactcacgtctgccatattcccagcgtgacagaagccagccacagcagtccaacgatgaagaacttaggcaaatagaaagttaaacattttctctctccctaaaaacaaacagtaggaaaaaagtaagatatacagcaaacagtgtcttattctaacagacatgcagaaaccccaaacgcttccacacatcttgtccctgctctgcagcgtgggccagagaccatctcgtgggaccatattctgaagctctgtctgtctgcttacctggacccgtatcccatgatacacgcacagccagaagagcagcagggcacacaggaacagagactggaagaagtcgtccagcatccccgggaaccagctattcaccaagaaggagagtgggaagaaagggtctggaagggagaaggcggaacgctgtcaagaccaccggaggaggctgctaaacagcagagcccccggccactctcaagcttagggctcaatatcaagatttcccctggtcagagctcaagggcaggtagcaaagcattttgttttctgaatgtctgaaaggcacagaacagattgcaacagtgatcctagcggagagccatctgcccctgcgtcagctcctcctgcagcccgagaatctcctgcactgcagcaagggccttttggaatggggacagaggaagagacagagcacgggcacctcagccaagttccaagactgctgagcctgcagcttcgtgtctcttcaggatccaagcatctgcagtggcctgtgtgacatggggcccaggaagagcaccacgacatactcccccagggactcccctcgggcactcctggggactctgggaccaggccactctttacaatgcctgccagctcacaatccgagcggggaaagattggagataaagacggcacccaccattgtagagcagcagcagggccaggaggacagacatccacttctgctcgatgccccagtccctcatggagaacttgcgcaggtgccgcagaccttctgggtccctgtgtctgcgtggaacggggtctctcgacgcgggtgggcaaagcgtggatgaatgacagacagacacacacgcaggagagtttgtgtggaatctgaatgtaatttgtcaaatcgaacatcagactttttatgcagaagacaacaaggtagttgggtgacatacccacaaggtacaaatgaggtaaccggatgcttaatgactcttacacagaacagaggaatgaaaatgcaaagatcggaaggaactgggcaataaaacaactgagacagagtcagccctgtctaaggtcagctatagtcttagaagccaggtgtgagaactttactctcctagtgcaagggctttcacacccaagtcatggttctaactagggagttccgttctagctaaccatctcatgaataatgcaatactttaaaaccacagctggatctacttcctaaaccattgtaaattcctgtatataggtgtaactcagctataattctaaatatctattctggtttctcctacggtcagaaacttctttcttccttagtgatggtaaattcctgtgaagggcagtgacctaacttttactcaaagagatagtgtaataccaggggcagtactgaattccaagcccaaggtcttgctaaggaagaactaggactgttggaacacaggcggacggctttagctatgtcagaattcaatcttaaaaggcacttatgataggaaaaaattgaaagagagcacgtggatccatacactagactaacgcggggatggaactcgggaatgaaagattgctgtatgggtagggaacgctagactccaggaggagagcttccttgaaactcttttgcctcatgagtgacttttaagcctctcggcttgtccagttgactcgaccagagagcgtagcactcagggaatgtacaaacaggcactgcaaagcaaacagccactgactgcctgcagggtgagtctcacccagtcagggaggtaccaggcaggatccattgggccagtcactgcttaaaatgactaacgtggtcccatcagtgacagtgacagccaaaacaaaacaaaaaaaaatatgattgctgcgtgtggccacgggtgacaggggtcgcacccttgcatttcggcttgggccgagaggcaaagtcatgccacccagaggcaagtattctctcaaacacctccatgtgtgtgtagagcccttgggagaaagttctctaaacagctctcacacactgtacagtgtgttatatctagggctgttatcctttttccttgtcatctaacataaactactaatttcctggcctgtgtgctgttttctactgagattcaggcctcttccccatttaagaacatatttagggctgtgtgcatcaatctttaggccctaggagaatccagacaccaggtagttctcaaaaaaaaaaaaaaaaaaaaaaaaaagccatgcagtggtggcgcacgcctttaatcgcagtacttgggaggcagaggcaggcagatttctgagttctaggtcagactgatctacagaatgagttctgggacaccaggacagctggggctatacagagaaatcctgtctcgaaaaaccaaaaccaaaacaaaacaaaaaattctgtgagacttgctatgagggaggccagtggtccacttcattctccatggcctccagtcaagggtccagggccctttttctaccacacttcctacacctttgccacatgcctatgtgctggtctccacggtgggtctctaacacaccatgcagctggagaggccatctccacacgccatacagacctaatgctacattccccgtcagcaccaggtgcagagcagctgacagcggaacggtgccatcagccaccgagtagcacgctctgtctttacggctaggctttctcaggacccttctatgctctgccagtttcttcaaagtgagtgtgggcacagacttcaggtcccaaatgaaccaaaagcttgcatttgcagaatcgtatctctgcaagctttcaaacgcccaaagactcaactgttcaggacaaaagaaagccacgtctgcactgagactgtcactccaacaagggcagctcccttctatgagggctacgtggtgtttacaggggtgggaattcactggacaccagtggtcagcaatgactctcacactacacaggagagagcacagaatgacacctcattcactctttgcagcacagagccccagtcagcccacactgggagccccagcagggctccgagtttggagctggcagagagcagcaccaccctcagtgaccgcggcagagcccctcaggcaaacgctactcacaatcacgatgaaggtgagcaccacaaacacgaagcggaaccagatctccagccgggaaaacgcagggttgtatgtcttccactgaaacgggaaatgcaggggcggggatggggtcagacagtgtctgtgtgagcacgcctgtgcgcaagacaccaagaggcagatctgcacctgaaggggcgacacctgactaccagaaacagttctcccatggtgagggcttgggcaagacaggatgacagggtgcccaacgattagtaacaattaccgaggaggttaaaatgctgcttccttctgtttcacatgttgtaacaaattttacttctatactgaagaacagatccaaaatcttaagtatcaacatttattgaaatggttttaagtggtgaatctagcagataaattatcatctgaattattaattttctatcaaaagtcaaccttcactagaaaacaccaatatctacatgcaaagaaacagacttgtgtgtaagatctgagtgtgggaagactctctctcctaaaataagtaaagtatgtgaggacggaatctgcagccttaaatcacaggcagctagctaagcgtgggatggctggctggctgagcgcaccctggcttctccagtgtccgggctgtttgattaagtgattcttgagttctacacacttaagctggttttccgagataaactgtacgagaccctgatgcatcaaaccacctaacaagggagtcacagaagctggccgctggctgcacggcacactcaccgtgaagttcatatccttgatgggctggttcaggtgctcaaaccccacagtaaccctgtactgtgtgtaattcaggtagccaaggtgggccacgatgatttctgcacatttctgaaaggaggaggtccacgtcacaaaagcaagtgaagaggacccctgccacccacagcccggagcgactcatttcaacaacagatgagccgaatgggagaactcgccgccaaaagctcagagaacgccagcagctgcctgccaaggatggttcctagaaagcaagcacccaatgggacttacagtgatcggaatcaatctccagcagacaactgaatacatcacctgcatagaaaagctaactttgcaggaacaccagcctggccagtcggtaatctctactgcacaggagtcgcaggcttagccaccacacaagcatcacagtctacatgtcttgggctccctatgcagcgctgtgaccagacagagtgtgtaccatagctgcttctcttcactttcagcttgctgttttctacacagatctccttcccttatgcctctcctccccacaacagaagccaaggctgtgggtggcagatgtggatgctttgcagtctactgagtcccctgctcagtccttcaggatgacttggggccctactatgtagcaaaacctcaccctggcatgtggctgtgcagcctacaaaggtctgagaccattctccatcacagctctgctccaaccctgccacaaggaccttcaacattgctccgttatctggataggagtccttctttcactaacccatcccccaagccaaagcaggagtcaccccagagtcaccctgggattaactttcttttcttgagtggcttcccacctcctcagtactggctgcctgccctgccaaagtgtgtggttcacatacccagcgaagctaagctcctcccctctctgctgcgactgacagtcacaggtgtagctaaggactcagtggaaccaggaccaggcacattcaatgtcagcacacaccagcacaccttccatgagacggcaacatttcttaaacatacaagaatcttttccaattttcgtggggcattttaccatttttaaagattaatttatttttatttgtgtgtgctagcatgcatcagatccctcagggcctgagttacaggaggtcgtggaccccccagctgtgggtgctggggaatgaactctgctctctggacaagcagcaaatgaccttcatacaacccacctctccagccagaggcgttttattaagagttacagcttgggtactggagaggtggctcagaggttaagagcactgactcctcttccaaaggtcctgagttcaattcccagcaaccacatggtggctcacaaccatctgtagtgggatccaatgccctcttctggtgtgtctgaagacagctacatataaataaaataaatcttaaaaaacaaaagttacagctcaagttggatgcactgtcacagcccacagagaagcaacctggggatgtggattccaggctcaagccacgctctgaaagattacaaagcacctggcaaaaggatggacgcgtcctcaccacctcaggggcgagtggtttgggttttgtttttttttttttttttctgttgtttgtttttgttttttttatatcaaattaacaacaaaggctagggaggaggtggcttggtggagaacgccatgtacgaggtcagcgttcccacctctgcctcctgggattccttacgctggagaagagactggaatcctagatccttaaagcaaggctgcctatggtgagctctgggtgcaagtgaatgaacctaacaatatctaaagccagaatgactgagggagacactcaataccaaactctgatctctacatgcatgcacaaaagcatgcagaaatgcacatacatacagttcacacatacatacagagaaacgtaaaaaccccaagagggtgacgaatatccatctaacacaaaaagtccttgttttcttgaggtgggaccatttccctgcagcaataaggggattacagagtggataactaggagagacactcccaaatcctgactggtgtaaagttatgcaggctatccacggtgcatcccaggagcagggaggccccccactcccaacctcaccccaccccaccaagcccactctccttgagagtcctgtgggctgggaaaatgcctccgacctgccagccagggtgaccagtcacagcagccatggaactagtactcactgagcagctgtgtcccattctggtggccaaggggatcttgctcattcctgcctggggctgcaaagatgcttttgggacttctacacatgccatcctcattgctcaacagaattgacttgtgtgccttctgcacacaggatggtgaggacacagggggaccttgatcctggtgactttcccagaacagaccagaagagcttaatcccccacagatgagaatatattccagaaatgtctcaggctgcttgcttagatgggaggcgagatggcgggtgtgtatgtgtgggcgtcagttacttctccaatgccatcttgtctgtgacagccatggctggggttgctgaggtggagaaagggccctcatccgagttctaaaccctctgaatcaacaggaaggaaacaagagacgaggactggccagtgcacagtcattccctgttcaacgctctccttcccgggagaaatcaactgtatttttactgttagtaactcggcagactgcatgcggataaagccacacacaggcttctggataaaagaacaccagagggcttctggataaaaaaaacagcttagatcctgttccttctacttagcatctgtgtcaacctggacaattgctgtgacctcttgaggcctctgtttcttcttttataaaatagaatttgatagtagctcctaccctgtggacctcctgtgaggatttaatgagtggcacagagaaggtcctcagcatgagacctggcagcccatgccagcatcgcttgtttagcgagtcctctcctcaactcctccacgccctgcctgttctgaccctctccaagggctcctgctgcaggaacctgttgagtcccgatgtggcagtttcaaggatcggggtctgagttgctggcttcttcttcttcttcttttttttttttttggtctttctagacagggtttctctgtgtagccctggctgtcctggaactcactctgtagaccaggctgtcctcggactcagaaatctgcctgcctctgcctcctgagtgctgggattaaaggcgtgcgccaccactgcccggcagagttgatggcttctgaaaatatagtatcgacagataatggagtgagagttcattcttatgtggatccagtggccacacgctatatcccaccgcggaggcctacaaaagtagtccctgactccaggaggcctgggtactctgtccccgctcacagatggatcagagctttcaatacccagtataaccgacccgaagccatagatagcaggactaaccctagaacagagggcagaggttcacccgagacttggtcctccattgcctaggaacagcagtcagcaggtgccctacgggctcggggtttgtggctgtgcatgcgcatgtgcgtgtgcatgtttgtgtgtgtgattatgtaaattaagaggcttctgtgccgaccaacagaggactggggaaaagaaacacgcacgtatacaaagcggagtttattaacaataaggaaaatgacatcatgaggtgtttgaaaaatggatgtggcagaaagccttacactcagcaaaacaggccaaactacaaacgataaacagtgccttttttttgtttttttttttgatttatttatttattatatgtaagtacactgtagctgtcttcagacactccagaagagggagtcagatctctttatggatggttgtgaaccaccatgtggttgctgggatttgaactctggacctttggaagagcagtcgggtgctcttacccactgagccatctcaccagcccagtgcctgttttatatgtgggacctagacttaaaaattatgtaccggagtttccatgtgtgtgtggggctgtgacatggaaatacctgtcagggacgggaacagaggagccgagacaaatgacaggggtgggcagtggaggggccaggggccaggtgagtgagggggcggtgggaaaggggatgaatgcgagccaagtgtgtgtgcaaattgcacgtggacaagcaggtctgtgacgcacttgcggctcatgactgactgtggagacatgaaacacactcacccctgcacacgtgagggtcctcgtccggttgtgaaccttgttatggatgtacgtcgtggttccatcttgagacacaccatcgaccttcactgtcatggtgaagctggtttggatggatgtttctacagagagagagagagaactctgttacctgagaccacatcgggcaactcgcagcagcagagcctcctgccgacaggcatccacagagatctgggaagcaccccgcccgccctacgtgctgagaaggctctgctacctcccaccattgctgaggggcctgtgctatgtcaaacctgcatcgatgacccatctgtttcacctcacatacaggtgcagggctataaaattaccccttttcactcttcacagagattcttcaagttataccaagataaaacaaatctctatttcttactaaaatttgtctaattatatttttagtataaaacagagaactgagctgttgaaatggttcagtggatagagaagcctatggctaaaccacctcagctctacaccaagaatttatttacatggtagaagaggatcaactccctctagctgacctcgacctccacatacatacacacacactctctcaaataaatacatgtggtagattttaagagagagagaggtggggacagagtggggacattttggagagatggtgtggcgttcccaaggcttgctgcttgggactggagttcaaatcctagcacctgcatacaagtgttccacacacgcctatgaccctagcaccgtggagagaggagacaggaggatcgctgagcctttctggctttcaggaagtgtgagccccaggttcagggagagatcatgcctcaaaagaacaggcagagggtgacagaaggcccagatgtcctcttctggcctctgtgtcagcagcagatatgcaccctctcactcatgtacacagatatttaaacagcaacaataactcaaaagtggcttcacagaacaattaaaaccccactcaaataaccagagttaacatcttctgcgtccgtcctttccctagaccgtcatctaaatacatacatcctgatgtaaaatttacttttgctttttctcactttttttttactatgatcaagggattgttttctttcttggattacctcagctgatcagaaaccagcctcagttctcaccagaatgaaatacagcttgcctcacagaagatgcagaggctagtctctgtcagcaacggtgccccaggactgggctgctcccctctcccactgccgactgaacaggcccagcacgtgcagtggtagccctggcttctaccccacgatactccctctccccaagtcaaactgtccacacgggtaccgagcatccctagggatccaaagcatgccttggggtgtcaagacgcgatgctttctcagctgcccacaccctacagacgagcaccctggcttaccttgggacgcatttttctaatgtaaggcgtggccatcttcctacatggacctgatagcatgtgcccagacaatgtaaagtcttttccacctctttggaatgagagtttacactaaaaacaacaagccaccccaaataccttctgagggctccagctccacaacgcacgtcagccatagttgttggttatatgtggacagtgggtttgaaggtataactgtctttagctgaagcagaagaaaaaaaaaaacaaaacaaaacaaagtaatcacatgacctgttcacactccctgaatacctcatcataaagtataaaacaaacactttgcacacagctcagcttgcaagccctgacagagctgggtcagctttctcttgcagaccacaaggaactagcttcctacagaggcctggctgcactgccttcgtgcggtggtacaagacagcagagaactgtccatgttcacagtatcctcatctctgtagtactgtgattggctgtggacatcgcatctctgtggtgctgtgattggggtcagacatcgctgcctgatgtcaacctgccagcggagttaactgagacggctggccgtgtgacaatggtcatctacagtgtctatctcctgtaaacaccacagtggtttcccatggccaaggctgtggaggaagctggtgaaggtgcctacctacgttcccacagccagaattatttgaaagcttcatctgcagaggtgaatgtcttatcttgttttcaggctaacagagtctctaccaaactttctgggaccacacttgtctgaaagccattggggagtgaaaactattagacaggaaagttgtctttctgaagcaaaatgtttttttttagaagctctgagttccacgggatgaccgttactctccctgtcacagagagagaccctgagaggcagggactatgagacccacaactgtcaagaaacctcatggtggtgccccttcaaatcagaccctctgcctcagagctcaatacgacgaggaatgcaaagaggcctcgaaggctggctacccagaggtggctccagggtggcagtggcagagaactgtatactgtaaaaatcgtaagggagccaggcactgtgaaaaatgctagcactcagaaggcagaggcaggtgcaattttgtgagttcagggccagcctgatctacatatcaagttctaggctaaccaagagaccaatgcctcaaaacaaatcagaaattgtaagacgagaccctaataggtaggcaggctggagacaggaggacggacaaacgactgtgaaggcacacgcagcatggcgctctgaagacccgggagcatattcagctatagactggatacttctccaattggaaggacttgtttttgataaaggtgatgacaaatcaaggaacatttaaataggggccagcagactttcatttaagctgccctcatgcagggaatctcaaccaacaaagagagccgctgctattggaactaacagggaacaggtcctaccttagacaaacagagagaggtcagccattaagtgcctcccatgcaagcaagggcaccagaggtccatgcccccgcccccacacccacccggcatccatcaggccaggtggcgcacagttgtaatcccagctctggggaggtacagacaggaggattcctaggctcactggccagccagcctagcgggcaaggccaagtcccagcgagagacactcagctcaaaaaacaaacaaacaaacaaagaaacgacataacaaaacccagctgatagcttctgaggacctaacctgtggctagcctctggcctccacatacatgtgcatgagtgcacatatacaaattaagctttttaaaggaaaggatcagatgcctaagtcatcattgtgccatcacagtgagtgcagcagggtatcccacataagcagtcagcatgagttaaggacgcttggaagtgagctgtagttctgtcagggggacacagtgtccttccaccaccatcccccctaagacaccgaggacgctaacaagggaatttcagtggacaggaccccaactgtgaaagaagaactgtgtgctggcagagcaggctgagcagtctatcctcagcaggctctcatcagggtgaagtgtgtgatgaacaccacccgattcttacagctcagtacctcttacctttttgctactattgagtgaataattagcaggcaaagtctcgatcactctgggtcctagagcaacaaagagaaggggagcgagggattaaagtggataacttactgattctgtaatcaaattaaatgcaagaaagactcacacattagacagaaagctctctcgtacctggccccattttaaaaaagagattttatgtaaccaggtcaaatagccaacacagtagacgctctgccgtgtgacacagcttccatgcgcattaaggtggaaagaccagcaagcaatgtgagatcgccagactttccccaacgctctttctagtacatggccccaatgaaacattactaaggaaagaagactggttaatgaacttctccaattaacctagttgtctagaaacactaagcaggagcgaaacatatggcttttttgaaatcaatgtttcattaagttctttctcccctaaatttacagcgattacagagcctacgattttaagcacattgtagagtacaattcagcaggactcaggactctgtgctgtgtagacacggtcacccatcttgtaaaactcagtctgcactagtaagctccccgccccccctccctgtgcccagcaggcatctctgtgtacctcagctaggtggggtcacaccgtactatctgtttgtgaatggtttatttaatttagtacagggtactcatgactcatgcagtaatgtgtctaagttgtctaatttttttctttttcctttttgtttgcatatgtgtcatagtgtgtgcacataagtgatcagaggactatgcaaggtagttggtgacctcctatggagttggggggttggcagcaagcaggccactggctttacccactgagccattgctgtgtaatatcttcttgcagggaagctctttaagccagtggttctcaacctgtctgtgggctgtgaacgaccctttcataggggtcacatatcagatatttacagtaataaaattagttataaagtagcaaggaaaataattttatggttggggatcaccacaacatgaggaactatgtattaaaggatagcagtattaggaaggttgaggaccactgctttaaacagaaagtaaatagctcgaaatagcttcaggaagtccctgaaactgaccagattcactgggcccctccctgacagataagcaagaaaagctgagagctcttcttcttctcttcttcttcttcttcttctcttcttcttcttcttcttctcttcttcttcttcttcttttttttttttttttttggtttttctagacagggtttctctgtgtagctctggaactcactttgtagaccaggctggcctcaaactcagaaatctgcctgcctctacctcccaagtgctgggattaaaggcgtgtgccacagccgggcatggacagagttccaggacagccaggactatacagagaaaccctatcttgaaaaaccaaaaaaaaaaaaaaaaaaaaaaaaaaaaaacaaaaaaaaaaaacataaatactacttgtatgcgatatttgttctaccctttctcttcaacctgtacgttgtccctggttagaaaataaggcttctgtagacaaaatacggtctgtgtcatatttgtgcatgtgcacacgtgtgtcacggagtatgcgtgatgtacacatacaggggaggtataaatacctatggatatgtgtgtgcagaggccagggagaagagctctggtgtcttcctctctcacttctgatggcggtcctctgaggcagggtctctccctgaacctagaactcacattttccaaggaggatggaagtcagcgagcctccagtgattgctacgtctccatctctccccaccagcaggaatggggatgcaggcaggtgctaggatctgaactcaggtcctcatggtttctcagcaaatgcccttaacctctgagccatctctccaacccctcatgtagtgttttcagtctagtctagctctgccttttaatcggaggatttaatcaccttatatttagttactcattaggagggctcatgccagttcctctatatttctgtttcctgcacatttgtttcccattggccccacagcttttttgttccgcacttgacacccaaagtcatagtctgactggagtttctaacagcttaatatgacaatacataaatactctgtctcatctttcatgttacaattgtgacgtgatctttctgaacagatatgcacatacagacatacagacacacacacagacacatacacagcttgcacatcaccgggagaggtgctgagaatcaaacccatggcctcgaatgtgctaggtagtcaagtactctcccacttatttgttattttatatccaaaccaataaaataatgttaacaattaagtctcttacgtaggaaccaaagtgtggacttgcattcttactggaatagcagctttcacattctcattgtaaacatgcaggccttcaagcaatgggaaaatgagagtgggttttcacactgatatcagaatgacatgagcttttataattactaacgtcgcctttgctggacttgctgtgttcaaacccgcggctctgcctgcagcacaggtgtagtggcagctgctcctttggccctgtggctttagcttcctggggacatcttcctttcacccccactttctcatctagagacaaggtcttgctatttagccttgcctgacctcagacatccaagttctaggaattcaggcgtgagccagcacacgcgagctccacctcctgcttgaagaacagttttgcagcaggattcctggttgagaactctgagcattttcaatgcatcagtctgtcttttgcccggtacgactgagctgagacccgtgctggcaacctcaccgaggactgcctgtctgtagtgagtccctctttcttgctctggtcgggattctgtctggtgtaggctgtagtgtcttggtaggagactctgaagttagaccacggcagctcattaaacttcctgcttattcacctttcgttcaaattggcaactattctccctgccctcttgccttctcctgagactcacaacctgtgtatggattacttgctggtggcccaaaggccctggaggctctgttcaatatctccgatcatttctattctgctccccagactcaaacatgccagtcagcctatcttcgggtttgtagatgcttccccttggcctgttccaatctgattcacccatccagtggacgttttaattcactatggtactttttaggtccagaatttccttttagtttctcttcccttcccggcatcccctaatgctctctggatctttcctcttactctctatgacggctatcacagcctctgttctgtctagcagatctgtcacatggtttcaaggatagagtctgatgtacttataatttttttcttttggtgagccatattttattatttatcagtcggttttgtctttaaaggcaatgctatggcacctggaagtcagggtctacacagtgagactctctttttaaagtaaattaaaagaaaatcattctcagcttgggatgccaattctctgctgcctccgtggctgccccagcttgctgccaacattcctccatccaactcagaccgtgctggtgtagtgtgtggaccttgaccggtacaaggccatgtctcagaggcgcctgcaaatcctgtgagggtgtctccgtataggaagagcttcccaagcggactcaacactgtctctggcttctcggagagacttagcaaccagtacctgaagaacctggacgctaagctagctagtcgctctgggcctcagttcccatgtctgcagaataaggtagtaacatagcagtccctaatctacccctgctctccaatatagcactgccacataaagtaattaagaggagagtgttaacaacagttaacttcacgtgttaatctcagtgggtcatagggcgtggatggcaaggtgtttggttaaacatggctgtcacaagtctctgagggacaactgggtaagattctcatggttcagccagtcgactgaataaagcagaccgccctatgcagggaaagtgagcaaagagctgaacagatagctaaggagaacttggtcgcccatcttcagtaggaaccttagtctcctgttgtgagactcagacctgaactgggctcacacaatatacccattgggtcttgggcccctggaccctgactggctcccatttgctgactagagacctgcagatgtcttaatatcccaaatcgcatgctccagttcctttactttacatagatataagaataatatcatatatgattatataatatatgctatatctcataattatattacatatctagcaatatattgtatctagtaataataccgacaattatttatagtgtaattcacttccactttaagataaataccattgtttgtaatgattatattatatattatgattgtatacagtagtgagatgtaattataatatagtggatacacatgtatgcatatatatgtgtgtgcatacatatgcacatatgtattccctattgtttctctttctctagaagatgcatagtaatctgcacatgagagaaagcgatgaaactcttgtgccccatgtattggctttggggcaccaacttccaccttcatctcaaaggctgaatatagtcagggtgtttgagacatagctgtttgaggaaacaaaagctggctaatgtctcacagagactgcacgcaatcctgatgcctccctacccgtgtgaaagggcaggttaagatgcaggtgacaatgggtgagccctggtaacagttacgatggagagaactgctgtgacttaatcccttagtgacttaacagcaaggaggagaagttgtcggtagtcgctatggtgacaactgtgcccttttcattaccacaaggcaagaagcatgtcaatctcccaccctcgatttctgagacacaaacacccctgggatataaaactgaggcttaacgcaatccacactcagtgttacatgcatcattcagaagagcgaatgcaatccaccctcaatgagcatgctagcttacttaaaaagaaaggaaaagaaacgaaggagagcactctcttggcaaagctggcttctgctgcccatggtggggaaagacacagccccagcccctgaaaccttgggaagaccattcagcttccgtggctgttttatggctgtataaagggaagttgggggctggggaaacagcccagcgggccaagagcgtgaggcgccagtatgaggactagacctgacaccctggcacccaagcaaacgctgtgcaggaagagacctgcctagatgccagggctcggaaggcagagtggcatccccagagcgagctgactggctggacaggctgaatcagtgagctctgggttcaagtgagagaccctgccttaatatacaaggtgacgaataacaggggaagacatgtgacaccaacatctggacacacagacacacagatacaggcacagacatcaacatctggacatacacagatacaggcacagacatctgacaccaacatctggacatacagacacataataccaccaccacccaccacaacaaaaataggctagcctttccagaggatgtgtcagagctacaaattattgggcagtttctaatgcccatgattttcacagggtcctggagcttggggtcaccagacaaatttccctgcacccccagtcccattcacctagatgttcacaaggcctgtatcccccttagacagtgggtgctggattccccaggacacaagactctagaaatgtttccgtgggttacaaagcaagttcaaagccaggttggcttttttaaagaggagaaggaagaggaggaggaggaggaggagaaacaggggaagagaaaataataataatgaatttattattattattattattcaaataaatggcaggtagcagcagctgccagtcccagcaaactgatccagggccctgagctgtgaacagcatgctgacattacccagcatgcctgctaggcctcccgggaagacaaggcgcagggtgtaaccacgctctgccctgcgggctcagagagaaggcacatctcccttcacactgagggtgggcgggtagaaccgatcctaagtgctgtaagaggaaaaacgattaaaaggcagacttaccctcaatgccgacgaagacggtcagtccgaaacagatgaagaagacaacaaacacaaggacgaagtggcgcttggagagcgtgtagagccgcatgggtgccaacctgtagggaagaagccgggagtgaggacggtcagggccctgcccacgccagtgccaccacccaggctgcacgaggccggcatctccccagcacagtgctggcctcggaagcacgccggctcccaagccagctgaccacccctgactgctgggcttggtcacctctggaatggatcattcctgtacatcagagccactgccactctggcctgcctcctgcaggacagacagactcacttcatgtggtgggagaatgaatactggggttcccatgccagggagaaatgtcaccacaccacagaggtggcataaccttttacatagcctactcatagctgccagaggagagccatagctcagaccaacaaggagccttgactccctgcatcggagagctatcactgagaatcccaaggaccagaggcaccagccatctccatccagccccaagcttaggctcagggtccctcatagcttgagatccggccaaagaccctcagcctggtgaagagcagcccagccttcccagaagcctgcttctgaatctctcccttcatcagggtgacaagcttctgtcatctacaggaataccgaagccgttcacaggactgactccagtatacacctacacattccctcagaacagagcatggcgcgtggggacactggagagatggctcggcagtcgagatctcgtactgctctatctagcaaaagacctgagtccagttcccagaacccacaccaggtggctcacaatagcctgcgactctagcgccaagagatctgaggccctcttggccccagtgggcaaaatgacacatacctctgacccctactccccaaacatatatgtgcacacacacaatttaaaaatgaaaatacatctttaaaacaaaaaagtcctcctcagtgttccatgttgcgttattagagaggcaaaccaagaggctactgtgccctgcagagtggccaaggtctgaactgtgcttgcactccagttagcttcgctaataaaaaaaaacagtgttgataggaagtggccaacctcactagaggcctaaagaggcggccagccccctagggaggagctaggggctcactttcagcctggtacttgacttgggagctgaaagcaacaggaaatctgaatcaacccagatagaggcgtggcctgggaacagagaaaggttgacttgtgctcagggtacacacccactcccttccacgagtgcctgaaattccggatagcaggcgggaagtgagcgttggggctgggcggtctccacacaaaggtgaggcttggtcaccatcgccactctgacacgtggcactgctaatcctgcaaggcctgtgcagccacccagccagttctcaggctggctgactttcagacttctggctgtctatgctgttcacttggtgagagaccaagtggagcctccaaggcatccgtgggactgcattccccgaggggacccataaaccattctgttggcatgatagagaaactgatcaatgtgctgctggctcaaatttgggccccgagggccttgtgctatcagctggaactggcctctgggatggggccagatttctttaaaacacagctctctccaaagggtggtaagagagagtttattctgagctaaaggtgagtgaccgtggaccaggtaccgagattcatgctgctttgatgatgttatgttccagcatacatttatcagctacatcaacttttatcagtcaaaacatttaccaagtacatcagtggggccactaggcaggcaggtcacattgtaacaggaaatccctgctgttggcttcagatgccatgatgatattcttagctttgggattggtggagcctaatggtctgtgtcttagttagggtcacgattgctgtgatgaacaccatggccaaagcagctcggggaggaaagggtgtatattgtagaaagtggtttccacttccacatcactgctcatcatcaaaggaacccaggactggaactcaaacagggcagaaacctagcggcaggagctgatgcagaggccatggaggggtgctgcttactggcttgttccccagggcccagtcagcctgcttttttttccttttattattattattattttatttattacgtattttcctcaatgacatttccaatgttatcccaaaagtcccccataccctcccccccacttccctaaccacccattctcatttttttggccctggcgttctccctgtactggggcatataaagtttgtgtgtccgatgggcctctctttccagtgatggctgactaggccatcttttgatacatatgtagctagtgtcaagagctccggggtactggttagttcttaatgttgttgcacctacagggttgcagatctctttagctccttggatactttctcagcctgctttcttatagaacccaggactaccagcccatggatggcaccactcacgatgggctggcccacccccagtcactgattctacagcagaatcttatggaggcattttctcaattgaggttcctttccctgatgactctaggctgtgtcaagctgtatacaactagccagtacaatctgttactacatcgaaaaagtttcgcccgacagttaaaaggaagtcagaatggacacagaggtaggtggtaaatggccaactggagaatttgagctctgaaggaaattctggctctcaatcagctgtgctccgacttccaaaatcattttacaggtcctcaggatagatgtggctttcccagggctttgcagttcacactctgggtttacagggaagctgagatctggggctgacgggcctgcccagcttgtcactgctatgctctctggcagcacctatggcttccctggagggaggaggccttaggaaatagggcccagttaatccctgtgtggaaaagccccgtggaactgagtcctggcaggagagcaaatgtccctctcgtcccatctctgtgacccagctgtctatttctttatactatgtgtttgaatatacgtttgttttaatgctgtaaagaagggaaggtttccaggcaactgcataagacatttccatgtagaaatcaaaatttacacaaagctaaatggactgggtggcagaaacagtgcaaacagagttcgctaacagtatctcacccatattaatggtgccaactgagaaaaatgtgccaggtctccaggagacactgggactaggggaggctggagagggccatccagaaactgtggcgtctttgccactctcctatggattgaaaatggctttcagagatctcagagccattgtgaactacaactgcactgtattcagtggctgggtcctgttgtcagacatcaacaacaaggagaactcctcggccaacggctaaaagcagaggcttagaggcagagaaaagcaaaggaaggttagattttaaacctggaattaaaagtgtatcatttggccaggcaccatggggcacgcctttaatcccagcactctggagacagaagcagagaagatctctgtaggatcgaggccagcctgatatatatatagcaagcatgaggatagccagggcttgagagatctcatctcaacacacaaaggcatcattgacaccctaaactcagtcactcagcagatgagaaaaaagcagacattcaggaagtgcttgatgacatgggtcaaatgtaaataacatgtgcctcccctccctgcctcccaggacaagagccactttggctcagttggcaggggaagcatgtttaataccagtcactcacataaaatagccaggcgcagcattacacctgcaagcctagcactggggaggcagaaacaactctggactaactggcttgagtacacatacacgcatgcgcaaacacacacacacacacacacacacacacacacacacacacacacacaccccgcccgccaacattttcccttcctaggtgttccaccgaggtgctgggtacatggcccagtgcctaaagtgctcgttacacaagtgtgaggcccaagttcagatccccagagcccatgttaaggctgggcgtgatagtggctgcttagcttgacgctgaagggcacagacagatcactggcactcagcaagctctgggttcagtgaaaggctgtttcaattaacaacaacaacaaaacaaacaataaagtgagagagacagaagacagaaaacacccgatgcttaccttgatcctccacatctctacacacatacattacacacacacatttttttacttaaaaaaaaaaaaaaaagcctccacttaaacccaagcaaaagttccctgatttagcaatcaagccccaaatcagtgggaagaagccacaggatagcaaactaacccctgagcctgagagtcgcagccccagggagccacctgtgctgggctcaactgggcactgggctagacaggatggtcacatgcaaaagatgccccgtccatcccagccagggttctcccagctcccaatctgaagggtttgatagctgagaatcctcagcttatccttgataaactctgagtctataacttacaagcaagagatgcctcggtcccaaagccgagagaaaagagcagtcctttttcagaacagccattccagccaccagagatcggcctggcggatgcatcccaactgcccagctcaaccggctgaaatgtcaagctggctgggaagcctgttgtccttcagggtcagaacaaccaaagaccacttctgcagctgctatacgcagggctgtgaggtaaaaatcagaggcccacagttctgcccacactcacctccactctgtggctaccatgatcttgaaattccccagctactacggtgtgtggttcactttagccaatgtgagatgctagggagtgagaagggatccctgcctctccagggcggaggacttctgtgaccccaccctactcactcccccaaaggctctctgctgtcctttatggcgtggagtttccctctctaggtctgtcaacctctcctgacttgggatctcacgaacatgccctatacgcctgaccaagctggggctggcacatccttggaagatcttccaaatgtaatgaaacaggccattcctatggacgctctgagctctgtctacagccacagacttatctcccagaggaatacaacatgacttcattggaaagtctacccccatccccaactgcagccgtaatcaaaactgtccacgccctgctgcccttcatatgttacagccatgaccgcttcgcaagggactgcttctactgaggggaagtctgtggagacaccgaggcacatgagcaaatcatgctacagggctctctgcaacacaggtgtctaccggggacacacctggctcttgctgctccctgcgtcttgtctctgtccacacctcagcttgtcccggcttatctcaggacaagttaaggaggaatttcctcctccatctccaactagccctcagtccagacccccatggaactacccacttgcctgatccactcggggctccaacgagagacctccatgtgacttgtttgacccaaatctcctggtcctctctgtcatctgctctacagccttcttcacttgaggtcctagttgcttaagcccgaatcgtagatgccacaagcagtctggtgtggaggtggcaagtcacatctaaagtcactggagtctggccttgttgggttgagcctggccattagccaccgacttatggaactgaggtcatgtccccactgcaagctaagccacttcccacaagatcgtctattaaagccaaaagcttcctatgagtacgtatgtcctccccccaacttaaaatactaaggcccacagatatgtccatccctatctgccagcatccttcatgttttcagcatttgacagttattaggcatcctgccagcaggacttgcccttcccactgccactggctgatctattagagccagcccccaggcgcctctcctgccttgggtgagacaccccaaccactgtgagaggaagtgcaggctacctctcaggacggagggctttactagacgtgaccaactatttgttctgccctccctcctcaccagcccagaactgcctgctgcttgcagtatgtgtcttatacatgggaaatgtctagtcaccaaagctctactttctctgccccggcctatctttttcttgctctgggttctactacattctctgctctgctaaacagtcaacccaggtccgtttttagtagcacctgtggctggttttgtcttctacatcaaaggcaagcaaagcagctctgtgacactttggtccaaaggctctctgaccaacatccacgccacagtcctcgacggctgtgctcgctcagcaggtgcatgtagcatcctggcgtggccagctggaaagtccagtctccattagcctggctgagtgcctctgagtccctgcccccaccatgatgcccactaagcacttctctctgccacacaggctcctcagtccataaaatggtactgcagagggcaggggacgagagctaatgactgtccagacctggaagtaaacgacaaggagggacttagctcagtggagagtgtgagaaagccccttcagggtgcccttgctagccatcatcacctctacagtaccccaacagcagcccacaccatcacctgcaaggaacacaagacgtcacctggcctgcacagacgccaggctgggcacattcaaaaactcagctactgtggtggtttgagtgagatgtgccccatgcacagcctgccatacgcctgcaatcccagcatcggggaggcaaaggcaggtaaatttttggagctcactggcagccattctacccaaatctgtgagctgcagattcagtgaaagaccatctcaaagcgcaaggtggtggatgccgggggggggggggggggggggggagagacgcctcctgaagaagcgctaacctgtagcattcgatagtatgacaggtttaccactcagtcaaattatacccagattccccaattcggtaaaaaagttttaaatctaccatcccacttcacattccagtgaagagtcaattttttttcacagtggcataagaacaatctcttatttggctcagtgtactggctttgtgtccagaagcctgggtccccgctttctaccatgcaagtgacattttctccttcctctataggatagggataagctgagtccttagaaggctgttgatacaggttgtcaatctacagaacaaatatagtccgtagtgagaaagcagccaaatctggatcatgctagttatcacttgtgcggtctttgcttggaaggggaaccttcttttattatgatttatttatagtccgtctccccacccccaccccgtggtgtagccttgtctggcctggaacctgctctgtataactctctggcctcaaactcatagagacccacctgcctctgcatgttccccatacccagcaacttgtttcatttttcaagcaggattttaatttgttgcccaggctagacctgggtttaagagacgctcttgccctagcctccccagatatgaccaagagctccaggcatgccccaccatgcccagattttctccttatttttgaaaatacaaaacagaacagaccaaactttagaccttagcatcatatctctgaagatccactgtgcaaaaaacctctgcgcctttagccccagccactgagagggaaagctggtatttcctgtgtaccttcttgacaccaggttagctacctggggaactaacactgagcacaggtattaccaggccattttgtataaggggaaatggggggcaggtttcaggtcagtaggaggtaggggtagggtctgaacctacaatgtacccccatcatgtgaaaggctagctttgggaaggggggtctaccatccccctcatgacctctctacagtcaccttttaaatgatggacatttgacaggaaacttctgcagggggagggggatctgaagattgaaatttcaaccagctaaactacaaaccattgggcaggcattccgtggtcatccaaggcctaacaacctcaccacattttaacagaggaaggctcagtgagaaagcatgagatcaagtgtattcttcccgggtcgtaagcccagaggctcacagatgcatgctgttaggtcatcagacaccctctcaagccaaacaggaggaggaagcatgtcagacatgggtcagcccacctgcatgtggcccgtgtgcccaggctgaacagtcccagaacccagggtgaagcagattacccaacacccttgatggagcacacagctgagggctgctgtcatcagtgtgggctctggagcctggccatggaagccaccccctcactgaggcttgagttatccaggcactcgctcacccctatgcccgcttcctttttcacatctgtagcttggtgtagtagagaaactcctttctaggaggttatcagtgagaagcccagaagaatataggtataaaggaacacggtaggggccgcagagatgcctcaggagttaagcgagctcactactcttccagaggaccccagtttggttccctgcacccaaccacgaagctcacaaccacctataactctagctctggggagcccacactctcttctggcctttttgggctccaacacaaacacacagacacacacacacacacacacacacgcacacggcatattctcgcacattaaaaataaaagagatacaacactctctaccacacagctaacatttaagaagttttctttaatttttttagacatcatttttattcataagaaaattaccctactcttgcctaccagagcccaagacctgtctcggagacggcaaacgcccagggctgccacacataggtaacaggtcgttacaaagctcaagtctgcaatctctcccagtaacctttcctagcaatggctttcccctcccgggtctagttccttatcctgtaacccagacttctgggttgcagaactggtcgaggcccaactccctcacatcctctctgaggagggggactttagactggcaggcagatccaggcttgtgagtacaccctgaagcgtgcagcattttttttttttactccagaaccctaactccattcccaagaaggtgaggactacttgtaagttatgcagagatccccaaggctaactcacctccagctggcttctaatccacctgattccggtattccatcacgggctgaagtaaccaaagtcaaacttctatgcaagcacgaggaaaggcttcccatcgtggactcttgcactgagaaaacgcttcccaaattaccctgctgcctccagaacccccaaatgagccttggaattgcatccggtcgccccgaggccacctaccaacctccacgcccggccgctccaactaccgtcacgccctcaccgctacctcggtgcacaccccaacgacagctgcgtcgacgacagcttcagggatggcgtccctggggtttgagttttcctcgttaaaacctcggcactttacagaaaccactcgggtcccaagtcagcagattgtaaaactcatataaaactcagcacccgagagctcttacgagagagctgggccagctccggcgtgcccacgtcaccaaacgccaccgagaagcgcgtcgggggcagctggggactctgatcgcagctggttggggggcggggggtccagctccagctggcggatgcgagagcccgggcgcccccaccgactccggacgcggagcagccgcggagcagccctctccgcgggtccccgctgaaaccctcgcgcgccctgagctccgcggcgcgcgagagccggggacccctaacttcgggccccgggacaccccgccccgccacttacggttccatctccgagcctcgggtccccggtccccgccggatcgtcccgagttcgcccggcgtcccgaagccgccgccggagccaccagggaagccaagcagccgggcgcggaaaacgcatcagagcgcgactgcgcggtcacgtgcacggaagccacggacccgcggggcggggcagtctcccgcagcactcgcgccggacacctgtcacgtgggtaggcgtcccggctaacccagatgcgaggccaccgaccacggaagggtacggaccccaaaggccttgggtccaagttcccagacactcatcatggctgctccctcttttcttcccctccgaagaagagggaagtatgcaaggcaagattagcatctctcgaaagtttactactgtgttaaggcgttaacatgtgccatgccattggcacgtctctggcaaccattaaaacgaatgaccgcgggtttctggtacatgcaacccagaagcagaggaagcatgcccagtgcagcttctcaccctctggcctgcagggcttaggctcaggtctcctgaattaagtgagcgagtgcccttcacctttgcggccttcagctatcagtggtgcaggagttgttcgcatcaatcccaatctaccatagtgaaacggacgctatatcccagtattccatcaccttcccctgttttgccactgttgatgggcctcctctttccaagatttgacagctagtatggacaacgctgtgcacatgagaattaaccaaatgattcaggaggcccttactaattgactaccagttaccagcctgcctgctttctaaaatttgagagaactgaggggggccttcgtataggatcaaagacaagaaggcagggaccagtgagagctctcaccttctgaccagggtgaccagtggctctgcttggcctaagactttccatcatataagcaatgaaagtcctacatcctggagacactccctcatcccccggagccaggcaaggctcagatcacattctgaagccctggtttttattattgttggttgcttctgtcagttaaccaggtgaactgtcttaacatttcaaaacacatctttatcttggtcctctcaaggacagaagcagagagagcagtcttcatgttgatttcatcaagaatatggaagcttgagagatgacacaggcagggaggcagaggagtacacagagcggttctgggagcttcacctcacatagctgattgtgtgggctacaggccagtgacagagaaactgccagaaacagagtccagaagcagtttcttggctccgtcctacctatcacctattcctcctgggttaaagtctacacacctgggttaaagtctacacacctgggttaaagtctacacacctgggttaaagtctacacacctgggttaaagtctacacacctgggttaaagtctacacacctggcaagtaatcttcacaggcaaacaacctgggccagtgccacaggtaccgggcagctcaggagtgacatacaagctcccctgtcagtcagcactaagggccagagtgtgtggtggcaaaggctgaaaccatgtgagttttcaccaggacaagggaggcaaagtcgaaacagggacagcatgagtctggacagagtcagatcggagatactgatcaacaggatcttgcactaagaagccaaggttgctatggagatgctaaataagacatctgggaatgactggtagtcctttggggctttcttgaggctccagcagaaggtctccatggtgacctcagtgagcgtctacctgagttcctcctgctgaacgggcaacctaagctcacgatgggacgagacccgggtgatgagacaaaggggcggaagagcaaatgagcgcaggacagtgggtcacagaatgtgctgaagtgtgatcgatcgatcgactggtcgcttggggagctttaagaaccctcaacccagttaaagcagatctgaggtgcagcttagggatggggggctttgttagcctccctccagggctcgggtgcacgtccgctaagctaccacagctcttcctgggaccagctgcatcactgagctccggttctgagactactctgtatcctggtaagaaatcctctttgtggctaaagctctgacagcaacaatcttagatgcagcagcgctggctctgcagagtggcagtgagtgacactagccatccaccccttaatgctggggaccctggcaaagctacagctcactgcagcgggaaggggcagtgttctgctctgcgattccctgcagaaggaagcaggagtttgcttctatatagacagaagcttccagtctatacagtggccgtgacctgaccctgacctaacaggatctgccctttccagaacctcagaaagtcctcccctacccccccccaaaaaaaaaacccatggagcttcaccctagactcatcactgcagtcacagatcaaaggacaaacggtggaccacacagttagcttcacttagaggctaaatccctaccctggcatcctgctgagatttggtgggaatctcaatgggcattgtttgatatgccaattgggagacaatggctaaaggggctcttggctgtccacatgtgtgcaggaagacaacagagacagacatcattgcttcctcagtcttcccaagtgctgtttggctccttcattccacagggagcagagaaaggcaggagtgcccactggctcccaccgcccccaccccccattcatagaggcagcacccacaaccaggggtctctggtggcaggagacagggagagggattgagagaggcaggcacaagcgcctgtgcctcaggcaggtagtcagtcctcagttcagtaacaaactaaaggctgctcagttagatcctaacgtcctatgaactcctgaggaagagaaggctgaggtgggtcagacctaggcacgtgatgatctatccagctacaggacccagggtcatgaagaagtcctctgctttagccttgaacacacagatagatcggggtctttctcttggtttcctggctctggactaaaccaaacaactccagaacactaaggataccataggaggaagaatagaaagttccagggccggcatggcagtgacttgggccaagcaaacccaagcagttatggtggacttctgtgagcgcacctagagtaccagtggtgggattagtgttgtgtcccttatggtgcaatgcatctgtctgtcaggatttacctttcatacctggctcatctggatcacactaaagtaatcatttaaagtcacagtcattctggatagtattcaggggtttcaggataggaggagagatgctacaaaatattttagaaagagacttggggtgcagtgatgactcagttgatacagtgagtcatcattgatacatggggacctggattcaacaccccccacccccaaacccacagtaagcggacaggcatggtgggattgtgtgacctcatcatggggaaggcagagaccagccagcctggcagaggtgctgatccccaagcagtgagagatcctggagagagagaagtgtggggaggagagagctggagagacggctcagtgggcaaggatgcctctaggcacacatgggcacttgggtttggatctcagacccatggggaaagccagacaagaaaaacatgaagctgggtgggtagggagtgggaggggcctaggaggaattggggaaagggaaaccatggttaaaatctattgtacggaaaatttatttatttattttatgtttttccagacagggtttctctgtatagccctggccaccttggaacttactctgtagaccaggctagcctcacactcaaaggtctgcctgcctctgcctcctgagagctgagattaaaggtgtgtatcacaacccagttaatttttttaattaagaaactaattttaaaaagaaagccaggcatggttgtgcaggcctctgcaacccctgcactgtgggacgtgaagatggaggattgccggagcttcctggcttccagccagctccaggctcagtgagagagtaagatgaagaatgaaagaacaggaagtcctcttctggcttctgtgtgaatgcatggtgtgcccacatgtagggcattgagctatgcaaagacagtctggtctccagtccagctgagatgttgaaccccgggacccggtggtgataattcacccacatgggacagaaggagttctctcatgtctcctggaccctggctcccgttgaagttaccgccccacctctgcccccacaggagaagcatggttagtagacacataagcaatgtcccaagcttctgaccttcaggctagactcctccccagttacctagcaacagaaaagatagcagcttactttaagaggggctgtttggcccctcctagctctctcactcctcttgctcctcttactctctctccctcttggtctctccctcttattttctagcctttcttctctctctcctttccccttctctcctcttggccatggccggtctctctctcttttctaccttctctctttccccctgcctttctacaataaagctctaaaactatagactgtctctgttcatcaaggcctgctgcacactctcacctgtgtgggaaactctccccctccgccctctctcccataaccctgaggctacagggtatcgcccggggcccccctggtttcgggggctgccccttgtccatccccttcccccgtcgagtggggtcagtggcttagatgcccacccggggccgagtgaaaagcgtctcgcagccttcctgagtcctcctgcccagagcataggaggaactctggcgggacgtgggctatcctcccttccccctctttcctctacagccccttattagttcccacacccatgtgcatgcgtgtgtgcacgaacacacattctccactacctccctacacagttcagaaattaagaacacccagcatgtgaggggaagaggaaggcagatctttgagtgtgaagccaacctggtctatatggtgattccaagccagccagggcaacatagtaagaccctatcaatcaaccaaccaactaactaatcaataaataaataacaattaaaaagagagagacaccaaggcaacctctcatgcctatgatactagcactggggaagaacaatcatgcattcaaggccagcatagactgcagagtcacagaccaggaataaataaataaataaataaataaataaataaataaggtgctcaccataaggctctcacagaaataacaaaagcttgattgaaccaccaagaggtctggtgagcatgcagcttctgctgctgtgattgcactcagcccaggctaaggacacgagctgaaggcactgtggatgtccctgcaacatggcacgagcatcgtggatacagcatgaggtaaacggaaaggtgcaatgtgagatggtgaacgttgtggtcccagaaggctcaagtcatctcaatgccacaacaaaagaaagagaaccgcagaagtcctgagatgactcagggcaggtccggaggtctaggtcagaggtacgagggtgctaaggatcctgccccataataagttacagagaacctctgcccagcctctccctttgacctggaagctgccagcaaggagataacagtcattaatgcctggttccattactatagccctccctgattcacacacacaccctggctaacgtccctctgtaacatatataactcacacacacaggagcaaccccaggtcctcttaaggatgttggatggtgctatttgcttgaaacaagtgaatgatggtccactttaattcacacagtaacaggaagagaccatgctagagagagtctgtgaaatcataccagtggacaaagaggaggaagaaccagggcacgaggagttactggaaccaagggacaagaattcgaagcacatcccatctcagagtcaaatccttcccaatacaggctaatgcctggaaggaaccccaagacttgcacttagatgctcactggggacccggctggggcagaacatgtgcagtaagttgataggaagaggcagcggtgtgggctgcccagccagcacttctgggttgatggctggggttgaggaggaatttttctctttggtgggagcccctcaagagaccccgcaagaaattgggaagggtgaagagactgggtgtcatcatttagcagaaaagagaagtctctgtgtcagaggacaacagccattctggtctttaaaagtcacagtttatatagcagatgttgagatggagttttgggctctaactggctaaaagtacgtcaatttgcgatatatttaaaggaattgaaaatgtgaagaatttgggtttggaacttcaagctttgagctaatatcttaacctgatacagaggaaagactgtgagaggatcctgttcagtaagatgagccaggttgggagaaatccagacatgttggaaaaagacagtgtgcttgttcccaaaggaagtgggaacaggagtccctgttgaaggaaaattgagacatgtagaaatcattgatggaccgggatctcagaatatgaaaggcgaaagcctgtgggcatgggctgggctagctgtggatgcattatacgccttgtcctggcatccactgacccctcgtacatgtgccgcctcaggccctctggcgcatggctcatccaggccctagaccttgctgaacagcaagatggcgtgagctgcctccatcactgagccacatgtggacataactcatacatttcaagtcacccagtaagctgatgaagttatctttctcattttgaaatgatggagacaggtagattctaaaaatcacattcttagccagtgagatggctcagcaagtaaaggcgcttgtcaccaagcctgatgactcaggatcacaaatctcacaaatgctctgactcctccaccctccccacagatagatagataataaatatgctttaaatatatatgaaaatcacagtttcctttcatgcaagaggaagaggaggggtcggaaggggggacagggagagggggaagaaacattactaatgaagaactacaatgaagtgtccccataacttgaacccatgagataagatgaacttcggatacacaactaactcagtcacataggctaaagtggagacatttttctgacttaaatagaagcaggcttctctgactttaaacttgatattgtattgatccaagttgtattgatccaaaggaggcagattgacctggaaatgtgtaaacaaaggaccagccaaggtcactgctgacagtggccactgagcgctcttaccctcccactcgtgtgtgagagtgtgtgtctgtgtgtctgtgtgtaatgagttccaggtgattctgatgtgcagggaggatcctcgtaaacaagtccccatggctttgatgtcctgtcctccaagatctgttttctcataagtctgcactggccagtaaatgcactgctgtttagacattcattcactgttctgtgctgcaaaaccacccctgccacccctgcttctgtgcagcgcctccagcaggccagcaagacggaggccaggatgcgctcctggaggaggcctcagtattgtttaagtgttgcctctagaagttgctgctctctccaagaacactggagccaacttcatcacctctgtattttacgaaaggaaaatgatagaagaaatgaagtgcaaatttgtaggggaaatggaaaattacaaatggcccagggctgagctccaaaggagcctggccatcatgctcatgctgtgaactagctgctggctggcccacatccattacctcaacaatcttccttacagaatccctgtggtttggcaatctaccttcctcccttcttcaaggatctacacctcagggaaagctccctgtgccctcagttcctagagtatgcgaatgtggccaagactaatcccatctttgcactagtgtgcccaggaaaggcaatcgtgactgactgatgcaggagtgactgatgtaggagctaacttgcttttgggttctctgctgaaatgtgaaacatgaatggagaagcatatgcctgcagatgttcaccttgatacgactctatagatgtgcagggtcaccttctgtctctccagttctgcgccctctgtgatcaccacatcctggcttctaaccctgctatcaagtcattttgtttgatatatgtgtatatgtgtggtggtttgaatatgcttggcccaggaagtggcactatcaggaagtgtggccttcttggcataggtgtgccttgttagaggaagggtgtcactgtggaggtgggcaatgaaaccctcctcctaaccacatgagagtcagtcttctcctgttggcctttagaacaagatattaaactctcagctcctcctgcaccatgcctgcctggatgctgccatgctcccatcttgatgataatggactgaacctctgaacctgtaagccagccccaattaaatgttgtccttataagagttgtcttggttatgatgtctgttcacagcagtaaaaccctaagacaatatgtatgtatgtatgtatgtatatatatatgtgtgtgtgtgtgtgtacatgtatgtatatgcatgtatatatatgtgtatgtgtatgtatatataagtgtgtgtatatatgtatgtgtgtattatgtatgtatttatatgtatgtatctgtgtatatatgtatgtattatgtatgtatgtgtatatatgtatgtgtgtattacatatgtgtgtatatgtgtattatgtatcaattatatatgtattatgtaggtatgtgtgtattctgtatgtatgtgtatatatgtacgtgtgtgtatatgtatgtatgtatgtatgtatgtgtgtatgtatattgcaactgcagtgtagagactaagggtatgactcagttggcactgttaccctatgagccatctccccagctccaaatctacttttattcaacatagagtatatccacccaggtacccaagtctaactgtatttaaagtgagagggattgcagctccattatgaaccaaacaactctggggactgaggaggtagcccagtaggtagagtgcttgcctagcatgcacggtgccctaggtttgatccctagcatcaaatacaattgagtacaggagcagtggctcacgtgaggagagttcagtgacctaatgaacacaattgggtgtgatggccagaggtggggatgggagagttgtaagttcacaaggtcttcttcagttagacagcaagttcaaagatagcctgggctacatgagactgtctcaaaataataaattaagtgggcccttacagtatcattagcccagtttgctagaccgtggtgcaggtaacaggtatgttctgtctagcttgttcaggctgaccctggaaggttcttgtcatgtgcaggtgtaaagtgctcatcaccacagaatctcacttcgtagtccatgcagagcactcctctgctccactgtagatgaaagtttggctgttccatcttgggaacattatacagtactgatatcagtacaggcctgctctgatacgaacggcttcctgtgtcttagtggactcctgtctgtgtctctagaggagacaccacactcaggaggaaaccccagctaagcttatacgcagcctttgcagaggctgccaattgtctgcagagatgacacccacttgcaccccatctgaagtatacgatgttacaagtccttgtgagcatgtctgtcttcttcgctgttgccatcggtgggaagcacactggacttaaagctattcttttttttttttttttttttgaagagattcatggaaagccagcctctcctccccatgaataagaatgagaagcaatccaaatggctactatccacccccacccccaccccccggatagcagttaattgtaaaaagaagtggtctggcctcaccttcaggctgacctatagtggtggttgtcatctctggctgggtacatctctgggggtaatcgtcacaggaaacatctttgtgacaatgacagctagtagtttcacttttctggtgtgatcccatggtggaattcagtgcttcctctaaacccagggagttcgcaaaggcttgaactttagccaaggatttcagctcccctgcttacaacctttccactttccctttcttggcaggcaataaattgtcatctctcatcggtgagatggttgtcagtcctctgaacacacggctgcagcttccacgaagggcagattttgtaactgacaggcacacagccaccgttgggagacaagtcattaacagttgtggtccttccttaccttgttagagaaaactgtcaacgtatgagattagtctctggtcctccaggggataaaaaaggaccagtgagctttagttattaatcacgcgtgaggaaacaaagatggtgagaggagaagctgctaacagtgtagtagcaagtccgcctgccagtgaggcagacccagcagctgtaactgtaaccagaacattccagctggggcgcacagggatagcccactgattcacaggctcagaggagcacctgaggatagctcagtgacctaataaaatacttccctgctacgcaagtctctgtggttctctgcaaagtgctttgccacatgagacagtttaaagtaccctgccgtccactttctctcatggcgggggacagctttaatcactgaccctttctgactgtggcgaatttgtcttcagaatctaactcaactgacaaagagtcacttgcttgccataggacaggcagccaaactgcttatccatttcccccagtagccctaatcccttcacattgctgttctaatgcaatctgtattcgctggtgtgatgggtaatgttagctgtcagcttgacagaatatagaatcacctggaagacaggcccctggacaagcctgtgggggcgggggcggtgtgttttggttgtgttgatggaggtcgggacctctgtccactgtgggcagcaccattccctagtctgtatgttcatactgtatgtctgctttaagttcttggcacttggatttcccagcaatcatgaactatacccctaaactgtgcactagagcaaacccttctcccttcagctgcctttcacagggtgtttttattatcatggctggtcttggttttatagatcaaggttcaaatcaacctgaccctgcctaagatcatgatcttatggctccaggcatgttgtcctcttcctccctcttctgtaactttcctccatgctgccccattcagtgagcatcttattcttcttaaagtgtctcctgatgagtcttgcttgctttcatgacaacatgaaattcctggcttctgtaagctccttaatttagccatgagtctttcttgctcactgacaaatcccccacatgtaaaacaggcacaggagatcctgggtagcagctgaatgtgaagataggacgacccaattgcagattaaccacctgagtgacttattctcttttctgctacctgcctggggatcttggtcttatttgctggatccttcaccaaagcaatattctcagcggacatggaacagagtggcggggagcatgtaggaaaagagatgggagattatcttatttcaacaatgcaatttgaaacatccgtgagcttctttaccttccagatctcccaggaggcttcattggtgggattatggggctcacagggtctcggcaccacatcactacatttcaagatgcttttaaaatttattattatatgtgtgtgcatgtgtgtgtatgatgtctgaatccctgggacatgtatgccacagcatgtttgtagaggtcagaggataacttttggagttggttctctcaagacagggtttctctgcgtagccctgactgtcctggaactcactctgtagaccaggctggcctcgaactcagaaatcctcctgcctctgcctccccagtgctgggattaaaggcgagcaccaccactgccctggagttggttctctccttctaccttacataggtccaaggccaactcaggccaccatgctcacagagcaagggattttactggctcagtcccctcgcttgcctacactacatctctttgtaaattggcctttccattcagtaacaactttcatggtcctgatactgcccgaggaagctgctgagcctttgagaagatttacttgtgacccaacttttggagaactgtgtaactatgagctcagcacatagcttgccactctttaccaccaactgtgtaaactgctcaacgccaggctccgaacctacagaaatctggtccaagctgtccatttcacggatgaggaagcttgagatacagctcaggtaactttcccagctcacacagctggtcagtaacataatcacccaaggtctgcacttctggacccagcagagtcctttccctacagcttaaggcactaggtattcaaggcctttgactgcaggacacatttccctaccagaaagcacagcacagggaggaagggaaaggtgcccttcagcaagcatcccaagcatccccgggctccacctccgctcctccaatgcaggtgaagggacaagagagctcaaataaacccacacccacagcttctctggactctcatatgtggccgctacatgcatcttcactgaaagagtacgagctggggcttgagaccatgtacccaggtcagagtagcccagcagaaaggcgaaggaccgcccccgttctgattagctttggtttgtgtaggggaggcagagagggggaagagaaggagataggctcctcaaatcagggtttggccaggcccagtggcaacagctaggcagcaggagtgggagaaaggggagcacgagggaggagccaagcaggaacgaaagcctggtgctcataaggctagcctatctgctcagggttctaagatggagaagaacccaggacccagatgcatggggccgccttgcaccctgaatcgcgcgcgcctcagtcagcattcctcgcccttcccgaggctcagcgttccggggctagggcgcggcggtggggacagagagctggggccccctgcgcctacctgtagtagcgatcatccttgaatggcgcgaggtcctccttgagctcgcggtacgcctcctgcagccgccggcacagctgcttgaggccactgcagagcggcggctcgaacgcagggtactccgcgtccatgcccgcgccgcgctgcgctccgccctcgcaatcgccgtcctcgccccctctccgccgccagctcccggcaccggagccttcggcacgattgggcgggaccggtcagggggaggagcagaggctgggagctggggagggggcgcgcatagaggcgccggctccacctcgccaccccaggcccgggctaccgcccgcccgtctgccagggaacccacccaggagtgggagatcaagcactagatcgccagcctcccagtgccgtcctcgctgggcctggtaccgaggagagaaattggaagagaaatgagggaaaccggcttgaggtccggcccaggggcctgttttgtaggcaatgttcaaggctgggagcgggcaaccacgttcagcaccgcggacagatcccaaggcccatttccctttttgagtacaaaacacaaaaagcctttaaaactaaatccctggggctgagagatggctcagcagttcagagcacttgttgctcttgcaaaggacctgctctcggttcctagcacccacatggtgggtcacaggtcctagtgattcaactcccttttgacagccccagtcactcatatgatgtacatacagggaaaaagttacatctatgtatgtgtatccatgtatgtatgtacatatgaatgtatgtacatatgaatgcatgtatgtgtatatatgtgtgtgtgtatatatatgtgtatatatatatatacatatatatatgtcataatattatttttaagtataatgaatgggttgtgtccaagaaaggtgccacttcctactctccttcccccaaaatactgcctgtggaaagaagtctctcatctcacaagcctagtagtgtgcacaataaaaactcacatgtgagattgcatcccaagagagtggtgtgatctcttgtaaatcaaatattaagtgcagaaacacttattccagagagtattgcattttcactgggatccgggacaggttcccatgaaagatcaatcttgggtaacctgttaaaaatagccactcatgtgtgtgtgtatccacaattgagtttaagttttagaatatgagtctgtcttggttttgtttcttttttagatttatttatttattacatgtaagtacactgtagctgtcttcagacactccagaagagggagtcagatcttattaagggtggttgtgagccaccatgtggttgctgggatttgaacttcagaccttcggaaaagcagtcggatgctcttacccactgagccatctcaccagcccttggttttgtttctattgctgtacaaaatgccttcacaaaagcaacttggggaaggaaatgtttttttagctcgaatgtccagggtgcagtccatcatttcgggtgagaaaagtggcaggagcttgagaaagatggtcacatgacatccactggcaagaaacagatgaatgaaaggacacaggcgtgttgtaatcagcactgtttctccatgcacacacctcaggaacctgggcccagggaatggcacaatccttatcagaagcgtctttgcccttagttaacagagtcaaggccctcacaggccaacttagatgagtctgttctcaggtgattgtagattgtgccaagttgacaaagtcatcactgtggccctggaacctggttactgagatctcaggtgactacaaccaccactcatgttacatagtttcaggattcccatagatgcacccattcttcttcatttttatcattggtttttatttcttccctcctaaatcttttttttttttttttttttttttggataaaaagattttattcctttcaagcacaaagaaaatcaacaggaattttaaaggtcattgatcagaaaatgaacaaaacttcttagaaaccttttcaattagccaaaacaaggtaaagataaaagttaaattctttcagcctaaatatttatccatctatatatcccactttgtgaataggcttttgattaaaagaagaaatgacatcaaactacccccaaacattttataagaggtaccaccatctagaagtgacaaaaataaattagtttcccccatgatatttaatctctaaagcataaaaagctatataatatcttatacaaattaaccagtgtttttacaaaagtaaagcagttttggactactaacagtacactgtacttgtggtgaacttgtggtgtacttgtgccacagcaggatgcctcctttcccaacctgggtcccggctggggtctgcagcagtgcggaaggggtggagtgatgtcatcctcccgacgccatgaaccccaccgagacacgagcccagcgccgtctccccggaccgcgggcaccgcccacgcgggaaagacgcggagtgtctgcagggaaccgccaacgttcaaacaaaatgatcctgactgccgaaaagtgtgttgggaaaatagaccaaaactgaaagattctgataaatgcaaatgtcttactcttccctcagaatatccttagttgacactttagaaatgtcaaaagaggaagtgttagggttttattattattgtttttgacaaattgtgtgggatttttgacaaattgtgtgtaggctcatcagcctcgggccaggtggccgtgagcagaagctgtgtcttcccagaccgggccccgccacacccggatctccgccgccaccctccctctcacggcccaacccgaggttacctcctcggaggcctggaagtcttccatctttaacgcgtctccttcgcccgccgagtagagtggact

SEQ ID NO: 163 - DNA, 8999 bp, Mus musculus
gaaataaggccactgtcttgagttcaaggaggattgcggatgatggcgcctgggatgatggcacgagcctggaatcccagcactggagaaaccagagcaagaggatctgaagtttgaggtgagcctgtgctacccagtgagagcatgtctcaaaaaatagttaaagtctagcaaataaaagtaagaggctggcaaggtattgcagtagtaaaaggcacttggtggtaaacctgattgcattagttcacatcctccataagccacccacactgtgcaaggagagaactgacttctgcaaaccacacacacacacacacacacacacacacacacacactataaatgaaaacagtaacgttttgatagtaatctgttagtattcctgggcttctgtgtgaaggtggatacaggagcccaggttccaagctatcatggaaaggctacaagaggcctgggaaactgtagataatttttgaaagacctaaaccgtgagaaagcagagtccactcagcatgcacactttctttatacggcttcacatgatattatacagagacagggtttctctgtgtagccctggctgtcctggaattcactctgtagaccaggctggcctcggactcagaattccacctgcttctgccacccaaatgctacgattaaaggtgtgtgccaccacttcccagctgtcatttagtattattttgggaacatttccccatagcttaggaaactggaaaacattatgaaacagggagtgttggcacacacttctaattcctgacttgggaagctgaggaaggaagattccaagtttcaagtccagcctattgtgaagcataggaagagcatttctcaaaaaccgaaactaaaacaaaacaacaacaaaaaatcatcaaaacattgtgattgctgtatggtattccatgagattcatatgccacaattcacatgggtgaggtttcttccaaatgttcacagtataaacaacagctcagtcaacatcatggggcacaatgtctgttgacacaggatcctttttctgggagtggtctctagaagtaaaatataaagtataatccgtttgattatcagtttgacagactggagctatgtctgagacaagcatctggggcatgcttgtgagggaggacctaggtagagatgcgaagactcaccattgcgggtgaaacagcccacaggctggggtcctgcactgcatgaaaggagagagccagcttgtagagagaataccttatgtctgtctggatgcggcaccggtcagtaataaatccgatggcctatggcttaggcaggaaataggaggtaggagatctgggaggcagaaaggattctagaatagagccagacatgggaggagtcccctgcagatgtgacaagacagatgtggcagaacgtaggttaaaacaaatgggttatcataagttatgattctagttatatggccaagtatttgaaaatatattttgggtctgagtcttatttttgggagcctgaggctgggcggaggaagggccaaacttctacaacgttgagcatcaatgcccctctccctgtctctgtctctctctgtctctgtctctctctctctttctctctccctctgatttttgactgtagtatttgaccagtagcctcatatcatcccaacccccacctccccactccacctcagcaccccaactcccccatccccacctttcctgccacaatggacttccctccaactgtgagccaatcaaagcctccttcctcaagttgctttggtcccgtgttttatctgatcaaatccctttaaatctctgcccagttagatcccagtttagcttttcccctttgacatcctcatcttgctgagtttgccttctctagtccccaacccacctcctgtcctggtgctgctcccatacagagctggatatcttgatctaacaaccaccctcagagaagggcactgtcagctcaacttgtaggctgcctaagcctataagcatcagctcagaaggtgaacctgaccaaacagacggaaccaagcaaggtaaaaagccttcagtccgtaccaggctcccggagttgactcagaagccctgcatccctcccatgggagagcatgcatctcccgcaaggatcatttttgcctactcctgtgactgcaaaggggcagagagattccccatggtgtggctgagggtcaaggttgctgagtaggtattgccagctccaagtcggcagtgcccacagggagctgatgctctccagacttctagagtcggggcgactttgcaaaactctcagagaatcaccccaaaactcctcttgtgctgtggctgctggagcccacccacccacccctaaaactcaccttcccagaaatgccactgggtttgaggctttgagccatcagatgttattttcatcgagtagggccatcctcttaatatattcagcagacatctgaccattgtgataaccctgatgggcggcatgggaggcaaattagcgaaaagatgattgattattttttttaaatgcagttttatcttcaacctttcccagcatcgtgctataccagggcaatcatttcttctcccaggtatttgccggtgtggagattgcacatctatttacggctgcctggaagccgcataattacaatatggtccaagtgcccattttctttccctgactacaaatagggatcaatcgaattttaaacgaccgctgcagggctggctcccgatcgtgacctttgtaaatgattacggctcaccactgttgctatctgcccagagaaagcgagcgggcagcgcgttctaactggcatttaatctggatgtgagccaaagacattccaggtgaaaacgggcagtgggtagtgggtgggaaagggcttgtgggctttcttcccaggcctgtggcctctgcctgtgcatcccacagcctgctctgctgtgtctcttcctgcgttctgtgagtgttttgttttgctacatcacatgtacacatgactaagctgggctgggcctttggtgaccatgaggacgaatttatcatgtccctggaagctatactgcttcatggggggaaaaattgtttggcagaaggaagtttgatgtctccaatggcagtgaagaaagccacaaccacctgcaggtactggaagaacttaggccaggactcagcctcagctcctacttaactgtccaaggtgttcctagagctaacccttttgatttggggtacaacagtgtgtttgaaaccttcaaggcccacattgctttttgagccaaatctctgagctcaggcccctcgtttcggaggtgaaaggtggtaaagtccctcccttcctcctcaaaatcactcaggctgatggcgttggtgcacacctttaaccccagaattaaggaggcagaggcaggaggatctcatctgagtttgaggccagcctggtctacataacaagttccaggatggccaggactaaatggaaagatcctgtttcaaaaaccaaccaaccaaagatcacatacatctgtttaatggccatgttctgatgatggacagagtagcacaggattgccccatcagaggcatcctgagagaaacaacacagtgaggagaggttcaagttctccatggtttcaaagactttcactccatcatggtgagggcggcatggggtgtttccggcactggagtgctgaatcttgctgttcacgtggtggtgggtggatcaggaacagagagcgaggcaagcatgagggccttcaaagacccaccctttgggctggcaagatgggtcaaccagtagtggcatttgtcaccatgcctgacaccctatgttagatctctaggaaccacactgtagatgaagaggaccgacttccacaggttgtcttctgaccccacacgtgtaccatggtatgtgtgtgtaccccttcaaaatacaaacaaatgtaatttaaacattaaatcaaagaagctaattcctagtgacccacttcctccagccaggctccacctcctaaatgtcactcagtttcgcaaacagtactgctaactggggaccagtgttcaggcgtaagctggtggggcatgtcccagttgaaaccaggtctggctcctgtttcttttgctttttggaatgtgcttgtcatgtttatgcatggcagtgagtatagttagccatctccacccatgtttgtcagcctcttcttccatatgttctaaagacgggtctgtgatagccatattttttgttgttgttgttttgaatgagtgagtttattaagcatatagcaaaccaaagtaaaagactaaatagcagatagatagatagatagatagatagatagatagatagatagatagatagatagatagatagatgataggtgggtgggtggatagacagatatgatggatggatagatagatagatagatagatagatagatagatagatagatagatagatagatagatagatagatagataggatagacagacagacagacagacaggcaggcaggcaggcaggcaggcaggtaggcaggcagacagcaccaaatcaaatactcacaacatccaacagaaactatctgggaaaactggctaaagttgccaatcaagacttctctccatggctgaatgtccagcttctctttcccactgaagacacttttaaactgtagataaacaatagcaacatctaaatatctattgaaaacagattacctcctagtagctagactccgcctcaaaaaaaaaaaatgtggatccctgtgatctctgatcacctggtctacagagtgagttccggccagccaggggtacatactgagatttcattttaaataaataataaataagtaggatagagtgtgggtgagcaagaaacctggtgccaacctctgctggcctcccaggcaacatctcctgctaatggacctcttagcaaagcctcaggatgaggtgaagggagagaacctaacactgtcagcacttgcccttgaaaaggcgagagtggaactcacctgggttctgaggggatgctgctaaaattcctgaagagacataaacaatatctaccccttctccaacagtcccaatggcaaactgagcgtgacttcaccatagttcatcccggacagccagtgagtttattgggatccttatgaggggttataggcaggagtgtgggaggccttcaagaagccacactgaatggcctccacccacatagatgacaactcccccaagtccgcagatagagccctctcccttatccatctatatactctagcccctcccctttattcttgcatctcgtttgctggggatgacagttctcggtcccttctagttggtcccagtgtgtgtgtaggtcagaggtcaatgtcagatgtcttcctggattgctgtccaccttattttttgatacagcatctctcactgaacctggagtacaccaaaccagcctaggcctagctggccaatgagctccagggatcctcctgtctctgtcccctccccacttgcacccccaagctctggctttttaatgtgagtgctgggggtccaaaaatctcaggtcctcaggcttgtagagcgggcactcaccaagtgagccatcttaccttcccatccccgcccctccagttttaatgtagaaatgctggcaggctccagtctttcaagcacagcctatttcaattacgctatatccaaggattacagtgtgaggcagccaacttaatccccaaatatcttgtcaatctggaagcatgagatatattttgtgtgctctcaggatgggctccttaatgcgtccctgggtgcagcggctgatctgagcctagagccagcattgagaactgccattccggagccctgggatgtcgccagacattccaccctcaccacatcaggagactatgagcccttccaaccggtgaggatgcccggatgcctttgtttgcgattacctttgtgttcgtgccccggagagcagagactttgctgattgcagtgtttacatgtgtacatgcaagtgttttctaagacgcttacattagtgtcatgttttgcagctgatgcagaacagcaggacttaggtgagaatctgtaatgcaaaatctaccgctcctgggaaaagaggaaacagagcgcacaaggcaagaacacttcttgcagttcacctctgccttggcgactagagtgttagtagttactccaagtgggatgatggcctgtgttcttaaagggtctcatttgctcataaagtcaccaaggagcctcagaggcaatgccttctctgcagaatcctacagatatgtacatacaggcatatatatgtacatacatatatgtatacatatccatatttatatacataaatacataataagtgcacatacatgtacatatgcatatatacacacatatatgtacacatacacattaatatacacatatacataaacacatattcatatacatatatatccatgtttatatacacatgcataaaatacatatgcataaacacaaactcatgtatatacatatacatgcatatacatataattatatacatatgtacatactcatatacacatccacatgcatgaacacatatctatatacatatatacacatatatgtatatgaatgcattcatatatatgtacatcgccatattcacatatacatacccagtcataaaaacacatatgggtaaatatatactcatatatatacttataatatacacatgtataaatatacatatgcatatgcacatactcatacatatatacgtacatatatcacacatacatataagatatatacatatagataccagtaggacccgatggcacagaactataatcctagctactaaggagctgaggcaaaggaatcacaattttcaggtaaggttaggcaacagagagagctcaaggatagcccagcaacttctcaagactccatcttaaaaccaaatttaaaaaggaaataagccagttgagaaggcagcccagtggtttggtgattgccttgtaaatgcaagagcatacatgggtctgatctccagtgcttcaaaacaaaaccggatggaaactgcaaaggtacggaagtgggaagaggagctctccatggacacatggagccttaccccatccttaactcttcccgggcacttgatcaggattctgtctgttaatgaaggctgatctgggtgccagctccttttctaagttcatctgtaaggaaaagaaagttttccaggtatcctgagaatctagaacaatccacttctgtaataaagtaatgacagtagtttatctccagcccagccaagggatgaatgccttctcacctctgcaggtgcctgatatgtgtggtactcacacagacacataaagagaagcagatctttccaaagatggcttgggtactgtttcatttcatgtgtatgtgtgtgtgtgtgtgtgtgtgtgtgtcctgcctgcatgtatgtctgtgtaccctggtaccaaaggagaccagaaaaggggcatcagagaccctggaaatggagttctcagacagttatgagccacaatgtgggtgctaggcttacctgctgaaacatctctctgtaaggggaggtgctggtactaagatctagttccctaattggttcttgatttgttaataaagaaggccaggagccatttgctgggtgaaaggtaggtacaggtgggacttctgggacccaagagaaaaacagagatgcagggaaagagaaaggggctttttttctgtcacgctttggaacgagaagaacgtagcaatcacataatatctcagggcaaccagggcctgcagctctgctgagagtgggttgccaaagatgtttggcaggggctgattggaacgggccactgagtttggggcagaaggagaaatggcagtttggtaagggcacacatttccagtgggaagtatctgcacccagcaaatgtgccacaaagggtaagctgagtgtgtcctttatgcgtggatttaagggtcttgggtggggctggtaacgtgacccttcctagagccagggtctcgggagtgggctggtggagcaggtgactcctggaacaaaggctacggtaggaaagagaagctgggtcagtgctggtggcacggatccagctaagtctggtggagcaaggctggtagtgagccacggttccaggagaagtgtgtttataaaactacacacaacagctccccagccccttgggttctgttttaaaccatttctccttgtgttagaacatctaaacatttaaaacatttccccttgggctttcagctgtagccctggctccaggcctgcccctccactccttcctctttgtggtacctcttctaacctactctcctctttcccaaagccttcggcaactttgccctccacctggcttagagactgctccagctctgcctgcagctgggaaggatttttttcctacttgaaaggttttccctcccacctttgtggcatgaagtggaaacttaagggttctttgggaagtcagttgtgttggatggtgttttgctaaagcaagcacgtgaaggaacgtttctctgaggcagacacaggagaaaggatgttctactaaagcaaaccggtgaaaggacgcacgatgaaggattctttgataacgacacacatgtattggtctgctttacgttgtgttgtgactccatagaaagagacgaaccaaaaaacttctgatggtgtgccaaggcttctttgttgcttctgtggactggggccgattggcagagtgacgtcagttgaaacggactcacgtgctgagacaagacacatggtgaggcaagacccatggaggagatgtgatgtgtggagggattataaataggactcaacagattgtgaggggggcttggtttgctggtagagctcgct

(The sequence listing continues in the following parts.)

What is claimed is:

1. A method of enhancing reprogramming of a somatic cell to a pluripotent cell in a human or mouse, comprising:
    upregulating in the somatic cell at least one long noncoding RNA (lncRNA) selected from SEQ ID NOs. 43, 272, 304, 334, 345, 395, and homologs thereof having at least 85% homology to the at least one lncRNA, the upregulating comprising adding or activating the at least one lncRNA.

2. The method of claim 1, wherein the adding or activating comprises contacting the somatic cell with the at least one synthetic lncRNA and/or a vector encoding the at least one lncRNA.

3. The method of claim 1, further comprising downregulating in the somatic cell at least one lncRNA selected from SEQ ID NOs. 361, 408, 414, 415, 418, 419, and homologs thereof having at least 85% homology to the at least one lncRNA, the downregulating comprising contacting the somatic cell with antisense oligonucleotides and/or interfering RNA (RNAi) targeting the at least one lncRNA.

4. The method of claim 3, wherein the somatic cell is human and the upregulating of the at least one lncRNA comprises upregulating lncRNAs selected from SEQ ID NOs. 334, 345, 395, and the homologs thereof having at least 85% homology to the at least one lncRNA, and the downregulating of the at least one lncRNA comprises contacting the somatic cell with antisense oligonucleotides and/or interfering RNAi targeting the at least one lncRNA selected from SEQ ID NOs. 361, 408, 414, and the homologs thereof having at least 85% homology to the at least one lncRNA.

5. The method of claim 1, further comprising expressing Oct 4, Sox2, Klf4, and c-Myc transcription factors in the somatic cell.

6. The method of claim 1, wherein the homologs have at least 90% homology.

7. A method of enhancing differentiation of a cell in a pluripotent state in a human or mouse, comprising:
    downregulating in the cell at least one long noncoding RNA (lncRNA) selected from SEQ ID NOs. 272, 304, 334, 395, and homologs thereof having at least 85% homology to the at least one lncRNA, the downregulating comprising contacting the cell with antisense oligonucleotides and/or interfering RNA (RNAi) targeting the at least one lncRNA.

8. The method of claim 7, further comprising upregulating at least one lncRNA selected from SEQ ID NOs. 361, 408, 414, 415, 418, 419, and homologs thereof having at least 85% homology to the at least one lncRNA, the upregulating comprising adding or activating the at least one lncRNA.

* * * * *